United States Patent 8,809,059 (PLANTS WITH INCREASED YIELD) - sequence listing, part 4

SEQ ID NO: 8441 - protein, 537 aa, Phaeosphaeria nodorum
MALFDNKNPGEAASPTASYRDEDFSRIDPDSGVKRGLKTRHLSMMALAGIIGPGILVGTGGALANGGPAALLIGFGFIGIVAWSITQSLGEMTTLYPTGGAFVTLSDRFVDKAFGVAVGWQYWLVWACVLANEYNVISSLMVFWSDKVPSWGYFLIFWFAFLGFQMIGVESFGEAEFWLALVKLVGLCTYFLFSIIYVSGGLIGQTEAIGFRYWNDPGAFTNGFRGVAQVFVFASTFYAGVEAVAVAATETRNPSVAVPLAIRQVIWRILFVYMGVAFFFGLTCPADADGLINGESRALKSPMTIAIQNAGWEGGVHLINAFIFITVVSAANSSIYIGSRTILFMAQERMAPRFLGKTNSRGVPYPAIIFTNLFGFISLMNLSTGGGKAYGYIINLSGVSTFIVWGAISFTHIRFRQAWAAQGRAPEQLPFRSFGYPWNSYFGLGANIFLALVQGWTTFSPFDAGTFVDAYILLPLFGIIYFGYKFIFKTRYWRAHEIDLDAGMRKDLDTKEEVLHGEPDAGGHKKKGIVRRLLSKI

SEQ ID NO: 8442 - DNA, 1725 bp, Neurospora crassa
  CDS (1)..(1725)
atgtccgacatagaaaaagggtcagcgggctcccacgacaaggagacccgcgtcgacgcggccactcttcccgcctatgaggccggcagcgtcgccgaggcgcaacaggaggacttcatgacgcgcaacggtctcaacctcgcctccttcaagccccgccggttccacacgggcgacggcaccgagatcgagcgcaccatgaagtcccgccacctgcacatgatcgccattggcggctccatcggcgccggtttctttgtcgggtccggcaaggcgctgcacaacggcgggccggcgtcgctgctgattgatttcgccatcatcggcgtcatgatgttcaacgtcgtgtacgccctgggtgagctggctgtcatgtttcctgttaccggtggcttctacacctactcgactcgctttatcgatccgtcttggggtttcgccatgggttggaactatgttttccagtgggcgattgtcttgcctctggaacttaccgtttgcgggtttacggtcgggtactggaatcaggacataagtgttgccgtctggatcaccatcttcctcgtcgccatcatcatcatcaacgtcttcggcaccctcggctacgccgaagaggaattctgggcttcggcattcaagctcggcgccaccattgtcttcctcatcatctgcctcgtcatggtcctcggcggcggtcccaaaggcagccgctacgaccactacaccggtgccgccctgtggtactcccccggcgccttcgccaacggctttagggggttctgctcctgcttcgtcactgcggcttttgccttttcgggcaccgaactcgtcggtctcgctgctgccgaggccaaaaaccccgtcaagtcccttcccggcgccatcaagcaagtcttttggcgcatcaccctcttttacatcctcggtctcttcttcgtcggcttgctcatcccctatgacgacgagaacctgttgggcgctaacccgttcatcaacgtcaacgcctccccctttgtgctggtgggcaagtacgcgaacctgacgggcttcgactcgttcatgaatgtggttattctggtgtcggtcctctcgctcggtgtctcgtgcgtctatggtggctcgcgcaccttgactgccctcgctcagcaggggtacgcgcccaagatctttacgtacgttgatcgttccaaccgcccgctgttctcggtcctgctcattattgcgtttggccccctggcgtatgtcaacttggcggctgctggtccgaccgtgttcgattggttgctttcgctttccgggctggcggcgctgttcacgtggggatcgatttgcttgagccatattcgctttcgcaaggcgtgggcgctcaagggacatagtgtggaggagatcccgttccgggctgcgggcggtgtgtggggatcgtggctggggttggtgttggttgttttggtgttgattgctcagttctacgtagccatctgcccacccggcggcggcttcaacacggtcgagggcttcttcgtgcagtacctcgccttgcccgtcgtcatcgtcttctggatcggtggattcatctggaagcgcacgagctggctccgcgttgatcagatcgatgttgacacgggccgtcgcgaacatgattgggagtcgattaatgcgtaccaagctgagttggctgctatgcctgcttggaagaggtggttccataagttgtttgtctga

SEQ ID NO: 8443 - protein, 574 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAIVLPLELTVCGFTVGYWNQDISVAVWITIFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEAKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 8444 - DNA, 1653 bp, Aspergillus oryzae
  CDS (1)..(1653)
atggctagctttgatcaagaggccaaagaaggcaatgatgctaagaatccaacgaacactcccgatgccctggccggggatgttgaggaagcaaatggcaatacacttaagagggccctcgaaggccgacacattcagatgatcgcgatgggcggagcaattggcgcaggtctgtttgtcggctcaggtgaagcgcttgcaaacggtggccctgcttctgtcctgataggttatcttattgtgggagttctgctgctgtgcacaattatgtctctcggggaactagccattatgtatccgattaatggagctttctatcaatatagcactcggttcatagatccttgttggggctttgcgatcggttgggcgtattccctcggctggcttgtcactttaccctttgaaattactgcagccagtttaacaatcgaatactggaactcggacttgaatcccgcaatattcgttagtatcttcctaattgtgctggtcataattcaagtctttggagtgcgcggttacggcgaggtggaatttgtactttccataatcaaggtgatagcatgtatagggctgatcattctggggatcattatcaataccggtggcgtccctggcagtcctcaaggatatattggtggaaaatattggcgtgatccgggcgcctttgcaaacgggttcaaagggttctgcgcggtatttgtgaatgcggcagtagcttttagtggtacagaactcgtcggtctcgcagcggcagagacaaagaatccccagaaaacccttcccacggccacgaagcaggtcctgtggcgcgtgaccatattctacattgtgaacctcctcatcgtcggtctcaacgttccacacaatagcccccagctgctcggctcaggtgacgcagcgagttccgctggagtcagcgcaaatgccagtccctttgtcctggccattcaagatgctggcatccacgtcctgccgtcaattatcaacgcagtcgtcctgatttccagtctgagtgtggccaattcttcaacattcgcctctacaagaacgctacaagccctagccgccgatggaggcgccccgtcatttttcgcctatatcgataaggccggtcgccctctggccccaatcgctctccaggtgctcttcggcttcctagcatacctccagttcgcgtcttccggtctaactatattcaactggctgctttctattgctggcgtgtcaactgtaatgatgaacctgagtatcaacatggcccacatccggtttcgtctggctctaaaggcccagaatcgcagcacggacgaaattccatggaagtccaccctgggaaccgtgggaagctctattggagcttttctttccgctattgctcttgttgcgatgttttattccgcgctttatgcaccgggtggggaccccccaagcgcattcaatttcttccagcaatatctcgctggatttatgggcctcgttctaatgatcttctggaaagtgtggaatcggcagtggtggcttggagtccccctccggcagattgatctagacactggcaggcgatttatggaaatggagcaggttactccagatgaaacgggagaaagccttccctggtggaagagagcgaaacagacaatctgctga

SEQ ID NO: 8445 - protein, 550 aa, Aspergillus oryzae
MASFDQEAKEGNDAKNPTNTPDALAGDVEEANGNTLKRALEGRHIQMIAMGGAIGAGLFVGSGEALANGGPASVLIGYLIVGVLLLCTIMSLGELAIMYPINGAFYQYSTRFIDPCWGFAIGWAYSLGWLVTLPFEITAASLTIEYWNSDLNPAIFVSIFLIVLVIIQVFGVRGYGEVEFVLSIIKVIACIGLIILGIIINTGGVPGSPQGYIGGKYWRDPGAFANGFKGFCAVFVNAAVAFSGTELVGLAAAETKNPQKTLPTATKQVLWRVTIFYIVNLLIVGLNVPHNSPQLLGSGDAASSAGVSANASPFVLAIQDAGIHVLPSIINAVVLISSLSVANSSTFASTRTLQALAADGGAPSFFAYIDKAGRPLAPIALQVLFGFLAYLQFASSGLTIFNWLLSIAGVSTVMMNLSINMAHIRFRLALKAQNRSTDEIPWKSTLGTVGSSIGAFLSAIALVAMFYSALYAPGGDPPSAFNFFQQYLAGFMGLVLMIFWKVWNRQWWLGVPLRQIDLDTGRRFMEMEQVTPDETGESLPWWKRAKQTIC

SEQ ID NO: 8446 - DNA, 1629 bp, Aspergillus oryzae
  CDS (1)..(1629)
atgagcgaatccatcatccctccgcgcaattcgtcagggagtatgaaaaagaccatccagcccactgccgattgggcggttgacatcgatcatggcgcggaaaccgatctccagcggacgctatccacccgccacatcaccatgattgccctagggtcatcgattggcatgggattatggctaggcagtggaacatccctagcaaatggtggtccagcggccatctttatcggttatctcttgagcggtaccatgatctggtcggtcagccattccatcggcgaaatggccgtaatgtatcctctgccttcggcattcattcaatggacctcgatctttgttgacccggcagccgggtttgccttaggatgggcatactggttctcatactggatcaccatcgccaacgagttacaaggtgtcgtgactgttctcaatttctggaccgacaaggtgcccacggcagcctggatcactatcttctgggtcgtgattattcttatcaacgtgtgggctgtcaagttctttggagaagtggaagttgtttcatcttcgatcaaattcgggtggattatcattgttattatctccctgattgtcgtatctgcaggaggcgcccctgctgagggccctatcggctttcggtattggaactcgtacgccttcacgaacggatttaaaggcttcctcagtgtcatgcccacttgtatctttgccatgtctggatccgaaaactgcgctctggttgcagccgaaacctccaaccccagaagagctgtccccaaggctgtgggatcgatctggctgcgtctttccttattttatatcctaggctccctcatgatcactattacggttgacccaaaggacaacaatctcttcggcgcttcgggagtcaacgcctcgccatttgtcattgcctatcgcaacgcgggtctcgagcctttggcccatataatgaacgccgtagttttcatctcggtcgtgtccacgggaagtatctctggatatgccgggtcccgtgctcttatggggctggcccatgtgaagatggcgcccaagatcttcggaaaagcagataaggtcggacgtcccctagccggactcttcattactcttctcatcggaggtggcctgggctacctcaatgtgaacaacagcggcgaggaagtcttcacatggttctccaatctcacgtctctgttcactctgttcggctgggggatgatctgtctatcgcacctccggatgcgttatgcctggaaagtccagggccgcgatgtatccgacctgccttggaaaagctggacgttcccttacgcggccatctggggactgggatggtgtattttgctcattattgcggagttctatctgagtgtctggccgcttggaggacagaccacggcgaagaacttctttgccaactatgtcagtgttgttgctatcgtcgtcatttatattggggccaagatctactatcgtgggccgttctgggtggattcccggacaatcgatctcgacagtctccggcggttctatgtcaagactggcgatgaagaatccgtggaggacaaaccgggcgcgatggggcatgtctccaaagcggttcgatttttgttcaattaa

SEQ ID NO: 8447 - protein, 542 aa, Aspergillus oryzae
MSESIIPPRNSSGSMKKTIQPTADWAVDIDHGAETDLQRTLSTRHITMIALGSSIGMGLWLGSGTSLANGGPAAIFIGYLLSGTMIWSVSHSIGEMAVMYPLPSAFIQWTSIFVDPAAGFALGWAYWFSYWITIANELQGVVTVLNFWTDKVPTAAWITIFWVVIILINVWAVKFFGEVEVVSSSIKFGWIIIVIISLIVVSAGGAPAEGPIGFRYWNSYAFTNGFKGFLSVMPTCIFAMSGSENCALVAAETSNPRRAVPKAVGSIWLRLSLFYILGSLMITITVDPKDNNLFGASGVNASPFVIAYRNAGLEPLAHIMNAVVFISVVSTGSISGYAGSRALMGLAHVKMAPKIFGKADKVGRPLAGLFITLLIGGGLGYLNVNNSGEEVFTWFSNLTSLFTLFGWGMICLSHLRMRYAWKVQGRDVSDLPWKSWTFPYAAIWGLGWCILLIIAEFYLSVWPLGGQTTAKNFFANYVSVVAIVVIYIGAKIYYRGPFWVDSRTIDLDSLRRFYVKTGDEESVEDKPGAMGHVSKAVRFLFN

SEQ ID NO: 8448 - DNA, 1593 bp, Aspergillus oryzae
  CDS (1)..(1593)
atgggcatatatatggaaaatgcgacagacaaggcacaaggggaaccagttgaccatggagcagatacccaactccatcgcaccctcggcacccgccatttgactatggttgccctcgggtcagcaattggcatggggatgtggctaggaagtggcacgtccttggccaacgggggccccgccagtcttttcattggatttcttataagcagctcaattatctggtctgtctgtcaatccattggtgaaatggcggttatatatcctcttccttcggcatttgtgcaatgggctacaatcttcatcagcccagctgctggtttcgctcttgggtggggatattggttttcctactggatcacaattgccaatgaacttcagggtgttgtaactgttctcaactattggacagacgaggtgccaaaggccgcatggatatctattttttgggctgttatcatcttgatcaacatctgggctgtgaggttcttcgcagaggtggaagtagtcgcatcaaccatcaaatttggctggatgttcatttgtgtcattgcattaattgtggttactgctggaggctcgccccagggaggccctattggattccgttattggaatgcgcagcctgttaacaacgggttcaagggctttatcagcgtcattccgacctgtatatttgcaatggctggctcggagaatgctgcgttggtggctactgaagttgctaacccgcgagaatcggtaccgaaagctatcaaatccgtctggttccgtctcggccttttctatatcttgggaagccttatgattacattaactgtggacccgaatgatcctagtttatttggtggttccgggagtaacgcctcgccgttcgtgattgctttcaagaatgccgggataccgatactagcccatatcacgaatgctgtgatttttatttccgtgatatccactggtagtatatcggggtatggtggctctcgaatcctgatggggctggcacatgtcaagatgaatcacaaggatgtcctccaggtattcggtaaagcagacagtgtaggtcgaccatgggctggctatattgccaccatcgggattggaggtgctctcgcttacctcaacgtgacacatactggagcacaagttttcacatggctttccaacctagtctccctacttacactatttggatggtctatgatatgtctttcccacctacggtttagatatacctggacgctgcaaggccgtaatgaggcgcaccttccttggagatcgtgggcatacccgtatgccgcatggtggggcttaatctggtgtcttgttgtctttgggattcagttttacttgagcatttggccgcttcacgagaagacgtccgcgaagaatttctttgccaattacatcagtgtaatagctgttgctatcatctgggtttgtgctcaggtttggtatagctgtccactttgggctgatgcgcgcaatatcgacttggatatgtgtcggcgcttctatgctgatactgtagatgaggagtctaccccagtggccaagtctttggcaaggaagctgcgtgttgtttgcaagtaa

SEQ ID NO: 8449 - protein, 530 aa, Aspergillus oryzae
MGIYMENATDKAQGEPVDHGADTQLHRTLGTRHLTMVALGSAIGMGMWLGSGTSLANGGPASLFIGFLISSSIIWSVCQSIGEMAVIYPLPSAFVQWATIFISPAAGFALGWGYWFSYWITIANELQGVVTVLNYWTDEVPKAAWISIFWAVIILINIWAVRFFAEVEVVASTIKFGWMFICVIALIVVTAGGSPQGGPIGFRYWNAQPVNNGFKGFISVIPTCIFAMAGSENAALVATEVANPRESVPKAIKSVWFRLGLFYILGSLMITLTVDPNDPSLFGGSGSNASPFVIAFKNAGIPILAHITNAVIFISVISTGSISGYGGSRILMGLAHVKMNHKDVLQVFGKADSVGRPWAGYIATIGIGGALAYLNVTHTGAQVFTWLSNLVSLLTLFGWSMICLSHLRFRYTWTLQGRNEAHLPWRSWAYPYAAWWGLIWCLVVFGIQFYLSIWPLHEKTSAKNFFANYISVIAVAIIWVCAQVWYSCPLWADARNIDLDMCRRFYADTVDEESTPVAKSLARKLRVVCK

SEQ ID NO: 8450 - DNA, 1695 bp, Aspergillus oryzae
  CDS (1)..(1695)
atggccatcgacgaggtcacccctgcgccgcaggtgacggaaaccgctgctggaaacgacggtgacaaaattaccatcaagacgggcgcaaaccctctgaagaagtttggcaagaagaaagatggcaacggaaatgaagatgtggagaaggatggaattggaggggatacgccgccgcaggagttacagcgcaggctgaagagcagacatttgcagatgattgctatcggtggtacaattggaacgggtctgttcatcagtagtggaacggccatcgcacactccggtccggcaggtgccctcatcgcctatatcttcgttgggactattgtgttctcggtcatgtcctcactaggtgaggtcgcaacgtatcttccgatctccggttctttcacctcctacaccgcacgactcgtcgatcccagtctgggttgcgcgatgggttggatttattggtttaattgggcttcgacatacgcggtggaactgactgccaccggtctgatcgttcagtattgggacgataaactgtcggtagccatctttatcgccatcttctgggtcgtaatcacactgctcaatttccttccggttggattctatggagaaatcgagttctggttttcgatgatcaaagtgctcacggtcctgggattcatgattttcgctatctgcattgacgctggtgttggaaagcagggttaccttggattccacacgtggaaggaacccggagcatttgctccctatctgatcgacgcgtcaaatccagtttccaagttcgtcggtttctgggccgtgcttgtgcaggctggtttctcctatcaaggtaccgagctggttggtgtcgcggctggtgaaacagagaatcccgagaagaccgtcccctcggccatccgcaagaccttcatccgtattcttatcttcttcgtcctgaccatcttcttcatgggcttgctggtcccctacgacaaccccaacctgatcaccgactccagcgacgcctctgcctcgcctatggtcatcgccgcgaagctcgccggcgtgaaggtccttcccagtctgatcaacgccgtcctcctgactgtcgtcctctcggctgctaactccaacgtctacagtggcagtcgtgtgctcctcggtctggcccaggagaagttcgcgcccccgatcttcggctgggtcactcaccgcggtgtaccctatatcagcgttgccttcacggccgccttcggtcttctcgggttcatgaacgtctccgagtccggtggaaaggtcttcaactggctggttaatatctccagtgtggctggattcatctgctggacgtccatcagtctgagtcacttggctttcatgcgtgccctcaaggcgcgcgacatctctcgtgatactttgccctacaaggccgccctccagccctatctgacctggtacggccttttcttcagtgtcctgatcatcctgacccaaggattcactgcctggatccccaccttcaacgtctccgatttctttgtcgcgtacatctgtgtgatcatcttcgtggtcctgtacctcggccacaagatcctctaccgtacccacttcgtgcacccgctagaggcagacttgcaatcgggccgcctccagaattactcctgggaaacggccagaccgaagacgtggcaggagagacttcgcgagagtctataa

SEQ ID NO: 8451 - protein, 564 aa, Aspergillus oryzae
MAIDEVTPAPQVTETAAGNDGDKITIKTGANPLKKFGKKKDGNGNEDVEKDGIGGDTPPQELQRRLKSRHLQMIAIGGTIGTGLFISSGTAIAHSGPAGALIAYIFVGTIVFSVMSSLGEVATYLPISGSFTSYTARLVDPSLGCAMGWIYWFNWASTYAVELTATGLIVQYWDDKLSVAIFIAIFWVVITLLNFLPVGFYGEIEFWFSMIKVLTVLGFMIFAICIDAGVGKQGYLGFHTWKEPGAFAPYLIDASNPVSKFVGFWAVLVQAGFSYQGTELVGVAAGETENPEKTVPSAIRKTFIRILIFFVLTIFFMGLLVPYDNPNLITDSSDASASPMVIAAKLAGVKVLPSLINAVLLTVVLSAANSNVYSGSRVLLGLAQEKFAPPIFGWVTHRGVPYISVAFTAAFGLLGFMNVSESGGKVFNWLVNISSVAGFICWTSISLSHLAFMRALKARDISRDTLPYKAALQPYLTWYGLFFSVLIILTQGFTAWIPTFNVSDFFVAYICVIIFVVLYLGHKILYRTHFVHPLEADLQSGRLQNYSWETARPKTWQERLRESL

SEQ ID NO: 8452 - DNA, 1695 bp, Aspergillus oryzae
  CDS (1)..(1695)
atgggcttcctcggagaaaagaacgatggcatctcgccagagatgaatagagagttgtcccgcgacatcaccaaagcagaggagggtatcgtcgcggaagagcaccatgtcgacctccaccgggacctcaaggcccgtcatattactatgattgctatcggaggtgctatcggtacaggtcttattattggaacgggagaagctcttgcgaaggctggccctgcagcaatcctaatttcctattccgttgtcggtcttgtcgtctatactgtcatgtgcggcctgggagaaatggccgcctggctgcccttgtcttctggttttactggctacgctgttcgattctgtgacccggctcttggatttgctctgggatggacatactggtttaaatatattattctcacgccgaatcaactaacagctggcgcgatggttatacaatattggataaagacagacaaagttaacgcaggcgtttggattacaatattccttgtgatcattgtctgcattaactacttcggtgtcaggtttttcggtgaattcgagttttggctgtcgtccttcaaggtgatagtcatcctcggtatcatcttgctctctttcattctgatgctgggaggtggacccgatcacgaccgcaaaggattccgttactggaagagcccgggagccttcaatacatatatcgctgatggagatgccggacgctttttcgccttctggtccactatggtttcggcaacgttcgcgtacctgggtacggagctgatcggggtaactgtcggcgaggctcagaacccccgcaaaactattccccgcgcgatcaagcttaccttctatcgaattgtcgtcttctatgtgaccagcgtcttgctcgtcggtacccttgtcccctacaactcagacgagcttgtctttgccacgaagcagtctagctctgctgctgcatcccccttcgtggtagcagtggtgcttgccggcatcccggttcttccccacatcctgaatgcatgcatcttgttgttcgtcttctccgcatccaactctgatttgtatatcgcgacccgaaccatttacggtctcgcccgggaaggcaaagcacccaagttcctagcgcggacggacaagcgtggtgtcccggtctttgccttgatcctgtgttccctgattgcctgcctggcctacatgaacgtctccagcgactcgaagaccgtcttcggctacttcgtcgaccttgtgaccatcttcggtctcctggcctggatctccctgctggtcacacacatccacttcatcaatgcccgcaaggcccagaatgtccccgagcacgagttagcctacaagtctcccttcggtaagacgggcgcttacatcgccctcgcattctgcatcctcatcgccctaacgaagagttacgacgtcttcacccacaacccgaagtggggcaacttcaactacaagaaattcattactgcctacctaggcatccccctctacctgattctgctctttggctacaaattcgtcactggcaccaagggcgtgaagcccgaggaagccgatctctggacgggcagggacgtcatcgatcgtgaggagcaggagtatttggcccgcaaagctgttatggatgaacagcggggcaccggaagctggttctataggacttttgtgtcctggctcttttaa

SEQ ID NO: 8453 - protein, 564 aa, Aspergillus oryzae
MGFLGEKNDGISPEMNRELSRDITKAEEGIVAEEHHVDLHRDLKARHITMIAIGGAIGTGLIIGTGEALAKAGPAAILISYSVVGLVVYTVMCGLGEMAAWLPLSSGFTGYAVRFCDPALGFALGWTYWFKYIILTPNQLTAGAMVIQYWIKTDKVNAGVWITIFLVIIVCINYFGVRFFGEFEFWLSSFKVIVILGIILLSFILMLGGGPDHDRKGFRYWKSPGAFNTYIADGDAGRFFAFWSTMVSATFAYLGTELIGVTVGEAQNPRKTIPRAIKLTFYRIVVFYVTSVLLVGTLVPYNSDELVFATKQSSSAAASPFVVAVVLAGIPVLPHILNACILLFVFSASNSDLYIATRTIYGLAREGKAPKFLARTDKRGVPVFALILCSLIACLAYMNVSSDSKTVFGYFVDLVTIFGLLAWISLLVTHIHFINARKAQNVPEHELAYKSPFGKTGAYIALAFCILIALTKSYDVFTHNPKWGNFNYKKFITAYLGIPLYLILLFGYKFVTGTKGVKPEEADLWTGRDVIDREEQEYLARKAVMDEQRGTGSWFYRTFVSWLF

SEQ ID NO: 8454 - DNA, 1605 bp, Aspergillus oryzae
  CDS (1)..(1605)
atgtctatcaaatccggaaaagatgatactatcatgtatcaggctcggtccgacctggacgaggaggaccccggcagccaggcagggtccatcgaccccctggctgctccgctgaagagaagattgaaatcgcgacatttgcaaatgatcgcaattggcgggattatcgggccgggattgttggtcggttcgggaaatgcactgaacaagggcggcccggcgggatgtttgatcagcttttctcttgtcgggcttattgtgttttttgtgatgcaatcgctgggcgaactggctactgcaatccccgtttctggatcgttcaccgagtatgcgcaacgattcgtggacgatgcgctggctttcgggctgggatgggcgtactggtatctatgggtgacgattctggcgagtgaatataatgcgatttcgcttgtcatcggtttctggacggatgctgtgccccagtggggttggatcttgatcttttgggtcctgttcctagggctgtccaatctgggtgttctagcatatggtgaaatggagttttggttgtcgcttatcaaagtgttggcgctgctcgctttcttcatcctagccatctgcatcagcacgggcggcgtcggacctggtcccatcggattcaaatattaccatgatccgggcgcatttgccgattccatcaacggtgtcgcaagaacattcgtcgttgccggcacgctttacgcaggcacagagatggttggagtgacagctggagaatcagcaaacccgcaaaaggccgtcccaaccgccatcaagcaggtcttctggcgtatcctgatcttctacatcggaaccttcttcttcctgggaatcctactcccctacaaccaccccaaacttctcagctccacttccaccgccgccagctccccattaaccatcgcgctcaccgacgcgggcatcctccccgccgcgcatctaatcaacgccctaatcgtaatcagcgtcatctccgccggcaacggctccttatacgtcgcatcccgaacaatgctcttcatggcccgcaacggcaaagcaccacgcttcatcgaccgcaccaattcccggggcgtaccctgggtcgccctaatcttctccaacatcttcacctgcatcgtattcctaaccctctcctcaagcgcaggccgaatctactccgccctaatcaccttagcaggagtggcaaccttcgtcgtctgggccgtgatctgcatcgcacacatccgcttccgcaaagcgatggtcgtacaaggcgacgatccatcccgacttcccttcagagctgcgctctatccctacgggacgtatttcgcgctgggcgcgaccatcttcctggttttctttcaggggtatacggccttcttgaacccgtttagtgtggatgatttcattattaattatatcttgttgccggtttttgtcatgttggttgtggggtataagatctggaataagacgaagattgttaaactggaggagatggatatctggacggggaggagagttgctgtgattgatgagacggaaacgggtaaagagcacggttggttggctaagttgaaggatataattattggttaa

SEQ ID NO: 8455 - protein, 534 aa, Aspergillus oryzae
MSIKSGKDDTIMYQARSDLDEEDPGSQAGSIDPLAAPLKRRLKSRHLQMIAIGGIIGPGLLVGSGNALNKGGPAGCLISFSLVGLIVFFVMQSLGELATAIPVSGSFTEYAQRFVDDALAFGLGWAYWYLWVTILASEYNAISLVIGFWTDAVPQWGWILIFWVLFLGLSNLGVLAYGEMEFWLSLIKVLALLAFFILAICISTGGVGPGPIGFKYYHDPGAFADSINGVARTFVVAGTLYAGTEMVGVTAGESANPQKAVPTAIKQVFWRILIFYIGTFFFLGILLPYNHPKLLSSTSTAASSPLTIALTDAGILPAAHLINALIVISVISAGNGSLYVASRTMLFMARNGKAPRFIDRTNSRGVPWVALIFSNIFTCIVFLTLSSSAGRIYSALITLAGVATFVVWAVICIAHIRFRKAMVVQGDDPSRLPFRAALYPYGTYFALGATIFLVFFQGYTAFLNPFSVDDFIINYILLPVFVMLVVGYKIWNKTKIVKLEEMDIWTGRRVAVIDETETGKEHGWLAKLKDIIIG

SEQ ID NO: 8456 - DNA, 1635 bp, Aspergillus oryzae
  CDS (1)..(1635)
atgcttccaccaaataaaagtgatcccgagatcgagagagtcgatcatgttgaaaaacaagatgcggacccaaagcccactctggaacagaagaatgtcggaaccttgcaacgtcgcctgaaatcgcgccatgtacaatttctagccctctctggggctattgggacaggcctttttgtcggcacgggacaagtgctgtcgctgtcaggaccactgtcgatgaccctggcgtttgccattagcggcttggatctctatgccgtgattaatagcatgggagagatggcgacttggctgcctctaccaggtgctgttcctgtctacgcagcgagattcgtggatgaagccttgggctttgcacttgggtggaactattggtatcagtttgccattggcgtgcccattgaaatcagcgcggcggcgatggccattgaatactggcctaataccgtgtcgcctgcggtctggatcacgattcttttcgtacctatgatcgtggttaatagcctgccagtccgaacttacggcgaggtagagttcgtcctgggcgcgatcaagctgacgacgattgtaggcttgatgttactcatgttgatcatcactctcggcggcgcacccacccacgatcggatcggatttcggtactggaaacatcccatggaggagtatcttaaaaccggtgcgctgggacggttcctcgccttcctcaaggtgtttgtccaagcgatcttcagctatggtggtagcgagatcgtcgtggtggccgcgggggaaacggagaatccgcgacgaaatatccccaaggctgtgcgtcgcgtgttctggcgcatcacgatattctacgttggcagtgtctttctcgttggaatgtgtgtctctgcgcgcgacaaccgcttattgaatgccatcaaagccggggcgaaggatgcaggagccagccctttcgtgatcgcgattcaaaacggtgggattcgagcactgccctccatcatcaatgcggtgattctgtcctcagctgtgtcggccggcaattcctttttttatgcatcgacgcgggtgctttactcgacggctctcgatggcaaggcaccgcgctttcttcgatatgagaaattcggcgttccgtatgcctgtgtggcgatcaccacagcgctgagtctcctcgtgtatctcaatgtgtcatcgagctccgccgaggtcttcttttggatcagtaacctgagttccgtcagtacgttggttgtgtggactgccattgggattacttacctccgatttcaccaggcgttgaagtatcatggtattcctcggtcaagccttccattcaaatcgccattccaaccgtatttagcatggtttgccgttatattttctgctatcatggctcttttgaacggattcgacgccttcttccccggccactttagtgcaaaaaccttcattccaccctacatcgccatccccatctttggaaccttgtatctcggatacaagttcgtcaaaggcacctcaattatcaaaatagaagaaatcgatctctggtcaggaaaagaggaagccgaccgtctggaagctatctgggagcagccgaaaccacgcaatttcctagaaagaatctggttctggatcgcatga

SEQ ID NO: 8457 - protein, 544 aa, Aspergillus oryzae
MLPPNKSDPEIERVDHVEKQDADPKPTLEQKNVGTLQRRLKSRHVQFLALSGAIGTGLFVGTGQVLSLSGPLSMTLAFAISGLDLYAVINSMGEMATWLPLPGAVPVYAARFVDEALGFALGWNYWYQFAIGVPIEISAAAMAIEYWPNTVSPAVWITILFVPMIVVNSLPVRTYGEVEFVLGAIKLTTIVGLMLLMLIITLGGAPTHDRIGFRYWKHPMEEYLKTGALGRFLAFLKVFVQAIFSYGGSEIVVVAAGETENPRRNIPKAVRRVFWRITIFYVGSVFLVGMCVSARDNRLLNAIKAGAKDAGASPFVIAIQNGGIRALPSIINAVILSSAVSAGNSFFYASTRVLYSTALDGKAPRFLRYEKFGVPYACVAITTALSLLVYLNVSSSSAEVFFWISNLSSVSTLVVWTAIGITYLRFHQALKYHGIPRSSLPFKSPFQPYLAWFAVIFSAIMALLNGFDAFFPGHFSAKTFIPPYIAIPIFGTLYLGYKFVKGTSIIKIEEIDLWSGKEEADRLEAIWEQPKPRNFLERIWFWIA

SEQ ID NO: 8458 - DNA, 1632 bp, Aspergillus oryzae
  CDS (1)..(1632)
atggagaagtccactttggcggaggacgccatccagccaacaggctactacaacgagtatgatgcgcctcccaaggacgaactccagctcaacgtaggtggtcgtggagcgacgcagcgacgcctgcggaactaccatgttaccatgattggtttttgcagtgggattggcaccggtctgtttgtgggaacaggcgccgcctatgccaaggccggtccggctggcttgctgctggcatatatcgtcgtgggcttggtgctatggtgcgtgatgcagagcatcggcgagctggccaccctgctacccacagccggatccttccctcattgggccactcgcttcatcgatccggctgtcgggttctcactagccatctcatatggatactgctataccattgccatcgcctcggaggtctccgctgctgctgttatcgtctcctattggaccgacctgacaccggccgtggtcatcaccgtgggtctagtactgatcctggccagcaatctgatgagtgtgcgtttctatggggaaacagaagtctttgggggtgcggtcaaggtcctttgcttcctcggcttagtgattgtatcgattgtgatcacggcgggtggagcgaataacgatagcatcggtttccgctattggaacgatcctggaccgtggacgaactataacggtatcaccggtcccacgggacacttcctgggctttctgtcgtcctttgtcaacgcctcatttagcttcattggtgtcgaaaccgttgttatcaccgccgccgagtcagtcaacccccaccatgccatcccgaaggcggctcgccgtgtgacataccgtatcgccttcttctatatcctcggtgccctcctgattggaatcattgtcgatccacgtaacccagctctcgtctcgggctctgataacgcgaacagctcaccattcgtgatcgccatcaaggaggccggcatcaatgccttgccgtcgattgtcaatgcatgcattctggttgcggcatggtccgccggtaattcgtactgctgggtgggctctcgcatgattgtggccatgacaacagaccaccagttaccgcaagtctttggccgcgtcaccaagaaaggtgtgccctacgttgccgtcattacggcttggctgtttgggccattggcgtacctgagtctcggctctggcggtgcggcacaggcatttacctggcttctgaatctcagcacagtcgctggtctgatcgcatgggcaacgctctccttctgctacattcgtttccactctgcgatgaaagcgcagggtgtctctcgtgatacccttccgtggaaggcgccgctgcaaccctatgctgcctgggtcggattcattggctcgaccatcatcgttctagtcgcgggatttcccgtcttcttaaagggtaattggtcgtcgtcggactttgtggcatcgtacatcggcattcccatcttcattgtgccgatcattggatggaagctcttcaaacgtactaagtttgtccgatcggctgagatagatttgtggtcgggccgtctgcaagaaggggaaatcctggtgcaacaacgggttcctcggaacctttgggagcgctttgtcgactggcttgtttga

SEQ ID NO: 8459 - protein, 543 aa, Aspergillus oryzae
MEKSTLAEDAIQPTGYYNEYDAPPKDELQLNVGGRGATQRRLRNYHVTMIGFCSGIGTGLFVGTGAAYAKAGPAGLLLAYIVVGLVLWCVMQSIGELATLLPTAGSFPHWATRFIDPAVGFSLAISYGYCYTIAIASEVSAAAVIVSYWTDLTPAVVITVGLVLILASNLMSVRFYGETEVFGGAVKVLCFLGLVIVSIVITAGGANNDSIGFRYWNDPGPWTNYNGITGPTGHFLGFLSSFVNASFSFIGVETVVITAAESVNPHHAIPKAARRVTYRIAFFYILGALLIGIIVDPRNPALVSGSDNANSSPFVIAIKEAGINALPSIVNACILVAAWSAGNSYCWVGSRMIVAMTTDHQLPQVFGRVTKKGVPYVAVITAWLFGPLAYLSLGSGGAAQAFTWLLNLSTVAGLIAWATLSFCYIRFHSAMKAQGVSRDTLPWKAPLQPYAAWVGFIGSTIIVLVAGFPVFLKGNWSSSDFVASYIGIPIFIVPIIGWKLFKRTKFVRSAEIDLWSGRLQEGEILVQQRVPRNLWERFVDWLV

SEQ ID NO: 8460 - DNA, 1692 bp, Aspergillus oryzae
  CDS (1)..(1692)
atggcctttgaggacgggtttaacgtcacgccaaagacagtgggaaaagaagcaatggccaacgatgaggcctttcaggtcaatgctcccactccatcgtccgatttgaaggacgtggactgcgagaagcatggcgctactcgcgagtcgaacccagtaccggatctaaagcgccagctcaaaagccgacatctgcaaatgattgccattgaattaggtggtacaattggtacaggtcttttcatcagtagtggcaccgccatcggtacagcagggccggtaggcgctttgattgcatatctcttcgtcggctctatcgtgtactccgtcatgcaggccctgggtgaaatagcaagttatctgccaatccaaggagcgttcacgtcctacgcagctcgattgatcgaccccagtcttggttttgccatgggttggatctattggttttcctgggctagtacctttgcgctagagttaactgcgacagggttgattatacagttttgggacaaggatatcaacatcgccattttcatcgcagtgttctgggtcgttattactcttttcaacttcctacctgttagcttttacggtgagctggagttctggttcgctagtatcaaggtgatcacagttgttgggtttatgatctttgcaatttgtattgatgcgggggccggcgataaaggatacttgggatttacttattggactaacccaggtccatttgcagcttacgccggtgtttctccagactcaacagccaaattcgtgggcttttgggctgtgcttattcaggcgggtttctcataccagggaacagagttggttggtattgcagcaggtgaaactgaaaatccccgcaaaactattccttctgcgatccgcaagacgttctaccgcattctgttcttcttcgtattgactatcttcttcatcggcctgctggtgccctataccaatgaagaccttgttaaggacggaaacgatgcaaactcttcaccgttcgtcattgcggccagacttgcgggtgtcaaggtcctgcctcatataatcaacgccgtcctgttaactgtcgtgctttccgccgccaattccaacgtctacagtggtagccgtatcctaatcggcttggctcaagaagggcttgccccgcgctggttcaagaaaacgtcgaaaaagggcgtgccctactacggtgtcatgttcactgcggcgtttggcttgctcggtttcatgaatgtgtctaatgctggtagtacagtgttcaactggcttctcaacattgcaggtgtggcaggcttcatcacttggtgttccctgaatgcctgtcatcttgcattcatgcgagctctgaaggctcgcaatatgtctcgtgaccttcttcccttcaaagcgatgtggcagccctggtattcctggtacgggctcttcttcaacatattgatcattttgactcaagggttcactgcttggatcccaacattcagtgtaacggatttctttatcgcctatatcagcttgatcctcttcgtggtactctatgtgggacataaaattttctatcggacgtcgtttgttcccccactcgaggccgacatcgacaccggtcgggtttctcttgaaaacgagtcatgggaaaccaccactactaagtggtatcaaaggatctttcgctcgtttcgaggctaa

SEQ ID NO: 8461 - protein, 563 aa, Aspergillus oryzae
MAFEDGFNVTPKTVGKEAMANDEAFQVNAPTPSSDLKDVDCEKHGATRESNPVPDLKRQLKSRHLQMIAIELGGTIGTGLFISSGTAIGTAGPVGALIAYLFVGSIVYSVMQALGEIASYLPIQGAFTSYAARLIDPSLGFAMGWIYWFSWASTFALELTATGLIIQFWDKDINIAIFIAVFWVVITLFNFLPVSFYGELEFWFASIKVITVVGFMIFAICIDAGAGDKGYLGFTYWTNPGPFAAYAGVSPDSTAKFVGFWAVLIQAGFSYQGTELVGIAAGETENPRKTIPSAIRKTFYRILFFFVLTIFFIGLLVPYTNEDLVKDGNDANSSPFVIAARLAGVKVLPHIINAVLLTVVLSAANSNVYSGSRILIGLAQEGLAPRWFKKTSKKGVPYYGVMFTAAFGLLGFMNVSNAGSTVFNWLLNIAGVAGFITWCSLNACHLAFMRALKARNMSRDLLPFKAMWQPWYSWYGLFFNILIILTQGFTAWIPTFSVTDFFIAYISLILFVVLYVGHKIFYRTSFVPPLEADIDTGRVSLENESWETTTTKWYQRIFRSFRG

SEQ ID NO: 8462 - DNA, 1662 bp, Aspergillus oryzae
  CDS (1)..(1662)
atgcctccccataccgcagaatacccctcgtttgacgaagctggtccgacatctattgcagagaaaaaaggcttccacgacaatgtgggatcgtacgatgtggagaacaccgccggccagctggaggaggtgcatgacttcaagcaaggcctccaccagcgccatattcagatgatcgcgctggctggtaccatcggaactggtcttttcctgggctctggacgagccatcgcaacggcggggcctctgggagcttttctcggatactccattattggtctcacggtgtcgagcgttgtcttcggcgttggtgaaatgggcgccctggcccctctcacaggtggtgctattcgataccttgaactcttctgcgatcctgcgttgtcatttgccattgggtggaaccatgtatactcctacgtggtatcaattccgtccgagattgtcgcagcggccgtcattgttcagttctgggtaacaatcaacaatgcaatttggataactgtgttcggtgtcgtcatgctcatcacagcactcctcttcgtccgtatctatggagagctggaattcggcttctccatgctgaagatcatgctagtcattggaatcaatatcatggccttggtgatcacatgtggaggaggtcccgaccataaagccatcggattcagttactggaagaacccagggcccttcgtccaatacctcggggttgagggctcattaggccggttcatgggattctggactacattcgacaacgctctttacgcatactccggcatcgacaacatcacagtggctgccgctgaaacacgcaatccccgccacgcgatcccccaagccgcgcgccggatcttcgttcgaatcttcctcttctacatcctaacaatcttcatggtcggcctagtcgtcccatccaacgaccccaatctcctcggctcaacaagcacagcagcccattcccccttcgtcatcgccgcccgcaacgcaggcatctccgcagtaccatccatcatcaacgccgtcgtcctcacctccgcctggtcctcaggaaattccaacatgctcggcggctcccgcatcctctacggcatggcctgcaacggccacgccccgaaattcttcaaacgaatgaaccgcttcggcgtcccttacatctccgtcgcgctatacggcctcttcgtggccctaggctacatgaccctctccgactcggcaagtacagtcttcacttggttacaagatatcgtcgccatatccacgctagtaaactgggtctgtatctgtatcgtctacctccgtttctactacggatgcaagaagcaaggcatagaccgtcataaggaactgccgtgggcagcgccattccagccctggagtacgtggttctctttgatcctgttagtcattctgttctttaccggtggttataagacgttcatgcatggacattgggatacggaaacgtttatctcgtcgtatttgaacgggccgcttattttggttatctacctgggctataagttcgtcaagaagacgaggattattccattagaggagattccgattcggccttttattgagaattatcagaataatccggagccggaaccgaagccgaagaaggggtggaggagattgaatattttgtggtcttag

SEQ ID NO: 8463 - protein, 553 aa, Aspergillus oryzae
MPPHTAEYPSFDEAGPTSIAEKKGFHDNVGSYDVENTAGQLEEVHDFKQGLHQRHIQMIALAGTIGTGLFLGSGRAIATAGPLGAFLGYSIIGLTVSSVVFGVGEMGALAPLTGGAIRYLELFCDPALSFAIGWNHVYSYVVSIPSEIVAAAVIVQFWVTINNAIWITVFGVVMLITALLFVRIYGELEFGFSMLKIMLVIGINIMALVITCGGGPDHKAIGFSYWKNPGPFVQYLGVEGSLGRFMGFWTTFDNALYAYSGIDNITVAAAETRNPRHAIPQAARRIFVRIFLFYILTIFMVGLVVPSNDPNLLGSTSTAAHSPFVIAARNAGISAVPSIINAVVLTSAWSSGNSNMLGGSRILYGMACNGHAPKFFKRMNRFGVPYISVALYGLFVALGYMTLSDSASTVFTWLQDIVAISTLVNWVCICIVYLRFYYGCKKQGIDRHKELPWAAPFQPWSTWFSLILLVILFFTGGYKTFMHGHWDTETFISSYLNGPLILVIYLGYKFVKKTRIIPLEEIPIRPFIENYQNNPEPEPKPKKGWRRLNILWS

SEQ ID NO: 8464 - DNA, 1770 bp, Aspergillus oryzae
  CDS (1)..(1770)
atggagaaggacgaaatcgaggccaaggccgagccccgaggagcggccttcgagtccccgccacctctgtacggagatagcgagccaacacaggcaggtcttggtcgcagaatatgggacagtttcaaaagggacccgaatgcccatgtcacgggcggccatggttcctccggtgcagatggaaagtcctttgatatcgaaaacgccgcgcagaagacggctagttcacctttacaacgtagtctcaagggccgtcatctgcagatgattgccatcggtggttctatcggtactggtctttttgtcggatccggaaaagtcttggccacaggtggcccagcgtcggttctcattgcttatgctttgattggttgcatgctttactgcaccgtacacgcacttggtgaaatggctgttcttttccccgttgctggttcatttgcgcactactcgactcgattcattgatccggcatggggtttcgctatgggttggaactatgcattgcaatggctcgtagtgttgccgctggaaattgtagctgcgtcgatcactgtcgactactggcagtccgatatctctaacgccgcatgggtcgcaatcttttgggtattgatcgtctcaatcaacttgttcggcgtcagaggctacggtgaggctgagtttgtcttctcactcattaaggttgttgctgtgattggctttatcatcctcggcattgtcctgaactgcggcggaggtccccagggtggatatatcggtggaaagtattggagcgatcctggtgctttccataatgggttcaaaggtctttgcagtgtcttcgtcaacgccgcgtttgcctttgctggaaccgagctcgtcggtttggctgcagctgagaccgctaaccctcggaaatcgctcccaacagctgtcaagcaagtgttctggcgtatttgtctcttctacattgtatcactcaccctggtcggccttcttgttccctggaatgacgaacgacttcttgatgggagctccagtgctgacgctaaagcctctccatttgtgatcgccatcaagaatgctggtatctccgtgctagactctatcatgaacgtcgttatcatgattgcggtcttatccgtgggtaactcgtcagtttatggctcctctcgtacccttgcagcccttgccgagcagggacaggcccccaaattcctgtcatatattgatcgcaagggtcgccctctctgggcaattctaattgcttctgccctcggtttgcttagtttcttggccgcatcagacaaacaagaagtggctttcgagtggatgatggccatatccggtctctcgtccatcttcacttggggttcggtttgtttggcgcacattcgcttccgtcgtggctggaaggctcagggccacagtctcaatgaactcgccttccaatcacaaccgggagtgatcggctcttggatcgggttcttgttcaactgtctcgttcttgtcgcacagttctgggttggatttgcgccaatcggttatgcgacgaagaccgctggtgagcttgttgaggcctggttttccgtatacctagctgctccagttgtcctgctcttttatatcccttacaagctctggttcaagacgccatttatccgggccaaggacatggacctgcaaaccggtcgtcgcgatctcgatcttcagtacttgatcgagcaggaacgagctgaacaggcagaatggcctgcatggaagaaggtgtataagttcttctgttag

SEQ ID NO: 8465 - protein, 589 aa, Aspergillus oryzae
MEKDEIEAKAEPRGAAFESPPPLYGDSEPTQAGLGRRIWDSFKRDPNAHVTGGHGSSGADGKSFDIENAAQKTASSPLQRSLKGRHLQMIAIGGSIGTGLFVGSGKVLATGGPASVLIAYALIGCMLYCTVHALGEMAVLFPVAGSFAHYSTRFIDPAWGFAMGWNYALQWLVVLPLEIVAASITVDYWQSDISNAAWVAIFWVLIVSINLFGVRGYGEAEFVFSLIKVVAVIGFIILGIVLNCGGGPQGGYIGGKYWSDPGAFHNGFKGLCSVFVNAAFAFAGTELVGLAAAETANPRKSLPTAVKQVFWRICLFYIVSLTLVGLLVPWNDERLLDGSSSADAKASPFVIAIKNAGISVLDSIMNVVIMIAVLSVGNSSVYGSSRTLAALAEQGQAPKFLSYIDRKGRPLWAILIASALGLLSFLAASDKQEVAFEWMMAISGLSSIFTWGSVCLAHIRFRRGWKAQGHSLNELAFQSQPGVIGSWIGFLFNCLVLVAQFWVGFAPIGYATKTAGELVEAWFSVYLAAPVVLLFYIPYKLWFKTPFIRAKDMDLQTGRRDLDLQYLIEQERAEQAEWPAWKKVYKFFC

SEQ ID NO: 8466 - DNA, 1611 bp, Glomus mosseae
  CDS (1)..(1611)
atggcttctactcctcccaccgattacggcaaggaggccgttctcgatgtctctgagacacgagatgtcgagactggcgaggtcaagaacggtggcctcaagcaagatctcaagaaccgacacatgcagatgattgccatcggtggcgctatcggtgctggtctcttcgtcggttcaggtggtgccctccagaagggtggccctgctgctctcctcatcggctatctcatcatcggtatcatgcttctatgcacatgcttggccctcgctgagatggctgtcctctaccccgtcaacggtgccttcttcacatacatcgtccgcttcgtcgatccttcatggggtttcgccatgggttggcaatacgctctcgcttggttgactgtcctgcctttcgaacttatcgcggcttccatcaccatcagattctggagagaagatatcaacatggctgtctgggtctctgtcttccttgttgtcctcatgggcattcagatcttcggtgttcgaggttacggtgaagttgagtttgttctctctatcatcaagatctgcgcctgtgttggtttcatcatcctcggtattgtcatcaactgcggtggcgttggcgaccagggctacatcggtgtcaagtactggcgcgatcctggtgctttcaccagcttcaagggtttctgcgctgtcttcgtcgtcgctgctttctccttcggtggtactgagatggtcggtctggctgctgctgagtctgccaacccccgcaagtctatccccatggctagcaagcaggtcttctggcgaattgctatcttctacattctcaacctgttcatcgtcggtctcatcctccccgccaacgaccctcgcctgatgggcgccagcggtgccaacaccaaggcctctcccttcgttcttgctatccaggatgccggtatcaaggtccttccaagcatcatgaacgctgtcatcactgttgctgttctctccgttgccaactcctgcactttcggttctacccgaaccatccaagctatggctgagcgcaacatggcccccaacttcttcaagtacattgactccaagggccgccctctctactgtgttatccttcagatcgcctttggtctccttgcctacattggcgctgctcctcagggcatggagatcttcggctggctcttggccctcactggtcttggcttcctcttcgtctggggctctatctgcctcgcccacatccgcatgcgtgccggtatgaaggctcagggcatcaacctcggcctcattccctacaagacccccttcggcgttgctggatcttacctcggtctcggtctcaacatcctcgcccttatcgcttctttctacactgctctcttccctgcctccggcgcctctcccaccgctgaggccttcttcagttcctacctcgccttcttctctgttacccttctctaccttggttacaaggcctgcacacgcaagaggcagatgtatgtccgccccgcagagatggatctggccagtggcgctgtttggttggaggaggtggagcccaaggagcctttcgtctgggccgatactcccaagaaggttctccgaagcttttactaa

SEQ ID NO: 8467 - protein, 536 aa, Glomus mosseae
MASTPPTDYGKEAVLDVSETRDVETGEVKNGGLKQDLKNRHMQMIAIGGAIGAGLFVGSGGALQKGGPAALLIGYLIIGIMLLCTCLALAEMAVLYPVNGAFFTYIVRFVDPSWGFAMGWQYALAWLTVLPFELIAASITIRFWREDINMAVWVSVFLVVLMGIQIFGVRGYGEVEFVLSIIKICACVGFIILGIVINCGGVGDQGYIGVKYWRDPGAFTSFKGFCAVFVVAAFSFGGTEMVGLAAAESANPRKSIPMASKQVFWRIAIFYILNLFIVGLILPANDPRLMGASGANTKASPFVLAIQDAGIKVLPSIMNAVITVAVLSVANSCTFGSTRTIQAMAERNMAPNFFKYIDSKGRPLYCVILQIAFGLLAYIGAAPQGMEIFGWLLALTGLGFLFVWGSICLAHIRMRAGMKAQGINLGLIPYKTPFGVAGSYLGLGLNILALIASFYTALFPASGASPTAEAFFSSYLAFFSVTLLYLGYKACTRKRQMYVRPAEMDLASGAVWLEEVEPKEPFVWADTPKKVLRSFY

SEQ ID NO: 8468 - DNA, 1830 bp, Saccharomyces uvarum
  CDS (1)..(1830)
atgccattatcagaagactttggatcttctggtaagaaagaggcttcgccagattccatttcaatacgctcctttagtgctgtgaacaaccttcagtcatcgtcaagtgaaaaaaattattctggacaaacaacccggaacaacaaacttatacataggttcgtggactcattcaaaagagcagaaggtagcactacacataccaagcaaataaatgagaatacatcagatttagaaggtgatgttaattccttcacgtcggactccaagctgaaaaagtccatgaaatcccgtcacgtcgtcatgatgactctggggacaggtatcggtacgggtcttttggttgccaatgctaagggtcttcattacggtgggcccgccgcattggttatcggttatttcttggtttcgtttgtcacatatttcatgattcaagcagctggtgaaatggccgtcacttatccgactttaccagcaaattttaacgcatactcctccatattcatctccaagccgtttgggtttgccacagtatgggtttactgtttccaatggctaactgttttacccctagagttgatcaccgctgccatgactattaaattttggaatgatacgataaatcccgatattttcattcttatcttctttgttttcttacttttcattcatttctttggtgtgaaaggttatggtgaaacagagtttatcttcaactgctgtaaaattttaatgatagcgggcttcatcattctttccgttgtcattaactgtggtggtgccggaaacgatggttacattggtggcaaatattggcgcaacccaggtgcatttgctggtgacacttcggcgggcaggttcaaaaacgtttgctatattttagttaccgcttacttttcttttggtggtatggaattatttgctttaagtgttcaagaacaggcgaatccaagaaagacaacccctgtggctgctaagagaagtatatatcgtatcctcgttatctacctactaactatgattttaattggattcaacgttccatataatgacgatcaattgatgggtgctggtgggtccgccacacatgcatctccttatgtgctagcggcctccatccatggcgtcaaagtggttccacatatcatcaatgctgttattttgatatctgttatctccgtcgcgaactcctccctatatgcgggcccaagattgatgtgctctttggcccagcaaggttacggacccaaattcttggattacgtcgacagagagggtagaccattaatagctctaattgtgtgtagtgttttcggtgtcatagggtttgttgcagcctcgtccaaggaagaggtcgtgtttgcatggctagctgccatcgcaggtttgagtgaactattcacctggacttccattatgttatcccatttacgttttagacaagcaatgaaagtacaaggaagatctctggatgagttaggatataaagctacaaccggtatttggggttccgcatacggggtcttcttcaatatcttggtgttcattgcccaattctgggtggccttggctcccctgaataatggtggtaaatgcagtgcggagtccttttttcaaagctatctggcttttccaatctggatagctttctacctcgggtatatgatctacaaccgcgacttcacctttttgaatcccctcgataagatcgatctagacttccacagacatatttacgatccagaactgatgagacaagaagacttggaaaatgaagaaaggaaaagagacatgtcgctgatgagaaagacttaccttttctggtgttga

SEQ ID NO: 8469 - protein, 609 aa, Saccharomyces uvarum
MPLSEDFGSSGKKEASPDSISIRSFSAVNNLQSSSSEKNYSGQTTRNNKLIHRFVDSFKRAEGSTTHTKQINENTSDLEGDVNSFTSDSKLKKSMKSRHVVMMTLGTGIGTGLLVANAKGLHYGGPAALVIGYFLVSFVTYFMIQAAGEMAVTYPTLPANFNAYSSIFISKPFGFATVWVYCFQWLTVLPLELITAAMTIKFWNDTINPDIFILIFFVFLLFIHFFGVKGYGETEFIFNCCKILMIAGFIILSVVINCGGAGNDGYIGGKYWRNPGAFAGDTSAGRFKNVCYILVTAYFSFGGMELFALSVQEQANPRKTTPVAAKRSIYRILVIYLLTMILIGFNVPYNDDQLMGAGGSATHASPYVLAASIHGVKVVPHIINAVILISVISVANSSLYAGPRLMCSLAQQGYGPKFLDYVDREGRPLIALIVCSVFGVIGFVAASSKEEVVFAWLAAIAGLSELFTWTSIMLSHLRFRQAMKVQGRSLDELGYKATTGIWGSAYGVFFNILVFIAQFWVALAPLNNGGKCSAESFFQSYLAFPIWIAFYLGYMIYNRDFTFLNPLDKIDLDFHRHIYDPELMRQEDLENEERKRDMSLMRKTYLFWC

SEQ ID NO: 8470 - DNA, 1746 bp, Penicillium chrysogenum
  CDS (1)..(1746)
atggaggagaagaagtttgaggccgtccaaactggcgcggaggcccccccagcttatggcgactcatctccaacgcggggaggcataggccaacgaatctttgacagtttcaagagagaccccaatcatacagtcaccggtcatgttggagctgatggctctggattcgacgctgagactgccgcccataacactgctcactccccgttgcagcgtcgcttgaagggtcgtcatctgcagatgattgctatcggtggttctatcggtactggtcttttcgttggttccggatctgttttggccaccggtggtccagcctcagtattgattgcctatatcttgatcggatgcatgctttattgtacagttcatgcattgggtgaaatggcagttctcttccccgttgccggttctttcgcccattattcaactcgtttcgtcgatcctgcttggggttttgccatgggctggaactacgctcttcagtggcttatcgtcttacccttggagatcgtcgctgcttctatcacggtcgattattggaacccaggggtttcaaatgccgcctgggtaactattttctgggttatgattgtctcaatcaacttattcggtgtgcgaggatatggtgaagctgaatttgtcttctccctcattaaggtcattgccgttattggtttcattatacttggaatcatcctcaactgcggtggtggaccccaaggtggatacatcggcgccaggtactggtacgacccaggtgcatttaggaacggtttcaagggtctctgcagtgtctttgtcaatgccgcatttgcctttgctggaaccgaacttgttggtcttgctgccgccgaaaccaccaatcctcgcaagtcccttccgacagccgttaagcaagtcttctggcgtattgctctcttctacatagtttcccttacccttgtcggcctcctagtgagatatgacgacgagagacttatcagcggtagctcttccgccgatgccaaggcctctcccttcgtcattgctattgagaacgcaggaattaaggctttgccttcgatcatgaatgtcgtgattatgattgcggtcctgtctgtcggcaattcctccgtctatggatcctcacgtactcttgctgcccttgccgagcagggccaagcccccaagttcctagcatacattgaccgcaagggacgtcctctacccgccattatcattgcatctatattgggtctgctttcctacctcgccgcctctgacgtgcagactaccgccttcgaatggatgatggccatctcgggtctgtcatctattttcaccggggttccgtgtgtccgtgcccacatcctcttccgtcgcgcatggaaaaaacagggccacagcctggacgaactggctttccgttcccaacccggcgtcattggctcgtgggtcggtttcattttcaactgtctcgtgctggttgcccagttctgggttgggttcgcccccattggttacgcagacatgacctctcaggagattgcctacaaattcttctctgtctacttggccgcccccgtggttctgatttgctacatcggttataagatcatgtacaagaccaagtttgttcgcacgtccgaggtggatttggtcaccggtcgtcgcgaccttgatatccagcatttaattgagcaggagatggccgagcaaagagaatggcccaagtggaagaaggtttataagttcttctgttaa

SEQ ID NO: 8471 - protein, 581 aa, Penicillium chrysogenum
MEEKKFEAVQTGAEAPPAYGDSSPTRGGIGQRIFDSFKRDPNHTVTGHVGADGSGFDAETAAHNTAHSPLQRRLKGRHLQMIAIGGSIGTGLFVGSGSVLATGGPASVLIAYILIGCMLYCTVHALGEMAVLFPVAGSFAHYSTRFVDPAWGFAMGWNYALQWLIVLPLEIVAASITVDYWNPGVSNAAWVTIFWVMIVSINLFGVRGYGEAEFVFSLIKVIAVIGFIILGIILNCGGGPQGGYIGARYWYDPGAFRNGFKGLCSVFVNAAFAFAGTELVGLAAAETTNPRKSLPTAVKQVFWRIALFYIVSLTLVGLLVRYDDERLISGSSSADAKASPFVIAIENAGIKALPSIMNVVIMIAVLSVGNSSVYGSSRTLAALAEQGQAPKFLAYIDRKGRPLPAIIIASILGLLSYLAASDVQTTAFEWMMAISGLSSIFTGVPCVRAHILFRRAWKKQGHSLDELAFRSQPGVIGSWVGFIFNCLVLVAQFWVGFAPIGYADMTSQEIAYKFFSVYLAAPVVLICYIGYKIMYKTKFVRTSEVDLVTGRRDLDIQHLIEQEMAEQREWPKWKKVYKFFC

SEQ ID NO: 8472 - DNA, 1680 bp, Penicillium chrysogenum
  CDS (1)..(1680)
atgggtcaccccgacgagattaacgctctcgaggcgcagcccggctacgttgacaacttgggagatttcaaggaaagtgagcaggatgagccagttcaacttcacagagagctcaaggctcgtcacatttctatgattgccattggtggtgccattggtactggattggtcgttggtactggtagcgccctgacagccggacctggatctttgtttattgcctactgctttatgggtttcgtcgtttggactgtcatgtgtggactgggtgaaatggctgcttggctaccattgtcctccggtttcactggttacgctggccgtttctgtgaccctgctctcggatttaccctcggatggtgctactacctcaaatatatcattctaccacctacacaactcacggccgctgctctagtcattacctattggccgagaacgtcagcagagaacgtcaatccaggtgtttggattgccatcttcatggtggctatcatcgtgataaactacttcggcgtgaagatcttcggtgaattggagttttggctctcatctttcaaggtgattgtcattctcggactcattctgtgctctttgctcttcgcactcggcggtggtccagaccacgacaggagaggcttccgatactggaataagcccggcgccttcgccactaaatatactgatggtgcccttggcaaattccttgctttctggtcgaccatggtgcaagccacctttgcattcctcggtaccgaacttattggtgtgaccgtcggagaagcccagaacccccggaagaccatccccaaagctatcaagctcaccttctggcgaatcatcgtgttctatattctcagtgtactcttcctcggtatgctcgtcccctacgactccaaggaactggctttcgcaaccgaggccgagagctctgctgccgcatcaccttttgtggtggcaatggggcaagtcgccgctcttcctcacatcatcaacggctgtatcctggtgttcgtgttttctgccgccaactctgatctatacattgcgactcgaactctgtacggtcttgcccgtgagaagaaggctcctaaaatctttgctcgcactaacagagctggtgtcccaatctattctctggcactgtcagcttctttctgcttgctcgcctttatgagtgtgtccagtacctccaaggaagtattcggatacttcaccgacatggtgtcaatcttcggattgttgacatgggtctccctcttgattacccacatcttcttcattcgtgcgcgacgtgcacagggagtcgaccaggcaacactggcctacaaagctcctctgggaatcatcggttcctgcattgcgctcttcttctgtgttttggtgctcttcactcgcagcttcggcgtgtttatccacgacccggaaacatacggcaactttgactacaagacttttatcacttcatacatcggaatccccctctatgttgccgcattcgctgggtggaagatctggaacaagaccgagattatcaagccccataatgcggatatctggaccggcaaggccgaaattgaccgcgaagaggcggaatatgtggctatggtggccattcaggaccaaaacttgtctggctggaacaaggtttacaggaagagtctcgcgtggctcttctga

SEQ ID NO: 8473 - protein, 559 aa, Penicillium chrysogenum
MGHPDEINALEAQPGYVDNLGDFKESEQDEPVQLHRELKARHISMIAIGGAIGTGLVVGTGSALTAGPGSLFIAYCFMGFVVWTVMCGLGEMAAWLPLSSGFTGYAGRFCDPALGFTLGWCYYLKYIILPPTQLTAAALVITYWPRTSAENVNPGVWIAIFMVAIIVINYFGVKIFGELEFWLSSFKVIVILGLILCSLLFALGGGPDHDRRGFRYWNKPGAFATKYTDGALGKFLAFWSTMVQATFAFLGTELIGVTVGEAQNPRKTIPKAIKLTFWRIIVFYILSVLFLGMLVPYDSKELAFATEAESSAAASPFVVAMGQVAALPHIINGCILVFVFSAANSDLYIATRTLYGLAREKKAPKIFARTNRAGVPIYSLALSASFCLLAFMSVSSTSKEVFGYFTDMVSIFGLLTWVSLLITHIFFIRARRAQGVDQATLAYKAPLGIIGSCIALFFCVLVLFTRSFGVFIHDPETYGNFDYKTFITSYIGIPLYVAAFAGWKIWNKTEIIKPHNADIWTGKAEIDREEAEYVAMVAIQDQNLSGWNKVYRKSLAWLF

SEQ ID NO: 8474 - DNA, 1623 bp, Uromyces fabae
  CDS (1)..(1623)
atggacggcaacatacgcgaagcagatgcggaaaaagtaagcacatcggtcttagagtcagcgctcccggccgccgatgctggaaacaagccagcgcctcatcagcttcaaagacagctacaaaaccgccatgtcgccatgatttccattggtggagcaataggcactggattgttcattggaacaggaacagctttgtcaaatggggggcctttttcattagttgttggatactgcctaatggctttaatggtatgggcactcatgtgtagcttaggggaaatgattgcccacttgcctattgctggtggacatcttgcactggccgatcggttcttttcgcctagtttgtcgttcacattgggatggtcttactggtatctctggtcgattgttcttccaactgagctatcggcttcagcgctttttattagtttttggaccgtcaaagttcatttgggtatctggatctttatttttttggcaatagttgctttgattaatcttggaggtgttcgattctatggggaaatggaattctggttttcgagtttaaagatcatcacaattgtgggagtccttattttaggttttgtcttggatttaggcgcagtaacgggagacacgatcggctttcgttattggaagaatcccgggctttttgtgcagtatgaaggcgtgcctggagccgccggtcgttttctaggtttcttttcagtcttagttacagcagcgttttctttcataggagtcgagatgcccgcaattgccgccgctgaggctaaaaatccacgtaggaatttaccccgagcaattaagagggtggctgcaagagtagtgggattctacattctgagcaccatagtagtctccatgctcgtaccctcaaatgaacctcgactgcgcttgagctcatccacaggggctaagtcaccatttgtcattgccatacacaatgctggcataaaagggatgtcctcggtgattaatggctgtttgctgtcgtttacgctctcggcagcatcttcagacttatatatttcgagtcgctctctatacggcctgagcattacaggaaatgcgcccagatttttgtcaaaaactacatcaaatgggttaccgatttattgttatcttatcggggtcatgatggggacgcttgcattcatggcgactggtgatggtcaagcaggaaaactttttggatatctagcaaacctgacaagcgtgactggcttgttaagttggtctggaatctttatcacgtatattcgcttccggggcggaatgaaactgcaaaatttcgacaggcaacagcttccctatcggtctcctgttggggtgactggggcctggtttggtctagtatcttgtaacataatcataatattcaacgggttttcagtttttctaaaaggaaagtggaatagtgcaacattctttacctgctattttccggttgcagcctttgtcttccttttttgcgctcacgcatggtggactaaagcaggtttggtgcagaaaaagcacatggacttcgccactggaagcgactgcccagatgaagatgaagaaagtccaccaaaatcttgggttcagaaagtttggagagctattatgtag

SEQ ID NO: 8475 - protein, 540 aa, Uromyces fabae
MDGNIREADAEKVSTSVLESALPAADAGNKPAPHQLQRQLQNRHVAMISIGGAIGTGLFIGTGTALSNGGPFSLVVGYCLMALMVWALMCSLGEMIAHLPIAGGHLALADRFFSPSLSFTLGWSYWYLWSIVLPTELSASALFISFWTVKVHLGIWIFIFLAIVALINLGGVRFYGEMEFWFSSLKIITIVGVLILGFVLDLGAVTGDTIGFRYWKNPGLFVQYEGVPGAAGRFLGFFSVLVTAAFSFIGVEMPAIAAAEAKNPRRNLPRAIKRVAARVVGFYILSTIVVSMLVPSNEPRLRLSSSTGAKSPFVIAIHNAGIKGMSSVINGCLLSFTLSAASSDLYISSRSLYGLSITGNAPRFLSKTTSNGLPIYCYLIGVMMGTLAFMATGDGQAGKLFGYLANLTSVTGLLSWSGIFITYIRFRGGMKLQNFDRQQLPYRSPVGVTGAWFGLVSCNIIIIFNGFSVFLKGKWNSATFFTCYFPVAAFVFLFCAHAWWTKAGLVQKKHMDFATGSDCPDEDEESPPKSWVQKVWRAIM

SEQ ID NO: 8476 - DNA, 1830 bp, Saccharomyces pastorianus
  CDS (1)..(1830)
atgccattatcagaagactttggatcttctggtaagaaagaaacctcgccggattccatttcggtacgttcctttagtgctgggaacaaccttcagtcattgacaagtgaaaaaagttattccagagactcaaccgggaacgacaaacttatacatagatttgtggactcatttaagagggcagaaagtagcactacaaagaccaagcaaataaacaagaacacttcagatttagaagaggatgttcattcctttacgtcggactccgacttgaaaaagtccatgaaatcccgtcacgtcgtcatgatgtcgctggggacaggtatcggtacgggtcttttggttgctaatgctaagggtcttcattacggtgggccagccgcattggttatcggctatgttttagtttcctttgtcacatatttcatgattcaagctgctggtgagatggctgtcacttatccgactctaccagcaaatttcaatgcatactcctccatattcgtctccaagccgtttgggttcgccacagtatggctttactgtttccaatggctaaccgttttacccctagagttaatcaccgcatccatgacagttcaattttggaacgataaaatcaatgctgatattttcattctaatcttctttgttttcttacttttcgtccatttctttggtgtgaaagcatacggtgagacagagtttattttcaactgttgtaaaattttaatgatagcgggcttcatcattctttccgttgtcattaactgtggtggtgccggaaatgatggttacattggtggcaaatattggcgtaacccaggtgcatttgctggtgactcttcggcttccaggttcaaaaacatttgctatattttagttaccgcctatttttcgtttggtggtatggaattatttgcattaagtgttcaagaacaggagaatccaagaaagtcgacccctgtggcagctaagagaagcatataccgtatcctcattatctaccttttaactatgattttgattgggttcaatgttccgtataatgatgatcaattgatgggatctggcgggtccgctacacacgcatctccctatgtgttggcagcctccatccatggtgtcaaagttgttccacatattatcaatgctgttattttaatttctgtcatttcagtgtccaactcctccctatatgcgggcccaagattaatgtgctctttggcccagcaaggctacgcacccaaattcttagattacatcgacagagagggtagaccattaagagctttaattgtgtgtagtatttttggcaccgttgcgtttgtcgcagcctcgtccaaggaagaggtcgtgtttacatggctagcagccatcgcaggtttgagtgaactattcacctggacttccatcatgttatctcactttcgttttagacaagcaatgaaagtacaaggaagatctttagatgagttaggatataaagctacatccggtatttggggttccgcatacggagtcttcttcaatatcttggtgttcattgctcaattctgggtggccttggcccccttgggtaatggtggtaaatgtagtgtggagtcctttttcgagagctatctggctgctccaatttggctagctttctacctcgggtatatgatctacaaccgcgatttcacctttttgaaccccctcgacaagatcgatctagacttccacagacgtgtttacgatccagagctgatgagacaagaagatttggaaaataaagaaaaaaaaaaacacatgccgctaatgaaaaaggcttaccttttctggtgttga

SEQ ID NO: 8477 - protein, 609 aa, Saccharomyces pastorianus
MPLSEDFGSSGKKETSPDSISVRSFSAGNNLQSLTSEKSYSRDSTGNDKLIHRFVDSFKRAESSTTKTKQINKNTSDLEEDVHSFTSDSDLKKSMKSRHVVMMSLGTGIGTGLLVANAKGLHYGGPAALVIGYVLVSFVTYFMIQAAGEMAVTYPTLPANFNAYSSIFVSKPFGFATVWLYCFQWLTVLPLELITASMTVQFWNDKINADIFILIFFVFLLFVHFFGVKAYGETEFIFNCCKILMIAGFIILSVVINCGGAGNDGYIGGKYWRNPGAFAGDSSASRFKNICYILVTAYFSFGGMELFALSVQEQENPRKSTPVAAKRSIYRILIIYLLTMILIGFNVPYNDDQLMGSGGSATHASPYVLAASIHGVKVVPHIINAVILISVISVSNSSLYAGPRLMCSLAQQGYAPKFLDYIDREGRPLRALIVCSIFGTVAFVAASSKEEVVFTWLAAIAGLSELFTWTSIMLSHFRFRQAMKVQGRSLDELGYKATSGIWGSAYGVFFNILVFIAQFWVALAPLGNGGKCSVESFFESYLAAPIWLAFYLGYMIYNRDFTFLNPLDKIDLDFHRRVYDPELMRQEDLENKEKKKHMPLMKKAYLFWC

SEQ ID NO: 8478 - DNA, 1647 bp, Neurospora crassa
  CDS (1)..(1647)
atgggcggtgcgagaaacgcaaccaaaaaggactttgtcaaggaacagtcggccgctgatgacgatgcggcctccttcgccgagcacaacgccggccccgagctgaagcgcaggctcaagtctcgccatttgcaaatgattgccattggtggtactattggtactggtctcttcatcggttccggcagcgccctcgccaagtcgggccctgctggcgtcctcatcggctactgctttatcgcctccattgtttacagcatcatgatgtccctcggtgaaatggccacctacgtccccgtcaccggcggtttcaccacgtacgcggctcgctttgtcgacagctctctcggtttctccatgtcgtggatctactggttttcgtgggccattacctttgcgctcgagctggtcgctactggtctgatcattcagtattgggacgactctctgtccatcggtattttcatcgccatcttctgggtcgtcattttcgtcatcaacctgttccccgtgtcctggtacggcgaggcggaattctggatgtcctctgtcaaggtcatcaccgtcctcggcttcctcatcttcggcatctgcatcaacgccggcgccggtcagcagggctacattggcttcaagtactggcacgagccgggtgcttttgctccctacattgttgaccctagccgccctgtcgccaagtgggttggcttctggtccgtcatgatccaggccggcttctccttccagggcaccgagcttgtcggtatcgctgctggcgagaccgaagacccgcgccgcaacgtcccccgtgcgatccgcatgaccttttaccgtatcttcctcttcttcatcatgaccgtcttcttcatcggcatcctcatcccctacgacaacaaggacctgaacaatggcggctacaccgcggctgcctctccctttgtcattgcggcccagctcgccggcgtcaaggtcctacccgacatcatcaacgctgtcttgcttactgtcgtcctctctgccgccaactccaacgtctactcgggctctcgtgtcctcgtctccctcgccaacgacggcatggcccccaagtggttcaagatgaccaccaagtccggcgtcccctatattgccgtcatgtttacctcggcgttcggtttcctcggcttcctcaacctctctcccaacggcagccaggccttcgactggcttctcaacatttcgggcgtcgcgggtttcattgcctggtccggcatcctcatcgcccacctccgcttcatgaagggtcttgaggcgcacggcatcccccgctccaagctgccctatcgcgccacctgggccccttactacgtctactacgccctgttcttctgcatcttgatcaccctgacccaaggcttcaccgcgttcatgccctggagcgtcgaagaattctttgtggcgtacgtttcgctcatcatttttgctgtcatgtacctgggccacaagctctataccctcattgtctacggcgccgcggcgtgtaagccggtctctgccaaggacatggatgttactactgggtctttggatctggatgccgagatccccgacgaggtcgaggagcctacgagtatctggaagaagattggaacgggtatcatgggttaa

SEQ ID NO: 8479 - protein, 548 aa, Neurospora crassa
MGGARNATKKDFVKEQSAADDDAASFAEHNAGPELKRRLKSRHLQMIAIGGTIGTGLFIGSGSALAKSGPAGVLIGYCFIASIVYSIMMSLGEMATYVPVTGGFTTYAARFVDSSLGFSMSWIYWFSWAITFALELVATGLIIQYWDDSLSIGIFIAIFWVVIFVINLFPVSWYGEAEFWMSSVKVITVLGFLIFGICINAGAGQQGYIGFKYWHEPGAFAPYIVDPSRPVAKWVGFWSVMIQAGFSFQGTELVGIAAGETEDPRRNVPRAIRMTFYRIFLFFIMTVFFIGILIPYDNKDLNNGGYTAAASPFVIAAQLAGVKVLPDIINAVLLTVVLSAANSNVYSGSRVLVSLANDGMAPKWFKMTTKSGVPYIAVMFTSAFGFLGFLNLSPNGSQAFDWLLNISGVAGFIAWSGILIAHLRFMKGLEAHGIPRSKLPYRATWAPYYVYYALFFCILITLTQGFTAFMPWSVEEFFVAYVSLIIFAVMYLGHKLYTLIVYGAAACKPVSAKDMDVTTGSLDLDAEIPDEVEEPTSIWKKIGTGIMG

SEQ ID NO: 8480 - DNA, 1899 bp, Neurospora crassa
  CDS (1)..(1899)
atggccgcttacggcagcagaggtggagattccttcggccagggaagttcatggagtttccgggaacccttcgcagtcggccgcgtcccgacatgggcacgcgctcgccatcgccaagaaccgaggttgcgaacattcctcgactcgttcaaacgggaccccgtccgccggatatcaacccatggcatctatgcccagagtcatcctgatcaataccaagcagccgactcctcggatgaacctccgaccgaacagaatcatggaagccactactttgacctgcacgccgccaacgtcaggacggcaaacacgggtctggcccgagagctcaaggggagacacttgcagatgattgccattgggggttcagttggttccggtttgttcgtggcctcgggcaagtgtctctacctaggaggtccggcctcgctcatcattgcatatggctttgtgggtgtcatgctttggtgtactattcaagctcttggagaactggccgttgctttccccgttgccggttccttctcgtcatactctacaagattccttgatccagcatgggggtttgccatggggtggaattatgccctccagtggttgacagtcctgccactcgaactcatagcagcttccatcaccatcggctactggaacgaccaactcaacaaagccatcttcatcaccatcttcctagcaaccgtcatcatcatcaacctcttcggcgtcaaaggctacggtgaagccgaattcgtcttttccattgtcaaaatcgccgccgtcaccggtttcatcatcctcgccgcagtcatcaacatcggcggcttcgacgacccccaaggcaacaccggctacattggcgggcggtactggaccaaccccggcgcttttcaccacggtttcaaaggtctctgctccgtctttgtctctgccgccttcgcctttacaggtaccgagctggtcgggctcgccgccgctgagaccgccaacccgcgtaaatccctgccgacagccatcaaacaagtcttttggcgcatcaccctcttctacattgtctctctcaccctcgtcggcctcatcgtcccttacaaccacgagcgcctcctgggaaacatccagcactactccgtctccgacgcctcgtactcgcccttcgttatagccatcgagtcggcctccatccaagtgctgccgggaattatgaacgccgtcatcctcatcgccgtactcagcgtaggcaactccgccgtcttcggtagttcccgcaccttagcagccctggccgaccagcgtcaagcgccccaaatcctcgcctacgtcgaccgcaagggtcgacccctcttcgccatcctttttgctgccctcgtcggcctgatcggctacctagccgacctgaaatttcaatccgacgtgctaaactggctgctcgccgtctcgggcctttcgtccatcttcacctggggctccatctgcctctgccacatccgctttcgccgcgcctgggcccgtcgcggccggtccctcacccaattatcctttacagcacaggcaggcatcacggggtcgtacgtcggcctttttctcaatgtctttgtgctgattgcccaattctggattgcggcgttcccgattgtcacgtttacagataaccagtcggcggctaccgcgtcgccgagtaaagtggcgcagagtttctttttgcagtatctgtgtgtgccgattgtggtggcgttttacttggtgtataagttgtggtttaggaccaagattgtgaggagtgatgagatggatttggacacgggacggaggagggatgtgaatttgcctgtgttggtgatgagggagaaggaggaggtagaagggtggccggggtggaagagggtttatcggtttttttgttga

SEQ ID NO: 8481 - protein, 632 aa, Neurospora crassa
MAAYGSRGGDSFGQGSSWSFREPFAVGRVPTWARARHRQEPRLRTFLDSFKRDPVRRISTHGIYAQSHPDQYQAADSSDEPPTEQNHGSHYFDLHAANVRTANTGLARELKGRHLQMIAIGGSVGSGLFVASGKCLYLGGPASLIIAYGFVGVMLWCTIQALGELAVAFPVAGSFSSYSTRFLDPAWGFAMGWNYALQWLTVLPLELIAASITIGYWNDQLNKAIFITIFLATVIIINLFGVKGYGEAEFVFSIVKIAAVTGFIILAAVINIGGFDDPQGNTGYIGGRYWTNPGAFHHGFKGLCSVFVSAAFAFTGTELVGLAAAETANPRKSLPTAIKQVFWRITLFYIVSLTLVGLIVPYNHERLLGNIQHYSVSDASYSPFVIAIESASIQVLPGIMNAVILIAVLSVGNSAVFGSSRTLAALADQRQAPQILAYVDRKGRPLFAILFAALVGLIGYLADLKFQSDVLNWLLAVSGLSSIFTWGSICLCHIRFRRAWARRGRSLTQLSFTAQAGITGSYVGLFLNVFVLIAQFWIAAFPIVTFTDNQSAATASPSKVAQSFFLQYLCVPIVVAFYLVYKLWFRTKIVRSDEMDLDTGRRRDVNLPVLVMREKEEVEGWPGWKRVYRFFC

SEQ ID NO: 8482 - DNA, 1746 bp, Saccharomyces kluyveri
  CDS (1)..(1746)
atgtcctttatccaagacagttatcgtaaggatctggagaaaatcgtctccaactcaaacaccacatctaaggatgtcgaaaatttggacctttccaaccaagatgatatctcatctcaagaatcccatttaaatattgacggtaagcatgacggtatccgtttgaaaaaagaattggaagcccgtcacgtttctatgattgccatcggtggttctttgggtaccggtttgttgattggtactggtacctccctttcccttgctggtcctgtttctattttgatcgcttactcctttgtcggtttcttggtctacattgttatgacatgtcttggtgagatggccacctacattccattggatggtttcacaagttatgcatcccgttactgtgacccagctttgggttttgccgttggttattcctaccttttcaaatacctgatcattacaccaaatcaattgaccgctgccgctttggtcttgcagtactgggtgtccagagagaaggtcaacccaggtgtctggattaccattttcctggttattattgtcacgatcaacgttgtaggcgtcaaattctttggtgaatttgaattttggctatcgagtttcaaagttcttgtcatgctgtgtctgatcgttctgctatttgttataatgttgggtggtggcccatcccatgaccgtttgggtttcaggttttacaaggatccgggtgcgttcagaccttattcagaagccatcagtggttccaagggtaaatttgtctcttttgtcgcagtctttgtttacgctttgtttgcatacttgggtaccgaattgtgtggtattgtcgctgcagagtgtaagaacccaagaagaaacgttcctcgtgctatcaagttgacgctgtaccgtatcgttgttttctaccttgtcaccatcttcttgttgggtatgactgtcgcttacaacgatccattgttgctacaagccaagaagaagtctacttctgccgctgcttctcccttcgtcgttgccatcaagaatgcaggtatcccagttttgccacacatcttcaacgcatgtgttttgatgttcgttttcagtgcttgtaactcggacttgtacgttgcttctagaagtttgtacgggttggccattgacaacaaggcaccaaagattttcgccaagactaacaagtggggtgttccatacaactctttgatcttgtgtatcctgttctgtctattggcttatatgaacgtgtcttctggttccgctcaagtcttcaactatttcgttaacgttgtgtctatctttggtttgatgagttggatcgccattttgattacctacatctacttcgacagggctttaagagcacaaggtgtggataaatctacgctagcttatgccgcaccactagcatccaaaggtgcttatttcgctttgtttttctgctgtttgattgctttgattaagaatttcaccgtatttttgggtcacaaatttgactacaagaatttcatcaccggctatattggtatcccagttttcatcatctgtttctttggttacaaatacatccgtggtaccaaattcgttaaaccagaggaagctgacttgtacactttcaaagaacttatcgacttggaagaagaagaaggtaagctttgggacgctgcacaaaaggaaaagatggaaagctctccaaagaacttcaaatggttttacgaaaagtttttgggctggatcttttaa

SEQ ID NO: 8483 - protein, 581 aa, Saccharomyces kluyveri
MSFIQDSYRKDLEKIVSNSNTTSKDVENLDLSNQDDISSQESHLNIDGKHDGIRLKKELEARHVSMIAIGGSLGTGLLIGTGTSLSLAGPVSILIAYSFVGFLVYIVMTCLGEMATYIPLDGFTSYASRYCDPALGFAVGYSYLFKYLIITPNQLTAAALVLQYWVSREKVNPGVWITIFLVIIVTINVVGVKFFGEFEFWLSSFKVLVMLCLIVLLFVIMLGGGPSHDRLGFRFYKDPGAFRPYSEAISGSKGKFVSFVAVFVYALFAYLGTELCGIVAAECKNPRRNVPRAIKLTLYRIVVFYLVTIFLLGMTVAYNDPLLLQAKKKSTSAAASPFVVAIKNAGIPVLPHIFNACVLMFVFSACNSDLYVASRSLYGLAIDNKAPKIFAKTNKWGVPYNSLILCILFCLLAYMNVSSGSAQVFNYFVNVVSIFGLMSWIAILITYIYFDRALRAQGVDKSTLAYAAPLASKGAYFALFFCCLIALIKNFTVFLGHKFDYKNFITGYIGIPVFIICFFGYKYIRGTKFVKPEEADLYTFKELIDLEEEEGKLWDAAQKEKMESSPKNFKWFYEKFLGWIF

SEQ ID NO: 8484 - DNA, 1806 bp, Saccharomyces kluyveri
  CDS (1)..(1806)
atgtcaaaaaaatccctagagaacttaagcaacgaaaagttgccggccacagaatgtggttcttctaactcaaatcttcgagaaagcatttcttctaacgacctcagtgacggagatcgtggtttcgtgaaccgcaagcttcacaacttttgtaattcctttaagagagctaatagtgacacttttgacgcatcacaagatctggaaggcgcatccataaattcggtacgatcaaactcaaaatttaaacagagcatgaagtccaggcacgtcgtcatgatgtctctaggtaccggtattggtaccggtttgttggtcgccaacggtaaatctttgcattttggtgggcctgctggtctattgattgggtactcgttggtgtctgttgttgcctatattatgatgcaagcagctggtgaaatggccgtcgcttatccaacccttcccgggaacttcaatgtgtactcttcaatctttatctccaaatcattcgggtttgctaccgtatggctttattgcttacagtggttgactgttctaccattggagttgattaccgcatcgttaacgataaaatactggaatagttcaatcaaccctgacgcctttatcgccattttttacgcagttatcgttttcattcatttcttcggtgcagccggttacggtgaagccgaatttatctttagtacttgcaaagtgtcgatgattgccggatttattatcctgagtattgtgattaactgtggtggtgcgggtactggcggctacattggcggtgaatattggcgcaaccctggtgcctttgctggtggctctccaattggtcatttcaaaggtattgcctacgttctggtgaccgcctacttttcgtacggtggtatggaattgttcgctctaacagtcaatgaacaggccaaccctagaaaagccgtgccatcagctaccaagaagtgtatctaccgtattctgataatttacatgttgacaatgatcttaattgggtttttggtgccatacaacagtgacgaattgatgggttcttctggtaaatctgcgacacacgcgtcgccttatgtcattgccgttgcatcacacggtgtcaaagttgttccacacatcatcaatgctgttattttaatctctgtcgtttctgtcggtaattctgccatgtattctgctcctagactgctcaattctttagccgagcagggctacgctccaaaaattttcagctatgtggatagagcaggtagaccattggttgcattggttggctgttccattttcggccttttgtcctttgttgctgcttccgataaggaagaacaagtcttcacttggttggctgccattgcaggtttaagcgaacttttcacctggtctgctatctgtctatctcacgtcagattcagagatgctatgaagtatcaagggtactccttgagtgaattggggtacaagtctaagactggctactgggggtccatatacgcaatcttcttcaacataattgtcttcgttgctcaattctgggttgccttggcacccattggtaatggtgggaaggcagacgctgaagcctttttccagagttacctggccttccctatctggatatcctgttatgttggttacaaaatctacagtaaagagtggaaactgcttgttccccttgatgaaattgatctaaacagccatagacacatttttgataaacacattttgcagcaagaagacgatgaacataaggaaaaattgaaaaactccggatggtgggtcaaaatggctaatttttggtgctaa

SEQ ID NO: 8485 - protein, 601 aa, Saccharomyces kluyveri
MSKKSLENLSNEKLPATECGSSNSNLRESISSNDLSDGDRGFVNRKLHNFCNSFKRANSDTFDASQDLEGASINSVRSNSKFKQSMKSRHVVMMSLGTGIGTGLLVANGKSLHFGGPAGLLIGYSLVSVVAYIMMQAAGEMAVAYPTLPGNFNVYSSIFISKSFGFATVWLYCLQWLTVLPLELITASLTIKYWNSSINPDAFIAIFYAVIVFIHFFGAAGYGEAEFIFSTCKVSMIAGFIILSIVINCGGAGTGGYIGGEYWRNPGAFAGGSPIGHFKGIAYVLVTAYFSYGGMELFALTVNEQANPRKAVPSATKKCIYRILIIYMLTMILIGFLVPYNSDELMGSSGKSATHASPYVIAVASHGVKVVPHIINAVILISVVSVGNSAMYSAPRLLNSLAEQGYAPKIFSYVDRAGRPLVALVGCSIFGLLSFVAASDKEEQVFTWLAAIAGLSELFTWSAICLSHVRFRDAMKYQGYSLSELGYKSKTGYWGSIYAIFFNIIVFVAQFWVALAPIGNGGKADAEAFFQSYLAFPIWISCYVGYKIYSKEWKLLVPLDEIDLNSHRHIFDKHILQQEDDEHKEKLKNSGWWVKMANFWC

SEQ ID NO: 8486 - DNA, 1752 bp, Saccharomyces kluyveri
  CDS (1)..(1752)
atgagctcggatatgtccaccgcaaattccaaaaaagaagaggagtctacgtatgcgattattcaaacatcctcaccttgctctaaaaagtattcctatatttccggacaggttaacaggtttattaattcttttagaagaaaaggtgagagtgaagatgttaaggaattgaaaggagagaatgaggaatgtggggctgccaccaaaatgaaaaaaagcatcaaatctcgtcatttattgatgatatcactaggtaccggtattggcacaggtttgcttgttggaaatggtaaggcactggccaaagctggacctgcaggtttagttatagggtatgcagttgcctcgattatgctatactgtattatccaggccgctggtgagttgggtatttgttattctgggatggctggtaactacacggcgtattcgtcactgttggtagaccccgctttaggtttttcagtttcctgggtctactgtgtgcaatggatgacagttttacctctacaattggttaccgctgcaatgactgttagatactggacaaatgccaacccggacatatttgtcgctgtatttttcgttgtaataatggtgattaatatgtttggtgctaaaggttatgctgaagcagagttcctgttcaacatatgcaaagtattgatgattgctgggtttgttatcttgggtattgctataaattgtggcggtgccggtaccagtggatatattggtgctaagtattggcattcgccaggttcatttgctgctggttttaaaggtgtttgttacgtgttctgttacgcagcttttagctacggtggtattgaagtcatggtattgacagctagtgagcaagaaaatccaaggaaatctatcccaaatgcttgtaagaaagtcatttaccgtatactgatgatttacatgctgactacaatcattgtatgtttcctagttccatacaacagcagcgagttgatgggttcttccggcgagtctgcatcacatgcctccccacttgtcattgctgttgcatcgcatggtgttaagatcgtcccacatattataaatgccgtcatattaatctcggtcatttctgttggcaactcctcaatgtattctgctcctagactattactatctctgtctgagcaaggttacgctccaaaatttttaaattacgtggatagacaaggtagaccattgatttgttttgccattaccttgctagttgcgttaattgcatttgtcgccgcgtccgacgccgaagaggatatatttgcttggctattggcgatctcagggttatcccaaatcttcatctggacttccatatgcctttcccatgttagattcagagatgcgatgcacgcacaaggtctttctttgggacaaatcggttacaaatcacaaacaggttattggggttcgtggtttgccatagttataagtgttttggtgttaattgcccagttctgggttgcaattgcaccaattggtgaagaaggtagattaaatgcagaaacatttttccagaattacttggctttcccaattttgttgggtgcttactttggctataaagtttatcacaaagactggagattatgcattccagcaagtgaggtagatttgtcctcccacagaaatatatctgatgaagagatattgagacaagaagattacgaatggaatgagaagatgtccaattcttccatttgggttaggctgtgccatttttggtgctga

SEQ ID NO: 8487 - protein, 583 aa, Saccharomyces kluyveri
MSSDMSTANSKKEEESTYAIIQTSSPCSKKYSYISGQVNRFINSFRRKGESEDVKELKGENEECGAATKMKKSIKSRHLLMISLGTGIGTGLLVGNGKALAKAGPAGLVIGYAVASIMLYCIIQAAGELGICYSGMAGNYTAYSSLLVDPALGFSVSWVYCVQWMTVLPLQLVTAAMTVRYWTNANPDIFVAVFFVVIMVINMFGAKGYAEAEFLFNICKVLMIAGFVILGIAINCGGAGTSGYIGAKYWHSPGSFAAGFKGVCYVFCYAAFSYGGIEVMVLTASEQENPRKSIPNACKKVIYRILMIYMLTTIIVCFLVPYNSSELMGSSGESASHASPLVIAVASHGVKIVPHIINAVILISVISVGNSSMYSAPRLLLSLSEQGYAPKFLNYVDRQGRPLICFAITLLVALIAFVAASDAEEDIFAWLLAISGLSQIFIWTSICLSHVRFRDAMHAQGLSLGQIGYKSQTGYWGSWFAIVISVLVLIAQFWVAIAPIGEEGRLNAETFFQNYLAFPILLGAYFGYKVYHKDWRLCIPASEVDLSSHRNISDEEILRQEDYEWNEKMSNSSIWVRLCHFWC

SEQ ID NO: 8488 - DNA, 1569 bp, Saccharomyces castellii
  CDS (1)..(1569)
atgaaagaggagatccgtgagataagtgttgaggtggaggcggagacggtcaggcgtgagctaaagcagcggcacatggggatgatagcgttggggggcacgatcgggacggggctgttcatcggtgtgtcgacgccgttgatgaacgctgggcctgtgggggccctgatcgcgtacctgttcatggcgaccctggcgtactcggtgacgcagtcgctgggggagatggcgacgttcatccctgtgacctcgtcgttcaccgtgttctcgcagcggttcgtgtcgccggcgtttggggcagccaacgggtacatgtactggttctcgtggtgcatcacctttgcgctggagctgtctgttgtgggccaggtgatccagttctggacgtttgcggtgccgctggccgcctggatcagcatcttctgggtgctgctgacggggatgaatatgttcccggtgaagtactacggggagtttgagttctgggtggccctggtcaaggtggtcgcgatcatgggctttctgatatactgtttctgtatggtctgtggtgctggagtcacggggcccgtgggcttccgctactggcgccacccgggcgcctttgggcccggtattattgcaaaggacaagaatcaagccaggtttttagggtgggtctcgtcgctaatcaacgctgcatttacgtttcaagggaccgagctggtgggtattactgccggtgaggctgccaacccgaggaagaccgttccaagggccatcaagaaggttgtgtttaggattctgtttttctacattctgtcgctgtttttcataggcctcctggtaccgtacgatgactggaaactgacgagcacagactcatatgtgtcggcgtcgcccttcattatcgcgatcgagaacagcggcacgcatgtcttgccgcacattttcaacgcggtcatcgtcgccaccatcatctcggcgggcaattccaacatatacgtcggctcgagaatcatgtacggtctgagcacaagcaggctggcaccgggcatcctctcacgcaccacgcagcacggggtgccctgggtggccgtgctggtcacctcgctgtttggcgccctggcatacatggagacgagcacgggtgggcagaaggccttcaactggctgctgaacatcacaggtgtcgcagggttctttacctggctgtttatatcactatcccatatcaggttcatgcaggcgctggagatgcgaggcatatccagagacgacctgcccttcaaggccaagtggatgccaggcctggcatattacggggtgttcttcatgacgttgatcatcatcatccaaggcttcaccagcttctgtccctggaacggcatcgactttctgaccgcctacatctcggttttcatgtttatcgctatctggatcgccttccaggcctggttcaggtgcaggcttatttggagggtcgaggacgtggacatagacaccgacagaagggccgtcgaagaggcagtgtggatcgagcaggagcccagaggtttctgggacaagttctggaacgtggtggcataa

SEQ ID NO: 8489 - protein, 522 aa, Saccharomyces castellii
MKEEIREISVEVEAETVRRELKQRHMGMIALGGTIGTGLFIGVSTPLMNAGPVGALIAYLFMATLAYSVTQSLGEMATFIPVTSSFTVFSQRFVSPAFGAANGYMYWFSWCITFALELSVVGQVIQFWTFAVPLAAWISIFWVLLTGMNMFPVKYYGEFEFWVALVKVVAIMGFLIYCFCMVCGAGVTGPVGFRYWRHPGAFGPGIIAKDKNQARFLGWVSSLINAAFTFQGTELVGITAGEAANPRKTVPRAIKKVVFRILFFYILSLFFIGLLVPYDDWKLTSTDSYVSASPFIIAIENSGTHVLPHIFNAVIVATIISAGNSNIYVGSRIMYGLSTSRLAPGILSRTTQHGVPWVAVLVTSLFGALAYMETSTGGQKAFNWLLNITGVAGFFTWLFISLSHIRFMQALEMRGISRDDLPFKAKWMPGLAYYGVFFMTLIIIIQGFTSFCPWNGIDFLTAYISVFMFIAIWIAFQAWFRCRLIWRVEDVDIDTDRRAVEEAVWIEQEPRGFWDKFWNVVA

SEQ ID NO: 8490 - DNA, 1788 bp, Saccharomyces castellii
  CDS (1)..(1788)
atggaaagttctaagaagaatgaaacttctccggaagtgaatagtataacctcttccactttgaagactccaaacgttacagagaaattcgaaccatatccagacactacagctgtcaagcacagaacacatttcaacagattcgttgactcattcaagagagctgaagtaaaccataatggtatagatcttgaagatggtaccaactcaatacaatccgatgataatttaaagaaggccatgaagtccagacacgtcattatgatgtctctagggacgggtatcggtaccgggttgttggtcgccaacgctaagggtctttatttggctggtcctgcatctttagtcattgggtactttatggtctccttcattacatatttcgtcattcaagccgcaggtgaaatggccgtcacatatccaactttaccaggtgggtttaataattacgcttccattttcgtttctaaaccattcggtttcgctaccgtgtggcttttctgtattcaatggttgaccgtcttacctttggaattgattaccgcatccatgactattaaatattggaatgataagattaatgcagatgtcttcgtcgtcatactctacgtgtttttattattcattcatttctttggtgtcagagcatacggtgaggctgaatttattttcaattcatgtaagattctcatgattggagggttcgtcatcctaagtatcgtcgttaattgtggtggagctggtgttgatggatacattggtggcaaatattggcgtgatccaggtgcatttgcatcagataacgcagcttccagatttaaaggtgtggcatttgtccttgtcactgcttatttctcatatggtggtgtcgaattattcgcattgtctgttaatgaacaagaaaatccaagaagatccacccctgctgctgccaagcaaagtatctaccgtatccttatcatttatttgttaaccatgatcttaatcggtttcaacgtcccacataacagtgatcaattgatgggtgctggtggatctgccactcatgcatccccctacgtgttggctgtctccatccacggtgttaaagtggttcctcatatcatcaacgcagtcatcttaatttcagtgacttctgtggctaattccgcattgtatgcatctccaagattactaagatcattagctgaacaagggtacgcacctaaatacttcaattatgtcgatagagaaggtagaccattacgtgcgctaatcttatgtagtatctttggtgtcattgcattctgtgcctgttccgatcaagaagaagtcatcttcacatggttagctgccattgcagggttaagtgaattatttacatggtcctccatccttctatcacatgttcgtttcagattggccatgaaagcccagggcaagtccttgaacgaattagggtatatatcaattactggtatttgggggtccctttacggttgtttcttcaacgttttggtgtttattgcccaattctgggtcgcgctaagtcctcctggtagtaaaggtgtctacagcgcggaagcttttttcgaaagttatttggcattccccgtttggttgttcttctatttaggatacatgctttacagtagagatttcacattcttgaccgatttgaaaaagattgatctagacaaccatagacgcctctacgatcctgaactattgagacaagaagatgaagaaaccaaggagagaataaggaatggtggctggacgcagaagctgttaaatttctggtgttag

SEQ ID NO: 8491 - protein, 595 aa, Saccharomyces castellii
MESSKKNETSPEVNSITSSTLKTPNVTEKFEPYPDTTAVKHRTHFNRFVDSFKRAEVNHNGIDLEDGTNSIQSDDNLKKAMKSRHVIMMSLGTGIGTGLLVANAKGLYLAGPASLVIGYFMVSFITYFVIQAAGEMAVTYPTLPGGFNNYASIFVSKPFGFATVWLFCIQWLTVLPLELITASMTIKYWNDKINADVFVVILYVFLLFIHFFGVRAYGEAEFIFNSCKILMIGGFVILSIVVNCGGAGVDGYIGGKYWRDPGAFASDNAASRFKGVAFVLVTAYFSYGGVELFALSVNEQENPRRSTPAAAKQSIYRILIIYLLTMILIGFNVPHNSDQLMGAGGSATHASPYVLAVSIHGVKVVPHIINAVILISVTSVANSALYASPRLLRSLAEQGYAPKYFNYVDREGRPLRALILCSIFGVIAFCACSDQEEVIFTWLAAIAGLSELFTWSSILLSHVRFRLAMKAQGKSLNELGYISITGIWGSLYGCFFNVLVFIAQFWVALSPPGSKGVYSAEAFFESYLAFPVWLFFYLGYMLYSRDFTFLTDLKKIDLDNHRRLYDPELLRQEDEETKERIRNGGWTQKLLNFWC

SEQ ID NO: 8492 - DNA, 1782 bp, Saccharomyces castellii
  CDS (1)..(1782)
atgccaagaaacgttatacaaccgaacaaggaaaagactgtggactattcgtcgacagaatatcttccaaacgagttagaatctccatcattcaacctcgatgcaactgaggaatctagatctggtctagttcacagattcgtcgactcattcaagagggctcaagattctacagaaaatgatctcgaagatgggacgaaaccattaggtgatgcttcacatttaaagaaggccatgaagtcaagacatgtcatcatgatgtgtgttggtaccggtatcggtacgggtcttctagtggctaatgcttcagggctatcctacggggggcccggttcattagttattggttatgtattggtttcctttgttacttatttcatgattcaagccgcaggtgaaatggccgtcgcataccctacattaccgggaaatttcaattcttatacatcaatgttcatttctaaaccattcggtttcgctacagtatggttatttttcatccaatggttaactgtgttcccattagaattgatcaccgcatcattaactatcaaatactggaatgataaaatcaatgctgatgtattcattgtcatcttctacgtgttcttattatttattcatttctttggtgtcaaagcttacggtgaagctgaatttatcttcaattcatgtaaagttctgatgattgctgggtttatcatattatcaatcgtaatcaactgtggtggtgcaggtaaagatggttatattggtgcaaaatattggagagatccaggttcttttgctgaaggtgattccgtggaaaaatttaaaggtatttgttacatcttagtcaccgcatatttctcctatggtggtgctgaattattctcattatctgtcaatgaacaagagaatccaagaaaatctacccctcaagctgccaaacaaagtatataccgtatcttaatcatttatttgttgacaatgattttaattgggtttaacgtccctcataataacgatcaactaatggggtcgggtggatccgcaacacatgcatccccatacgtcctggccgcatcaattcatggtgttaaagtggttcctcattttatcaatgctgtcattttgatctctgttatttctgtcgcaaattcagctctttatgcatctccaagattgatgtgttcccttgctgaacaaggttatgctccaaaattcttagattatgttgacagagaaggtagaccattacgtgctctaatactttgtgctgtttttggtgtcattgggtttgtctctgcatcatccaaggaggaagaagtcttcacttggttagctgccattgcagggttaagtgaacttttcacttggtcaggaattatgctttctcacgtccgttttagacaatgtatgaaactacatggtagatccgaggaagaaattggtttcagagctgttactggtatctgggggtcaatgtacgggatctcctttaacatgctggtgttcattgcccaattttgggtcgctcttgccccaccaagtcttcatggtaaagtagatgctgagtcattcttccaaagttacttagctgcaccaatttggctattcttttacttcggctacatgctttataagagagatttcacatttttagtcccactggataaaattgacctaaatttccacagaagaatctatgatcctgaactgataagacaggaagatgaagaaaataaggaaaaaatcaaaaattcctctgtgtgggttagaatgttccatttctggtgctaa

SEQ ID NO: 8493 - protein, 593 aa, Saccharomyces castellii
MPRNVIQPNKEKTVDYSSTEYLPNELESPSFNLDATEESRSGLVHRFVDSFKRAQDSTENDLEDGTKPLGDASHLKKAMKSRHVIMMCVGTGIGTGLLVANASGLSYGGPGSLVIGYVLVSFVTYFMIQAAGEMAVAYPTLPGNFNSYTSMFISKPFGFATVWLFFIQWLTVFPLELITASLTIKYWNDKINADVFIVIFYVFLLFIHFFGVKAYGEAEFIFNSCKVLMIAGFIILSIVINCGGAGKDGYIGAKYWRDPGSFAEGDSVEKFKGICYILVTAYFSYGGAELFSLSVNEQENPRKSTPQAAKQSIYRILIIYLLTMILIGFNVPHNNDQLMGSGGSATHASPYVLAASIHGVKVVPHFINAVILISVISVANSALYASPRLMCSLAEQGYAPKFLDYVDREGRPLRALILCAVFGVIGFVSASSKEEEVFTWLAAIAGLSELFTWSGIMLSHVRFRQCMKLHGRSEEEIGFRAVTGIWGSMYGISFNMLVFIAQFWVALAPPSLHGKVDAESFFQSYLAAPIWLFFYFGYMLYKRDFTFLVPLDKIDLNFHRRIYDPELIRQEDEENKEKIKNSSVWVRMFHFWC

SEQ ID NO: 8494 - DNA, 1773 bp, Saccharomyces bayanus
  CDS (1)..(1773)
atgacgacgcctaagcaagactctgaagtagaggaaaaacacatgtacactgagccggccggaacgttctttcatgacgtcgaagcctctcaaactcatcacaggcgtggatcattgtcgctgaaagatgagaagagcaaggaactgtatccattgcgctcctttcccaatggagtcaatggccaggacactttctcgatggaggaagatatacaggacgaagacgagggcgaagtgcagaatgcggaggtgaaaagagaacttaaacaaaggcacatcggtatgattgcccttggtggtaccatcggtaccggtctgttcatcggtctatctacacctctaacgaacgccggccccgtgggtgctctgatatcctatttattcatgggttcgttggcttactccgtcactcaatcactaggtgaaatggccacattcattccagtcacatcttcgttcacggtcttttcgcaaagatttctgtcgcctgcatttggtgcagccaacggttacatgtattggttttcttgggccgtcacctttgccctggagcttagtgtggttggacaagtcattcaattttggacgtacgccgtcccattggcagcatggattagtattttctgggtgatcatcaccgcaatgaacatgttccccgttaaatattacggtgaatttgaattctgggtcgcctctatcaaagtcatcgccattatcgggtttttgatctactgtttttgcatggtctgtggtgctggtgtcaccggcccagttgggttccgttactggagaaacccaggtgcatggggcccaggtattatctccaagaataagaacgaggcaaggttcctaggttgggtttcctctttgattaatgctgcgttcacattccaaggtactgaattggttggtatcactgctggtgaggccgccaacccaagaaaaactgttcccagagccatcaagaaggttgttttccgtatcttgaccttctacatcggatccctattgttcattggtcttttggtgccatacaacgatcctaaattaacctctgccacctcttatgtctccacttctccatttattattgccattgaaaactcaggtacaaaagtattgccccatatattcaatgctgttatcttaacaaccatcatttccgcagcaaattcaaatatttatgtgggctctcgtgtcttatttggtttatccaaaagcaagttggctccaaagtttttttcaaaaaccacaaaaggtggtgtcccatatattgcggttttcgccacttccatatttggtgctttagcttacatggaaacttccaccggtggtgggaaagtattcgcatggttattgaatatcactggtgtcgctgggttcttcgcttggttgtttatctcggtatctcatatcaggttcatgcaagctttgaaataccgtggcatttctcgtgatgaattgccattcaaagccaaactaatgcccggattggcttattatgctacttttttcatggtagttattatcctcatccaagggttcacctcttttacaccaacattcaacggtgttaatttccttgccgcctatatttctgttttccttttcttggcaatttggattctatttgaactgatatttagatgcagatttgtctggaaaatcgaagacgtggatatcgattctgacagaagagacatcgaagccattgtgtgggaagaacctgagccaaagaccctttgggacaagttttggaatgttgtaggttaa

SEQ ID NO: 8495 - protein, 590 aa, Saccharomyces bayanus
MTTPKQDSEVEEKHMYTEPAGTFFHDVEASQTHHRRGSLSLKDEKSKELYPLRSFPNGVNGQDTFSMEEDIQDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAVTFALELSVVGQVIQFWTYAVPLAAWISIFWVIITAMNMFPVKYYGEFEFWVASIKVIAIIGFLIYCFCMVCGAGVTGPVGFRYWRNPGAWGPGIISKNKNEARFLGWVSSLINAAFTFQGTELVGITAGEAANPRKTVPRAIKKVVFRILTFYIGSLLFIGLLVPYNDPKLTSATSYVSTSPFIIAIENSGTKVLPHIFNAVILTTIISAANSNIYVGSRVLFGLSKSKLAPKFFSKTTKGGVPYIAVFATSIFGALAYMETSTGGGKVFAWLLNITGVAGFFAWLFISVSHIRFMQALKYRGISRDELPFKAKLMPGLAYYATFFMVVIILIQGFTSFTPTFNGVNFLAAYISVFLFLAIWILFELIFRCRFVWKIEDVDIDSDRRDIEAIVWEEPEPKTLWDKFWNVVG

SEQ ID NO: 8496 - DNA, 1836 bp, Saccharomyces bayanus
  CDS (1)..(1836)
atgggcaagtttagaaatataatatcgtccaaaaaatgggacgaggagcaggacaattccgaggaacagagcatacgggacgactcgacaaatcagatagaacatgagatggaggtgatagacacatccaacaagccggtcgcatactccattgacgagaaacaggacaatttgaagaagaagagcgggttgatgctagatggcaccattggtgacataaattcgatcacgaactcgttaacgaggtcccaaattgcctcgcacgagcaaggtggggacgacgaagaagaggaggctcactacgaagacaagcacgtcagaagagccttgaagcagagacacattggtatgatcgcgctcggtggtaccatcggtactggtcttttcgtcggtatctccacccccttgagcaatgcaggccccgtcgggtccctgattgcttatattttcatgggtacagtggtttacttcgtaacacagtcgctgggtgaaatggccacttttatccccgtgacgtcatccatcacagtcttctcaaagaggtttttatcacctgcattcggtgtttccaacggttacatgtactggttcaattgggccatcacgtatgcagtggaagtctccgttattggtcaagtcattgaatactggacaacgaaagttcctttgggggtttggattgccatattttgggtccttatcactctaatgaattttttccccgttaaagtttatggtgagtttgaattctgggtggcatcggtaaaagtcctggccatcatggggtacttgatatacgccttggttatcgtctgtggtgggtccaaacaaggtcctattggtttcaggtactggagaaatccaggtgcttgggggcccggtatcatctccagtgacaagaatgaagggcgttttctcggttgggtctcctctttgatcaacgccgccttcacgtaccaaggtactgaactggtcgggatcactgctggtgaagccgccaacccaagaaagaccgtccctagagctatcaacaaagttgtcttcaggattgtacttttttatatcatgtctttgttcttcattggtctcttggtcccatacactgacccccgtctatccgccagttccgctgtcattgcatcatcaccatttgtcatttccattcaaaacgctggtacttatgctttgccagacattttcaacgctattgtcttgatcactgttatctctgccgctaactcaaacgtttacgttggttcccgtgttttgtactctttggcccagaccggtaacgctccaaagcaatttggatacgtcactaaacaaggtgttccataccttggtgtcttgtctacagctgcattgggtcttttggccttcctggttgtcaacaacaacgccaacaccgcattcaactggttgatcaacatctccactttggctgggttatgtgcttggttattcattagtttgtcacacatcagattcatgcaagctttgaatcaacgtggtatctctcgtgatgatttgcccttcaaggctaaattcatgccctacggtgcctactacgcgtcctttttcgtcactgtcatcattttcattcaagggtttcaatcattctgtccattcagagtggccgacttctttacgtcctacatttccttaattcttttggctgtcgtgttcactggttgccagctatactacaaatgtagattcatttggaaactggaagacattgatatcgactctgacagaagagaaatcgaagctatcatttgggaagacgatgagccaaagaatttgtgggagaaattctgggcagccgttgcataa

SEQ ID NO: 8497 - protein, 611 aa, Saccharomyces bayanus
MGKFRNIISSKKWDEEQDNSEEQSIRDDSTNQIEHEMEVIDTSNKPVAYSIDEKQDNLKKKSGLMLDGTIGDINSITNSLTRSQIASHEQGGDDEEEEAHYEDKHVRRALKQRHIGMIALGGTIGTGLFVGISTPLSNAGPVGSLIAYIFMGTVVYFVTQSLGEMATFIPVTSSITVFSKRFLSPAFGVSNGYMYWFNWAITYAVEVSVIGQVIEYWTTKVPLGVWIAIFWVLITLMNFFPVKVYGEFEFWVASVKVLAIMGYLIYALVIVCGGSKQGPIGFRYWRNPGAWGPGIISSDKNEGRFLGWVSSLINAAFTYQGTELVGITAGEAANPRKTVPRAINKVVFRIVLFYIMSLFFIGLLVPYTDPRLSASSAVIASSPFVISIQNAGTYALPDIFNAIVLITVISAANSNVYVGSRVLYSLAQTGNAPKQFGYVTKQGVPYLGVLSTAALGLLAFLVVNNNANTAFNWLINISTLAGLCAWLFISLSHIRFMQALNQRGISRDDLPFKAKFMPYGAYYASFFVTVIIFIQGFQSFCPFRVADFFTSYISLILLAVVFTGCQLYYKCRFIWKLEDIDIDSDRREIEAIIWEDDEPKNLWEKFWAAVA

SEQ ID NO: 8498 - DNA, 1713 bp, Saccharomyces bayanus
  CDS (1)..(1713)
atgagtaaaaatgtggacattagcgtgtccaaagagggtcaatacgaacttaactccatctccacgataaaggaggaggagctggtagacgtccagtacgatggacagggtgccccggcggctatcgccgccggggggtgcattgcgaacgacgatgccaaggcggcagaggcgctaccccgggaggtgaaacggaacttgaagcagcggcatatagggatgattgctctgggaggcaccatcggcacgggcctcataataggtatcggtccgccgctggcgcatgcgggtcccgttggcgccctgatatcgtatatattcatggggaccgtcatttactcggtgacacagtcactgggggagatggcaacattcatacccgtgacgtcctcgttctccgtctttgcacagaggttcttgtcgcctgcccttggcgccaccaacggctacatgtactggctgtcgtggtgcttcaccttcgcactggaactatctgttctggggcaaatcatccagtattggacagatgctgtgcctctgtccgcttggatcgtaattttctggtgcctgctcacgctgatgaacatgttcccagtgaagtactacggggagttcgagttttgtattgcttccataaaggttatcgcgctgctcgggttcatcatctactcgttttgcatggtatgtggtgccggacagccggatggacccatcggattcaggtactggagaaatccaggagcctgggggcccggtatcatctccagtgacaagaacgaagggcgttttctcggttgggtctcctctttgatcaacgccgccttcacgtaccaaggtactgaactggtcgggatcactgctggtgaagccgccaacccaagaaaggccgtcccaagggcaattaagaaagttgtggtcaggatcctagtcttctacatcatgtcgctgtttttcataggccttttggttccgtacaacgacccgaaactggacagtgacggatcgtttgtgtccgcatcccccttcatgatcagcatcgagaattccggcaccaaggtcctcccagacatattcaacgcggtcgtgctgatcaccatagtctccgcgggcaactccaacgtgtacatcggctcaagggtcctgtacagtctatccaaaaacgacttggcgccccggttcctgtcgatcgtgaccaagggcggggtcccctactttgccgttctggcaacatctgtattcgggttcctggccttcttggaaacctccgcaggtagtggcaaggctttcaactggctgttaaacattactggtgtggcaggatttttcgcatggctgctgatttcattttcgcacatccgctttatgcaagcgataagcaaacgcggaatatcgaggaacgatctgccttacaaggctcgcatgatgccttatctagcctactacgcatcctttttcatcgccctgatagtcctgatccagggcttcactgcatttgcgcccagtttccagcctgtagatttcgttgccgcatacatatccgtcttcctatttgttgcaatctggttttcattccagctttggttcaagtgtcccataatcttgaagttgcaggacgtcgacatagattccgaccgccgcgaaatagaggagcaggtatggatagaacccttacgcaaaaccaagtggcagtgcgtgtgggatgtccttgcataa

SEQ ID NO: 8499 - protein, 570 aa, Saccharomyces bayanus
MSKNVDISVSKEGQYELNSISTIKEEELVDVQYDGQGAPAAIAAGGCIANDDAKAAEALPREVKRNLKQRHIGMIALGGTIGTGLIIGIGPPLAHAGPVGALISYIFMGTVIYSVTQSLGEMATFIPVTSSFSVFAQRFLSPALGATNGYMYWLSWCFTFALELSVLGQIIQYWTDAVPLSAWIVIFWCLLTLMNMFPVKYYGEFEFCIASIKVIALLGFIIYSFCMVCGAGQPDGPIGFRYWRNPGAWGPGIISSDKNEGRFLGWVSSLINAAFTYQGTELVGITAGEAANPRKAVPRAIKKVVVRILVFYIMSLFFIGLLVPYNDPKLDSDGSFVSASPFMISIENSGTKVLPDIFNAVVLITIVSAGNSNVYIGSRVLYSLSKNDLAPRFLSIVTKGGVPYFAVLATSVFGFLAFLETSAGSGKAFNWLLNITGVAGFFAWLLISFSHIRFMQAISKRGISRNDLPYKARMMPYLAYYASFFIALIVLIQGFTAFAPSFQPVDFVAAYISVFLFVAIWFSFQLWFKCPIILKLQDVDIDSDRREIEEQVWIEPLRKTKWQCVWDVLA

SEQ ID NO: 8500 - DNA, 1857 bp, Saccharomyces bayanus
  CDS (1)..(1857)
atgaacgacagcgacagtctctttgtcgacgaggccaatccagctccatgtacacatggtctgcacgagagagggcacgcggaaaaggagaagaaggacttcacagtgactgaaaaccaagatgaaggactacaacagcaagcgaagcgccaagggacgagtgggaaattcaaactacaaaacgaatgcaaaaaattcttcgactcgttcaaaagacagctgccagcggatcaaaattccgaactagagtcacaagaaaggaacaatttgacaaggtccatcaaatcacgccatttgatcatgatcagtctcggcaccggtatcggtacggggctgctggtcgggaatggccaagttctcggaacggcaggacccgccgggttggtgcttggttatggtatcgcctctatcatgctttactgtatcatccaagccgccggtgaactgggtctttgttatgccgggttaaccggtaattacaccaggtactcttccattttggtcgacccttcattggggtttgccgtttccgtggtttataccatccaatggttgaccgttcttcctttgcagttggtcacggcagcgatgactatcaaatattggaccaatgtgaacgcagacatctttgttgccgcagttttcatttttgtcatcatcatcaacttgtttgggtccaaaggctatgccgaagctgaattcatgtttaatatctgtaaaattctgatggtaatcggattcgtgatcctggccattgtcatcaattgcggtggtgcaggtgataggaaattcatcggtactaaatactggcacaatcctggtccatttgctcacggtttcaaaggtgtctgtactgttttttgttatgccgccttcagttacggtggtatcgaagtcctgcttctatcagcagccgagcaagagaacccaacaaaatccattccaaacgcttgcaaaaaagttgtgtatcgtatcttgttcatttacatgttgacgaccattttgatttgcttcctggtaccatacaacagtgacgaattattaggctctggtagctcttccgggtcacatgcatctccatttgtcattgctgttgcgtcccacggtgtcaaagtcgtgcctcacttcatcaatgctgtgattttgatttctgttatttctgtggctaattcttcgttatattctgcaccaaggctactactatcgttggcagaacaagggtttttacctaaatgtctggcgtatgttgacagaaacggcagacctttgctttgttttcttgtttctattatctttgggtgcatcggctttgttgccacgagtgacgctgaagaacaggttttcacatggttattagccatttccagtctttcccaattgtttatttggatgtcgatgtctctgtcacatattagattcagagacgccatggccaagcaaggccgttcaatggacgaggtgggatacaaagcacaaacaggctactggggatcttggcttgcggttttgattgcgttatttttcctagtttgccagttttgggtcgccatcgcacccgttagcaaacatggtaaattggatgctaatgttttcttccagaattatttggcaatgcccattgtcttgtttgcctatttcggccacaagatctacaccaaatcgtggaagttttggattccagccgaaaaaatcgatttggactcacacagaaccatatacgtcccaccaatactcatggggactaacaagattgatgacgatgatcttaaagaatatgaaacttcagagtcatcggaaaacccgaacggctcaggctcaagaaagtttttcaagagaatggctaatttctggtgttaa

SEQ ID NO: 8501 - protein, 618 aa, Saccharomyces bayanus
MNDSDSLFVDEANPAPCTHGLHERGHAEKEKKDFTVTENQDEGLQQQAKRQGTSGKFKLQNECKKFFDSFKRQLPADQNSELESQERNNLTRSIKSRHLIMISLGTGIGTGLLVGNGQVLGTAGPAGLVLGYGIASIMLYCIIQAAGELGLCYAGLTGNYTRYSSILVDPSLGFAVSVVYTIQWLTVLPLQLVTAAMTIKYWTNVNADIFVAAVFIFVIIINLFGSKGYAEAEFMFNICKILMVIGFVILAIVINCGGAGDRKFIGTKYWHNPGPFAHGFKGVCTVFCYAAFSYGGIEVLLLSAAEQENPTKSIPNACKKVVYRILFIYMLTTILICFLVPYNSDELLGSGSSSGSHASPFVIAVASHGVKVVPHFINAVILISVISVANSSLYSAPRLLLSLAEQGFLPKCLAYVDRNGRPLLCFLVSIIFGCIGFVATSDAEEQVFTWLLAISSLSQLFIWMSMSLSHIRFRDAMAKQGRSMDEVGYKAQTGYWGSWLAVLIALFFLVCQFWVAIAPVSKHGKLDANVFFQNYLAMPIVLFAYFGHKIYTKSWKFWIPAEKIDLDSHRTIYVPPILMGTNKIDDDDLKEYETSESSENPNGSGSRKFFKRMANFWC

SEQ ID NO: 8502 - DNA, 1902 bp, Saccharomyces bayanus
  CDS (1)..(1902)
atgtcctcgtcgacgtcgccatacgaactgaaggacttgaaaaatagctccactgaagtacatgccgcggagcaggagaacgaaatcgagtatttcgaaacagactccaatgaccgtccctcgcagcagcctcatctggactacgagcaacacaacacctctgccgtgcgtcggttcctcgactccttcaagagggccgaccaggatcaagagcaggaggcagaagtggcacagatgaacgacctcacgtccgccatttcgccctcgtccagacaggctcacgagctggagaaggacgagactactgacaagatagctcctcacacgggccacaaatccgactcgctgaagaagaccatccagcccagacacgtgcttatgattgcgctcggtaccgggatcggtaccgggctactggtgggtaatggtacagcgctggtgcatgcgggccccgctgggctgctcatcggttacgccatcatgggttccattctgtactgcatcatccaggcctgtggtgagatggccctcgtgtacagcaacctgaccggtgggtacaatgcatacccgagtttcctggtggatgacgggttcgggtttgccgtcgcctgggtttactgtctgcaatggttatgtgtgtgtcccctggagctggtcacggcgtccatgaccatcaagtactggaccacgtccgtcaacccggacgtgttcgtcatcatcttctatgtcctggtcatcaccattaacattttcggcgctcgtggttacgcagaggcggaattcttcttcaactgctgcaaaatcctcatgatgaccgggttcttcattctcgggatcatcatcgatgtcggtggggccggaaacgacggctacattggtggcaagtactggcacgaacccggtgcgttcaacggtgtgcacgccattgacagattcaaaggtgtcgtcgccactttggtcaccgctgccttcgcgtttggtgggtccgaattcattgccatcaccactgccgaacagtccaacccaagaaaggccattccaggtgccgccaagcagatgatctacagaatcctgttcctgttcctggccaccatcatcattgtgggtttcctcgtgccatacaactccgaccaactgttgggttccagcggtggcggtaccaaggcctccccatacgttattgccatcgcatcccacggtgttcgtgtggccccacatttcgtcaacgccgttatcctactgtcggtcctatccatggccaactcctctttctactccagtgcccgtttgttcctaactttatccgagcaaggttacgcccccaagatcttttcctacattgacagagccggcagacctttgattgccatgtgcgtctccgcattgtttgccgtcattgccttctgtgctgcatcccccaaggaggaccaagtgttcacttggttgttggccatttccggtctatcccaacttttcacgtggaccgccatttgtctttctcatatcagattcagaagagccatgaaagtccaaggcagatcccttggtgaattgggtttcaaatctcaaaccggtgtttggggctctatctactcctgtatcatgatgatcctgattcttattggccaattctgggtcgccatcgcccccattggcgaaggtaagctggacgctcaagccttcttcgagaactacctggccatgccgatcctgattgtactgtacgtgggttacaaaatgtggaacaaggattggaaactgttcattagagccgataagatcgatttgacctctcacagacaaatcttcgacgaagaattaatcaagcaagaagatgacgaatacagagaacgtttgagaaccggcccttattggagaagggtcttggccttctggtgttga

SEQ ID NO: 8503 - protein, 633 aa, Saccharomyces bayanus
MSSSTSPYELKDLKNSSTEVHAAEQENEIEYFETDSNDRPSQQPHLDYEQHNTSAVRRFLDSFKRADQDQEQEAEVAQMNDLTSAISPSSRQAHELEKDETTDKIAPHTGHKSDSLKKTIQPRHVLMIALGTGIGTGLLVGNGTALVHAGPAGLLIGYAIMGSILYCIIQACGEMALVYSNLTGGYNAYPSFLVDDGFGFAVAWVYCLQWLCVCPLELVTASMTIKYWTTSVNPDVFVIIFYVLVITINIFGARGYAEAEFFFNCCKILMMTGFFILGIIIDVGGAGNDGYIGGKYWHEPGAFNGVHAIDRFKGVVATLVTAAFAFGGSEFIAITTAEQSNPRKAIPGAAKQMIYRILFLFLATIIIVGFLVPYNSDQLLGSSGGGTKASPYVIAIASHGVRVAPHFVNAVILLSVLSMANSSFYSSARLFLTLSEQGYAPKIFSYIDRAGRPLIAMCVSALFAVIAFCAASPKEDQVFTWLLAISGLSQLFTWTAICLSHIRFRRAMKVQGRSLGELGFKSQTGVWGSIYSCIMMILILIGQFWVAIAPIGEGKLDAQAFFENYLAMPILIVLYVGYKMWNKDWKLFIRADKIDLTSHRQIFDEELIKQEDDEYRERLRTGPYWRRVLAFWC

SEQ ID NO: 8504 - DNA, 1830 bp, Saccharomyces bayanus
  CDS (1)..(1830)
atgccattatcagaagactttggatcttctggtaagaaagaggcttcgccagattccatttcaatacgctcctttagtgctgtgaacaaccttcagtcatcgtcaagtgaaaaaaattattctggacaaacaacccggaacaacaaacttatacataggttcgtggactcattcaaaagagcagaaggtagcactacacataccaagcaaataaatgagaatacatcagatttagaaggtgatgttaattccttcacgtcggactccaagctgaaaaagtccatgaaatcccgtcacgtcgtcatgatgactctggggacaggtatcggtacgggtcttttggttgccaatgctaagggtcttcattacggtgggcccgccgcattggttatcggttatttcttggtttcgtttgtcacatatttcatgattcaagcagctggtgaaatggccgtcacttatccgactttaccagcaaattttaacgcatactcctccatattcatctccaagccgtttgggtttgccacagtatgggtttactgtttccaatggctaactgttttacccctagagttgatcaccgctgccatgactattaaattttggaatgatacgataaatcccgatattttcattcttatcttctttgttttcttacttttcattcatttctttggtgtgaaaggttatggtgaaacagagtttatcttcaactgctgtaaaattttaatgatagcgggcttcatcattctttccgttgtcattaactgtggtggtgccggaaacgatggttacattggtggcaaatattggcgcaacccaggtgcatttgctggtgacacttcggcgggcaggttcaaaaacgtttgctatattttagttaccgcttacttttcttttggtggtatggaattatttgctttaagtgttcaagaacaggcgaatccaagaaagacaacccctgtggctgctaagagaagtatatatcgtatcctcgttatctacctactaactatgattttaattggattcaacgttccatataatgacgatcaattgatgggtgctggtgggtccgccacacatgcatctccttatgtgctagcggcctccatccatggcgtcaaagtggttccacatatcatcaatgctgttattttgatatctgttatctccgtcgcgaactcctccctatatgcgggcccaagattgatgtgctctttggcccagcaaggttacggacccaaattcttggattacgtcgacagagagggtagaccattaatagctctaattgtgtgtagtgttttcggtgtcatagggtttgttgcagcctcgtccaaggaagaggtcgtgtttgcatggctagctgccatcgcaggtttgagtgaactattcacctggacttccattatgttatcccatttacgttttagacaagcaatgaaagtacaaggaagatctctggatgagttaggatataaagctacaaccggtatttggggttccgcatacggggtcttcttcaatatcttggtgttcattgcccaattctgggtggccttggctcccctgaataatggtggtaaatgcagtgcggagtccttttttcaaagctatctggcttttccaatctggatagctttctacctcgggtatatgatctacaaccgcgacttcacctttttgaatcccctcgataagatcgatctagacttccacagacatatttacgatccagaactgatgagacaagaagacttggaaaatgaagaaaggaaaagagacatgtcgctgatgagaaagacttaccatttctggtgttga

SEQ ID NO: 8505 - protein, 609 aa, Saccharomyces bayanus
MPLSEDFGSSGKKEASPDSISIRSFSAVNNLQSSSSEKNYSGQTTRNNKLIHRFVDSFKRAEGSTTHTKQINENTSDLEGDVNSFTSDSKLKKSMKSRHVVMMTLGTGIGTGLLVANAKGLHYGGPAALVIGYFLVSFVTYFMIQAAGEMAVTYPTLPANFNAYSSIFISKPFGFATVWVYCFQWLTVLPLELITAAMTIKFWNDTINPDIFILIFFVFLLFIHFFGVKGYGETEFIFNCCKILMIAGFIILSVVINCGGAGNDGYIGGKYWRNPGAFAGDTSAGRFKNVCYILVTAYFSFGGMELFALSVQEQANPRKTTPVAAKRSIYRILVIYLLTMILIGFNVPYNDDQLMGAGGSATHASPYVLAASIHGVKVVPHIINAVILISVISVANSSLYAGPRLMCSLAQQGYGPKFLDYVDREGRPLIALIVCSVFGVIGFVAASSKEEVVFAWLAAIAGLSELFTWTSIMLSHLRFRQAMKVQGRSLDELGYKATTGIWGSAYGVFFNILVFIAQFWVALAPLNNGGKCSAESFFQSYLAFPIWIAFYLGYMIYNRDFTFLNPLDKIDLDFHRHIYDPELMRQEDLENEERKRDMSLMRKTYHFWC

SEQ ID NO: 8506 - DNA, 1659 bp, Uromyces fabae
  CDS (1)..(1659)
atgagctcggacgatgtgaaggctctgggaggcgacctggagaaggcgcactctatcatggatcaagaattcgtaactgaaaaaggcaatggtactatcactgaagacaagcaagatggtcagatgcaaagacatctaaaaccacgtcacatgtcgatgatagctattggcggtactatcgggacgggattgtttattggatccggacaaggtcttaaccaaggtggcccggtaggccttcttctaggttatagcaccatgggcatcgttgtctacagtgtgatggtttcacttggcgagatggtaacaatgtttccgattactggctccttcgtgcattacgcttcccgattcgttgacccagcattagggtttgctcttggatggaactattggtattgttatgccattactttacctactgaaatcaccgctgcagggattgtgattcaatattggacaaaaagtgtgaatgtggccgtatggataacaattttcctagtggcttcatgcggtgtaaatttatttggagtcagatggtacggggaggcagaattttggtgttccgctgtcaaagtaattgctatcgtttgcttgattatacttggcattatcattgatttaggtggcggtccaaatcatgatcgaattggatttagatactggatttctcctggcccattcaatcaattgaatggcattcctggttccactggtcgattcctcgccttctggtcggtctttattcaagcatctttttcatatcaaggcacggaaatcgtagctttggcagcaggggaagctctcaacccgagaaagaccatccccaaagccatcaacagggtcttttatcgtatcctattattttatgttggtggtgtgactgtgataggattgctggtgccctacaattcaccagatttgcttggtggtactggagatgccacttcatccccatttgtgattgccatcaagtctgcaggtatctcagtgctgccagatgtgctgaatgctgtcattttggcagttgtattttcagcagctaattcagatttgtatgctgcctcaagaatgacgtttggtttagctactgatggaatggcgccagcaatattctcccgttgtacaagcaacggtttacccatcgctggattgatcctcactattggatttggtttgctagcctacatgaatgttaattcttctaccggaacagttttccagtggctcgcaaatttctcttctgtgacaggacttctaacgtggtggtctatctctcttgcctacatcaggttttaccacggcttgatacatcacaaaatagaccgcaatacctttgcatacaaggctccttaccaaccatggctctcttacttttctattactatgtctactttaatcatcttcttcaacggttttgaggttttcatgagcggaagttggtcaacttcgaagtttgtatcggcatatctttctattccaatgtttatcgtcttctttataacatggaagatctatcacaagactgcttttgttaaaattgatcagatggactttgtaacgggaaaacgcgaattcgattcaatggaacaaattgagagcgagaaagaagttgagccagttggcaaatttgcacaatttcttgaatggttaatgtag

SEQ ID NO: 8507 - protein, 552 aa, Uromyces fabae
MSSDDVKALGGDLEKAHSIMDQEFVTEKGNGTITEDKQDGQMQRHLKPRHMSMIAIGGTIGTGLFIGSGQGLNQGGPVGLLLGYSTMGIVVYSVMVSLGEMVTMFPITGSFVHYASRFVDPALGFALGWNYWYCYAITLPTEITAAGIVIQYWTKSVNVAVWITIFLVASCGVNLFGVRWYGEAEFWCSAVKVIAIVCLIILGIIIDLGGGPNHDRIGFRYWISPGPFNQLNGIPGSTGRFLAFWSVFIQASFSYQGTEIVALAAGEALNPRKTIPKAINRVFYRILLFYVGGVTVIGLLVPYNSPDLLGGTGDATSSPFVIAIKSAGISVLPDVLNAVILAVVFSAANSDLYAASRMTFGLATDGMAPAIFSRCTSNGLPIAGLILTIGFGLLAYMNVNSSTGTVFQWLANFSSVTGLLTWWSISLAYIRFYHGLIHHKIDRNTFAYKAPYQPWLSYFSITMSTLIIFFNGFEVFMSGSWSTSKFVSAYLSIPMFIVFFITWKIYHKTAFVKIDQMDFVTGKREFDSMEQIESEKEVEPVGKFAQFLEWLM

SEQ ID NO: 8508 - DNA, 1785 bp, Schizosaccharomyces pombe
  CDS (1)..(1785)
atgacttcgtttacggaatcaaaaaaactggatgaaatagagtcgccagttccggaaattattgttccaagtaccaccaatggaaacggaacaattgaatcttacaaagaaaaatcggttggaacctctttcttggatttttttcgctcctacaagttgcgcccagacaatgagtttgctgaagtgcacaacagtgaggactttttgaaaccgaggcatttgcaaatgatcgccattggtagctgtattggtacgggtctttttgtttccactggcaaatctttaaaaaacgctggaccgggaagtctaatgattaatttcattatcctcagcgcaatgattctcgctttaattctttctctaggagaaatgtgttgtttcctaccaaatcaaagtagtatcacaatgtacactggacgattgttaaataataacattggttttgcgcagtcatggttatatttttggatatggctgaccgtcttgcctagtgaaatctctgccgcttgcgaagtagttgacttttggacaacacagcacttaaacccagctatttgggtaactatcttcttggcttatgttgtcttagttaatgcatttggagcccgtagctatggtgaatgtgaattcgttagttcatttttaaaagtcgtcattgttatcatcttcttcttcgttgcaattatcatcaactgtggagctgctccaaaaggtggctacattggtgcgcactattggcatcatccaggatcgtttcgtaacggtttcaaaggtttttgctccgtatttatttcctcagcctattcgttgtcgggtactgagaacataggtacggctgctggaaataccagcaatcctcaacgtgcaattccaagtgctgtgaaaaaggtgttctaccgtatgggcttcttctacatcatcaccatcttcttgatcactttagtagtcccgtatgataacccagacctgggtaatgtcagtccattcattattgcgatcaagaatggaggaattcatgtactaccacatatcaccaatgctgttattctcgtttccgttctctctgtaggtaatgcagctgtattcgcagcgtctcgcaatgcaatggcgttggtaaagcaaggatgggcaccacgtttcctaggtcgtgtagatcaaaagggacgtcccgtaatttcatacttgtgttcgctagccatggcttgtattgcttacgttaatgctgcacctgacggttctgttgtgttcgactggctaatgtctgtctcgggtggaggagccttcgtaatttggggactttcttttatcgatcacatccgtttgcgatatgcaatgaaggctcagaaaattccagacactgtcttaccatataagtttcctggaagcgtttatcttagctactatggagtccttatcaattttttagcactctgtgcacttgtatacatttcgattttcccagtaacacatgagaagccgagtgcatacggcttctttgtttcatttttaggaccgtctgtttttatcgcttatcttctgattagtccgattttcgtgaagccaacgtttcaatccctaaaggatgtagaccttacaacgggccgttatgatttggtaaattcacaaatgtatgtagctgagtcgagcacttcggaattaagtgaaaaagatctaaccaagccaaacctccaaagcaatgataataaaaatagtgaagatctcgaaagcaatactcctccacaaaagaaaagcgcgttacagaaagttgccgacttcctttgctag

SEQ ID NO: 8509 - protein, 594 aa, Schizosaccharomyces pombe
MTSFTESKKLDEIESPVPEIIVPSTTNGNGTIESYKEKSVGTSFLDFFRSYKLRPDNEFAEVHNSEDFLKPRHLQMIAIGSCIGTGLFVSTGKSLKNAGPGSLMINFIILSAMILALILSLGEMCCFLPNQSSITMYTGRLLNNNIGFAQSWLYFWIWLTVLPSEISAACEVVDFWTTQHLNPAIWVTIFLAYVVLVNAFGARSYGECEFVSSFLKVVIVIIFFFVAIIINCGAAPKGGYIGAHYWHHPGSFRNGFKGFCSVFISSAYSLSGTENIGTAAGNTSNPQRAIPSAVKKVFYRMGFFYIITIFLITLVVPYDNPDLGNVSPFIIAIKNGGIHVLPHITNAVILVSVLSVGNAAVFAASRNAMALVKQGWAPRFLGRVDQKGRPVISYLCSLAMACIAYVNAAPDGSVVFDWLMSVSGGGAFVIWGLSFIDHIRLRYAMKAQKIPDTVLPYKFPGSVYLSYYGVLINFLALCALVYISIFPVTHEKPSAYGFFVSFLGPSVFIAYLLISPIFVKPTFQSLKDVDLTTGRYDLVNSQMYVAESSTSELSEKDLTKPNLQSNDNKNSEDLESNTPPQKKSALQKVADFLC

SEQ ID NO: 8510 - DNA, 1788 bp, Saccharomyces cerevisiae
  CDS (1)..(1788)
atgtcgtcgtcgaagtctctatacgaactgaaagacttgaaaaatagctccacagaaatacatgccacggggcaggataatgaaattgaatatttcgaaacaggctccaatgaccgtccatcctcacaacctcatttaggttacgaacagcataacacttctgccgtgcgtaggtttttcgactcctttaaaagagcggatcagggtccacaggatgaagtagaagcaacacaaatgaacgatcttacgtcggctatctcaccttcttctagacaggctcaagaactagaaaaaaatgaaagttcggacaacataggcgctaatacaggtcataagtcggactcgctgaagaaaaccattcagcctagacatgttctgatgattgcgttgggtacgggtatcggtactgggttattggtcggtaacggtaccgcgttggttcatgcgggtccagctggactacttattggttacgctattatgggttctatcttgtactgtattattcaagcatgtggtgaaatggcgctagtgtatagtaacttgactggtggctacaatgcataccccagtttccttgtggatgatggttttgggtttgcagtcgcttgggtttattgtttgcaatggctgtgtgtgtgtcctctggaattggtgaccgcatccatgactatcaaatattggacgacatctgtgaacccggatgtgttcgtcattattttctatgttttggtgattactattaatattttcggtgctcgtggttatgcagaagctgagttcttcttcaactgttgcaaaattttgatgatgactgggttcttcattcttggtattatcatcgatgttggtggcgctggtaatgatggttttattggtggtaaatactggcacgatccgggcgctttcaatggtaaacatgccattgacagatttaaaggtgttgctgcaacattagtgactgctgcttttgcctttggtggttcagagtttattgccatcaccactgcagaacaatctaatccaagaaaggccattccaggtgcggccaaacaaatgatctacagaatcttattcctattcttggctaccattattctactgggtttcttggtgccatacaattccgatcaattattgggttctaccggtggtggtactaaagcctcgccatatgtcattgctgttgcatcccacggtgtccgtgtcgtcccacacttcattaacgccgttattctactttccgtgctgtccatggctaactcctccttctactccagtgctcgtttatttttaactctatccgagcaaggttacgctcctaaggttttctcctacatcgacagagccggtagaccattgattgccatgggtgtttctgcattgtttgccgttattgccttctgtgctgcatctcccaaggaagaacaagttttcacttggttattggccatttctggtttgtctcagcttttcacatggactgccatttgtttatcccatcttagatttagaagagccatgaaagtccaagggagatctcttggagaattgggtttcaaatctcaaactggtgtttggggatctgcctacgcttgcattatgatgattttaattcttattgcccaattttgggtcgctatcgcccccattggtgaaggtaagctggatgcacaagcctttttcgaaaactacttggctatgccaatcttgattgcactttatgtcggctacaaggtctggcacaaggattggaaactgttcatcagggagacaagatcgacctag

SEQ ID NO: 8511 - protein, 595 aa, Saccharomyces cerevisiae
MSSSKSLYELKDLKNSSTEIHATGQDNEIEYFETGSNDRPSSQPHLGYEQHNTSAVRRFFDSFKRADQGPQDEVEATQMNDLTSAISPSSRQAQELEKNESSDNIGANTGHKSDSLKKTIQPRHVLMIALGTGIGTGLLVGNGTALVHAGPAGLLIGYAIMGSILYCIIQACGEMALVYSNLTGGYNAYPSFLVDDGFGFAVAWVYCLQWLCVCPLELVTASMTIKYWTTSVNPDVFVIIFYVLVITINIFGARGYAEAEFFFNCCKILMMTGFFILGIIIDVGGAGNDGFIGGKYWHDPGAFNGKHAIDRFKGVAATLVTAAFAFGGSEFIAITTAEQSNPRKAIPGAAKQMIYRILFLFLATIILLGFLVPYNSDQLLGSTGGGTKASPYVIAVASHGVRVVPHFINAVILLSVLSMANSSFYSSARLFLTLSEQGYAPKVFSYIDRAGRPLIAMGVSALFAVIAFCAASPKEEQVFTWLLAISGLSQLFTWTAICLSHLRFRRAMKVQGRSLGELGFKSQTGVWGSAYACIMMILILIAQFWVAIAPIGEGKLDAQAFFENYLAMPILIALYVGYKVWHKDWKLFIRETRST

SEQ ID NO: 8512 - DNA, 1722 bp, Saccharomyces cerevisiae
  CDS (1)..(1722)
atggatgaaactgtgaacatacaaatgtccaaggaaggtcagtatgaaatcaattctagctctataataaaagaggaggagtttgtagatgaacaatattctggggagaacgttacgaaggccatcaccacagagagaaaagtcgaggatgatgctgctaaggaaacagagagctcaccacaagaaagaagagaggtgaagcggaagttaaagcagcggcatatagggatgattgctctcggcggcaccattgggacgggcctcataattggtattggtccgccattggcacacgccggccctgttggtgccttgatatcgtatttatttatggggacagtgatttactccgttacacaatcgttaggagagatggtcacttttatcccggttacatcttcattttctgtcttcgcccaaagatttctgtcgccagcgctgggagcgactaacggatatatgtactggctgtcgtggtgtttcaccttcgcactggaactatccgttttggggaaagttattcagtactggacagaagcagtgcctctagcggcttggatcgtgatcttttggtgcctgttaacttcaatgaacatgtttcccgtaaagtattacggagaatttgagttttgtattgcctccataaaggtcatcgcgttgctcggttttatcattttctcattctgtgttgtgtgtggtgcgggacaatctgatggacccatcggtttcaggtactggagaaatccaggagcctgggggcctggcattatctccagtgataaaaatgagggccgttttctcggatgggtttcctctttgattaatgctgcatttacgtaccaaggtactgaactggttgggataaccgctggtgaagcggctaacccaagaaaagctctcccgagggcaataaagaaagttgtagtgaggattctagtcttttacattctttcactatttttcattggccttttggtcccatataatgacccaaagttggatagtgacggtatatttgtctcttcatcgccctttatgataagcattgagaattcaggcacaaaagttctcccagatatatttaacgcggtcgtgctaatcaccattctttccgcaggtaactctaatgtgtacattggctcaagagtactgtatagtctgtctaaaaatagcttggcgccaaggttcttgtctaacgtgaccagaggtggtgttccatacttttctgttctatctacatccgtgttcggatttttggctttcttagaggtttctgcaggcagcggcaaggcctttaactggttattgaacataactggtgtggccggtttctttgcctggcttttgatttcattttctcatatccgtttcatgcaagccataaggaaacgtggtatatcgagggatgacttaccttataaagctcaaatgatgccttttttggcatattatgcatcttttttcatcgctctaattgttctgatccagggcttcaccgctttcgcacctacttttcagcctatagactttgtcgctgcatatatatcaatattcctatttttggccatatggttatcattccaagtttggtttaagtgccgcttactctggaagctgcaggatatcgatatcgattctgaccgccggcaaatagaggagttggtatggatagagccagaatgtaaaacaaggtggcaacgagtttgggatgtcctttcataa

SEQ ID NO: 8513 - protein, 573 aa, Saccharomyces cerevisiae
MDETVNIQMSKEGQYEINSSSIIKEEEFVDEQYSGENVTKAITTERKVEDDAAKETESSPQERREVKRKLKQRHIGMIALGGTIGTGLIIGIGPPLAHAGPVGALISYLFMGTVIYSVTQSLGEMVTFIPVTSSFSVFAQRFLSPALGATNGYMYWLSWCFTFALELSVLGKVIQYWTEAVPLAAWIVIFWCLLTSMNMFPVKYYGEFEFCIASIKVIALLGFIIFSFCVVCGAGQSDGPIGFRYWRNPGAWGPGIISSDKNEGRFLGWVSSLINAAFTYQGTELVGITAGEAANPRKALPRAIKKVVVRILVFYILSLFFIGLLVPYNDPKLDSDGIFVSSSPFMISIENSGTKVLPDIFNAVVLITILSAGNSNVYIGSRVLYSLSKNSLAPRFLSNVTRGGVPYFSVLSTSVFGFLAFLEVSAGSGKAFNWLLNITGVAGFFAWLLISFSHIRFMQAIRKRGISRDDLPYKAQMMPFLAYYASFFIALIVLIQGFTAFAPTFQPIDFVAAYISIFLFLAIWLSFQVWFKCRLLWKLQDIDIDSDRRQIEELVWIEPECKTRWQRVWDVLS

SEQ ID NO: 8514 - DNA, 1830 bp, Saccharomyces cerevisiae
  CDS (1)..(1830)
atgctatcttcagaagattttggatcttctgggaaaaaggaaacttctcctgattcgatatcgatacgttcctttagtgccgggaataatttccaatcatcatcaagtgagaaaacttattctaagcaaaaatccgggagtgacaaacttatacatagatttgcggattcattcaaaagagccgagggtagcactacaagaactaagcaaataaatgaaaatacgtctgatttagaggatggcgttgagtctatcacgtcggattccaagttgaaaaagtccatgaagtcgcgccatgttgtcatgatgtctttagggacaggtattgggactggtcttttggtagctaatgcaaaaggtctacattacggtggtcctgctgcgctaataattggttacatcttggtttctttcgagacgtacttcatgatccaagctgcaggtgagatggcggtaacctatccgactttaccagcaaatttcaacgcatactcctccatattcatttccaaatcatttggattcgccacagtatggctttactgtttccaatggctaacggttttgcctttagagttaataaccgcgtctatgactattcaatttgggaatgataaaataaatccggacatttatattcttattttctatgttttcttagtattcattcatttcttcggtgtaaaagcctatggtgaaacggaattcatcttcaattgctgtaaaattttaatgattgcaggtttcattattctttctattgttatcaactgtggtggggccggaaatgacggttatatcggggccacttattggcataatccaggtgcttttgcaggtgacacatcgattggtaggttcaaaaacgtttgctatattttagttactgcttacttctcctttggtggtatggaattatttgcactaagtgttcaggaacagtctaaccctagaaaatctactccggtggcagccaagagaagcatttatcgtatcgttgtgatttatcttttgactatgatcctcattggattcaatgttccatataatgatgaccaactaatgggcgcaggcggatccgctacacatgcatctccctatgtcttagccgcttctattcacggtgtgaaaattgttccacatattatcaacgctgttattttgatttctgtggtttcagtggcaaattcctctttgtatgctggtccaagactgatttgctctttggcccaacaaggctacgcacccaagtttttagattacgttgacagagagggcaggcccttgagagctcttattgtgtgttgcgttttcggcgtcattgcttttgttgcagcttcatcaaaggaagagatcgtgtttacatggttagcagctatcgcaggcttgagtgaattattcacatggacttccataatgttgtcccatctgcgattcagacaagcaatgaaagtacagggaaggtctctagacgagttgggatacaaggccacaacagggatttggggttccatatacggtgtcttttttaatattttagtctttgttgcccaattttgggtagcattggcccccttaggtaatgggggcaaatgcgatgcggaatccttctttcaaaattatttagcttttccaatatggttggccttttacttcggatatatggtttacaaccgagattttacgctattaaatcccctcgacaagattgaccttgacttccacagacgcatttatgatccagagctaatgagacaagaggacgaagaaaataaagaaaaactaaggaatatgtctttgatgagaaaagcttatcatttctggtgttaa

SEQ ID NO: 8515 - protein, 609 aa, Saccharomyces cerevisiae
MLSSEDFGSSGKKETSPDSISIRSFSAGNNFQSSSSEKTYSKQKSGSDKLIHRFADSFKRAEGSTTRTKQINENTSDLEDGVESITSDSKLKKSMKSRHVVMMSLGTGIGTGLLVANAKGLHYGGPAALIIGYILVSFETYFMIQAAGEMAVTYPTLPANFNAYSSIFISKSFGFATVWLYCFQWLTVLPLELITASMTIQFGNDKINPDIYILIFYVFLVFIHFFGVKAYGETEFIFNCCKILMIAGFIILSIVINCGGAGNDGYIGATYWHNPGAFAGDTSIGRFKNVCYILVTAYFSFGGMELFALSVQEQSNPRKSTPVAAKRSIYRIVVIYLLTMILIGFNVPYNDDQLMGAGGSATHASPYVLAASIHGVKIVPHIINAVILISVVSVANSSLYAGPRLICSLAQQGYAPKFLDYVDREGRPLRALIVCCVFGVIAFVAASSKEEIVFTWLAAIAGLSELFTWTSIMLSHLRFRQAMKVQGRSLDELGYKATTGIWGSIYGVFFNILVFVAQFWVALAPLGNGGKCDAESFFQNYLAFPIWLAFYFGYMVYNRDFTLLNPLDKIDLDFHRRIYDPELMRQEDEENKEKLRNMSLMRKAYHFWC

SEQ ID NO: 8516 - DNA, 1815 bp, Saccharomyces cerevisiae
  CDS (1)..(1815)
atgtcagatcctatagtaacgtcttccaaaatggaaaaaagtgcagagtttgaagtaacagactctgctttatataataacttcaatacatcaacaacagcttcactaactccggagattaaggaacattctgaggaatctcgcaatgggttagttcacagattcgtcgactcattcagaagagccgaaagccaacgtttagaagaagacaatgacttggaggatggtaccaaatcgatgaaatctaataaccacttaaaaaagtcaatgaaatctagacatgttgtaatgatgtctttaggtacagggataggaacaggtcttctagttgccaacgccaaaggtttgagtcttgcaggcccggggtctttagtcatcggttacgttatggtgtccttcgtcacgtattttatggtccaagcggctggtgagatgggtgtcacttatccgacgcttccaggtaacttcaatgcatacaattcaatctttatttcaaagtcgtttgggttcgcgaccacttggttattttgcattcagtggttaactgtgctaccgttggaattgattacttcttccatgaccgtcaagtactggaatgacacaattaatgctgatgtattcattgtcattttctatgtgtttttattgtttatccacttttttggtgttaaggcatacggtgaaacggaatttatcttcaattcctgtaagatattgatggttgcaggattcattattttatcagtcgtcatcaattgtgggggagccggtgtggacggctatattggcggcaaatattggcgcgaccctggttcatttgcagaaggcagcggtgccactcgtttcaaagggatatgttatattctagtatctgcatatttctccttcggtggtattgaattatttgttctttccatcaatgagcagtctaaccctagaaaatccactcctgtagccgcgaagagaagtgtatatcgtattttgatcatttatttgctgacaatgattctaattgggttcaatgttcctcacaataacgatcaattgatgggttccggtggctccgcaacgcacgcttcaccatatgtcttggcagcctctattcacaaggttagggtcatcccccatatcattaatgctgttattttgatatcagtcatctctgttgcgaactctgccctttatgccgcaccgagattaatgtgttccttggctcaacagggctatgctccaaaatttttgaactatattgatagggagggaagacctttaagggccttggtagtgtgctctcttgttggtgtcgttggcttcgtcgcctgttctccacaggaagagcaagcatttacatggttggcagccattgcaggtttgagtgaacttttcacatggtcaggcattatgctttcacacattcgattcagaaaagcgatgaaagtccaaggaagatcacttgatgaagtcggctataaggccaataccggtatatggggttcatactatggggtttttttcaatatgcttgtctttatggcccaattttgggtcgcactgtctccaataggaaatggcggaaagtgtgatgctcaggcattcttcgagagttatctggctgccccgctatggatattcatgtatgttggatacatggtttacaaaagagattttacctttttaaacccactggacaagatcgacttggactttcatagaagagtttacgaccctgaaataatgaggcaggaggacgaagaaaataaagaaaggttaaagaactcttcaatattcgtcagagtctacaaattttggtgttag

SEQ ID NO: 8517 - protein, 604 aa, Saccharomyces cerevisiae
MSDPIVTSSKMEKSAEFEVTDSALYNNFNTSTTASLTPEIKEHSEESRNGLVHRFVDSFRRAESQRLEEDNDLEDGTKSMKSNNHLKKSMKSRHVVMMSLGTGIGTGLLVANAKGLSLAGPGSLVIGYVMVSFVTYFMVQAAGEMGVTYPTLPGNFNAYNSIFISKSFGFATTWLFCIQWLTVLPLELITSSMTVKYWNDTINADVFIVIFYVFLLFIHFFGVKAYGETEFIFNSCKILMVAGFIILSVVINCGGAGVDGYIGGKYWRDPGSFAEGSGATRFKGICYILVSAYFSFGGIELFVLSINEQSNPRKSTPVAAKRSVYRILIIYLLTMILIGFNVPHNNDQLMGSGGSATHASPYVLAASIHKVRVIPHIINAVILISVISVANSALYAAPRLMCSLAQQGYAPKFLNYIDREGRPLRALVVCSLVGVVGFVACSPQEEQAFTWLAAIAGLSELFTWSGIMLSHIRFRKAMKVQGRSLDEVGYKANTGIWGSYYGVFFNMLVFMAQFWVALSPIGNGGKCDAQAFFESYLAAPLWIFMYVGYMVYKRDFTFLNPLDKIDLDFHRRVYDPEIMRQEDEENKERLKNSSIFVRVYKFWC

SEQ ID NO: 8518 - DNA, 1773 bp, Saccharomyces cerevisiae
  CDS (1)..(1773)
atgacaaattcaaaagaagacgccgacatagaggagaagcatatgtacaatgagccggtcacaaccctctttcacgacgttgaagcttcacaaacacaccacagacgtgggtcaataccattgaaagatgagaaaagtaaagaattgtatccattgcgctctttcccgacgagagtaaatggcgaggatacgttctctatggaggatggcataggtgatgaagatgaaggagaagtacagaacgctgaagtgaagagagagcttaagcaaagacatattggtatgattgcccttggtggtactattggtacaggtcttttcattggtttatccacacctctgaccaacgccggcccagtgggcgctcttatatcatatttatttatgggttctttggcatattctgtcacgcagtccttgggtgaaatggctacattcatccctgttacatcctctttcacagttttctcacaaagattcctttctccagcatttggtgcggccaatggttacatgtattggttttcttgggcaatcacttttgccctggaacttagtgtagttggccaagtcattcaattttggacgtacaaagttccactggcggcatggattagtattttttgggtaattatcacaataatgaacttgttccctgtcaaatattacggtgaattcgagttctgggtcgcttccatcaaagttttagccattatcgggtttctaatatactgtttttgtatggtttgtggtgctggggttaccggcccagttggattccgttattggagaaacccaggtgcctggggtccaggtataatatctaaggataaaaacgaagggaggttcttaggttgggtttcctctttgattaacgctgccttcacatttcaaggtactgaactagttggtatcactgctggtgaagctgcaaaccccagaaaatccgttccaagagccatcaaaaaagttgttttccgtatcttaaccttctacattggctctctattattcattggacttttagttccatacaatgaccctaaactaacacaatctacttcctacgtttctacttctccctttattattgctattgagaactctggtacaaaggttttgccacatatcttcaacgctgttatcttaacaaccattatttctgccgcaaattcaaatatttacgttggttcccgtattttatttggtctatcaaagaacaagttggctcctaaattcctgtcaaggaccaccaaaggtggtgttccatacattgcagttttcgttactgctgcatttggcgctttggcttacatggagacatctactggtggtgacaaagttttcgaatggctattaaatatcactggtgttgcaggcttttttgcatggttatttatctcaatctcgcacatcagatttatgcaagctttgaaataccgtggcatctctcgtgacgagttaccatttaaagctaaattaatgcccggcttggcttattatgcggccacatttatgacgatcattatcattattcaaggtttcacggcttttgcaccaaaattcaatggtgttagctttgctgccgcctatatctctattttcctgttcttagctgtttggatcttatttcaatgcatattcagatgcagatttatttggaagattggagatgtcgacatcgattccgatagaagagacattgaggcaattgtatgggaagatcatgaaccaaagactttttgggacaaattttggaatgttgtagcatag

SEQ ID NO: 8519 - protein, 590 aa, Saccharomyces cerevisiae
MTNSKEDADIEEKHMYNEPVTTLFHDVEASQTHHRRGSIPLKDEKSKELYPLRSFPTRVNGEDTFSMEDGIGDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAITFALELSVVGQVIQFWTYKVPLAAWISIFWVIITIMNLFPVKYYGEFEFWVASIKVLAIIGFLIYCFCMVCGAGVTGPVGFRYWRNPGAWGPGIISKDKNEGRFLGWVSSLINAAFTFQGTELVGITAGEAANPRKSVPRAIKKVVFRILTFYIGSLLFIGLLVPYNDPKLTQSTSYVSTSPFIIAIENSGTKVLPHIFNAVILTTIISAANSNIYVGSRILFGLSKNKLAPKFLSRTTKGGVPYIAVFVTAAFGALAYMETSTGGDKVFEWLLNITGVAGFFAWLFISISHIRFMQALKYRGISRDELPFKAKLMPGLAYYAATFMTIIIIIQGFTAFAPKFNGVSFAAAYISIFLFLAVWILFQCIFRCRFIWKIGDVDIDSDRRDIEAIVWEDHEPKTFWDKFWNVVA

SEQ ID NO: 8520 - DNA, 1827 bp, Saccharomyces cerevisiae
  CDS (1)..(1827)
atgaagatgcctctaaagaagatgtttaccagcacgtctcctcgtaactcttcttctcttgacagtgatcatgacgcttactattcgaaacaaaatcctgacaatttccctgtaaaggagcaagaaatctataacattgacctggaagaaaacaatgtgtcctctcgttcatccacctctacatcaccttcagcaagggacgactctttcgcagttccagatggtaaagacgaaaacacgcggttgaggaaagatttaaaggcaagacatatttctatgatcgccattggtggttcattaggtacaggtctgcttataggtacaggtaccgccttattgacgggtggtccggttgcgatgttaattgcatatgcctttgtcggccttttagtcttttacaccatggcctgtcttggtgaaatggcttcttacattccattggatggttttacaagttatgcctcacgttacgtggatcctgcattaggttttgctattggttatacttaccttttcaaatatttcatcttacctcccaaccaacttactgctgctgctttggtcattcaatattggatcagcagagaccgtgttaaccctggtgtgtggattactatattcttggttgttattgtcgctatcaatgtcgtcggtgtaaaattctttggtgaatttgaattttggttgtccagtttcaaagtcatggtaatgttgggtctaatcctgttactatttattattatgcttggtggaggtcctaaccatgaccgcctagggtttagatactggcgtgatcctggtgcgttcaaagaatattcgacggctatcactggtggtaaaggtaaatttgtttcgttcgttgctgttttcgtttacagtcttttcagttacacgggtattgaattgacaggtatcgtttgttctgaagctgagaatccaagaaaaagtgttccaaaggcaattaaattgacagtttaccgtatcattgttttttacctatgcaccgttttccttttgggtatgtgcgttgcatacaatgaccctcgtttactttccacaaaaggtaagagtatgtctgctgcggcatctccattcgtggttgccattcaaaactcaggtattgaagtcttacctcatatcttcaatgcttgtgtcttggttttcgttttcagtgcttgtaactcagatttgtacgtttcttccagaaatttatatgcgttggcaattgatggtaaagcgccaaagatcttcgctaagacaagtagatggggtgttccttacaatgctttaatactctccgtgctgttttgtggcttggcgtacatgaatgtgtcttcaggatcagcaaagattttcaactactttgttaacgttgtttctatgttcggaatcttgagttggatcaccattttaattgtttacatctacttcgataaagcctgccgtgctcaagggattgacaaatcaaaatttgcttatgtcgctcctggccaacgttatggtgcttattttgctttattcttctgcattttgattgctttaatcaaaaacttcactgttttcctaggtcataaatttgattataaaacattcatcaccgggtatattggcctgcctgtctatatcatttcttgggctggttacaaattgatatacaaaaccaaagtgataaagtctaccgacgtggatttgtacacatttaaggaaatatacgatagagaagaagaagagggaagaatgaaggaccaagaaaaggaagagcgtttaaaaagtaacggtaaaaatatggagtggttctatgaaaaatttttgggtaatatcttctag

SEQ ID NO: 8521 - protein, 608 aa, Saccharomyces cerevisiae
MKMPLKKMFTSTSPRNSSSLDSDHDAYYSKQNPDNFPVKEQEIYNIDLEENNVSSRSSTSTSPSARDDSFAVPDGKDENTRLRKDLKARHISMIAIGGSLGTGLLIGTGTALLTGGPVAMLIAYAFVGLLVFYTMACLGEMASYIPLDGFTSYASRYVDPALGFAIGYTYLFKYFILPPNQLTAAALVIQYWISRDRVNPGVWITIFLVVIVAINVVGVKFFGEFEFWLSSFKVMVMLGLILLLFIIMLGGGPNHDRLGFRYWRDPGAFKEYSTAITGGKGKFVSFVAVFVYSLFSYTGIELTGIVCSEAENPRKSVPKAIKLTVYRIIVFYLCTVFLLGMCVAYNDPRLLSTKGKSMSAAASPFVVAIQNSGIEVLPHIFNACVLVFVFSACNSDLYVSSRNLYALAIDGKAPKIFAKTSRWGVPYNALILSVLFCGLAYMNVSSGSAKIFNYFVNVVSMFGILSWITILIVYIYFDKACRAQGIDKSKFAYVAPGQRYGAYFALFFCILIALIKNFTVFLGHKFDYKTFITGYIGLPVYIISWAGYKLIYKTKVIKSTDVDLYTFKEIYDREEEEGRMKDQEKEERLKSNGKNMEWFYEKFLGNIF

SEQ ID NO: 8522 - DNA, 1809 bp, Saccharomyces cerevisiae
  CDS (1)..(1809)
atgagtaatacttcttcgtacgagaagaataatccagataatctgaaacacaatggtattaccatagattctgagtttctaactcaggagccaataaccattccctcaaatggctccgctgtttctattgacgaaacaggttcagggtccaaatggcaagactttaaagattctttcaaaagggtaaaacctattgaagttgatcctaatctttcagaagctgaaaaagtggctatcatcactgcccaaactccattgaagcaccacttgaagaatagacatttgcaaatgattgccatcggtggtgccatcggtactggtctgctggttgggtcaggtactgcactaagaacaggtggtcccgcttcgctactgattggatgggggtctacaggtaccatgatttacgctatggttatggctctgggtgagttggctgttatcttccctatttcgggtgggttcaccacgtacgctaccagatttattgatgagtcctttggttacgctaataatttcaattatatgttacaatggttggttgtgctaccattggaaattgtctctgcatctattactgtaaatttctggggtacagatccaaagtatagagatgggtttgttgcgttgttttggcttgcaattgttatcatcaatatgtttggtgtcaaaggttatggtgaagcagaattcgtcttttcatttatcaaggtcatcactgttgttgggttcatcatcttaggtatcattctaaactgtggtggtggtccaacaggtggttacattgggggcaagtactggcatgatcctggtgcctttgctggtgacactccaggtgctaaattcaaaggtgtttgttctgtcttcgtcaccgctgccttttcttttgccggttcagaattggttggtcttgctgccagtgaatccgtagagcctagaaagtccgttcctaaggctgctaaacaagttttctggagaatcaccctattttatattctgtcgctattaatgattggtcttttagtcccatacaacgataaaagtttgattggtgcctcctctgtggatgctgctgcttcacccttcgtcattgccattaagactcacggtatcaagggtttgccaagtgttgtcaacgtcgttatcttgattgccgtgttatctgtcggtaactctgccatttatgcatgttccagaacaatggttgccctagctgaacagagatttctgccagaaatcttttcctacgttgaccgtaagggtagaccattggtgggaattgctgtcacatctgcattcggtcttattgcgtttgttgccgcctccaaaaaggaaggtgaagttttcaactggttactagccttgtctgggttgtcatctctattcacatggggtggtatctgtatttgtcacattcgtttcagaaaggcattggccgcccaaggaagaggcttggatgaattgtctttcaagtctcctaccggtgtttggggttcctactgggggttatttatggttattattatgttcattgcccaattctacgttgctgtattccccgtgggagattctccaagtgcggaaggtttcttcgaagcttatctatccttcccacttgttatggttatgtacatcggacacaagatctataagaggaattggaagcttttcatcccagcagaaaagatggacattgatacgggtagaagagaagtcgatttagatttgttgaaacaagaaattgcagaagaaaaggcaattatggccacaaagccaagatggtatagaatctggaatttctggtgttaa

SEQ ID NO: 8523 - protein, 602 aa, Saccharomyces cerevisiae
MSNTSSYEKNNPDNLKHNGITIDSEFLTQEPITIPSNGSAVSIDETGSGSKWQDFKDSFKRVKPIEVDPNLSEAEKVAIITAQTPLKHHLKNRHLQMIAIGGAIGTGLLVGSGTALRTGGPASLLIGWGSTGTMIYAMVMALGELAVIFPISGGFTTYATRFIDESFGYANNFNYMLQWLVVLPLEIVSASITVNFWGTDPKYRDGFVALFWLAIVIINMFGVKGYGEAEFVFSFIKVITVVGFIILGIILNCGGGPTGGYIGGKYWHDPGAFAGDTPGAKFKGVCSVFVTAAFSFAGSELVGLAASESVEPRKSVPKAAKQVFWRITLFYILSLLMIGLLVPYNDKSLIGASSVDAAASPFVIAIKTHGIKGLPSVVNVVILIAVLSVGNSAIYACSRTMVALAEQRFLPEIFSYVDRKGRPLVGIAVTSAFGLIAFVAASKKEGEVFNWLLALSGLSSLFTWGGICICHIRFRKALAAQGRGLDELSFKSPTGVWGSYWGLFMVIIMFIAQFYVAVFPVGDSPSAEGFFEAYLSFPLVMVMYIGHKIYKRNWKLFIPAEKMDIDTGRREVDLDLLKQEIAEEKAIMATKPRWYRIWNFWC

SEQ ID NO: 8524 - DNA, 1722 bp, Trichoderma atroviride
  CDS (1)..(1722)
atgtcgaaagaggagagtggccatgtcactcccgagaagggcgacaatgtcgtcgactatcaggccagcacgacagtcctccccagcgagggccctgagcgcgacgccaactggttcacgcgcaatggcctcaacgtcgactccttcaagaagaagcactatggcccgggcatggtcgagcttgagcgtcccatgaaggctcgccatcttcacatgattgccattggtggttccattggtgctggtttcttcgtcggctcgggcggtgctctggccaaaggtggccctggttctctctttgtcgacttcctcattatcggtatcatgatgttcaacgtcgtgtacgctctcggtgaactcgccatcatgtaccccgtctctggttctttctacacatactctgctcgtttcatcgaccctgcctggggtttcgccatgggctggaactatgttcttcagtgggctgccgttcttccgcttgaattgacagtttgtggtattacgatatcgtactggaactcggaaatcaccacagccgcttggatctctctcttcctcggcgtcatcatcatcatcaacctgtttggcgctctcggctatgctgaagaggagttttgggcatcgtgcttcaagctggctgccaccgtcatcttcatgatcatcgcttttgtccttgtcctcggtggtggtcccaaggatggccgataccacgagtactggggtgcccgctactggtacgacccgggcgcgttcaagaacggcttcaagggcttctgctccgtcttcgtcaccgctgccttctccttctccggtactgagctggtcggtcttgccgctgccgagtctactaaccccaccaagaacatgcccggtgctatcaagcaggtcttctggcgtatcaccatcttttacatcctcggtctcttctttgtcggcctgctgatcaacagcgatgatcccgctctgctctcctctgccgcctacgctgactccaaggcctctccctttgtgcttgtcggcaagtacgctggcttgaagggtttcgaccacttcatgaacctcgtcattctcgcctccgtcttgtccatcggtgtctctggtgtgtatggtggatctcgaaccctgaccgctctggctcagcagggctatgctcccaagctcttcacctacattgacaagtctggccgtcccctgccctctgtcatcttcctcatcctgttcggcttcatcgcctatgtcagcttggatgccaccggtcccgttgtctttgactggcttcttgccatttccggcttggccgctctcttcacctggggctctgtctgccttgcccacattcgattccgcaaggcctggaagtaccacggccacactctggatgagattccattcaaggctgctggcggtgtctacggctcatacctcggccttttcatttgcgtcattgtcctgatggctcagttctataccgctattgcagcccctcccggatcaccaggcgttggtaccgcagaggacttcttcaagcagtacctggctgctcccgtcgtcctcggtttctggatcgttggatggctgtggaagcgccagcctttcttgagaaccaagaacattgacgttgacactggtctccgtgagtttgactgggacgagatcaacgcagagcgcacaagaattgctcccctgcctgcctggagacgcatcatccaccacaccttctaa

SEQ ID NO: 8525 - protein, 573 aa, Trichoderma atroviride
MSKEESGHVTPEKGDNVVDYQASTTVLPSEGPERDANWFTRNGLNVDSFKKKHYGPGMVELERPMKARHLHMIAIGGSIGAGFFVGSGGALAKGGPGSLFVDFLIIGIMMFNVVYALGELAIMYPVSGSFYTYSARFIDPAWGFAMGWNYVLQWAAVLPLELTVCGITISYWNSEITTAAWISLFLGVIIIINLFGALGYAEEEFWASCFKLAATVIFMIIAFVLVLGGGPKDGRYHEYWGARYWYDPGAFKNGFKGFCSVFVTAAFSFSGTELVGLAAAESTNPTKNMPGAIKQVFWRITIFYILGLFFVGLLINSDDPALLSSAAYADSKASPFVLVGKYAGLKGFDHFMNLVILASVLSIGVSGVYGGSRTLTALAQQGYAPKLFTYIDKSGRPLPSVIFLILFGFIAYVSLDATGPVVFDWLLAISGLAALFTWGSVCLAHIRFRKAWKYHGHTLDEIPFKAAGGVYGSYLGLFICVIVLMAQFYTAIAAPPGSPGVGTAEDFFKQYLAAPVVLGFWIVGWLWKRQPFLRTKNIDVDTGLREFDWDEINAERTRIAPLPAWRRIIHHTF

SEQ ID NO: 8526 - DNA, 1743 bp, Schizosaccharomyces pombe
  CDS (1)..(1743)
atgaataattacggggtctcttccataggcacaagtcttacccctagtcccactgggtcaatcgacgagtatacttcgaaagaagtgaagcatcccgaagatgtgaaagtggatgccagctatgaaaaggaagaagttggatatggagagctcgaggtggttcccgaaaggggaaacttgtttcagcgttggtatcgttcttttcttcctcctgaagatggaaaacctcaaaaacttaagcgtactcttactgcaagacacattcagatgattggtatcggtggtgcaattggtactggtgtgtgggttggtagtaaaaacacccttcgtgagggtggtgctgcttcggttttaatctgttatagcttggttggatctatggtattgatgactgtatactcattgggtgaattggctgttgcattccccatcaatggtagttttcacacttatggtactcgtttcattcacccctcatggggcttcactcttggttggaattatttggcaagtttcctggctacatatccattggaactcatcacggcgtcaatttgtttgcagttttggataaatataaattccggtatttggattactgtgtttatagctttgctgtgcttcgtcaacatgttcggtgtacgaggttatggtgaggtagaattctttgtctcttcccttaaagttatggctatggttggttttatcatctgtggtattgtcatcgactgtggtggtgtaagaaccgaccatcgaggctacattggtgctactatctttagaaaaaatgcctttattcatggatttcatggtttctgctctgtcttttccaccgctgctttctcctatgctggtactgagtatatcggtattgctgcttctgagacaaagaaccctgcaaaagcattcccaaaagctgtcaagcaagtctttattcgtgtttccctattttacatcttagcccttttcgtcgttagtctgttaattagtggacgtgatgaaagattgaccacccttagcgcaactgctgcaagtccctttattttggcccttatggatgccaagattcgtggattgcctcatgtcctgaacgctgttatcttaatttccgtgcttactgcagctaatggtattacttatactggaagtcgtactttgcactccatggctgaacaaggtcatgcaccaaaatggttcaaatatgttgatcgtgaaggtagacctctattagcaatggcatttgttctttgcttcggtgcattgggctacatttgtgaatctgcccaaagtgataccgtctttgactggcttctttccatttccaacttagccactctctttgtatggttgagtattaacgtttcctacataatttacagattggcatttaaaaagcaaggcaagtcatacgacgaagtaggctaccactctcctttcggaatatatggtgcttgctatggagcttttatcattattcttgtttttatcactgagttttacgtatccattttccctattggtgcctctccggatgccggagcattctttcaaagctacctctgtttccctgtagtcgttattgtcttcattgcccatgctttaattacccgccaaaagttccgtaagttatctgaaattgacttggatactggcttcagcaagtacgatcgtttggaagaatcagataagggaccaatgactgccaagagtctcgccaaatccgtcctatctttctgcgtttaa

SEQ ID NO: 8527 - protein, 580 aa, Schizosaccharomyces pombe
MNNYGVSSIGTSLTPSPTGSIDEYTSKEVKHPEDVKVDASYEKEEVGYGELEVVPERGNLFQRWYRSFLPPEDGKPQKLKRTLTARHIQMIGIGGAIGTGVWVGSKNTLREGGAASVLICYSLVGSMVLMTVYSLGELAVAFPINGSFHTYGTRFIHPSWGFTLGWNYLASFLATYPLELITASICLQFWININSGIWITVFIALLCFVNMFGVRGYGEVEFFVSSLKVMAMVGFIICGIVIDCGGVRTDHRGYIGATIFRKNAFIHGFHGFCSVFSTAAFSYAGTEYIGIAASETKNPAKAFPKAVKQVFIRVSLFYILALFVVSLLISGRDERLTTLSATAASPFILALMDAKIRGLPHVLNAVILISVLTAANGITYTGSRTLHSMAEQGHAPKWFKYVDREGRPLLAMAFVLCFGALGYICESAQSDTVFDWLLSISNLATLFVWLSINVSYIIYRLAFKKQGKSYDEVGYHSPFGIYGACYGAFIIILVFITEFYVSIFPIGASPDAGAFFQSYLCFPVVVIVFIAHALITRQKFRKLSEIDLDTGFSKYDRLEESDKGPMTAKSLAKSVLSFCV

SEQ ID NO: 8528 - DNA, 1836 bp, Saccharomyces cerevisiae
  CDS (1)..(1836)
atgggcaggtttagtaacataataacgtccaataaatgggacgagaaacaaaacaacattggcgaacagagcatgcaggaattaccagaagaccagatagaacatgagatggaagcaatagatccaagtaataagacgaccccatactctattgatgagaaacagtacaacacaaaaaagaagcatgggtcattgcaaggtggcgcaattgctgatgtaaattcgataactaattcgttaacaagattgcaagttgtctctcatgaaacagatattaacgaggatgaagaagaagcccactatgaggataaacacgtgaagagagccttgaagcaaagacacattggtatgattgcactaggtggtacaatcggtactggtcttttcgttggtatctccactcccttgagtaatgctggccctgtggggtccctgattgcttacattttcatgggcaccattgtctacttcgttacccagtcacttggtgagatggctacgtttatccccgtgacatcatctatcactgtcttttcgaagaggttcttatcacctgcattcggtgtttctaacggctacatgtactggttcaattgggctattacttatgctgtggaggtttctgtcattggccaagttattgaatactggacagataaagttccattagcggcctggattgcgatattctgggtaattattactttgatgaattttttccctgtcaaagtttatggtgaatttgagttctgggtggcctctgttaaagttttagccattatgggttacttgatatatgctttgattattgtctgcggtggatcccaccagggccctatcggtttcaggtactggagaaatccaggagcctgggggccaggcatcatctccagtgataaaagtgaaggccgttttctcggatgggtctcctccttgattaatgctgcatttacgtaccaaggtactgaactggttgggatcaccgctggtgaagcggctaacccaagaaagaccgttccaagagctatcaataaagtcgtctttagaatcgtactattctatattatgtctttgttctttattggtctactggttccatacaacgattcccgtttatctgctagttctgctgttattgcatcatcacccttcgttatttccattcaaaacgctggtacttatgctcttccagatattttcaacgccgtggtgttgattactgttgtatctgccgctaattcgaatgtttacgttggttcccgtgttctttactctttagctaggactggtaacgcaccaaagcaatttggatacgtcaccagacagggtgttccatatctcggtgttgtttgcactgctgcattgggtcttttggcattcctggttgtcaataacaatgcaaacactgcatttaactggttgatcaacatttccactttggctgggttatgcgcctggttattcatctctttggcacatattaggttcatgcaagctttaaagcaccgtggtatttctcgtgatgatctgcccttcaaggccaaattgatgccttatggtgcctactacgcagccttttttgtcaccgtcatcatattcatccaagggttccaagcgttctgtccgttcaaagtttctgagtttttcacatcttacatctccttgattcttttagccgttgtgttcattggttgccagatatactacaaatgcagatttatttggaagctagaagatattgacatcgattccgacagaagagaaatcgaagcaattatttgggaagacgacgagcctaagaatttatgggagaaattctgggctgctgttgcatag

SEQ ID NO: 8529 - protein, 611 aa, Saccharomyces cerevisiae
MGRFSNIITSNKWDEKQNNIGEQSMQELPEDQIEHEMEAIDPSNKTTPYSIDEKQYNTKKKHGSLQGGAIADVNSITNSLTRLQVVSHETDINEDEEEAHYEDKHVKRALKQRHIGMIALGGTIGTGLFVGISTPLSNAGPVGSLIAYIFMGTIVYFVTQSLGEMATFIPVTSSITVFSKRFLSPAFGVSNGYMYWFNWAITYAVEVSVIGQVIEYWTDKVPLAAWIAIFWVIITLMNFFPVKVYGEFEFWVASVKVLAIMGYLIYALIIVCGGSHQGPIGFRYWRNPGAWGPGIISSDKSEGRFLGWVSSLINAAFTYQGTELVGITAGEAANPRKTVPRAINKVVFRIVLFYIMSLFFIGLLVPYNDSRLSASSAVIASSPFVISIQNAGTYALPDIFNAVVLITVVSAANSNVYVGSRVLYSLARTGNAPKQFGYVTRQGVPYLGVVCTAALGLLAFLVVNNNANTAFNWLINISTLAGLCAWLFISLAHIRFMQALKHRGISRDDLPFKAKLMPYGAYYAAFFVTVIIFIQGFQAFCPFKVSEFFTSYISLILLAVVFIGCQIYYKCRFIWKLEDIDIDSDRREIEAIIWEDDEPKNLWEKFWAAVA

SEQ ID NO: 8530 - DNA, 1725 bp, Schizosaccharomyces pombe
  CDS (1)..(1725)
atgctctccaaattttacgaagacatagattccaaattggaaaatgcaatgttatctcaaatagaaagcagtacaataacttgtgatggtaaatccctaaacacattgcctacccctaaacaagaggatgtcgagtttggcgttcctctgcagccagaagacactcaagatctccaaagaaagctgaagccccggcatatgcaaatgattgccataggaggatgcgttggcactggtctgtttgttggttcgggtaatgcactggccgatggtggtcctgctagtattcttatagccttcgcagtgataggaacttatgttttatttacaaccagcgcgttggcagaactctccgcaatttatcccgtttccggttcattttatacatacttttcgaaattcatcgacccggcatgggggtttgctgttggtatacagtattggttatcttttgccgtgaccgttccattagaacttacagttgccccgttgattattaatttttggaatgcatctggtccggtttcgatttggatttcagttttttacgtaattattatcgcgattaacatttggggaaccgaggggtatggtgaggtggaattttttttgagtatcatgaaagtcatttcagtcatcggttttgtaattctaagcataataattgcagcaggtggagtaccaactgatgatcgaggagtaatcggagtgtcatattggaaacaaccgttggtttttaacaatggattcaaagggttatgcgctgtttctgttatagctattttctccctgtcaggaaccgaactagttggtcttgccgcatcagaagcaaagaatcctcaaaaaacagttcccgcagcagtcaaacaaatattttggcgtattttcttgttctatattgttgctcttttcatgcttactttggtggttccgtctgacctacctgggctacgcacgagcgataactcaaatgtgctaatttcaccattcgttattgccattcaactggcaaatataagggcacttccgagcatcatgaacgtagtaattctgctttccacattatccgtaggaaattcagcttcctatgcggcgtcacgtgccttgtttgctttagcaaagaacggctatgcacctaagatttttaataaaactaacaaacgaggtcatccaatttatgcaattgccgtaacgcttttatttggttctatagcatacttcactgaagctggagttggcggcgcactctttggttggttgttatcaatatgtggtttgtcaacaacatttatatggggaagtatttgcctcgcccatattcaatttagaagagcgtggaaaatacaaaataggaaactagaagatcttccttaccgtagcatttttggagtatatggatctatttatggtgtggccatgacaatattggctttaattgcccaattttatgtcgcggtattcccaattggaaaaaaaccaaatccagtggatttttttcaggcatatatggctgcacccatattaattatcagctttgtggcatggaagttttttagacgtacatcatttgttcgtatcgaaaaaattgatctttcagagggtgcgcatggcgaacagaaacaaaatctcgaacccgtcatcaatatacccgttgaagagatagacttcccaatgaaagtagccaccaaggagagcatgaaaaatgtagagaaaaatgcgttatga

SEQ ID NO: 8531 - protein, 574 aa, Schizosaccharomyces pombe
MLSKFYEDIDSKLENAMLSQIESSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLSVGNSASYAASRALFALAKNGYAPKIFNKTNKRGHPIYAIAVTLLFGSIAYFTEAGVGGALFGWLLSICGLSTTFIWGSICLAHIQFRRAWKIQNRKLEDLPYRSIFGVYGSIYGVAMTILALIAQFYVAVFPIGKKPNPVDFFQAYMAAPILIISFVAWKFFRRTSFVRIEKIDLSEGAHGEQKQNLEPVINIPVEEIDFPMKVATKESMKNVEKNAL

SEQ ID NO: 8532 - DNA, 1752 bp, Saccharomyces cerevisiae
  CDS (1)..(1752)
atggatgaatttgaatctaccaaactttcgaaggttcagttttccactagcgtgttaagtacgccttcgaatgaaggaaataatctaatacacagattcaagaactctttcaagcgaaatgattcaccagcgatccaagaaggtttgctgtattcggagctttcagaggaagaaaaaatacaatgggacttagccaaccagccgtataaaaaggtcctagatcaaagacacctgaccatgatagccattggaggtactctagggacgggtcttttcattggtttaggggaatcactagcgtccggacctgcttctttgctaattggtttcttgttggtcggcgcatctatgctctgtgttgttcagtgtggggccgaactttcatgtcagtaccctgtttccggctcctatgcgctgcacgccagtagatttatagacccatcagtcggcttcagtataggaattaactacttattgatgtggctcatatcttaccctagcgagctggtaggatgttcgcttaccatctcttattgggcaccatcggtcaatcctgctgcctgggttgcaatcgcgttcgttttaagcatgctattgaatctttttggggcaagaggctttgcagaatcagagttttatatgtcaattttcaaaattgtggctctattcatttttataattattggtattgttctcattgcaggtggtgggcctgattctactggatacatcggcacgaagtattggcacgatccaggctccttcgctgttcctgttttcaaaaacctctgcaatacttttgtttcggcagcatactcctttagtggtacagaaatggttgttttaaccagcactgaagcaaggagtgtttcctcagtctctcgggcagcgaaaggtacgttctggagaattatcatcttttatattgttacagtgattataattggttgcctggtcccttataatgatcctcgtctgattagcggttcatccagtgaggatattactgcttccccgtttgttattgccttgagcaatactggtgctatgggaacaagagtgtctcattttatgaatgcggtcatcttgatagccgtattttctgtttgcaattcctgcgtttacgcatcctctagattgattcagggtttggcgacagcaggccaacttccaaagatctgcgcttacatggacaggaatggtcggcctttagttggcatggctatatgtggcgcttttggattgttaggctttttggttgtttccaagaaccagggtacagttttcacatggttgtttgcgttgtgttccatttcatttttcacaacttggttctgtatttgcttctgtcaagtcagatttaggatggcaatgaaagctcaaggaaggtcaaaggatgacattatctatagatcgacattagggatatacggaggaattttcggctgtatcttaaatgttctattggtaattggagaaatatatgtatcggctgcacccgtgggtagtcccagttctgctgctaatttctttgaatattgtatgagtattcccataatgattgctgtatatattggccatagaatttaccgcagagactggagacactggtacatcaagcggatggatattgacctcgatagcggacattcgttagaggacttcgaagccaccaagcttgagagggatgaggataagaaatacgtttcctctaagccactttactataggatctatcggtttttctgttaa

SEQ ID NO: 8533 - protein, 583 aa, Saccharomyces cerevisiae
MDEFESTKLSKVQFSTSVLSTPSNEGNNLIHRFKNSFKRNDSPAIQEGLLYSELSEEEKIQWDLANQPYKKVLDQRHLTMIAIGGTLGTGLFIGLGESLASGPASLLIGFLLVGASMLCVVQCGAELSCQYPVSGSYALHASRFIDPSVGFSIGINYLLMWLISYPSELVGCSLTISYWAPSVNPAAWVAIAFVLSMLLNLFGARGFAESEFYMSIFKIVALFIFIIIGIVLIAGGGPDSTGYIGTKYWHDPGSFAVPVFKNLCNTFVSAAYSFSGTEMVVLTSTEARSVSSVSRAAKGTFWRIIIFYIVTVIIIGCLVPYNDPRLISGSSSEDITASPFVIALSNTGAMGTRVSHFMNAVILIAVFSVCNSCVYASSRLIQGLATAGQLPKICAYMDRNGRPLVGMAICGAFGLLGFLVVSKNQGTVFTWLFALCSISFFTTWFCICFCQVRFRMAMKAQGRSKDDIIYRSTLGIYGGIFGCILNVLLVIGEIYVSAAPVGSPSSAANFFEYCMSIPIMIAVYIGHRIYRRDWRHWYIKRMDIDLDSGHSLEDFEATKLERDEDKKYVSSKPLYYRIYRFFC

SEQ ID NO: 8534 - DNA, 1659 bp, Schizosaccharomyces pombe
  CDS (1)..(1659)
atggatgaaaaaaaggcgttgcagtatgaagaaagtaagagggccgaagagattactgatattgaattggtctctgttggtggcatcgacgttgaaaagaagtacggagaaactaaacgtgctttgaaatctcggcacgtacagttaattgccatcggaggatgtattggtactggtcttttcgttggatctggttctgcgctttcagaatctggccctgcttcattatttttatcatatgtgattatgtcttttgtgatttggacagttatgaatgccttgggagaaatgtgtacttatctaccattaagtggtgcgtctcctatcacttatattgaaagatatgtcgatgcttcattagcttttgcagccggatggaattattggtatgcgtacgtcttccttgtagctagcgaagtaacggctgctagtattgttattgaatattggacttatgccgttcccaccgcaggttggattgccatattgcttttccttgttgctgttcttaactcctttttcgtaaaatggtttggtgaaactgagttttggtttgccattattaaagttattgcaattgtgggattaattattttgggagttgtcatcttttttggtggtacgccaaaacatgatcgcttgggttttcgctattggaagcatggcctcgcctttcgagaatatattgtcaaaggcgcttccggtcgatttgtaggattttggagtgccgtgattaaaagtgggtttgcttttattttagctcccgagcttgtcatcttttcagccggtgaaaccgaagccccaaggcgtaacatccctaaagccactagcagattcatttacaggttaatcttcttctacatttttggctctttaactattggtgtgataacctcttcaaaagatcctcgtcttttgaacgctatttctagtggagctagtggagctgctgcctccccttttgttattggaattcaaaatgctgaaattcctgtgttgaatcacattattaacgccgtaattttgacttcagcttgttcatctggaaattctttcctttttgctggatcaagatctatctattctttagcaaaagaacatcaggctccgaaaatatttaagtactgtaaccgatggggtgttcctgttatatctgttgcagtaaccgtcctttttgcatgtctagcctttttaaatgcttccgcatcggcagctgttgtatttaattggttttgtaatctctctaccatttcaggatttttagcttggatctgtgttttggtagcctatcttcaattccgaaaggctatgattttgaacaatttgtgggaaactcgtccttataaaaccccttttcaaccatatgctacttaccttactttgttcttgcttgcattgattactcttactaatggatttactgtcttcgttggtcataccttcaccgccggtaacttcattgctgcctacatcactttgccaattttccttgttttgtatgttgctcataaactttggtcaaggaattggagctttggtaaaagaatcgaagaaattgatgttactacgggagttgcggaagctgaagctctcgaacaaatgtatcccgcacctgtacccagaaacatcattgagaaaatttggttttggattgcttaa

SEQ ID NO: 8535 - protein, 552 aa, Schizosaccharomyces pombe
MDEKKALQYEESKRAEEITDIELVSVGGIDVEKKYGETKRALKSRHVQLIAIGGCIGTGLFVGSGSALSESGPASLFLSYVIMSFVIWTVMNALGEMCTYLPLSGASPITYIERYVDASLAFAAGWNYWYAYVFLVASEVTAASIVIEYWTYAVPTAGWIAILLFLVAVLNSFFVKWFGETEFWFAIIKVIAIVGLIILGVVIFFGGTPKHDRLGFRYWKHGLAFREYIVKGASGRFVGFWSAVIKSGFAFILAPELVIFSAGETEAPRRNIPKATSRFIYRLIFFYIFGSLTIGVITSSKDPRLLNAISSGASGAAASPFVIGIQNAEIPVLNHIINAVILTSACSSGNSFLFAGSRSIYSLAKEHQAPKIFKYCNRWGVPVISVAVTVLFACLAFLNASASAAVVFNWFCNLSTISGFLAWICVLVAYLQFRKAMILNNLWETRPYKTPFQPYATYLTLFLLALITLTNGFTVFVGHTFTAGNFIAAYITLPIFLVLYVAHKLWSRNWSFGKRIEEIDVTTGVAEAEALEQMYPAPVPRNIIEKIWFWIA

SEQ ID NO: 8536 - DNA, 1884 bp, Saccharomyces cerevisiae
  CDS (1)..(1884)
atggtaaatatactgcccttccacaagaacaatagacacagcgcgggagtcgtcacctgcgcggacgatgttagcggcgacggtagcggcggcgacaccaagaaggaggaggatgttgtccaggtaacggaatcaccatcgtccgggtcgcgcaataatcatcgcagcgacaatgaaaaagatgacgccatccgtatggagaaaatatctaagaaccagtccgcgtcgtccaacggcaccatccgcgaggatttgattatggacgtggacttggagaaatcgccctccgtcgatggcgatagcgagccgcacaaactaaaacaaggtttgcagtcgcgccatgtgcaactgatcgcgctgggcggcgccatcggtaccggtttgctggtggggacttcatccacgcttcatacgtgcggtcccgcggggctgttcatatcgtacattattatttccgcggtgatctacccgatcatgtgcgcgctgggcgaaatggtgtgctttttgcccggtgatggttctgacagtgccgggtcgacggccaatctggtcactaggtacgttgacccttcgttgggcttcgccactgggtggaattacttctactgctacgtcattttagtggccgccgagtgtacggcggcatccggtgtggtcgaatactggaccaccgcggttcccaagggcgtttggatcacgatctttctatgcgtggttgttatactaaacttttccgcggtcaaagtgtacggcgaatccgagttttggttcgcgtctatcaagatattatgcattgtgggactgatcattctgtcctttattttgttttggggtggtggccccaaccatgaccgtcttggcttcagatactggcaacatccgggcgcttttgcgcatcacctcacgggcggatcgctgggtaacttcacagatatctacactgggattatcaagggcgccttcgccttcattcttggtccggaactggtgtgcatgacttccgcggaatgcgcggaccagcgtagaaatatcgctaaggcttcgcgccgctttgtatggagactgatcttcttctacgttctggggacgctggccatctccgttattgttccatacaatgacccaacattggtaaatgcgctggcgcagggcaaaccgggagccggctcgtcaccctttgtgatcggaattcaaaacgccgggattaaggttcttccccacattatcaatgggtgtatcttgaccagcgcgtggtctgccgccaatgcgtttatgtttgcgagcacgagatcactgttgaccatggcgcaaacgggacaggcacccaaatgtttgggcagaatcaacaaatggggtgttccatacgtggctgtgggtgtttccttcttgtgttcttgtttggcatatctgaacgtgtcttcatccacggcagacgtgtttaattggttttccaatatcagcaccatttccgggtttctgggctggatgtgcggctgcatcgcgtacctgagattccgcaaggctattttctacaatggcctctacgacagattgcctttcaagacgtggggacagccttacaccgtgtggttctctctcattgttataggcatcatcaccattaccaacgggtatgccattttcatccctaagtactggagagtagcagatttcattgctgcctacatcaccctacccatcttcctggttttgtggttcggccataagctgtatactcggacgtggagacaatggtggctccctgtgtccgagatcgatgttactacagggttagtcgagatcgaggagaaatcaagagaaattgaggagatgagattaccccccaccggtttcaaagacaagttcttggacgccttgttgtaa

SEQ ID NO: 8537 - protein, 627 aa, Saccharomyces cerevisiae
MVNILPFHKNNRHSAGVVTCADDVSGDGSGGDTKKEEDVVQVTESPSSGSRNNHRSDNEKDDAIRMEKISKNQSASSNGTIREDLIMDVDLEKSPSVDGDSEPHKLKQGLQSRHVQLIALGGAIGTGLLVGTSSTLHTCGPAGLFISYIIISAVIYPIMCALGEMVCFLPGDGSDSAGSTANLVTRYVDPSLGFATGWNYFYCYVILVAAECTAASGVVEYWTTAVPKGVWITIFLCVVVILNFSAVKVYGESEFWFASIKILCIVGLIILSFILFWGGGPNHDRLGFRYWQHPGAFAHHLTGGSLGNFTDIYTGIIKGAFAFILGPELVCMTSAECADQRRNIAKASRRFVWRLIFFYVLGTLAISVIVPYNDPTLVNALAQGKPGAGSSPFVIGIQNAGIKVLPHIINGCILTSAWSAANAFMFASTRSLLTMAQTGQAPKCLGRINKWGVPYVAVGVSFLCSCLAYLNVSSSTADVFNWFSNISTISGFLGWMCGCIAYLRFRKAIFYNGLYDRLPFKTWGQPYTVWFSLIVIGIITITNGYAIFIPKYWRVADFIAAYITLPIFLVLWFGHKLYTRTWRQWWLPVSEIDVTTGLVEIEEKSREIEEMRLPPTGFKDKFLDALL

SEQ ID NO: 8538 - DNA, 1653 bp, Emericella nidulans
  CDS (1)..(1653)
atgagtcccccgtcggccaagagcatggaggagggtcgcaccccgtccgtccagtacggatatggagaccccaagacattggagggagaaatagaagagcacacagcaactaagcgtggtctgtcatcacgacagctgcagctgctcgccatcggaggatgtattggcactggtctcttcgtcggtacttcgacagtgctgacccagacgggtcctgctcctttgctgatgagctacattgtcatggcctctattgtctggtttgtcatgaacgtcctgggcgagatgaccacctacctgcccattcgcggtgtctcagtaccgtacttgatcggccgcttcaccgaacccagcattgggtttgcttccggctataactactggtattcatttgctatgctgctggcctcggaagtcactgcctcggggttgatcattgaatactggaatccgcccgtcagtgtcggtctgtggatcgccattgtccttgttgtgatcctggccctgaacgtcttcgcggtcgagtggtacggagaatccgagttctggttcgctggtctgaaaatattggccatcatcggtctgattatcctgggcgttgtgctgtttttcggtggaggcccaaatcatgaccgcttagggttccgctactggcaagaccccggtgcattcaatccgtacctggttcccggggacactggcaaattcctggggttttggactgccctgatcaagtccggtttttcgttcattttctcgcccgaattgatcaccacagccgctggagaggtcgaggcaccgcgtcggaacatccccaaagccaccaagcggttcatctaccgtgttttcaccttctatatcctgggcagtttggttattggagtcactgtggcctacaacgaccctacccttgaggctggagtcgaaagcggcgggtcaggggccggcgcgagtccattcgtcgttgccatccaaaacgctggtattggagggctcaaccatgtcgtcaatgctgccatcctgatctctgcctggtcatccggtaacgcatggtgttacgctggatcgagaacgctgtactcgctcgccggtgagggccaggccccaaagatcttcacacgcaccaaccgcaccggcgttccctatgtggctgttcttgcgacatggacaatcggactgctatccttccttaatctgtctagctccggacagacggtcttctactggttcaccaatattactaccgttggcgggttcatcaactgggttctgatcggaatcgcctatctgcgcttccgcaaggccctgcaattccacggcatgctggacatgctaccattcaagaccccgctgcaaccatacggtacctactacgtgatgttcatcatctcgatcctgaccttgacgaacgggtacgcggtgttcttcccgggccgcttcactgcttcggacttcttggtctcgtacattgtttttgctatcttccttgcgctttatgctggacataagatctggtaccggacgccctggttgaccaaggtgtcagaggttgacatctttacgggcaaggatgagattgaccgtttgtgcgagaatgatatggagcgacagccccggaactggttggagcgagtctggtggtggattttttag

SEQ ID NO: 8539 - protein, 550 aa, Emericella nidulans
MSPPSAKSMEEGRTPSVQYGYGDPKTLEGEIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLASEVTASGLIIEYWNPPVSVGLWIAIVLVVILALNVFAVEWYGESEFWFAGLKILAIIGLIILGVVLFFGGGPNHDRLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIQNAGIGGLNHVVNAAILISAWSSGNAWCYAGSRTLYSLAGEGQAPKIFTRTNRTGVPYVAVLATWTIGLLSFLNLSSSGQTVFYWFTNITTVGGFINWVLIGIAYLRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 8540 - DNA, 1764 bp, Saccharomyces cerevisiae
  CDS (1)..(1764)
atggatatactcaagaggggaaatgaatcggacaagtttacgaaaatagagacagaatctactacgataccaaatgactcggatagatctggttcactgatcagaagaatgaaggattccttcaagcaaagtaacctgcatgtcattccagaagaccttgaaaacagcgaacagacagagcaggaaaaaatccaatggaaactagcttctcagccctatcaaaaagtcttgagccaaaggcacttgaccatgattgccataggtggtactttggggacgggactgttcattggtttaggttattctttggcatctgggccagccgctttgctaatcggttttttgttagttggtacttcaatgttctgtgtcgttcagagtgccgcagagctttcctgccaattcccggtttctggctcatatgccacacatgtcagtaggttcatagatgaatcggttggctttactgtggctacaaactatgctttggcttggctgatttcttttccaagcgaattaattggttgtgcacttactatttcatactggaaccaaacggttaatccggctgtttgggtggccattttttatgttttcattatggtactgaacttgtttggtgtgagaggctttgccgagactgagtttgctctgtcaatcattaaggttattgctatatttattttcatcattattggtatcgtccttattgccggaggggggcctaactctactggttatattggcgccaaatactggcacgacccaggtgccttcgcaaaacctgtcttcaagaatttgtgtaacacattcgtttctgctgctttttcctttggtggtagtgagttagtgctgttaactagtacagaatctaaaaatatttcagctatatcacgtgctgccaaaggtacgttctggagaatcgcgattttttacattactaccgttgtcattattggatgtctcgtaccttataacgaccccagactgctcagtggttcgaacagtgaggatgtatctgcctctccctttgttattgctttgagtaatacaggatcaatgggtgcaaaagtttccaactttatgaatgtcgttatccttgttgcggttgtgtcagtttgcaattcttgcgtttatgcttcttcaagactaattcaagctttaggtgcatctggccaacttccttcggtatgttcctacatggacagaaagggtaggcctttggttggcattgggattagtggtgcatttggtcttttaggttttcttgtggcctcgaaaaaggaggacgaggtcttcacttggcttttcgccctttgttccatttcatcattcttcacctggttctgtatttgtatgtcacaaattagatttaggatggctttgaaagctcaaggaagatccaatgacgaaatagcttacaaatccatactgggtgtttatggtggaattttggggtgtgtgctaaatgcattgctaattgcgggtgaaatatacgtatcggccgccccggtcggtagccctagctccgctgaagccttctttgaatactgtttaagtattccaatcatgattgttgtttattttgcacataggttttatcgaagagattggaaacacttctacatcaagaggagtgagatcgatctggatactgggtgttccgtggagaatctagagcttttcaaagcacaaaaagaagctgaggaacaactcattgcttctaagccattctattacaaaatctacagattttggtgttag

SEQ ID NO: 8541 - protein, 587 aa, Saccharomyces cerevisiae
MDILKRGNESDKFTKIETESTTIPNDSDRSGSLIRRMKDSFKQSNLHVIPEDLENSEQTEQEKIQWKLASQPYQKVLSQRHLTMIAIGGTLGTGLFIGLGYSLASGPAALLIGFLLVGTSMFCVVQSAAELSCQFPVSGSYATHVSRFIDESVGFTVATNYALAWLISFPSELIGCALTISYWNQTVNPAVWVAIFYVFIMVLNLFGVRGFAETEFALSIIKVIAIFIFIIIGIVLIAGGGPNSTGYIGAKYWHDPGAFAKPVFKNLCNTFVSAAFSFGGSELVLLTSTESKNISAISRAAKGTFWRIAIFYITTVVIIGCLVPYNDPRLLSGSNSEDVSASPFVIALSNTGSMGAKVSNFMNVVILVAVVSVCNSCVYASSRLIQALGASGQLPSVCSYMDRKGRPLVGIGISGAFGLLGFLVASKKEDEVFTWLFALCSISSFFTWFCICMSQIRFRMALKAQGRSNDEIAYKSILGVYGGILGCVLNALLIAGEIYVSAAPVGSPSSAEAFFEYCLSIPIMIVVYFAHRFYRRDWKHFYIKRSEIDLDTGCSVENLELFKAQKEAEEQLIASKPFYYKIYRFWC

SEQ ID NO: 8542 - DNA, 1779 bp, Saccharomyces cerevisiae
  CDS (1)..(1779)
atgaccgaagactttatttcttctgtcaagcgttcaaatgaggagctgaaggagcgaaaatctaactttggatttgtagaatacaaatccaagcaattaacatcatcctcatcacacaattcaaactcatcgcatcacgatgatgacaaccaacacggcaagaggaatattttccagcgatgtgttgattctttcaagtctcctctggacggctcgttcgacacaagtaatttgaagaggactctgaaaccaaggcacttaatcatgattgccattgggggcagtataggtactggtttgtttgtcggtagtggtaaggcaatcgccgaaggtggtcctcttggtgtcgtcattggttgggctattgcaggctctcaaatcatcgggacgattcatgggctaggtgaaatcacggtgcggtttcccgttgtcggggcctttgccaattacggcacaaggtttttggatccaagtataagttttgttgtttcgaccatatacgtgctacagtggttttttgtattacccttagaaatcattgcggcggcaatgaccgtacagtactggaactcgtctattgaccccgtaatttgggtagccatcttttatgctgttattgtttccataaatttgtttggtgtacgaggttttggggaagcggaatttgcattttccaccataaaagcaataacagtttgcggattcattatattgtgcgttgtcctcatttgcggtggaggtcccgaccacgagttcattggcgccaaatactggcacgaccctggttgtttggccaatgggttcccgggcgttctatctgttcttgttgttgcttcgtattctctcggtggtatagaaatgacgtgcctggcatcaggtgaaacggaccccaaaggcttaccaagtgctatcaagcaagtgttttggaggatcttatttttctttttgatatcactgaccctggtaggattcctggttccatatacaaaccaaaacttactgggtggttcatctgtggacaactcaccttttgtcattgccataaaattgcatcacattaaagccttgccctccatcgtcaatgcggtcatccttatcagtgttttgagtgtaggtaactcctgcatcttcgcttcaagtagaacgttgtgttcgatggcccaccaaggccttattccatggtggtttggttatatcgaccgtgctggtaggccgctggttggcattatggcaaattcactatttggattactagcatttctggtcaaatctggctcgatgtctgaagttttcaattggttaatggccattgccggcctggccacgtgcattgtctggttgagcatcaacctgtcacatatcagatttagactggcgatgaaggctcaagggaagtctctggatgaattagaatttgttagtgctgtcgggatttggggatcagcgtattccgctttaatcaactgtctaatcttgatagctcaattctattgttcactatggcccattggtggctggaccagcggcaaagaaagggctaaaatattttttcaaaattatctgtgtgccttaatcatgttatttatattcatcgtccacaaaatttattacaagtgtcaaacaggcaaatggtggggggttaaggcgttaaaggacatagatttggaaaccgatcgtaaagatatcgacatcgaaatagtcaagcaagaaattgccgaaaagaaaatgtacctagattcccgtccatggtacgtgagacagttccatttctggtgttaa

SEQ ID NO: 8543 - protein, 592 aa, Saccharomyces cerevisiae
MTEDFISSVKRSNEELKERKSNFGFVEYKSKQLTSSSSHNSNSSHHDDDNQHGKRNIFQRCVDSFKSPLDGSFDTSNLKRTLKPRHLIMIAIGGSIGTGLFVGSGKAIAEGGPLGVVIGWAIAGSQIIGTIHGLGEITVRFPVVGAFANYGTRFLDPSISFVVSTIYVLQWFFVLPLEIIAAAMTVQYWNSSIDPVIWVAIFYAVIVSINLFGVRGFGEAEFAFSTIKAITVCGFIILCVVLICGGGPDHEFIGAKYWHDPGCLANGFPGVLSVLVVASYSLGGIEMTCLASGETDPKGLPSAIKQVFWRILFFFLISLTLVGFLVPYTNQNLLGGSSVDNSPFVIAIKLHHIKALPSIVNAVILISVLSVGNSCIFASSRTLCSMAHQGLIPWWFGYIDRAGRPLVGIMANSLFGLLAFLVKSGSMSEVFNWLMAIAGLATCIVWLSINLSHIRFRLAMKAQGKSLDELEFVSAVGIWGSAYSALINCLILIAQFYCSLWPIGGWTSGKERAKIFFQNYLCALIMLFIFIVHKIYYKCQTGKWWGVKALKDIDLETDRKDIDIEIVKQEIAEKKMYLDSRPWYVRQFHFWC

SEQ ID NO: 8544 - DNA, 1860 bp, Saccharomyces cerevisiae
  CDS (1)..(1860)
atggacgatagtgtcagtttcattgccaaagaggccagtccagcacaatattcgcacagtttgcatgaaagaacacacagtgaaaaacaaaagagagactttacaataacagaaaaacaagatgaggtatctggacaaacagcggagcctcgaaggacggacagcaaatccatattacagaggaaatgcaaagaattcttcgactcttttaaaaggcagctgccaccagaccgtaattccgaactagagtcccaagaaaaaaacaacctgacaaagtcgatcaaatctcgtcacttagtcatgatcagtctcggtaccggtataggtactggtttactggtcggtaatggtcaggtgctgggaacagctggtcctgccgggttagtccttggttacggaatagcatcgatcatgctttactgtatcatccaagcggcaggcgagttaggtctctgttatgcaggactaaccggcaattacaccagatatccttctattttagtcgacccttcgttgggttttgcagtttctgtggtttacaccattcaatggctaactgttctgcccttacaattggtcactgcggcaatgacagttaagtactggacgagtgtaaatgcagacatctttgttgccgtggttttcgtttttgtaattatcattaatctatttgggtccagaggctatgctgaagccgagttcattttcaattcctgtaagatattgatggtaatcggattcgtcattctggcgattatcatcaattgtgggggtgcaggtgacagaagatacatcggtgctgagtactggcacaatcctggtccatttgcccacggtttcaaaggtgtatgtacggttttctgttatgctgcattcagctacggtggaattgaagttctacttctatctgccgctgagcaggaaaacccaacaaaatctattcccaatgcctgcaaaaaagtggtataccgtattctgctgatttacatgctcaccaccattttggtttgctttcttgttccatacaacagtgacgaattattagggtctagtgactcctctggatcccatgcctccccatttgtcattgctgttgcatcacatggtgtcaaagttgtgcctcactttataaatgctgttattttgatttctgtcatttctgttgcaaactcttcgttatattctgggccaagattgttattatcattggcagaacaaggcgtcttacctaaatgcttagcatatgttgatagaaacggcaggcctttactttgtttttttgtttcccttgtctttggatgcattgggtttgtagccactagtgacgctgaagaacaggttttcacctggttattggcaatttctagtctttcgcaattatttatctggatgtcaatgtccttgtcacatataagatttagagatgccatggcaaagcaaggtcgttcgatgaacgaagttggatacaaagcacaaactggctattggggttcatggcttgcagttttaattgcaatcttcttccttgtgtgccagttctgggtagccatcgcacctgttaatgaacatggaaaacttaacgtcaaagtgtttttccaaaattatttggcaatgcccatcgttttgtttgcctattttggtcacaagatatacttcaaatcatggagcttttggattccagccgaaaaaattgatttggactcacatagaaacatatttgtgtctccatcgcttacagagatcgacaaagttgacgataacgatgatcttaaagagtatgaaaattcagaatcgtcggaaaatccaaacagttcgcgttcaagaaagttttttaagaggatgaccaatttctggtgctaa

SEQ ID NO: 8545 - protein, 619 aa, Saccharomyces cerevisiae
MDDSVSFIAKEASPAQYSHSLHERTHSEKQKRDFTITEKQDEVSGQTAEPRRTDSKSILQRKCKEFFDSFKRQLPPDRNSELESQEKNNLTKSIKSRHLVMISLGTGIGTGLLVGNGQVLGTAGPAGLVLGYGIASIMLYCIIQAAGELGLCYAGLTGNYTRYPSILVDPSLGFAVSVVYTIQWLTVLPLQLVTAAMTVKYWTSVNADIFVAVVFVFVIIINLFGSRGYAEAEFIFNSCKILMVIGFVILAIIINCGGAGDRRYIGAEYWHNPGPFAHGFKGVCTVFCYAAFSYGGIEVLLLSAAEQENPTKSIPNACKKVVYRILLIYMLTTILVCFLVPYNSDELLGSSDSSGSHASPFVIAVASHGVKVVPHFINAVILISVISVANSSLYSGPRLLLSLAEQGVLPKCLAYVDRNGRPLLCFFVSLVFGCIGFVATSDAEEQVFTWLLAISSLSQLFIWMSMSLSHIRFRDAMAKQGRSMNEVGYKAQTGYWGSWLAVLIAIFFLVCQFWVAIAPVNEHGKLNVKVFFQNYLAMPIVLFAYFGHKIYFKSWSFWIPAEKIDLDSHRNIFVSPSLTEIDKVDDNDDLKEYENSESSENPNSSRSRKFFKRMTNFWC

SEQ ID NO: 8546 - DNA, 1614 bp, Schizosaccharomyces pombe
  CDS (1)..(1614)
atggaggcagcgccttctgagaaagttcctgccaagaagctatcctcctcagaaaacctcgacattggagtttccgaagttgtaacagttgacgcagcggaaaataattcaaatggaatcaaacgtggattgaagactcgtcatgtatcgatgatggcccttgctggtatcatcggtccaggtgtcttcattggtatgggcagtgccctgcatattggtggtccggtgggtctaattgtcggctttgccatcgttagtattgttgtttttggggttatgctgagtatcggcgagtttaattcgctatttgatttcaacttcaatactcatgctgctcgatgggttgacccagcatttggagccgctatcggatggaactatgttatcgtatggcttaccaacatcgcagcagaatatacatctttaacatctattcttcaatattggggcccccatgtgccatcttatggcttttttctaattttttggggtttttttacgtgttaccaaatgctaggtgtgtcagtgtttggagaatctgaatacattttggctttcattaaacttctatttattactggattctacatatttgcaataatttacgcagctggaggaattcctcatcataagccgcccaacttgtttaaagaaatgccattggcacacggatttgggggtatagtttcagcatttgtatatgccggtgtcttttttagtggtgtagaatctgtatctatgactgcagctgaaagcaaaaatccaaaaaaagctatcccgcttgctgtgagacaaacgttctggagaatcttgtatgtctattttggtatctcaatctcttacggtatcaccgtagcatggaatgacccaaatctttcgtcaggctccaaaactctcaagtctccaatgacaattgctataatgaatgccggttggaatcacgcaggtgattttgtcaatgcagtcattttaattacttgcctttcttccatcaacagtggtatatatataggaagtcgatctttgtataatttagccaaggatggcatggctccaaaaatttttaaaagggttgataaaagaggtgtaccatgggttgcggtccactcagtccaccttttcgggtttctttccattatgaattacagcacaggtgctgtcaaggcatatggctatattatcaatttagctggtgtgtctgcattcattgtgtggacagcaatcatattcgttcactttcgtttcagacgaggctgggtaaagcaaggctatgccttgtctgatttaccgtttaaatcacctctttatccctttccccagcttataggattcgttataggaatcattctcacactagtacaaggatggacggtttttaaaccatttgctgctggcgattttgtcgatgcctatatacttctacccctgtttttcgtcatttggctatcttataaatttattaaaaagacaaagtgggtatcttatgaagacatggacttcataaacggcagacgagttattgaaccaacctattcaaatgaacagtcttcagataaagaaaccgaagacggcaaaaaaacaagtttctggaacagagtttggaaagaagtataa

SEQ ID NO: 8547 - protein, 537 aa, Schizosaccharomyces pombe
MEAAPSEKVPAKKLSSSENLDIGVSEVVTVDAAENNSNGIKRGLKTRHVSMMALAGIIGPGVFIGMGSALHIGGPVGLIVGFAIVSIVVFGVMLSIGEFNSLFDFNFNTHAARWVDPAFGAAIGWNYVIVWLTNIAAEYTSLTSILQYWGPHVPSYGFFLIFWGFFTCYQMLGVSVFGESEYILAFIKLLFITGFYIFAIIYAAGGIPHHKPPNLFKEMPLAHGFGGIVSAFVYAGVFFSGVESVSMTAAESKNPKKAIPLAVRQTFWRILYVYFGISISYGITVAWNDPNLSSGSKTLKSPMTIAIMNAGWNHAGDFVNAVILITCLSSINSGIYIGSRSLYNLAKDGMAPKIFKRVDKRGVPWVAVHSVHLFGFLSIMNYSTGAVKAYGYIINLAGVSAFIVWTAIIFVHFRFRRGWVKQGYALSDLPFKSPLYPFPQLIGFVIGIILTLVQGWTVFKPFAAGDFVDAYILLPLFFVIWLSYKFIKKTKWVSYEDMDFINGRRVIEPTYSNEQSSDKETEDGKKTSFWNRVWKEV

SEQ ID NO: 8548 - DNA, 1746 bp, Schizosaccharomyces pombe
  CDS (1)..(1746)
atgtcacatagcgattacaatttcgatattgagcaaaacgcttttgaaaaggaagcaccgaaggtgtccatcgaaagaaaaggagatgtcgttgaggaagaggtaatagctaccggcgaagtcgagaattatgctgaaccaaagagtagaaactttttgcagagattttttgacgactttaagcctgctttaacaactcgtggtgacggtgtagcactgaaacgaaaattgacatccagacacatgcagatgatttcggttggaggagccattggtagtggtctgtatgttggttcaggcagtgcattcgcagatggcggcccagcctcagtaattatcaattatatcttaattggaattatgatgatttttgttatttacgctctcggcgaattagcaattgcttatccagttgctggcagttttaatacttatgcaacgcgcttcattgatcctgcctggggatttgctgttagctggaattactttcttaattattttgtcacgtgtccattggaactaacaacgtgtgccattacttttaaattttggacagaaattaatagtgcagcgtggattagcatttttttagcggttgttattgtcatcaatctttttggagttcgtgcatacggagaagtggaatttatattgagtactattaaagtaattgctaccgttggtttcattattttagccatcattattaactgtggaggtgtaccaaccgaccatcgaggatatattggtggcagtattatcaaacaaaaaccatttcgacatggattcaaaggattttgttcagtttttaccactgctgctttctccttttctggaactgaaattattggactggcagcagccgaagttggtaatccaaggaaatccgtacccagtgctgttaaacaagtgttttggcgtattgctatcttttatgttgtctctttaatattgattggattgttggtcagtccggatgatcctagattgatgggcaacggcgatgtcagcgtttcaccttttgttctagctattcaagaagctaatattaaaggtcttccttctgtttttaacgctgtcattattatttcggtagtttcggtaaccaattctactacgtacactgcagctcgtacccttcaaggtatggcaactctcaagcaagcacccaagtttttttcttatactgatcgagttggccgtcctttaatagccatggttgtggttctcttatttggcttctttgcatacattaatgaagccgacaaaaacggaagcgatatcagcgacacagtgttcgactggttactagcaatctcaggattgtcaagcttttttacttggggaagtatatgtttatctcatattatgttccgtttagcatttaagaagcaaggtcattccttaaaggagttgggatttgtgtctcccatgggaatctggggttcagtcattggattgggtttcaacatattatgtttgatggctgagttttatgtatctctgttcctcataggtggtagtccgaatgctaatgatttctttcaaggatatctagctgcctgcattgctttagctttttttattggttacaagatttacgacagatcgcatattccctctttggataaactagatatcgatactggacttaaaacttatgacaaccaagatgaagaaaaagaagaatattcttccaagggtcctctaaacattttgaaaaaagcatggaatgccgtttgctga

SEQ ID NO: 8549 - protein, 581 aa, Schizosaccharomyces pombe
MSHSDYNFDIEQNAFEKEAPKVSIERKGDVVEEEVIATGEVENYAEPKSRNFLQRFFDDFKPALTTRGDGVALKRKLTSRHMQMISVGGAIGSGLYVGSGSAFADGGPASVIINYILIGIMMIFVIYALGELAIAYPVAGSFNTYATRFIDPAWGFAVSWNYFLNYFVTCPLELTTCAITFKFWTEINSAAWISIFLAVVIVINLFGVRAYGEVEFILSTIKVIATVGFIILAIIINCGGVPTDHRGYIGGSIIKQKPFRHGFKGFCSVFTTAAFSFSGTEIIGLAAAEVGNPRKSVPSAVKQVFWRIAIFYVVSLILIGLLVSPDDPRLMGNGDVSVSPFVLAIQEANIKGLPSVFNAVIIISVVSVTNSTTYTAARTLQGMATLKQAPKFFSYTDRVGRPLIAMVVVLLFGFFAYINEADKNGSDISDTVFDWLLAISGLSSFFTWGSICLSHIMFRLAFKKQGHSLKELGFVSPMGIWGSVIGLGFNILCLMAEFYVSLFLIGGSPNANDFFQGYLAACIALAFFIGYKIYDRSHIPSLDKLDIDTGLKTYDNQDEEKEEYSSKGPLNILKKAWNAVC

SEQ ID NO: 8550 - DNA, 1740 bp, Schizosaccharomyces pombe
  CDS (1)..(1740)
atgtcagctaaagattatgacttcgatattgaaagcgttttgcctgaagaaaaagctccacaagtctcagaggccaaaaaggattatatttcccaagaatcgacagttttgtctggccaagttgattttgtagaacctgagcataaagggttttttcaaaacttaatagatggctttaaaccagccagagaagctgacggtaatggaggtcccgcattaaaacgaggtttaagtacgaggcatatgcaattgatgtctattggcggtgctattggtagtggtttgtatgttggttcaggaagcgctttggccgacggtggtccagcttcagtgatcattaattatattttaattggtattatgatgtttttcgttatttatgctctgggtgagatggctgtcgcgtatccagttgccggcagttttaatacttatgcaacgcgcttcattgatcctgcctggggatttgctgttagctggaattatttttttaattattttgttacattcccatttgagttaacgacttgcgcaattacgtttacgttttggacagatgtcaattgtgcggtttggattagtatttttttggttgtcgttattggtattaaccttttcggtgtccgtgtttttggagaagtggagtttgtattagctctgattaaagtggtcgctaccgtcggtttcattattttagccattattattaactgtggaggtgtaccaaccgaccaccgaggatatatcggtggcagtatcattaaacaaaaaccatttcgacatggatttaaaggattttgttctgtgtataccactgctgctttctccttttctggaactgaaatcgttggactggcagcggctgaagtcggcgatccaagaaaaacactacctggtgcagtgaagcaagtcttctggcgagtagctatattttatattgtttccctaatcttgatcggattgctcattagtcctgatgatcccaaattaatgggcaacggatcagcaagcgtttcacctttcgttcttgctattcaagaagctaacattaaaggtcttccttctgtttttaacgctgttattattatttccgtaatatccgtgacaaattcaagtacgtatacagctggtcgtaccctccatggtatggcgaatttaaagcaggcacctgcatttttcaagtacaccgaccgtctgggtcgtcctttaatagcaatgattgtggtcctttcatttggattcttcgcttatattaatgaagccaataataatggaaacgatatcagtgacacagtgttcgactggttactagcaatttccggtctttccaacttcttcacttggggaagtatatgtttatctcatattatgttccgtttagcatttaagaagcaaggtcattccttaaaggagttgggatttgtgtctcccatgggaatctggggttcagtcattggattgggtttcaacatattatgtttgatggctgagttttatgtatctctgttccccataggtggtagtccgaatgctaatgatttctttcaaggatatctagctgcctgcattactcttgttttcttcattggttacaagatttacgacagatcgcatattccctctttggataaactggatatcaccactggtttaaaaacatatgaatatgaagaaacgaaagattcttctgataccgggagattccgttttttcaaaaaaataattaataccgtttgctaa

SEQ ID NO: 8551 - protein, 579 aa, Schizosaccharomyces pombe
MSAKDYDFDIESVLPEEKAPQVSEAKKDYISQESTVLSGQVDFVEPEHKGFFQNLIDGFKPAREADGNGGPALKRGLSTRHMQLMSIGGAIGSGLYVGSGSALADGGPASVIINYILIGIMMFFVIYALGEMAVAYPVAGSFNTYATRFIDPAWGFAVSWNYFFNYFVTFPFELTTCAITFTFWTDVNCAVWISIFLVVVIGINLFGVRVFGEVEFVLALIKVVATVGFIILAIIINCGGVPTDHRGYIGGSIIKQKPFRHGFKGFCSVYTTAAFSFSGTEIVGLAAAEVGDPRKTLPGAVKQVFWRVAIFYIVSLILIGLLISPDDPKLMGNGSASVSPFVLAIQEANIKGLPSVFNAVIIISVISVTNSSTYTAGRTLHGMANLKQAPAFFKYTDRLGRPLIAMIVVLSFGFFAYINEANNNGNDISDTVFDWLLAISGLSNFFTWGSICLSHIMFRLAFKKQGHSLKELGFVSPMGIWGSVIGLGFNILCLMAEFYVSLFPIGGSPNANDFFQGYLAACITLVFFIGYKIYDRSHIPSLDKLDITTGLKTYEYEETKDSSDTGRFRFFKKIINTVC

SEQ ID NO: 8552 - DNA, 1758 bp, Schizosaccharomyces pombe
  CDS (1)..(1758)
atgaatgcttatgttagggattctgaatccgtatattcagaatcgtatcctcccgaaaacttcataagtaatgaacccgagaaatcaaaagataaagacaatttcaacggcgaagaagtcatttcttatgtcggtgaggtcgaaacagtccctgccaaagaagagaatgtatttcgacgattcattaatggatttaaaattgaaaaaaaccaacaagattctgccggacaaggactaaagcgtcggcttaagagtcgtcatattcaaatgatcggtattggtggagctattggtaccggtgtttgggtgggaagctctaaatctctttatagggggggagcagcgtcagttttaattgactactgtattgttggaactatggttttttgtactgtttatgctttaggagaattagctgttgcctttcctacgcggggaagttttgttacacatgctacgcgattcatcgatgaatcatggggctttgcacttagttggaattatgtattctcgttcattgttacgattccattagagttgacgacaggaacaatgatgatcaaatattggaccaatctaaacagtggtatatgggtgacagttttcatcgtgttcctattttttattaatatctttggagtaaaaggatatggtgaaatggagtttatcatgtctactatcaaagtggttgcaatgtgtggttttatcattcttggtatcattattgattgcggtggtgtaccaactgatcatcgaggctatatgggaacacatattttccgcgaaaatgcttttcgccacaaatttaaaggattttgcgctgtatttaccagtgctgcattttctttttccggtactgaatatgttggtgtcgcagcagctgaaacagagaaccccgcgaaggcctttccggttgcagtaagacaaacgctattcagaatagcaatattctacatactttcacttttcattgttagtttactcattagtggtgctgaccctcggttaacttcataccatggagttgatgcaagtccatttgtgctagctattaaagatgctaacatcaaagcgttaccttcaattctgaatgccattattttgatctccgtaatctcttctgctaatgctcagttgtacgctggaagtcgcgcaattcattccttagggtgtaatggctttgctcctaagtgttttacactggttgatcgtgaaggtcgacctctcgttgctcttcttattttgttcttgtttatgtttttaggttaccttgtcgaaacaggacaatatgacactgtatttgactggatgctgtcgatttctggtttgggtacattattttgctggggcagtatatgtctagcacatattcggtatagagccgctatgaaacatcaaaacaggagcctcaaagaggttggatttgtctctccatttaatgtttatgcttcctattatgcttttatactagtttgcttagtgttggctgcagaattttatgtctccattttccctgttggcggtaaaccagatgccagtgcattttttgaaaactatttatctgctcctgtaattctagttttttttatatgccacaagctttattacaaaaccaaacgaattactctttcaaatatggatttggaaactgattttgcatacaaaactccagtggaagaagaagaagaagaagagaagagtgctggttccctaagtatcaaacaaagaatgaaaaagctatctgatatgatgtgctaa

SEQ ID NO: 8553 - protein, 585 aa, Schizosaccharomyces pombe
MNAYVRDSESVYSESYPPENFISNEPEKSKDKDNFNGEEVISYVGEVETVPAKEENVFRRFINGFKIEKNQQDSAGQGLKRRLKSRHIQMIGIGGAIGTGVWVGSSKSLYRGGAASVLIDYCIVGTMVFCTVYALGELAVAFPTRGSFVTHATRFIDESWGFALSWNYVFSFIVTIPLELTTGTMMIKYWTNLNSGIWVTVFIVFLFFINIFGVKGYGEMEFIMSTIKVVAMCGFIILGIIIDCGGVPTDHRGYMGTHIFRENAFRHKFKGFCAVFTSAAFSFSGTEYVGVAAAETENPAKAFPVAVRQTLFRIAIFYILSLFIVSLLISGADPRLTSYHGVDASPFVLAIKDANIKALPSILNAIILISVISSANAQLYAGSRAIHSLGCNGFAPKCFTLVDREGRPLVALLILFLFMFLGYLVETGQYDTVFDWMLSISGLGTLFCWGSICLAHIRYRAAMKHQNRSLKEVGFVSPFNVYASYYAFILVCLVLAAEFYVSIFPVGGKPDASAFFENYLSAPVILVFFICHKLYYKTKRITLSNMDLETDFAYKTPVEEEEEEEKSAGSLSIKQRMKKLSDMMC

SEQ ID NO: 8554 - DNA, 1743 bp, Schizosaccharomyces pombe
  CDS (1)..(1743)
atggaaccagaatatgtctcttttagcgacaaggacactaaatctatcctaaatgaaagcaaatcttctttgaaggatgtcaaaccttctttggaggaaaagagttacattaccccgggattagttgacgatgtggagcctaagggtaaaaacttcgtagtacgcttttttgatgactttaagcctgcaaaggcaacgggagaagatggcacggcgcttaagcgtagtctgaaaagccggcatatgcaaatgatatctattggaggtgcaattggtacaggtctatatgtcggttcaggtagttcgcttgcagatggcggacccgcttcagtgatcattaattacagcttaattggaattatgatgttctttattgtttatgcgcttggtgaaatggctgttgcttatccggtcgctggtggattcaatacctatgctacccgtttcattgatccagcttggggatttgcggtaagttggaactacttcatcaactatttcgttacttttccacttgaattaacaacttgcgctatcacatttcggtactggacggatattaatagcgcagcttggatctctatttttctggttgtcattattatagtcaatctttttggcgttcgcgcatatggagaagtggagtttattttaagtactgttaaagtggtcgctacctttggattcatcattttggccatcatcatcaattgcggtggtgttccaactgatcaccggggttacattggcggaagtattataaaacataagccgtttcgacatgggttcaaaggattttgttctgtctttactactgcggctttctccttttctggtactgaagtcattggtttagcggcggctgaagttgacaatcctcagaaagcgcttcctcatgccgttaagcaagttttttggcgtattgctatattttatgttgtctccttgatattgatcggtttgcttattagccccgatgatcctaatttgatgggaaatggctctaccagtgtgtcacctttcgtacttgctattaaagaagcaaacatcaaaggcctaccttccgtttttaacgctgttattattatttccgtcgtttctgtgacaaattccagcacatatacagccggtcgtaccctccatggtatggcgaatttaaagcaggcaccctccttctttaaatataccgatcgtcttggtcgtcctttacttgccatgatcgttgttctgttatttggattctttgcttatatcaacgaagctgataaaaatggtaacgatgttagtgatacggtattcaattggttgcttgctctatctggtctgtcaaacttttttacctggggaagtatatgtctttgtcatatcatatttcgcttggcgtttaagaaacaaggacattccctaaaagaattgggatttgtatctcctatgggtatttggggatcttgcattggattatttttcaatattttatgccttatggcacaattttatgtctccttatttccaatcggtggaaaaccaaatgcaaatgattttttccaggggtatttggcggcacccgttacactcgctttttttatcggttataaaatatatgatagatcgcacatcccttctttggataaactagacattactactggtcttaaaacatatgagaatctcgatgaagaagaagatgagcccaccactgcttctaagaggattttcaagaaaatcagttcggttttctgttaa

SEQ ID NO: 8555 - protein, 580 aa, Schizosaccharomyces pombe
MEPEYVSFSDKDTKSILNESKSSLKDVKPSLEEKSYITPGLVDDVEPKGKNFVVRFFDDFKPAKATGEDGTALKRSLKSRHMQMISIGGAIGTGLYVGSGSSLADGGPASVIINYSLIGIMMFFIVYALGEMAVAYPVAGGFNTYATRFIDPAWGFAVSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRSHIPSLDKLDITTGLKTYENLDEEEDEPTTASKRIFKKISSVFC

SEQ ID NO: 8556 - DNA, 1752 bp, Schizosaccharomyces pombe
  CDS (1)..(1752)
atgtcgtcgccagatcgctctattgacattgaccttgaaaaatatccttcaacggctaccaagtccgtctacggccaatcgaaggatgataaaaatgttttcgacattcatcccaccgaatccgaagtcatccccggtgaagtcgagtatgctgatactccttcccatcaaaatttcttgcaaaagttttttagcgacttcaaacccgttaaagccgaccgcgaggatggtgtcgcattaaagcgtcatctgaaaggtaggcatatgcaaatgattgccattggtggtgctattggtactggtttgtttgtgggttctggtagttcacttgctgatggtggaccggcttctgttattatcgattatactttgattggtattatgatgttctttactgtctatgctttaggtgaacttgctgtttcttatcctgtcgctggtggtttctataattacgcagttcgttttatcgatccagcctggggctttgccgttggttggaactatttcatgaattatttcgttacatttccactggagttaactacttgtgccatcactttccgctactggacagacattaatagttgtgcttggattacgattttcttggtatttgttatatgtatcaatcttttcggtgttagaggttatggtgaagttgaatttattctatctacgctcaaagttgttgccactactggttttattattttggctattattattaattgcggtggtgttcctactgatcctcgtggctacatcggtggtaaaattattaaaaacaaacctttccgtcatagctttaaaggtttttgttccgtgtttactactgccggtttctccttctcaggtactgaagttgttggtttagctgctgctgaagctgaagatcctcaaaagtctctccctcgtgctaccaaacaggtcttttggcgtattgctattttctacgtcgtatctttaattttaattggtctgcttgtttcaccagatgatcctcgtttgatgggtaatagcagcgatggtagtacctctcccttcgtgttggccattaaagaagcaaacatcagaggccttccttccgttttcaatgcagtaattatcatttctaccgtctctgttgcaaattcttgtactttcactgctagtcgtactcttcatgctatggccgctaaaggtgacgcacctcgcttctttgcatatactgatcgtcttggtcgtcccctcctcgctatggctgtttgtttgttgtttggattttttgcatatatcaatgccgccggtgatgttagtgacactgttttcgattggttattggctatttccggtatctcaaacttcttctcatggggcagtattaatctttgccatatcgtcttccgtcttgctatgaagaaacaaggccgttctttggatcaacttggatttgtatcacctatgggtatttggggttctgctattggattggctttcaacattttgtgtcttatggccgaattctatgtatctttgttccccatcggttcaaagccaaatgctaacgattttttccaaggatatcttgctgctccaattgtgattgctttctttattggctacaaaatttatgatagaagtcatattccctcattgagtaaacttgatttagacacgggacttcgtacctatcctccaaaagataaagaatctgagaaaattcgtgatgcgaagggtttctttaagtggatttggcaatctctttgctaa

SEQ ID NO: 8557 - protein, 583 aa, Schizosaccharomyces pombe
MSSPDRSIDIDLEKYPSTATKSVYGQSKDDKNVFDIHPTESEVIPGEVEYADTPSHQNFLQKFFSDFKPVKADREDGVALKRHLKGRHMQMIAIGGAIGTGLFVGSGSSLADGGPASVIIDYTLIGIMMFFTVYALGELAVSYPVAGGFYNYAVRFIDPAWGFAVGWNYFMNYFVTFPLELTTCAITFRYWTDINSCAWITIFLVFVICINLFGVRGYGEVEFILSTLKVVATTGFIILAIIINCGGVPTDPRGYIGGKIIKNKPFRHSFKGFCSVFTTAGFSFSGTEVVGLAAAEAEDPQKSLPRATKQVFWRIAIFYVVSLILIGLLVSPDDPRLMGNSSDGSTSPFVLAIKEANIRGLPSVFNAVIIISTVSVANSCTFTASRTLHAMAAKGDAPRFFAYTDRLGRPLLAMAVCLLFGFFAYINAAGDVSDTVFDWLLAISGISNFFSWGSINLCHIVFRLAMKKQGRSLDQLGFVSPMGIWGSAIGLAFNILCLMAEFYVSLFPIGSKPNANDFFQGYLAAPIVIAFFIGYKIYDRSHIPSLSKLDLDTGLRTYPPKDKESEKIRDAKGFFKWIWQSLC

SEQ ID NO: 8558 - DNA, 25 bp, Artificial sequence
  primer
atgcctagaaacccattgaaaaagg

SEQ ID NO: 8559 - DNA, 26 bp, Artificial sequence
  primer
tcaacaccagaaatgtaaaaatcttg

SEQ ID NO: 8560 - protein, 500 aa, Artificial sequence
  consensus sequence
  Variant (3)..(4): Xaa in position 3 to 4 is any amino acid
  Variant (7)..(11): Xaa in position 7 to 11 is any amino acid
  Variant (12)..(13): Xaa in position 12 to 13 is any or no amino acid
  Variant (19)..(22): Xaa in position 19 to 22 is any amino acid
  Variant (24)..(28): Xaa in position 24 to 28 is any amino acid
  Variant (29)..(29): Xaa in position 29 is any or no amino acid
  Variant (32)..(52): Xaa in position 32 to 52 is any amino acid
  Variant (53)..(53): Xaa in position 53 is any or no amino acid
  Variant (56)..(60): Xaa in position 56 to 60 is any amino acid
  Variant (62)..(63): Xaa in position 62 to 63 is any amino acid
  Variant (64)..(70): Xaa in position 64 to 70 is any or no amino acid
  Variant (72)..(73): Xaa in position 72 to 73 is any amino acid
  Variant (75)..(83): Xaa in position 75 to 83 is any amino acid
  Variant (86)..(90): Xaa in position 86 to 90 is any amino acid
  Variant (92)..(94): Xaa in position 92 to 94 is any amino acid
  Variant (96)..(100): Xaa in position 96 to 100 is any amino acid
  Variant (101)..(101): Xaa in position 101 is any or no amino acid
  Variant (103)..(112): Xaa in position 103 to 112 is any amino acid
  Variant (114)..(123): Xaa in position 114 to 123 is any amino acid
  Variant (124)..(129): Xaa in position 124 to 129 is any or no amino acid
  Variant (131)..(137): Xaa in position 131 to 137 is any amino acid
  Variant (139)..(145): Xaa in position 139 to 145 is any amino acid
  Variant (146)..(146): Xaa in position 146 is any or no amino acid
  Variant (149)..(149): Xaa in position 149 is any amino acid
  Variant (151)..(156): Xaa in position 151 to 156 is any amino acid
  Variant (158)..(163): Xaa in position 158 to 163 is any amino acid
  Variant (165)..(173): Xaa in position 165 to 173 is any amino acid
  Variant (175)..(189): Xaa in position 175 to 189 is any amino acid
  Variant (190)..(201): Xaa in position 190 to 201 is any or no amino acid
  Variant (203)..(214): Xaa in position 203 to 214 is any amino acid
  Variant (215)..(225): Xaa in position 215 to 225 is any or no amino acid
  Variant (227)..(227): Xaa in position 227 is any amino acid
  Variant (229)..(231): Xaa in position 229 to 231 is any amino acid
  Variant (232)..(232): Xaa in position 232 is any or no amino acid
  Variant (234)..(234): Xaa in position 234 is any amino acid
  Variant (236)..(240): Xaa in position 236 to 240 is any amino acid
  Variant (242)..(242): Xaa in position 242 is any amino acid
  Variant (244)..(246): Xaa in position 244 to 246 is any amino acid
  Variant (247)..(247): Xaa in position 247 is any or no amino acid
  Variant (249)..(251): Xaa in position 249 to 251 is any amino acid
  Variant (252)..(252): Xaa in position 252 is any or no amino acid
  Variant (254)..(254): Xaa in position 254 is any amino acid
  Variant (256)..(261): Xaa in position 256 to 261 is any amino acid
  Variant (264)..(265): Xaa in position 264 to 265 is any amino acid
  Variant (268)..(278): Xaa in position 268 to 278 is any amino acid
  Variant (280)..(280): Xaa in position 280 is any amino acid
  Variant (281)..(284): Xaa in position 281 to 284 is any or no amino acid
  Variant (286)..(288): Xaa in position 286 to 288 is any amino acid
  Variant (289)..(301): Xaa in position 289 to 301 is any or no amino acid
  Variant (305)..(309): Xaa in position 305 to 309 is any amino acid
  Variant (310)..(311): Xaa in position 310 to 311 is any or no amino acid
  Variant (313)..(320): Xaa in position 313 to 320 is any amino acid
  Variant (321)..(322): Xaa in position 321 to 322 is any or no amino acid
  Variant (324)..(324): Xaa in position 324 is any amino acid
  Variant (328)..(331): Xaa in position 328 to 331 is any amino acid
  Variant (333)..(334): Xaa in position 333 to 334 is any amino acid
  Variant (337)..(338): Xaa in position 337 to 338 is any amino acid
  Variant (340)..(342): Xaa in position 340 to 342 is any amino acid
  Variant (344)..(353): Xaa in position 344 to 353 is any amino acid
  Variant (356)..(363): Xaa in position 356 to 363 is any amino acid
  Variant (364)..(368): Xaa in position 364 to 368 is any or no amino acid
  Variant (370)..(370): Xaa in position 370 is any amino acid
  Variant (372)..(397): Xaa in position 372 to 397 is any amino acid
  Variant (398)..(403): Xaa in position 398 to 403 is any or no amino acid
  Variant (406)..(416): Xaa in position 406 to 416 is any amino acid
  Variant (418)..(419): Xaa in position 418 to 419 is any amino acid
  Variant (421)..(423): Xaa in position 421 to 423 is any amino acid
  Variant (425)..(425): Xaa in position 425 is any amino acid
  Variant (429)..(434): Xaa in position 429 to 434 is any amino acid
  Variant (436)..(439): Xaa in position 436 to 439 is any amino acid
  Variant (440)..(441): Xaa in position 440 to 441 is any or no amino acid
  Variant (443)..(477): Xaa in position 443 to 477 is any amino acid
  Variant (478)..(499): Xaa in position 478 to 499 is any or no amino acid
RHXXMIXXXXXXXIGTGLXXXXGXXXXXXGPXXXXXXXXXXXXXXXXXXXXXXGEXXXXXPXXXXXXXXXFXXYXXXXXXXXXGFXXXXXYXXXWXXXXXXEXXXXXXXXXXWXXXXXXXXXXXXXXXXFXXXXXXXNXXXXXXXXGEXEXXXXXXKXXXXXXFXXXXXXXXXGXXXXXXXXXXXXXXXXXXXXXXXXXXXFXXXXXXXXXXXXXXXXXXXXXXXAXFXXXXGXEXXXXXAXEXXXXPXXXXPXAXXXXXXRIXXFYXXXXXXXXXXXPXXXXXLXXXXXXXXXXXXXXXXSPFXXXXXXXGXXXXXXXXXXNXVILXXXXSXXNSXXYXXXRXXXXXXXXXXAPXXXXXXXXXXXXXGXPXXXXXXXXXXXXXXXXXXXXXXXXXXXXXXXXWLXXXXXXXXXXXWXXIXXXHXRFRXXXXXXGXXXXXXLXXXXXXXXXXXXXXXXXXXXXXXXXXXXXXXXXXXXXXXXXXXXXXXXXXXXXXXXXY

SEQ ID NO: 8561 - protein, 35 aa, Artificial sequence
  protein pattern
  Variant (2)..(3): Xaa in position 2 to 3 is any amino acid
  Variant (4)..(4): Xaa in position 4 is Ile or Val
  Variant (5)..(9): Xaa in position 5 to 9 is any amino acid
  Variant (11)..(11): Xaa in position 11 is any amino acid
  Variant (12)..(13): Xaa in position 12 to 13 is any or no amino acid
  Variant (15)..(20): Xaa in position 15 to 20 is any amino acid
  Variant (21)..(22): Xaa in position 21 to 22 is any or no amino acid
  Variant (24)..(24): Xaa in position 24 is any amino acid
  Variant (25)..(25): Xaa in position 25 is Phe, Ile, Leu, Met or Val
  Variant (26)..(26): Xaa in position 26 is any amino acid
  Variant (27)..(27): Xaa in position 27 is Ala, Asp, Gly, Asn, Ser or Thr
  Variant (28)..(28): Xaa in position 28 is Leu or Met
  Variant (29)..(29): Xaa in position 29 is Ala, Gly, Ser or Thr
  Variant (30)..(33): Xaa in position 30 to 33 is any amino acid
  Variant (34)..(34): Xaa in position 34 is Ala, Gly, Ile or Leu
NXXXXXXXXSXXXSXXXXXXXXRXXXXXXXXXXXP

SEQ ID NO: 8562 - protein, 19 aa, Artificial sequence
  protein pattern
  Variant (2)..(3): Xaa in position 2 to 3 is any amino acid
  Variant (4)..(4): Xaa in position 4 is Ala, Asp, Gly, Pro, Ser or Thr
  Variant (5)..(5): Xaa in position 5 is Ala, Ser, Thr or Val
  Variant (6)..(7): Xaa in position 6 to 7 is any amino acid
  Variant (8)..(8): Xaa in position 8 is Phe or Tyr
  Variant (9)..(9): Xaa in position 9 is Ala or Gly
  Variant (11)..(11): Xaa in position 11 is any amino acid
  Variant (13)..(15): Xaa in position 13 to 15 is any amino acid
  Variant (16)..(16): Xaa in position 16 is Ala, Gly, Asn or Ser
  Variant (17)..(18): Xaa in position 17 to 18 is any amino acid
NXXXXXXXXEXEXXXXXXK

SEQ ID NO: 8563 - DNA, 1074 bp, ARABIDOPSIS THALIANA
  CDS (1)..(1074)
atggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtga

SEQ ID NO: 8564 - protein, 357 aa, ARABIDOPSIS THALIANA
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 8565 - DNA, 1578 bp, Zea mays
  CDS (127)..(1215)
  misc_feature (1566)..(1566): n is a, g, c or t
  misc_feature (1571)..(1571): n is a, g, c or t
ctcggtaccctccggggcaaagccgaacgaaccagagacagagaagcagagaacccctcctcgacctcggcctctcctcttcctcctccgctcccaaaatcctagggttttgctcgccgcggcgcgatggagcccacctcgtcggcgtcgatcgcgcggcagacgtgggagctggagaacaacattcccgcggcggcctccgacccggacgcgatggacgcgatctaccgctacgacgacgcgtctcaggcgcgggcgcagcaggagaagccttgggccaacgacccgcaccacttccgccgcaccaagatctccgcgctcgcgctgctcaagatggtcgtccacgcccgcgccgggggcaccatcgaggtcatggggctcatgcagggcaagtgtgagggcgacgccatcatcgttatggacgcattcgcgctccccgttgagggcaccgagaccagggtcaatgcccaggccgatgcctacgagtacatggttgactactcaaccatcaacaagcaggctggaaggttggagaatgtggttggctggtatcactcacaccctggctatggatgctggctgtcaggaatcgacgtgtcaactcagatgctcaatcaacaattcacagaaccattcttggctgttgtgatagaccccacaaggaccgtttctgctggtaaagtggagattggagcctttagaacatacccaaaagattacaagccaccagatgagcctgtatctgagtatcagactattccactcaacaagatagaagattttggtgtccattgcaaatcgtactatgctttggatataacttatttcaagtcatccctggattctcacctccttgatctgctctggaacaaatactgggtcaacacgctatcttcatcatcacttctgggcaacagagattatgttgctgggcagatctttgatttagctgataaactagagcaagctgaaggccagctggcacacagtcgatttggtggtatgattatgccatcgcaacgaaagaaagagcaagaagagtctccactggctaaggtaacacgagatagctccaaaatcacagctgagcaggttcacggcctcatgtcacaggtcataaaagacatccttttcaactctgttcacccgtcaagcaaggcaagcacaagtgctccaccagattcatccggtcctgagcctatggttgaagcctgagttccagcggaaggggacaatggatatttgtgttatgttatctgattcagaaggtgcaaaacaagttatcttttgagtacagaatcatcatgtaattatgagttgccatcttgggctgccactgagagggtgtgatttgggtccggttagcaatctcatgtattggatttcggatcagtattcgaagctttcataacgaggagccatcatcttattttaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaactcnagggngggcccg

SEQ ID NO: 8566 - protein, 362 aa, Zea mays
MEPTSSASIARQTWELENNIPAAASDPDAMDAIYRYDDASQARAQQEKPWANDPHHFRRTKISALALLKMVVHARAGGTIEVMGLMQGKCEGDAIIVMDAFALPVEGTETRVNAQADAYEYMVDYSTINKQAGRLENVVGWYHSHPGYGCWLSGIDVSTQMLNQQFTEPFLAVVIDPTRTVSAGKVEIGAFRTYPKDYKPPDEPVSEYQTIPLNKIEDFGVHCKSYYALDITYFKSSLDSHLLDLLWNKYWVNTLSSSSLLGNRDYVAGQIFDLADKLEQAEGQLAHSRFGGMIMPSQRKKEQEESPLAKVTRDSSKITAEQVHGLMSQVIKDILFNSVHPSSKASTSAPPDSSGPEPMVEA

SEQ ID NO: 8567 - DNA, 1553 bp, Triticum aestivum
  CDS (124)..(1218)
gccggccggttcgggagagaacccctattccccttcgtcctcctccccccttccgctcctagctagggttttgcctgcccgccggcctgccgtcagcgacgcccggcgcagccagccagcgcgatggagcccacctcgtcgtcggcggtggcgaggcagacgtgggagctggagaacaacatcccggcggccgcctccgacccggacgccatggacgcgatctaccactacgacgaggcggccaacgcgcgggcccaccaggagaagccctgggccaccgacccgcaccacttccgccgtgccaggatctccgccctcgcgctcctcaagatggtcgtccacgcccgcgccggcggcaccatcgagatcatgggcctcatgcagggcaagttcgagggcgactccatcatcgtcatggacgccttcgcgctccccgtcgagggcaccgagaccagggtcaacgcccaggccgacgcctacgagtacatggtcgagtactccaccatcaacaagcaggctggaaggttggaaaatgtggttggctggtaccactcacatcctggttatggatgctggctgtcaggcattgatgtttcaactcagatgcttaatcagcagtttcaagaaccatggttggctgttgtgatagaccctacaaggactgtttctgctggtaaagtggacattggagcttttaggacatacccaaaagattacaagccaccggatgagcctgtgtctgagtatcagaccataccactcaacaagatagaagattttggtgttcactgcaaacagtactattctttggatataacctatttcaagtcatccctggactctcacctccttgatctactctggaacaagtactgggtcaacacattatcttcatcaccacttctgggcaacagggattatattgctggacaaatctttgatttagctgataaactagagcaagctgaagggcaactggcacacagtcgatttggcatgcttatgccatcacagcgaaagaaagagcaagaggagtcgccgctggctaaggtaacccgggatagctccaaaattaccgctgaacaggttcatggtctcatgtcacaggtcatcaaggacatcctcttcaactctgtgcacccgtcaagcaaaagcaaggcaagcgcaagcggagccgccccagattcaccagtgcctgagcccatggtcgaagcatgagagttccagtgaaattttgatgctggattaacctacaccgggcttgcgagccgtttcatcactttgaatcgtggccagcatagttatctgattcggactttggtcggctgggagcttcatcatctgtcaaatcagaattggcatgtaattatgagttaccttttgcatctagtgatgccactgaagaggttctgttatttacttttaggagtttgattgaagtcaccttgggtaaaccatgcggctattatgtttggtggatgttgacagcctttctgattggtcggcacaatctacctatgttcaaggtctctatcaaacagtgcgctcaattt

SEQ ID NO: 8568 - protein, 364 aa, Triticum aestivum
MEPTSSSAVARQTWELENNIPAAASDPDAMDAIYHYDEAANARAHQEKPWATDPHHFRRARISALALLKMVVHARAGGTIEIMGLMQGKFEGDSIIVMDAFALPVEGTETRVNAQADAYEYMVEYSTINKQAGRLENVVGWYHSHPGYGCWLSGIDVSTQMLNQQFQEPWLAVVIDPTRTVSAGKVDIGAFRTYPKDYKPPDEPVSEYQTIPLNKIEDFGVHCKQYYSLDITYFKSSLDSHLLDLLWNKYWVNTLSSSPLLGNRDYIAGQIFDLADKLEQAEGQLAHSRFGMLMPSQRKKEQEESPLAKVTRDSSKITAEQVHGLMSQVIKDILFNSVHPSSKSKASASGAAPDSPVPEPMVEA

SEQ ID NO: 8569 - DNA, 1509 bp, Glycine max
  CDS (125)..(1252)
cggaattcccgggtcgacccacgcgtccggctgcgagaagacagaagggggtgtagaggcagctaaaaacaaagagtgtgatagtaagagtagtagaagagcggtctggtccaagtgctgcaatatgcaaggcaaagaaatggaagggttgtcgtcttcatcggcgatcgcgcagaaaacatgggaactcgagaacaacatcatcccgatggacactccgggcggcgccgctatctcctccaccgctaccaccacgacaagcgccgacgactcgatcttctactacgacgaggcggggcagaacgagttccagcgcgacaagccctgggccaacgacccccactacttcaagcgcgtgaagatctccgcactcgcgctcctcaagatggtcgtccacgcgcgctccggcggcaccatcgaggtcatgggcctcatgcagggcaagaccgacgccgacgccatcatcgtcatggacgccttcgccctcccagtcgaaggcaccgagactcgcgtcaatgcccaggccgatgcctacgagtacatggtcgattattcccagaccaacaaacaggctgggcggttggagaatgttgtgggatggtatcactctcatcctggttacggttgctggctgtcggggatcgatgtttcgacgcagatgctgaatcagcagtttcaagagccgtttctagcggttgtgattgacccgacgaggactgtttcggcggggaaggttgagattggggctttcaggacttatcctgaagggtataagcctccggatgagcctatttctgagtaccagactattcctcttaataagattgaggattttggtgttcactgtaaacagtattatgccttggatattacttactttaagtcctctcttgattcacacctcttggacctgctgtggaacaagtattgggtgaatacactgtcgtcttctcctctgttgggtaatggagattatgttgctggacaaatctctgatttagctgagaagctagaacaggcagagaatcagttggcacactcacgctttgggccactaatagcacccacgcctagaaagaaagaggaggaatctccacttgctaagattactcgtgacagcgcaaaaataactgtggagcaagtgcatggtctaatgtcgcaggtcatcaaggacattctgtttaactccgttcatcaagcaaacagaactcgcacagaaccatctggtcccgaaccaatgattgaaagttgattctggctcagctagacatgcgtttatatattctttcctttttttggatatgtcctcattatcggccaactcttaacagtaaatctagccttgtattttgcctctttttttccctcgcgctgtgcatattcttgttttatttcacaagagtatgcatgtactgtcaaccatgcagtggaattcatctaacagaaacaaaaccgttggcaaatactaagttaacaaatacaattgtctgtgctttaatattttaaaaa

SEQ ID NO: 8570 - protein, 375 aa, Glycine max
MQGKEMEGLSSSSAIAQKTWELENNIIPMDTPGGAAISSTATTTTSADDSIFYYDEAGQNEFQRDKPWANDPHYFKRVKISALALLKMVVHARSGGTIEVMGLMQGKTDADAIIVMDAFALPVEGTETRVNAQADAYEYMVDYSQTNKQAGRLENVVGWYHSHPGYGCWLSGIDVSTQMLNQQFQEPFLAVVIDPTRTVSAGKVEIGAFRTYPEGYKPPDEPISEYQTIPLNKIEDFGVHCKQYYALDITYFKSSLDSHLLDLLWNKYWVNTLSSSPLLGNGDYVAGQISDLAEKLEQAENQLAHSRFGPLIAPTPRKKEEESPLAKITRDSAKITVEQVHGLMSQVIKDILFNSVHQANRTRTEPSGPEPMIES

SEQ ID NO: 8571 - DNA, 1128 bp, Glycine max
  CDS (1)..(1128)
atgcaaggcaaagaaatggaagggttgtcgtcttcatcggcgatcgcgcagaaaacatgggaactcgagaacaacatcatcccgatggacactccgggcggcgccgctacctcctccaccgctaccaccacgaccaacgccgacgactcgatcttctactacgacgaggcggggcagaacgagttccagcgcgacaagccctgggccaacgacccccactacttcaagcgcgtgaagatctccgcactcgcgctcctcaagatggtcgtccacgcgcgctccggcggcaccatcgaggtcatgggcctcatgcagggcaagaccgacgccgacgccatcatcgtcatggacgccttcgccctcccagtcgaaggcaccgagactcgcgtcaatgcccaggccgatgcctacgagtacatggtcgattattcccagaccaacaaacaggctgggcggttggagaatgttgtgggatggtatcactctcatcctggttacggttgctggctgtcggggatcgatgtttcgacgcagatgctgaatcagcagtttcaagagccgtttctagcggttgtgattgacccgacgaggactgtttcggcggggaaggttgagattggggctttcaggacttatcctgaagggtataagcctccggatgagcctatttctgagtaccagactattcctctcaataagattgaggattttggtgttcactgtaaacagtattatgccttggatattacttactttaagtcctctcttgattcacacctcttggacctgctgtggaacaagtattgggtgaatacactgtcgtcttctcctctgttgggcaatggagattatgttgctggacaaatctctgatttagctgagaagctagaacaggcagagaatcagttggcacactcacgctttgggccactaatagcacccacgcctagaaagaaagaggaggaatctccacttgctaagattactcgtgacagcgcaaaaataactgtggagcaagtgcatggtctaatgtcgcaggtcatcaaggacattctgtttaactccgttcatcaagcaaacagaactcgcacagaaccatctggtcccgaaccaatgattgaaagttga

SEQ ID NO: 8572 - protein, 375 aa, Glycine max
MQGKEMEGLSSSSAIAQKTWELENNIIPMDTPGGAATSSTATTTTNADDSIFYYDEAGQNEFQRDKPWANDPHYFKRVKISALALLKMVVHARSGGTIEVMGLMQGKTDADAIIVMDAFALPVEGTETRVNAQADAYEYMVDYSQTNKQAGRLENVVGWYHSHPGYGCWLSGIDVSTQMLNQQFQEPFLAVVIDPTRTVSAGKVEIGAFRTYPEGYKPPDEPISEYQTIPLNKIEDFGVHCKQYYALDITYFKSSLDSHLLDLLWNKYWVNTLSSSPLLGNGDYVAGQISDLAEKLEQAENQLAHSRFGPLIAPTPRKKEEESPLAKITRDSAKITVEQVHGLMSQVIKDILFNSVHQANRTRTEPSGPEPMIES

SEQ ID NO: 8573 - DNA, 1125 bp, Glycine max
  CDS (1)..(1125)
atgcaaggcaaagaaatggaagggttgtcgtcttcgtcggcgatcgcgcagaaaacatgggaactcgagaacaacatcatcccgatggacactccgggcggcgccgccatctcctccacaaccaccacgacaagcgccgacgactcgatcttctactacgacgaggcgggccagaacgagttccagcgcgacaagccctgggccaacgacccccactacttcaagcgcgtgaagatctccgcactcgcgctcctcaagatggtcgtccacgcgcgctccggcggcaccatcgaggtcatgggcctcatgcagggcaagaccgacgccgacgccatcatcgtcatggacgccttcgccctccccgtcgaaggcactgagactcgcgtcaatgcccaggccgatgcgtacgagtacatggtcgattattcacagacaaacaaacaggcagggcggttggagaatgtagtgggatggtatcactctcaccctggttatggttgctggctgtcggggatcgatgtttcgacgcagatgctgaatcagcagtttcaggagccgtttctggcggttgtgattgacccgacgaggaccgtttcggcggggaaagttgagattggggctttcaggacttaccctgaagggtataagcctccggatgagcctgtttctgagtaccagaccattcctcttaataagattgaggactttggtgttcactgtaaacagtattatgcattggacatcacttactttaagtcgtctcttgattcacacctcttggacctgctgtggaacaagtattgggtgaatacactgtcgtcttctcctctgttgggtaatggagattatgttgctggacaaatctctgatttagctgagaagctagaacaagcagagaatcagttggcacactcacgctttgggccactaatagcacccacacctagaaagaaagaggaggaatctccacttgctaagattactcgtgacagtgcaaaaataactgtggagcaagtgcatggtctaatgtcacaggttattaaggacattctgtttaactccgtccatcaagcaaacagaactcgcacagaagcatctggtcccgaaccaatgattgaaagctga

SEQ ID NO: 8574 - protein, 374 aa, Glycine max
MQGKEMEGLSSSSAIAQKTWELENNIIPMDTPGGAAISSTTTTTSADDSIFYYDEAGQNEFQRDKPWANDPHYFKRVKISALALLKMVVHARSGGTIEVMGLMQGKTDADAIIVMDAFALPVEGTETRVNAQADAYEYMVDYSQTNKQAGRLENVVGWYHSHPGYGCWLSGIDVSTQMLNQQFQEPFLAVVIDPTRTVSAGKVEIGAFRTYPEGYKPPDEPVSEYQTIPLNKIEDFGVHCKQYYALDITYFKSSLDSHLLDLLWNKYWVNTLSSSPLLGNGDYVAGQISDLAEKLEQAENQLAHSRFGPLIAPTPRKKEEESPLAKITRDSAKITVEQVHGLMSQVIKDILFNSVHQANRTRTEASGPEPMIES

SEQ ID NO: 8575 - DNA, 1119 bp, Physcomitrella patens subsp. patens
  CDS (1)..(1119)
atggaggcctccacgtcctctgcgatggtagctcgccagacatgggagattgagaacaatatcgtcgccatggaatcacccgcagctgcttcagattccgatgccatctttgagtacgacgaggcttctcagagcagcatccaacagctgaagccttggaatcgcgaccctcacttcttcaaaaacgtcaaaatatccgccctcgcgctgctcaagatggtcgttcattcccgatcaggtggcacgattgaggtcatgggcttgatgcagggaaagacggatggagatactataataataatggatgcatttgctttgccagtagagggcacggagactcgagtgaatgctcaagcagatgcttatgagtatatggtgcagtactctcaaacaaataaacaggtgggaaggctagaaaacgtggtaggctggtaccattcgcatcctggctatggatgttggctttcaggtatcgatgtatccactcaaatgttgaatcagacttatcaggagcccttcttagccgtggtaattgatccaacacgcactgtgtctgctggaaaagttgagattggagcattccgcacctatcctcagggttacaagccgccagatgaacccccatctgagtatcaaacgatacctttaaacaaaattgaggattttggtgttcattataaacagtattattctcttgatataacctattttaagtcgtcattggattcgcacctcctggacctcctctggaataaatattgggtcaatactctttcatcctcacctttgctcgccaatcgagattatgtggcaggacaagtggccgatcttgccgagaaactggagcaagcagagagtcagctagctcattctgggcgtatgggagggttcttcatgccagtgcaaaagaaaaaggaggaagagtcacagcttgccaagatatcgcgtgacagttccaagataactgtggagcagctgcacgggcttatgtcgcaggttatcaagaatactttgttcaatgtagtgacgtcaagtgcctctgcttctgctgcagcgtctgctgaaacacctacttcagccacagactcctcgggaccggaacctatggtagaggcataa

SEQ ID NO: 8576 - protein, 372 aa, Physcomitrella patens subsp. patens
MEASTSSAMVARQTWEIENNIVAMESPAAASDSDAIFEYDEASQSSIQQLKPWNRDPHFFKNVKISALALLKMVVHSRSGGTIEVMGLMQGKTDGDTIIIMDAFALPVEGTETRVNAQADAYEYMVQYSQTNKQVGRLENVVGWYHSHPGYGCWLSGIDVSTQMLNQTYQEPFLAVVIDPTRTVSAGKVEIGAFRTYPQGYKPPDEPPSEYQTIPLNKIEDFGVHYKQYYSLDITYFKSSLDSHLLDLLWNKYWVNTLSSSPLLANRDYVAGQVADLAEKLEQAESQLAHSGRMGGFFMPVQKKKEEESQLAKISRDSSKITVEQLHGLMSQVIKNTLFNVVTSSASASAAASAETPTSATDSSGPEPMVEA

SEQ ID NO: 8577 - DNA, 930 bp, Physcomitrella patens subsp. patens
  CDS (1)..(930)
atggattcaaggctgcacaggatttttgctgggggcggttctggaggtggaccgcatccagattcacccctcgttgattcgtcggagcaagtgtacatttcctctctggcgctgctcaaaatgctcaaacatggtagagctggagtgcctatggaggtgatggggctgatgcttggggagttcgtggacgagtacactgttcgtgttgtggatgtatttgctatgccacagagtggaacaggtgtaagtgtggaagcagttgaccctgtctttcaaacgaagatgcttgatatgctcaagcaaactggtcgaccagagatggtggtgggctggtaccattctcatccaggttttggttgctggttgtctggcgtggatatcaatactcagcagagttttgaagctttgaatcaaagggcggtagcagtagtagtggatccaatccaaagtgtgaaaggaaaggttgtgatcgatgcttttcgattgatcaaccctcaaacaatgatgttgggacaggagcccagacaaaccacatcgaacgttggacatcttaacaagccctccatccaggctttaatccatggattaaaccgacactactattcaatcggaattaattatcggaagaatgaactagaagagaaaatgcttttgaaccttcacaagaagaagtggactgatggacttactcttcagcgatatgacgagcatggaaaaactaatgaagccacagtgaaagaaatgttggatttagcaatcaagtacaataaagctgtgcaggaggaagaccagcttagtccagagaaattggctattgtcaatgtggggcgtcaagatgcgaagaagcacctagaagagcatgtctctaatttgatgtcgtctaatattgtacagaccttagggaccatgcttgacaccgttgtcttctag

SEQ ID NO: 8578 - protein, 309 aa, Physcomitrella patens subsp. patens
MDSRLHRIFAGGGSGGGPHPDSPLVDSSEQVYISSLALLKMLKHGRAGVPMEVMGLMLGEFVDEYTVRVVDVFAMPQSGTGVSVEAVDPVFQTKMLDMLKQTGRPEMVVGWYHSHPGFGCWLSGVDINTQQSFEALNQRAVAVVVDPIQSVKGKVVIDAFRLINPQTMMLGQEPRQTTSNVGHLNKPSIQALIHGLNRHYYSIGINYRKNELEEKMLLNLHKKKWTDGLTLQRYDEHGKTNEATVKEMLDLAIKYNKAVQEEDQLSPEKLAIVNVGRQDAKKHLEEHVSNLMSSNIVQTLGTMLDTVVF

SEQ ID NO: 8579 - DNA, 930 bp, Physcomitrella patens subsp. patens
  CDS (1)..(930)
atggattcaagactgaataggattttcgccgggagcggtggagggggtggcccgcacccagactcgcctctcgttgattcatcggagcaagtctacatttcttccctggcgttgcttaaaatgcttaaacatggtagagcgggagttcctatggaagtgatgggactgatgctcggggagtttgtggacgagtacactgttcgtgtcgtagatgtatttgctatgcctcagagtggaactggcgtgagtgttgaagcagttgaccccgtttttcaaacgaagatgctcgacatgctcaagcaaactggccggcctgagatggtcgttgggtggtatcattcacatccagggtttggctgctggttgtctggcgtggatatcaatacgcaacagagttttgaagctttgaatcaaagagctgtggcagtagtggtggatccaatccaaagtgtgaaaggaaaggttgtgattgatgcttttcgattgatcaacccccagacaatgatgttgggacaggagcctaggcagaccacttcaaatgttggtcatcttaacaagccttccattcaggctttgattcatggattgaaccgacactattattctattggcattaattatcggaagaatgaattggaagagaaaatgcttttgaaccttcacaagaagaagtggactgatggactcactctgcaacgatacgacgaacatggaaaaactaatgagtccacggtgaaggaaatgttagatctcgcaatcaagtacaataaggctgtgcaagaagaagaccagctcagtccagagaagttggctattgccaatgtggggcgtcaagatgcaaagaagcatttagaagagcatgtctctaatttgatgtcttccaatattgtgcagaccttgggaaccatgcttgacaccgttgtcttctag

SEQ ID NO: 8580 - protein, 309 aa, Physcomitrella patens subsp. patens
MDSRLNRIFAGSGGGGGPHPDSPLVDSSEQVYISSLALLKMLKHGRAGVPMEVMGLMLGEFVDEYTVRVVDVFAMPQSGTGVSVEAVDPVFQTKMLDMLKQTGRPEMVVGWYHSHPGFGCWLSGVDINTQQSFEALNQRAVAVVVDPIQSVKGKVVIDAFRLINPQTMMLGQEPRQTTSNVGHLNKPSIQALIHGLNRHYYSIGINYRKNELEEKMLLNLHKKKWTDGLTLQRYDEHGKTNESTVKEMLDLAIKYNKAVQEEDQLSPEKLAIANVGRQDAKKHLEEHVSNLMSSNIVQTLGTMLDTVVF

SEQ ID NO: 8581 - DNA, 1119 bp, Physcomitrella patens subsp. patens
  CDS (1)..(1119)
atggaggcatcgacgtcctctgcgatgatagcgcgccagacatgggagatagagaataatatcgttgccacggattcgcccgcagctacttcagattccgatgccatctttgagtacgacgaagcggctcagagcagcattcagcagcagaagccttggactcgcgatccccactacttcaaaaatgtcaagatatctgccctcgcactgctcaagatggtggttcatgcacgatctggtggcacgattgaagtcatgggcttgatgcagggaaagacggacggggataccattataatcatggatgcgtttgctttgccagtagagggcacagagactcgggtgaatgctcaagcggatgcgtatgagtacatggtccagtactctcaaacgaataagcaggtggggagactagaaaatgtggtaggctggtatcactcgcatcctggctacggttgttggctttcgggtattgatgtgtccactcagatgctgaatcagacttaccaggaacccttcttagccgtggttattgacccaacgcgcactgtgtccgctggaaaagttgagattggagcattccgcacctatcctcagggttacaagccgccagatgagcccccatctgagtatcaaacaattcctttaaataaaattgaggactttggtgtccattataaacagtattattctcttgatataacctatttcaagtcatcattggattcgcacctgctggatctcctctggaacaaatactgggtcaacactctttcatcatcacctttgcttggcaatcgggactatgtcgcagggcaagtggctgatcttgcggagaagctggagcaagcagagagccagctagctcattctgggcgcatgggaggattcttcatgccagtacaaaagaagaaggaggaagagtcccagcttgcaaaaatctctcgcgacagttccaagataaccgtggagcagctgcatgggctaatgtcacaggtcattaaggatactttgttcaactcagtgatgtcaagtagcaacgcgcctgtggcaatgtcagctgaaacatctattgtagccacagattcctctggaccagaacctatggtggaggcatag

SEQ ID NO: 8582 - protein, 372 aa, Physcomitrella patens subsp. patens
MEASTSSAMIARQTWEIENNIVATDSPAATSDSDAIFEYDEAAQSSIQQQKPWTRDPHYFKNVKISALALLKMVVHARSGGTIEVMGLMQGKTDGDTIIIMDAFALPVEGTETRVNAQADAYEYMVQYSQTNKQVGRLENVVGWYHSHPGYGCWLSGIDVSTQMLNQTYQEPFLAVVIDPTRTVSAGKVEIGAFRTYPQGYKPPDEPPSEYQTIPLNKIEDFGVHYKQYYSLDITYFKSSLDSHLLDLLWNKYWVNTLSSSPLLGNRDYVAGQVADLAEKLEQAESQLAHSGRMGGFFMPVQKKKEEESQLAKISRDSSKITVEQLHGLMSQVIKDTLFNSVMSSSNAPVAMSAETSIVATDSSGPEPMVEA

SEQ ID NO: 8583 - DNA, 1056 bp, Arabidopsis thaliana
  CDS (1)..(1056)
atggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggtgagtaaatacaatctgacaatgctgatcctatttccccttgcggttaatggatccatgaaattgacttaa

SEQ ID NO: 8584 - protein, 351 aa, Arabidopsis thaliana
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVSKYNLTMLILFPLAVNGSMKLT

SEQ ID NO: 8585 - DNA, 1101 bp, Nasonia vitripennis
  CDS (1)..(1101)
atggcagaggagaatattcaggtaatgaaagaaatcgaactcgaaatggcaggttatctttcagattctcaaagcaacattgctcagaaaacatgggaaatggaaaacaatgtcgagacaattagcacaatcgatgagatatacagatatgacaggaaagagcaacaggacatccttgctgcaaaaccatgggagaaagatccacacttcttcaaagatataaaaatttcggctttagctttactgaaaatggttatgcatgcacgttctggtggaacacttgaagtgatgggtttgcttcttggaaaagtaactgcaaatactatgcttgtcatggattcttttgctttacccgtggaaggaactgaaacacgtgtaaatgcacaagctcaagcttatgaatacatgacagcgtatatcgatgctgccaagcaggttggaaggcaggagaatgctattggttggtatcacagtcatcctggttatggatgctggctttctggcattgatgtttctactcaaatgttgaaccagaatttccaagaaccatttgttgctattgtcattgatccagttaggacaatatcagcaggaaaagtttgcttgggagcatttagaacgtacccaaagggctacaaaccagcaaatgaagaaccatctgagtatcaaactattcctttaaataaaattgaagattttggagttcattgtaagcaatactattcccttgaagtgacatactttaaatcatcactggatcgaaggttacttgattctttatggaataaatactgggtcaatactctgagttcttctagtttgttaactaacactgactacacaactggacaaatattcgacttatctgataaattggaacaatctgagcaagcattaggtcgaggatatgttcttggtggagtagagctacatgatcgatgcactgtagataaacttgtaaaagctactagggacagtagcaaaaccacaattgaagtaattcatgggctaatggcacaaattattaaggatagactttttaaccaagttggagtcaaaaaggaagaaatggaagaagcttctgctgaagaaacagcgtga

SEQ ID NO: 8586 - protein, 366 aa, Nasonia vitripennis
MAEENIQVMKEIELEMAGYLSDSQSNIAQKTWEMENNVETISTIDEIYRYDRKEQQDILAAKPWEKDPHFFKDIKISALALLKMVMHARSGGTLEVMGLLLGKVTANTMLVMDSFALPVEGTETRVNAQAQAYEYMTAYIDAAKQVGRQENAIGWYHSHPGYGCWLSGIDVSTQMLNQNFQEPFVAIVIDPVRTISAGKVCLGAFRTYPKGYKPANEEPSEYQTIPLNKIEDFGVHCKQYYSLEVTYFKSSLDRRLLDSLWNKYWVNTLSSSSLLTNTDYTTGQIFDLSDKLEQSEQALGRGYVLGGVELHDRCTVDKLVKATRDSSKTTIEVIHGLMAQIIKDRLFNQVGVKKEEMEEASAEETA

SEQ ID NO: 8587 - DNA, 1011 bp, Aedes aegypti
  CDS (1)..(1011)
atggccgattccgagctggcccgcaagaactgggagctggagaacaacatcgaaacgctgccggcgagtgacgaaatcttccgctatgatgccgaacagcagcagcgaatcctggcggcccgaccctgggacaaggatccgcacttcttcaaggacattaagatttccgctttggcgctgctgaagatggtgatgcatgcccgctcgggtggggctctggaagtgatgggactgctgctggggaaggtcgaagaggacaccatggtggtgatggatgcctttgctcttccggttgagggaacggaaacccgggttaatgcccagtcgcaggcttacgagtacatgacggcctatatcgaggcggccaaggaggtgggtcggtgtgagaatgccatcgggtggtaccacagccatcccgggtatggatgctggctgtcggggattgacgttaacacgcagatgctgaaccagaactaccaggaaccgtttgtggccatcgtggtggacccggtcaggaccgtttccgccgggaaggtttgcctgggggcattccgaacgtatcctaagggatacaaaccaccaaacgaggaaccgtccgagtaccaaacgatcccgttgaacaaaatcgaagactttggcgttcattgcaagcagtactatcagctggaggtttcctacttcaagtcggctttggaccgcaaattgctggactctttgtggaacaagtactgggtcaatacgttgggcagctcgggtctgttgagcaacgctgactacacaaccggtcagatcttggatctgtcggagaagttggaactgagcgaagctagcttgggacgtggtccgttcgtagtcagcggaaccgatccgaacgagaaacgcacggaagataagctctcgaaggctactcgcgactgcagccggacttccatcgaactgatccacggattgatggcccagatcgccaaggacaagctgttcaacacggtcaatgtgaagaccgccaagtga

SEQ ID NO: 8588 - protein, 336 aa, Aedes aegypti
MADSELARKNWELENNIETLPASDEIFRYDAEQQQRILAARPWDKDPHFFKDIKISALALLKMVMHARSGGALEVMGLLLGKVEEDTMVVMDAFALPVEGTETRVNAQSQAYEYMTAYIEAAKEVGRCENAIGWYHSHPGYGCWLSGIDVNTQMLNQNYQEPFVAIVVDPVRTVSAGKVCLGAFRTYPKGYKPPNEEPSEYQTIPLNKIEDFGVHCKQYYQLEVSYFKSALDRKLLDSLWNKYWVNTLGSSGLLSNADYTTGQILDLSEKLELSEASLGRGPFVVSGTDPNEKRTEDKLSKATRDCSRTSIELIHGLMAQIAKDKLFNTVNVKTAK

SEQ ID NO: 8589 - DNA, 1035 bp, Magnaporthe grisea 70-15
  CDS (1)..(1035)
atggatgttgctatgaagtcgtgggagctcgacaacaacgtcaaactggtcgacccatctcgcgatgccctctacaactacgacgccgagtcccaaaaggcaatcaaccagcaaaggccatgggccaaggacccaaactacttcaagtctgtgcgcatcagcgccatcgccctgatcaagatggtgatgcacgcccggtccggcggctcgctcgaggtcatggggatgatgcagggctacgtggacgggacggcgctcgtggtcacggacgccttcaggcttccggtagaaggcaccgagacgagggttaacgcgcacgacgaggcaaatgagtacctggtcgagtacctccggctcagccgcgagcagggcaggctggagaacgtggtcgggtggtaccacagccaccccgggtacgggtgctggctgtcgggcatcgacgtgagcacgcagttcctgcagcagcagttcatggaccccttcgtcgctgttgtcatcgacccggaccgcaccatcagcgccggcaaggtcgagatcggcgcctttaggacctatcccgagaactacaaggccgaggaggccagcacgtcggatgggtaccagccagtgcccctggccaaagctgaggactttggcgcccacgcgagcaggtactacgcccttgagacggagcacttcaagagtaccctcgacgcccaccttctggagttactgtggaacaagtactgggtccagaccctgtcgcagagccccctcatcaccaatcgtgactacggcaacaagcagatgctcgacctgggaagcaggatcagggacgttgttggcgtcatgcagcgcaacggccgctccggtcagtcgggttacggcatggccttgggaggcgcctccggcaccagtaaagctgtcgagagcgccatcgagaccatggccagggacagcatgcacgttgccgccagccagagggccgctctgatggcgggtgagctaaaggcaaaggtgtttaccggccaggctgagccgtcggctgcgtcgtag

SEQ ID NO: 8590 - protein, 344 aa, Magnaporthe grisea 70-15
MDVAMKSWELDNNVKLVDPSRDALYNYDAESQKAINQQRPWAKDPNYFKSVRISAIALIKMVMHARSGGSLEVMGMMQGYVDGTALVVTDAFRLPVEGTETRVNAHDEANEYLVEYLRLSREQGRLENVVGWYHSHPGYGCWLSGIDVSTQFLQQQFMDPFVAVVIDPDRTISAGKVEIGAFRTYPENYKAEEASTSDGYQPVPLAKAEDFGAHASRYYALETEHFKSTLDAHLLELLWNKYWVQTLSQSPLITNRDYGNKQMLDLGSRIRDVVGVMQRNGRSGQSGYGMALGGASGTSKAVESAIETMARDSMHVAASQRAALMAGELKAKVFTGQAEPSAAS

SEQ ID NO: 8591 - DNA, 1035 bp, Apis mellifera
  CDS (1)..(1035)
atggcaagcacttcttctgatcaaagcactattgccaaaaagacatgggaaatgtcaaataatattgaaacaattagcacggttgatgaaatttatagatatgatcgaaaagaacaacaggatatattagcagcaaaaccatgggaaaaagatcctcatttttttaaagatataaaaatctctgcattagcattattaaagatggttatgcatgctcgttctggaggaactttagaagtaatgggtcttttgcttggaaaagttgcagcaaatacaatgattgttatggattcttttgcattacctgtagaaggcacagaaacaagagttaatgcacaagcacaggcatatgaatatatgacagcatatatagaagcagctaaacaagttggaagacaagaaaatgctattggatggtatcatagccatcctggttatggatgctggttatcaggtattgatgtatctacacaaatgcttaatcaaaattttcaagaaccatttgttgctattgtaattgatcctgtaagaacaatatctgctggtaaagtttgtttgggtgcatttagaacttatccaaagggatataaaccagcaaatgaagagccatctgagtatcaaacaattcctttaaataaaattgaagattttggtgttcactgtaaacaatattattctttagaagtttcttatttcaaatcatcattagatagaagattactagattctttgtggaataagtattgggtgaatacattaagttcttctagtcttttaacaaatgctgattatactactggacaaatatttgatttatcagataaacttgaacaatcagaagttgcacttggaagaggatttattttaggtggaacagatccccatgatcgcagtactgtagaaaaattaatgaaagcaacaagagatagttgtaaaactactattgaaattattcacggattaatggcacaaataattaaagatagattattcaatcaagttgggtgtaatcctattgaatctcaacaacaataa

SEQ ID NO: 8592 - protein, 344 aa, Apis mellifera
MASTSSDQSTIAKKTWEMSNNIETISTVDEIYRYDRKEQQDILAAKPWEKDPHFFKDIKISALALLKMVMHARSGGTLEVMGLLLGKVAANTMIVMDSFALPVEGTETRVNAQAQAYEYMTAYIEAAKQVGRQENAIGWYHSHPGYGCWLSGIDVSTQMLNQNFQEPFVAIVIDPVRTISAGKVCLGAFRTYPKGYKPANEEPSEYQTIPLNKIEDFGVHCKQYYSLEVSYFKSSLDRRLLDSLWNKYWVNTLSSSSLLTNADYTTGQIFDLSDKLEQSEVALGRGFILGGTDPHDRSTVEKLMKATRDSCKTTIEIIHGLMAQIIKDRLFNQVGCNPIESQQQ

SEQ ID NO: 8593 - DNA, 1065 bp, Aspergillus nidulans FGSC A4
  CDS (1)..(1065)
atgcaagctgctcaactatcctgggagctagagaatgctgttaccctgattgatccccaacgagactccctctacagatacgacgaggaaacccacaaataccttagtgatacccgtccatggaccaaagaccctcactattttaaatcagttcggatctccgccgtcgctctcctgaaaatggtcatgcacgcccgctccggcggttcgctcgaagtcatgggtctgatgcaaggctatatcctccccaacacattcgtcgtaacagacgccttccgcctccccgtggagggcacagagactcgagttaacgcgcaagacgaagcaaacgagtatatggtctcatatctccagtcgtgtcgggaagcagggaggatggaaaacgcagtggggtggtaccacagtcaccctggctacgggtgctggctttcgggcattgacgtttctacgcaggatatgcagcaaatgagcgggccatttgttgctgttgtcattgatcccgaacgtacgatctctgcgggaaaggtagacatcggtgcgttcaggacgttccctaaggactataccccccccaaggaggagcaagaagaagacgaataccagaccgtaccgcttaacaaagccgaggactttggagcacacgcttcccattactactcacttgaggtgtcactttttaaaagcgcccttgatactgagattctctccctcctctggaataagtactgggtcgccacgctcagccaaagccctctattcaccactcgcgactacggaagtaaacagatgctcgacctcagccagaagacgcgtcgggtagcccgcggaattgagagcaacccgcctcgaggaggcgcccctacccaggtcagagatcagcaactcgagagagtagtaaaggacggccagcggattgtatcggaggaagtcaagggactattagccgccgaagtcaagatgcagctgtttcaggtgggtatgcatcaggcgtgggcctcagttacagcagacctaggaccacacaatgccaaacaaccttcgatcagctaccgcggaggcacctag

SEQ ID NO: 8594 - protein, 354 aa, Aspergillus nidulans FGSC A4
MQAAQLSWELENAVTLIDPQRDSLYRYDEETHKYLSDTRPWTKDPHYFKSVRISAVALLKMVMHARSGGSLEVMGLMQGYILPNTFVVTDAFRLPVEGTETRVNAQDEANEYMVSYLQSCREAGRMENAVGWYHSHPGYGCWLSGIDVSTQDMQQMSGPFVAVVIDPERTISAGKVDIGAFRTFPKDYTPPKEEQEEDEYQTVPLNKAEDFGAHASHYYSLEVSLFKSALDTEILSLLWNKYWVATLSQSPLFTTRDYGSKQMLDLSQKTRRVARGIESNPPRGGAPTQVRDQQLERVVKDGQRIVSEEVKGLLAAEVKMQLFQVGMHQAWASVTADLGPHNAKQPSISYRGGT

SEQ ID NO: 8595 - DNA, 1035 bp, Tribolium castaneum
  CDS (1)..(1035)
atgtcgaagccggggacctccgaaacccaggaacaaatcgcacaaaaaacctgggaaatggccaataaagtcgaactggtgaactcggtcgacgatatttaccgctacgacaagaagcagcagcaagacatcctcgccgcgaagccctgggagaaagaccctcacttcttcaaagatatcaaaatctcggccttggccctcttgaaaatggtcatgcacgcgcgttcggggggcaccctggaggtcatgggcctgattttgggcaaagtcgacggaaacacaatgtttgtgatggactcgtttgcgctgcctgtggaagggacagagacccgagtcaacgcacaagctcaggcttacgagtacatgagttcgtacatcgaggctgcgaagctggtgggccgccaggagaacgcgataggctggtaccacagccacccgggatacgggtgctggttgtctgggattgacgttggcacccagatgctcaaccagaatttccaggaaccgttcgttgccattgtgattgatcctgtgagaaccatttccgcggggaaggtgtgtctaggggcgttcaggacgtacccgaaagggtacaaaccagcaaatgaggaaccgtcagagtaccagaccattcctctgaacaaaatcgaggattttggggtgcattgcaaacaatattattcgcttgaagtgtcgtattttaaatcgtcacttgataggcgattgcttgattccttgtggaacaaatattgggtcaatactttgagctcgtctagtttgttaacgaatgctgattacacaactgggcaaatttttgatttgtcggagaagttggaacagtcggaagcggccattgggcgcggggggttcatcgtaggcggcactgatccgcacgaaaaacgaacagaagacaaactgttgaaagctacaaaggacagttgcaagactacgattgagattattcacggactgatggcccaaatgatcaaagaccggctttttaacagcacttccttgaataattcgacccattaa

SEQ ID NO: 8596 - protein, 344 aa, Tribolium castaneum
MSKPGTSETQEQIAQKTWEMANKVELVNSVDDIYRYDKKQQQDILAAKPWEKDPHFFKDIKISALALLKMVMHARSGGTLEVMGLILGKVDGNTMFVMDSFALPVEGTETRVNAQAQAYEYMSSYIEAAKLVGRQENAIGWYHSHPGYGCWLSGIDVGTQMLNQNFQEPFVAIVIDPVRTISAGKVCLGAFRTYPKGYKPANEEPSEYQTIPLNKIEDFGVHCKQYYSLEVSYFKSSLDRRLLDSLWNKYWVNTLSSSSLLTNADYTTGQIFDLSEKLEQSEAAIGRGGFIVGGTDPHEKRTEDKLLKATKDSCKTTIEIIHGLMAQMIKDRLFNSTSLNNSTH

SEQ ID NO: 8597 - DNA, 1092 bp, Picea sitchensis
  CDS (1)..(1092)
atggaggtctcaagtgcttcttcttccgccacaatagcacagcaaacatgggagcttgagaacaacatagttaacatggatggcccttctgcagagtctgactcaatatattactatgatgaagttacgcagaagaaaattcagcaggacaagccatgggccagggatccccattacttcaagaaggtgaagatatcagcactggctctgttgaagatggtggtgcattctaggtctgggggtacaatagaggtcatgggtcttatgcaggggaagactgacggtgataccattattgtcatggatgcatttgcccttcctgtggaaggaactgaaaccagagtcaatgcacaggctgatgcttatgaatatatggtggattatgcccagactaacaagcaggttggacgcttggaaaatgttatagggtggtatcattcacatcctgggtatggttgctggctttctggtattgatgtgaacacacagatgcttaatcagcagtttcaggaacctttcttagcagtagttatagatcccacaagaactgtatctgctggaaaagttgagattggtgcttttcgaacatatccccaaggatacaagcctcctgatgagcctgtctctgagtatcaaacaatccctctgaataaaattgaggattttggtgtacactgcaagcactattatgctctggatattacatacttcaagtcatcccttgattctcacctcttggacctcttgtggaataaatattgggtgaatactctttcatcttcaccactcttagggaaccgagattatgttgcaggtcaaatttcagatcttgcggagaagctagagcaagcagaaagtcagttggcccattcacgtgtaggctcatttcttgtgcctccacaaaggaagaaggaggaggaatcacaacttgcaaagattactaaggacagttcaaagattactgttgagcaagtgcatggactgatgtcacaggttatcaaggatatcttgtttaattcagttcaccagtcaacaaaatctggaatagcttttggagagggatcaggacctgagcccatggttgagacctga

SEQ ID NO: 8598 - protein, 363 aa, Picea sitchensis
MEVSSASSSATIAQQTWELENNIVNMDGPSAESDSIYYYDEVTQKKIQQDKPWARDPHYFKKVKISALALLKMVVHSRSGGTIEVMGLMQGKTDGDTIIVMDAFALPVEGTETRVNAQADAYEYMVDYAQTNKQVGRLENVIGWYHSHPGYGCWLSGIDVNTQMLNQQFQEPFLAVVIDPTRTVSAGKVEIGAFRTYPQGYKPPDEPVSEYQTIPLNKIEDFGVHCKHYYALDITYFKSSLDSHLLDLLWNKYWVNTLSSSPLLGNRDYVAGQISDLAEKLEQAESQLAHSRVGSFLVPPQRKKEEESQLAKITKDSSKITVEQVHGLMSQVIKDILFNSVHQSTKSGIAFGEGSGPEPMVET

SEQ ID NO: 8599 - DNA, 1074 bp, Medicago sativa
  CDS (1)..(1074)
atggaagcgtcttcgtcatcatcatcagcgatagcacaacaaacatgggaattagagaacaacataatcccaatggaaactccttcagacgattcaatcttccactacgacgaagcaggacaagccgaattccaacgcgataagccatgggcgaacgatcctcactacttcaagcgtgtcaagatctctgcactcgctcttctcaagatggttgttcacgcgcgttctggtggaacaatcgaagttatgggtcttatgcaaggtaaaactgatgctgattccatcatcgttatggatgcttttgcgctacctgttgaaggtactgaaactcgtgtcaatgctcaagctgatgcttatgaatacatggttgattattctcagaccaacaaacaggctgggaggttggagaatgtcgtgggatggtatcattcacatcctggttatggttgctggctttctgggattgatgtttcgacacagatgttgaatcagcaatttcaggagccgtttttggcggttgtgattgatccgacaagaactgtttctgctgggaaagtggagattggggccttcaggacttaccctgaaggttataagcctgctgatgatcctatttctgagtatcaaactattcctcttaataagattgaagattttggtgtccattgtaaacagtattattccttggatatcacttactttaagtcttctcttgattcacaccttttggatcttctgtggaacaaatattgggtgaatacactttcatcttctcctttattgggcaatggagactatgtagctggacaaatctcggatttagccgaaaagctagaacaagcagagaatcaattggcacactcgcgtttcgggccactggtagcacctacacctagaaagaaagaagaagaatctccacttgctaagatcactcgtgatagtgcaaaaataactgttgaacaagtgcacggtttaatgtcacaggtaatcaaggacatcctgttcaactctgttcatcaagctaacaagtctcatacagaaacatctgaccctgaaccaatgattgaaagttga

SEQ ID NO: 8600 - protein, 357 aa, Medicago sativa
MEASSSSSSAIAQQTWELENNIIPMETPSDDSIFHYDEAGQAEFQRDKPWANDPHYFKRVKISALALLKMVVHARSGGTIEVMGLMQGKTDADSIIVMDAFALPVEGTETRVNAQADAYEYMVDYSQTNKQAGRLENVVGWYHSHPGYGCWLSGIDVSTQMLNQQFQEPFLAVVIDPTRTVSAGKVEIGAFRTYPEGYKPADDPISEYQTIPLNKIEDFGVHCKQYYSLDITYFKSSLDSHLLDLLWNKYWVNTLSSSPLLGNGDYVAGQISDLAEKLEQAENQLAHSRFGPLVAPTPRKKEEESPLAKITRDSAKITVEQVHGLMSQVIKDILFNSVHQANKSHTETSDPEPMIES

SEQ ID NO: 8601 - DNA, 1146 bp, Phaeosphaeria nodorum
  CDS (1)..(1146)
atggaggccgcagcattgaagacgtggggtaagtctatccgatacagagtccacgaaatcatccccaaacaccccgcaatgccccgccacagcaccacagatactaacaaacacgcagagctcgagaactcggtcaagctcgtcgacccgaccaaagatgccctctactcgtactcctcctcagcccagaagtccatggacgaggcccacccatggcgcaccgacccgcactacttcacctcggtgcgcgtctccgccgtcgccatgctcaagatggtcatgcacgcgcgctccggcggctctctcgaagtcatgggcctgatgatgggcaagatcgaagcacacacattcgtcgtcaccgacgccttccgcctgcccgtcgagggcaccgagacccgcgtcaatgcgcaggacgaggcgaacgagtacatggttgagttcttgcagcgcgcacgagaccagggccagatggataatgcggtcggctggtaccattcccatccgggctatgggtgctggttgtccggcatcgatgtcaatacgcagaagacgcagcagcagttctcggaccccttctgcgccatcgtcattgatcctgatcgcactgtcagcgcgggcaaggttgaaattggcgcgttccgaacgttcccagcggcgtatatcgaggagcaggaaaaggtcacgagcaagaccggtggtggcggggctgatggtgatgggttccagacgattccgctgggcaagattgaggactttggcgctcacgctgcgcactactattcgcttgaagtctcccactacaagtcctcgctcgacgccaagatcctagaagccctgtggaacaaatactgggtacagactttgtcctcgtcaccgctgatttcgaaccgcgactacggcaccaaccagattagcgatttggcgcgcaagatacaacaagagacgagcagcagcaagcggtacaagaccatgacagcgggcactggaaacgagaaggaccagctcgctaagctaggtgcggcgggtagcaagattgcgcgggaggaggacatgggcttgttggcggccaaggtcaaggaccaggtgtttaacctcaagggcggcgctcaagagcctgtcagccaggaggtcgagatgaagagctga

SEQ ID NO: 8602 - protein, 381 aa, Phaeosphaeria nodorum
MEAAALKTWGKSIRYRVHEIIPKHPAMPRHSTTDTNKHAELENSVKLVDPTKDALYSYSSSAQKSMDEAHPWRTDPHYFTSVRVSAVAMLKMVMHARSGGSLEVMGLMMGKIEAHTFVVTDAFRLPVEGTETRVNAQDEANEYMVEFLQRARDQGQMDNAVGWYHSHPGYGCWLSGIDVNTQKTQQQFSDPFCAIVIDPDRTVSAGKVEIGAFRTFPAAYIEEQEKVTSKTGGGGADGDGFQTIPLGKIEDFGAHAAHYYSLEVSHYKSSLDAKILEALWNKYWVQTLSSSPLISNRDYGTNQISDLARKIQQETSSSKRYKTMTAGTGNEKDQLAKLGAAGSKIAREEDMGLLAAKVKDQVFNLKGGAQEPVSQEVEMKS

SEQ ID NO: 8603 - DNA, 1386 bp, Phaeosphaeria nodorum
  CDS (89)..(1096)
ccacatcaacaccacgctccctctctggataccccgtctccctcggaacctacttcttcatagactcacccataccccccacaccatcatggaccggctaagcagaatgttggccgccgcgcagggcatgggaggcatgggcggaggtcccgcacaagacaccaacctgatcgacaactcggaaaccgtctacatctcgtctctggcgctgctcaagatgctgcggcacgggcgggcgggtgtgcccatggaggtcatgggcctcatgctgggcgagtttgtggatgactacacagtacgcgtcgtggatgtattcgccatgccgcagtccggtaccggtgtttccgtcgaggctgtcgaccccgtcttccagaccaagatgatggacatgctgaggcagacaggaaggcaagagacggtcgtcggctggtaccactcacatcctggcttcggctgctggctgtcgtccgtcgacatcaacacgcaacagtcctttgagcagctcacgccccgcgccgtcgccgtcgtagtcgatcccatccagtccgtcaagggcaaagtcgtcatcgatgccttccgcctaataaatccgcaaaccctcatgatgggccacgagccccgccagaccacatccaacgtcggccacctcaacaagccctcgatccaagccctcatccacggcctgaaccgccactactactcaataggcatcgattacaagaagactgcgctggaggagaacatgctgatgaacctgcacaagcacgtctggaccgaggcactgctgatggaggacttcaagggcgagggcgagcggaacaacgacaggctgcagaagctggtctcgttggccgagggttacgagaagcgcgtcaaggaggagacggagctcaccaaggaccagctcaagacgcgatacgttggaaaggtcgaccccaagaagcacatcgaagacgtcggccaacagctcatcgaggacaacatcgtgtccgtctcgcgacaaatgatcgacaaggaggcctcggtgccaaagccagcctcgcggcaaaacggaaatgccgaagccagcaacgacgatgtcgagatggatgagtagatttcaccccagagcagcttgaccatcgtcttgcacatgaaagagtaggctacaaagcatgtctcaccgaggcctacttgcgtaccaggagatacggaccaagaagcttggagcagatcacttggcacgaacgatatcctcccatcatgatggtgcaggcacgacggggtgccgtggagagcgctacagcagacgctctgcagaagaagtccaattcggcaaatacgaagcatgccgtagagaaatgccatcaatagcatgatataatgaaacatcatacaaacaaatta

SEQ ID NO: 8604 - protein, 335 aa, Phaeosphaeria nodorum
MDRLSRMLAAAQGMGGMGGGPAQDTNLIDNSETVYISSLALLKMLRHGRAGVPMEVMGLMLGEFVDDYTVRVVDVFAMPQSGTGVSVEAVDPVFQTKMMDMLRQTGRQETVVGWYHSHPGFGCWLSSVDINTQQSFEQLTPRAVAVVVDPIQSVKGKVVIDAFRLINPQTLMMGHEPRQTTSNVGHLNKPSIQALIHGLNRHYYSIGIDYKKTALEENMLMNLHKHVWTEALLMEDFKGEGERNNDRLQKLVSLAEGYEKRVKEETELTKDQLKTRYVGKVDPKKHIEDVGQQLIEDNIVSVSRQMIDKEASVPKPASRQNGNAEASNDDVEMDE

SEQ ID NO: 8605 - DNA, 981 bp, Aspergillus oryzae
  CDS (1)..(981)
atgaagctcgaaaatgccatcagcctcatagatccccaacgagacgccctctaccagtacgatcaagaaacacacaaagccctcagcgcggagcgcccatgggccaaagacccccactatttcaaatcgataaggatctccgctgtcgcgctactgaagatggtgatgcacgcacgctcaggcggatctctcgaagtcatgggcctaatgcaaggctacatcctgccagaaacctttgtcgtaaccgatgcatttcgcctcccagtcgaaggaacagagactcgagtgaacgcccaagacgaagcaaacgaatacatggtgtcttatctccaggcatgtcgggatgcgggacggatggaaaatgcagtcggctggtatcacagtcaccctggatatggttgctggttatcggggattgatgtcaccacgcaggatatgcagcaactcggcgggccgtttgttgccgtggtcattgatccagagcggaccatttcggcggggaaggtagatatcggggcgtttagaacgttccctaaggattatacgccacccaaagaagagcaagaggatgatgagtaccagaccgtaccgcttaacaaagcggaggactttggagcgcatgcatcccattactattcgcttgaggtatcgctttttaagagcgtccttgatactgaaattctgtcacttctgtggaacaaatattgggtggctaccctcagccagagccctctatttaccacccgtgattatggtagcaaacagatgatggatcttagccagaaagttagacgggccgcgcgcagtattgaaagcaatccctcacgaggcgggaccactactgtcaaagatcaacaattggagaaagtcgtgcgagatgggcagcgaattgtatcggaggaagtgaagggcctcctggcagctgaagtcaagatgaagctcttccaaggcatcggcgagaataacaaagcagagacataa

SEQ ID NO: 8606 - protein, 326 aa, Aspergillus oryzae
MKLENAISLIDPQRDALYQYDQETHKALSAERPWAKDPHYFKSIRISAVALLKMVMHARSGGSLEVMGLMQGYILPETFVVTDAFRLPVEGTETRVNAQDEANEYMVSYLQACRDAGRMENAVGWYHSHPGYGCWLSGIDVTTQDMQQLGGPFVAVVIDPERTISAGKVDIGAFRTFPKDYTPPKEEQEDDEYQTVPLNKAEDFGAHASHYYSLEVSLFKSVLDTEILSLLWNKYWVATLSQSPLFTTRDYGSKQMMDLSQKVRRAARSIESNPSRGGTTTVKDQQLEKVVRDGQRIVSEEVKGLLAAEVKMKLFQGIGENNKAET

SEQ ID NO: 8607 - DNA, 1104 bp, Solanum lycopersicum
  CDS (1)..(1104)
atggacgctctgaattcttacgcatcgtcggcggcgatggcgcaacaaacatgggagttagaaaacaacatcgtgacgacggacgcgccatcggggtcggcaccggaaaactctgcgtcggatgcaatattccactatgacgatgcggcacagactaagttccagcgggagaagccgtggacgagtgaccctcactacttcaagcgcgtgaagatctctgctcttgctcttctaaagatggttgttcacgcgcgttctggaggtacaattgaggtaatgggactaatgcaaggtaagacggatggagatgctattattgttatggacgcttttgcccttccagttgaaggaactgaaactagggttaatgctcaagctgatgcgtatgaatacatggttgaatattcacagaccaacaagcaggctggtcggctggagaatgtggtcggatggtatcattctcatcctggctatggatgctggctctctggcattgatgtaactacacaaatgcttaaccagcagtatcaggagccctttcttgcagttgttattgatccaacaagaactgtttctgctggaaaagttgagattggtgcctttcgaacatatcctgaaggatataagcctccagatgaccctatctcagagtaccagaccattcctttgaacaaaattgaagacttcggagtacattgcaagcagtattattcattggatattacctatttcaagtcctctctcgattgccatctcttggacctactatggaacaagtattgggtgaacacactttcttcttctcctttgcttgaaaatggagactatgttgctggacagatatctgatcttgctgaaaagatggagcaagctgaaaatcacctgtcccattcacgttttgggcacttagtggcagcccctcaaaggaagaaggaggaagaatctcagcttgctaagattacacgtgatagtgctaagattactgtcgagcaagttcatggcttaatgtcgcaggttattaaagacattcttttcaatagcgtttgtaagtcaggcaagtcgcagactgaaccctctgatccagagccgatggtcgaaacctga

SEQ ID NO: 8608 - protein, 367 aa, Solanum lycopersicum
MDALNSYASSAAMAQQTWELENNIVTTDAPSGSAPENSASDAIFHYDDAAQTKFQREKPWTSDPHYFKRVKISALALLKMVVHARSGGTIEVMGLMQGKTDGDAIIVMDAFALPVEGTETRVNAQADAYEYMVEYSQTNKQAGRLENVVGWYHSHPGYGCWLSGIDVTTQMLNQQYQEPFLAVVIDPTRTVSAGKVEIGAFRTYPEGYKPPDDPISEYQTIPLNKIEDFGVHCKQYYSLDITYFKSSLDCHLLDLLWNKYWVNTLSSSPLLENGDYVAGQISDLAEKMEQAENHLSHSRFGHLVAAPQRKKEEESQLAKITRDSAKITVEQVHGLMSQVIKDILFNSVCKSGKSQTEPSDPEPMVET

SEQ ID NO: 8609 - DNA, 1077 bp, Arabidopsis thaliana
  CDS (1)..(1077)
atggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagaggcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacagtactattcattagatgtcacttatttcaagtcatctcttgattctcaccttctggatctactatggaacaagtactgggtgaacactctttcttcttctccactgctgggtaatggagactatgttgctggacaaatatcagacttagctgagaagcttgagcaagccgagagtcatctggttcagtctcgctttggaggagttgtgccatcatcccttcataagaaaaaagaggatgagtctcaactaactaagataactcgggatagcgcaaagataactgtggaacaggtccatggactaatgtcgcaggtcataaaagatgaattattcaactcaatgcgtcagtccaacaacaaatctcccactgactcgtcggatccagaccctatgattacatattga

SEQ ID NO: 8610 - protein, 358 aa, Arabidopsis thaliana
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQRLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 8611 - DNA, 1263 bp, Ashbya gossypii
  CDS (1)..(1263)
atggacacacctagcgcagcgctgcatagacatactgtcgggcagctgcggaaattgctactgcaccgagagggttctgcgggctgtggacgcttgcagccggctttagatgggtcacagccgttggactctccactcagcaccgtgccctcgtcgcgcagccaggtgcgcgtgcagcaggaattgtggaagcaggatccaacatacttccagaaggcggcgctgtcggcactggcatgtatgaagatactgcgacatgcctttgatggcggagacatggaagtgctcggtatgctgctggggtatgtgcaagatgagatgatagttgtggtggattcgtataggctgcctgtggagggcaccgaaacgcgggtgaacgcgcagatggaatcctatgagtacacggtgcagtacctggagacggcggtgccagaggggctcgcgatagtgggctggtaccactcgcatccgggatatggatgctggctgagtggcattgatgcggagactcagacgctcaatcagaacttccaggacccgtatctggcgattgtagttgatcctaaacgctccaaggctagtggggtcattgacattggcgcgttccggacgatgcccgagaccgcggacacgagatcagtgtcctcgcactcaaacgcctcgcgttacggacaccactcggcccggtattatgagctggaagtttcgtactttgaagtgccgcaggaaaggcgatggtgcgactcgaggctgtcggtcgagccacctaagcctgctgatgccaccgagagggccatgctggcgcagttgctggaagcagcgaaggcgtgcaaaaacgtcaaacgcctgcaaacagtagatagagccctagtcccggaatcgatcgggccatacgcacttcgcgaacaggcagaccaagatctgcaattccggcgtcctctgcgctcattctctagcaacagtattgcccgcaggagcagcactgaagtcgcattggggaatgcgaatgaagagctagaccccttgcccacccttgcagatgcgaaccttcgtaaccatgacagtccatccgcagatatggctatggataacacgagtatttctagcaacgaagagcagcctcatctgacattccaagaatcttccggtgtgcaacttaatgccgcagagaccgagtattttgacataaagaatgaattactgaccttgaagttactggaatatcaaaaagcaaggttttacagagatgcgttcacgctatag

SEQ ID NO: 8612 - protein, 420 aa, Ashbya gossypii
MDTPSAALHRHTVGQLRKLLLHREGSAGCGRLQPALDGSQPLDSPLSTVPSSRSQVRVQQELWKQDPTYFQKAALSALACMKILRHAFDGGDMEVLGMLLGYVQDEMIVVVDSYRLPVEGTETRVNAQMESYEYTVQYLETAVPEGLAIVGWYHSHPGYGCWLSGIDAETQTLNQNFQDPYLAIVVDPKRSKASGVIDIGAFRTMPETADTRSVSSHSNASRYGHHSARYYELEVSYFEVPQERRWCDSRLSVEPPKPADATERAMLAQLLEAAKACKNVKRLQTVDRALVPESIGPYALREQADQDLQFRRPLRSFSSNSIARRSSTEVALGNANEELDPLPTLADANLRNHDSPSADMAMDNTSISSNEEQPHLTFQESSGVQLNAAETEYFDIKNELLTLKLLEYQKARFYRDAFTL

SEQ ID NO: 8613 - DNA, 1005 bp, Aspergillus fumigatus
  CDS (1)..(1005)
atgcaggctgcacagcagtcctgggagctcgaaaacaccatcagcctcatcgatcctcaacgggatgcgctctatcgatacgatgaagaaacacacaaggccctgagcgctgcccggccatgggccaaagacccccactacttcaagtcgatacgcatctccgccgtagcattaatcaaaatgaccatgcatgctcgctcaggcggctccctcgaggttatgggtctgatgcaagggtacatccttcctgagacgtttgtcgtaacagatgccttccgcctccccgtcgaaggcaccgagacccgcgtcaacgcccaggaagaagcgaacgagtacatggtgtcgtatctccaatcctgccgcgatgcgggccgcatggagaacgcagtggggtggtatcacagtcatcccgggtatggatgctggctgtccgggatcgatgttacgacgcaagatatgcagcagctcggcgggccgttcgttgctgtcgtcattgacccggaacgcaccatctccgccggcaaggttgacattggggccttccgcactttccccaaggattatacccctccaaaagaaggaaatgaggatgaagattaccagactattcccctcagcaaggcggaggatttcggcgcatacgcgcaccagtattactcgcttgaggtgtcattcttcaagagcagtctcgacacggaacttctgtcgcagctctggaacaaatactgggtggctacgctgagtcaaagtcccctgttcacaactcgggattacggcagtaggcagatgatggatctcagtcagaaagtccggcgggctgcgcggggaattgaatccagcgggtcacgaggtggtgccactacacctaaagatcagcagctggagaagatagtacgggacggacagcggattgtctctgaggaggtaaaaggtctcttggcagctgaggttaagatgaagctcttccagggaatcggggaggggacgcaaacgggtgcctcatga

SEQ ID NO: 8614 - protein, 334 aa, Aspergillus fumigatus
MQAAQQSWELENTISLIDPQRDALYRYDEETHKALSAARPWAKDPHYFKSIRISAVALIKMTMHARSGGSLEVMGLMQGYILPETFVVTDAFRLPVEGTETRVNAQEEANEYMVSYLQSCRDAGRMENAVGWYHSHPGYGCWLSGIDVTTQDMQQLGGPFVAVVIDPERTISAGKVDIGAFRTFPKDYTPPKEGNEDEDYQTIPLSKAEDFGAYAHQYYSLEVSFFKSSLDTELLSQLWNKYWVATLSQSPLFTTRDYGSRQMMDLSQKVRRAARGIESSGSRGGATTPKDQQLEKIVRDGQRIVSEEVKGLLAAEVKMKLFQGIGEGTQTGAS

SEQ ID NO: 8615 - DNA, 1116 bp, Cryptococcus neoformans
  CDS (1)..(1116)
atggcgtccactgctagaaagacgtttgaaatcaataacaacgttcaggttgtcgacccttcggctgccattttccagtactcacgagaagaggagaaattattggatgatgaagctccttggaggacagatccgcattatttccacacagtcaaaatatccgctgtcgctttgataaagatggttacccatgcgcgttccggaggaatctacgagattatgggtatcatgtatggcaaagtacgtgatggcacgttttggatcatggacgttgcagcattaccggtacagggtaccgagactcgagtgaacgcaggaaacgaagcgatggaatatatggttaacttccagacagcaaatgcggaggctgggaaaggggagcttctgagaggctggtatcactcccaccctggatatggctgttggctttcaggaatagatgtcaacactcagttaaataaccaaaaattcaacgatccttaccttgcggtcgtcatcgaccctaacaggactgtttctgctggtaaggtagagatcggagcttttaggacttatcctgagggttacactccgcctgccactggcaattcgcagtaccaatcaattcctatggataagattgaggactttggtgtccacgccaacgcatactaccctttgaaagttgagatttataaaagcaaacttgacgagaaaatgcttgacttgctatggaacaagtattgggtagccactcttagttccaactctctcgtatcgaatctcgagtactccacgtcacaagtccaggatctgaatgctaaactgcgtgctgcgtctcaatctatctccaattcatcttcaaagctcaaattgaagcctacgcaacctactacgaagggcaaggaaacaactgagggctccgataaaaagttaaaaaagggtgaaaaggaattcagtggagttgaggaagaagaaacgcccttgaataaggtgacccaggagagttcgaggataacttcagaagctgaaaatggtatcatctcccagctcctcaaggagaagttgttcaacactccgttaacacaatcagtggatgacaagtcagctcaggcaactgtacaaggtagatactga

SEQ ID NO: 8616 - protein, 371 aa, Cryptococcus neoformans
MASTARKTFEINNNVQVVDPSAAIFQYSREEEKLLDDEAPWRTDPHYFHTVKISAVALIKMVTHARSGGIYEIMGIMYGKVRDGTFWIMDVAALPVQGTETRVNAGNEAMEYMVNFQTANAEAGKGELLRGWYHSHPGYGCWLSGIDVNTQLNNQKFNDPYLAVVIDPNRTVSAGKVEIGAFRTYPEGYTPPATGNSQYQSIPMDKIEDFGVHANAYYPLKVEIYKSKLDEKMLDLLWNKYWVATLSSNSLVSNLEYSTSQVQDLNAKLRAASQSISNSSSKLKLKPTQPTTKGKETTEGSDKKLKKGEKEFSGVEEEETPLNKVTQESSRITSEAENGIISQLLKEKLFNTPLTQSVDDKSAQATVQGRY

SEQ ID NO: 8617 - DNA, 1410 bp, Debaryomyces hansenii
  CDS (1)..(1410)
atgcgatgcattcatgaactcgcagatgtattcataaatgattcagatgagagaatcctcacacagctgttagatgctacggagatagataaacatgctgattatgaatcttttttttccattaactctgatgagagtataatgaaggcaagaccttggaagtcaaatgccaaatacttcaagaaaacatatatatcttcgttagcattatgtaaaatgtcagttcatgccaaatcaggaggtgcaattgaagttatggggatgatgactggcaagattattaaaaactcaataattgtgatggatgtttatccattgccagttgagggtaccgagacaagagttaatgctcaggcagaaggttatgaatatatggtgcaatatctagaaaacctgaaacaagtgggtagagatgagaatattgttggatggtatcattcacatccaggttatggctgttggttgtctggtatagatgttgcaacgcaaagtttgaaccagaatttccaagatccgtatctagctatagttattgatccgatgaaaacagaggaccaaggaaaagttgagattggggccttccggacctttcctgataattacaaatcccctgattccgctgcacctactaacaatactagaggagtccccccgtccaaacagaaagattttggggttcattcggataagtactattcattagatatccaaatcttcaagtccaatctagatactgaaattctaaacatcatatcgaacaaatcgtggatcggcaaactaatcaaatcggtcaacacagcgaatcatcaagaacaaaatatgatagaaaacgtattcaagttgatcaataaacttcagaagaaggaagtcaatcaattgaacaggttcgaaatctcgtttatcaaaaaattcgacttgatctttgaagacataataagcaagaagcttatgaatgacaatagattctacagtacaatatcacagagttcctatgacagctttagtgggcatgggaattcatcaagcaacgatgaaatggacgacgaaagcgatctcgatgacagagacaagagcagtgcacccctagacatttctgacacgggaaacgacgacgttatgtccatggaaagctcggtcaacgtctacacagacaagagaggagatgacaatgacgatgatgatgacaacgacggctatgacaaaagacccatgtacaccaattatagatcaagagcaaatctaaccaagccacgaaaactgggttcctcgccggaagaacatgtgaagttactgaataacgtaaataagaccatcacaaacatatctaatcatagtaaagatataggtcttacagaactacaggacttgatagccctaaagaccaaagagctgatttttttgggcaaataa

SEQ ID NO: 8618 - protein, 469 aa, Debaryomyces hansenii
MRCIHELADVFINDSDERILTQLLDATEIDKHADYESFFSINSDESIMKARPWKSNAKYFKKTYISSLALCKMSVHAKSGGAIEVMGMMTGKIIKNSIIVMDVYPLPVEGTETRVNAQAEGYEYMVQYLENLKQVGRDENIVGWYHSHPGYGCWLSGIDVATQSLNQNFQDPYLAIVIDPMKTEDQGKVEIGAFRTFPDNYKSPDSAAPTNNTRGVPPSKQKDFGVHSDKYYSLDIQIFKSNLDTEILNIISNKSWIGKLIKSVNTANHQEQNMIENVFKLINKLQKKEVNQLNRFEISFIKKFDLIFEDIISKKLMNDNRFYSTISQSSYDSFSGHGNSSSNDEMDDESDLDDRDKSSAPLDISDTGNDDVMSMESSVNVYTDKRGDDNDDDDDNDGYDKRPMYTNYRSRANLTKPRKLGSSPEEHVKLLNNVNKTITNISNHSKDIGLTELQDLIALKTKELIFLGK

SEQ ID NO: 8619 - DNA, 984 bp, Drosophila melanogaster
  CDS (1)..(984)
atggactccgacgccgcacaaaagacctgggagctggagaacaacatccagacgttgcccagttgtgacgagatctttcgctacgacgccgaacagcagcggcagatcatcgatgcgaagccctgggagaaagatccccacttctttaaggacattaagatctcggctctggcgctcctaaagatggtgatgcacgctcgctctggcggtactttggaggtgatgggtctaatgcttggcaaggtagaggacaacacaatgattgtcatggatgcatttgcactgccagtggagggcactgaaacccgcgtcaatgcccaggcacaagcgtacgagtacatgaccgcctacatggaagcggccaaagaggtgggacgcatggaacacgccgtgggctggtatcacagccatcccggttacggttgctggttgtccggcatcgatgtgtccacccagatgctcaaccagacataccaggagccattcgtggccattgtggttgatccggtgcgcactgtttccgctggcaaggtgtgtctgggtgcattccgcacgtatccaaaaggttataagccaccaaacgaggagccctcggagtatcagaccatcccgctgaataagatcgaagactttggagtccactgcaagcagtactatcccttggaaattagctacttcaagtctgctctggaccgcaggctcctcgactctctgtggaacaaatactgggtaaacacactgggcagctcgggtctgctcaccaacacagagtacaccaccggtcagatcatggatctctccgagaagctggagcagagtgagaactttttaggtcgcggaaccgatgtcaatgagaagcgttcggaggataagctgtccaaggccacccgagactgcagccgctccaccattgaactgatacacggcttgatggctcagattgttaaggacaaacttttcaacaaggtcggactgggcaaatag

SEQ ID NO: 8620 - protein, 327 aa, Drosophila melanogaster
MDSDAAQKTWELENNIQTLPSCDEIFRYDAEQQRQIIDAKPWEKDPHFFKDIKISALALLKMVMHARSGGTLEVMGLMLGKVEDNTMIVMDAFALPVEGTETRVNAQAQAYEYMTAYMEAAKEVGRMEHAVGWYHSHPGYGCWLSGIDVSTQMLNQTYQEPFVAIVVDPVRTVSAGKVCLGAFRTYPKGYKPPNEEPSEYQTIPLNKIEDFGVHCKQYYPLEISYFKSALDRRLLDSLWNKYWVNTLGSSGLLTNTEYTTGQIMDLSEKLEQSENFLGRGTDVNEKRSEDKLSKATRDCSRSTIELIHGLMAQIVKDKLFNKVGLGK

SEQ ID NO: 8621 - DNA, 1008 bp, Emericella nidulans
  CDS (1)..(1008)
atgcaagctgctcaactatcctgggagctagagaatgctgttaccctgattgatccccaacgagactccctctacagatacgacgaggaaacccacaaataccttagtgatacccgtccatggaccaaagaccctcactattttaaatcagttcggatctccgccgtcgctctcctgaaaatggtcatgcacgcccgctccggcggttcgctcgaagtcatgggtctgatgcaaggctatatcctccccaacacattcgtcgtaacagacgccttccgcctccccgtggagggcacagagactcgagttaacgcgcaagacgaagcaaacgagtatatggtctcatatctccagtcgtgtcgggaagcagggaggatggaaaacgcagtggggtggtaccacagtcaccctggctacgggtgctggctttcgggcattgacgtttctacgcaggatatgcagcaaatgagcgggccatttgttgctgttgtcattgatcccgaacgtacgatctctgcgggaaaggtagacatcggtgcgttcaggacgttccctaaggactataccccccccaaggaggagcaagaagaagacgaataccagaccgtaccgcttaacaaagccgaggactttggagcacacgcttcccattactactcacttgaggtgtcactttttaaaagcgcccttgatactgagattctctccctcctctggaataagtactgggtcgccacgctcagccaaagccctctattcaccactcgcgactacggaagtaaacagatgctcgacctcagccagaagacgcgtcgggtagcccgcggaattgagagcaacccgcctcgaggaggcgcccctacccaggtcagagatcagcaactcgagagagtagtaaaggacggccagcggattgtatcggaggaagtcaagggactattagccgccgaagtcaagatgcagctgtttcagggtatcgggggaaaacagacggtagagtctacttag

SEQ ID NO: 8622 - protein, 335 aa, Emericella nidulans
MQAAQLSWELENAVTLIDPQRDSLYRYDEETHKYLSDTRPWTKDPHYFKSVRISAVALLKMVMHARSGGSLEVMGLMQGYILPNTFVVTDAFRLPVEGTETRVNAQDEANEYMVSYLQSCREAGRMENAVGWYHSHPGYGCWLSGIDVSTQDMQQMSGPFVAVVIDPERTISAGKVDIGAFRTFPKDYTPPKEEQEEDEYQTVPLNKAEDFGAHASHYYSLEVSLFKSALDTEILSLLWNKYWVATLSQSPLFTTRDYGSKQMLDLSQKTRRVARGIESNPPRGGAPTQVRDQQLERVVKDGQRIVSEEVKGLLAAEVKMQLFQGIGGKQTVEST

SEQ ID NO: 8623 - DNA, 1023 bp, Gibberella zeae
  CDS (1)..(1023)
atggaggcatcagctctcaaagcatgggagttggacaataatgtccagttagttgaccccaaacgcgacgctctctacaacttcgatgcagacgctcaaaaggccatcaataaggaacaaccgtggaagcaagaccccagccacttcaaacatgtacgaataagcgccaccgcccttatcaaaatgaccatgcacgcccgctctggtggcaatctcgaggtcatgggcttgatgcaaggctacactcaaggtgatacattcatcgtcaccgacgcattccgacttcccgtcgagggaacagagactcgagtcaatgcccaggacgaagcgaacgaatacatcgtcgaatatctcgacctatgccgagcccaaggacgccaggagaacgtcgtgggctggtaccacagtcacccaggttacggatgctggctaagcggcatcgacgtggacactgaagctatgcagcagcaattccaggatccattccttgctgtcgtgatcgaccccgaccgtaccatcaactccggcaaggttgacattggcgccttcagaacctacccagccgactacaagcccagcggcggcgtcacttcggacggctttcaagcagtacccctcgccaaggccgcagaattcggtgctcatgcaagccgatactacagtctagaagtctctcacttcaagagttcgctcgactcccacctcctagagctactctggcacaagtactgggtacagacacttagccagaacccgctcatcacgaaccgagactacggcaacaagcagttactagatttgagttccaagatcaaggaggcgacgacaggtatcacgcgaaaccgagctggccagggtatgatgatgggaatgagcactaagagctccgacaaggcagtggacaagctagctaaggaagcgaacctgattgcatctaaagagcgatcaggtcttattgcgaaccaagtcaaggccagccttttcaacgaccttgggtccaaggcgaaccctacgtcggaatga

SEQ ID NO: 8624 - protein, 340 aa, Gibberella zeae
MEASALKAWELDNNVQLVDPKRDALYNFDADAQKAINKEQPWKQDPSHFKHVRISATALIKMTMHARSGGNLEVMGLMQGYTQGDTFIVTDAFRLPVEGTETRVNAQDEANEYIVEYLDLCRAQGRQENVVGWYHSHPGYGCWLSGIDVDTEAMQQQFQDPFLAVVIDPDRTINSGKVDIGAFRTYPADYKPSGGVTSDGFQAVPLAKAAEFGAHASRYYSLEVSHFKSSLDSHLLELLWHKYWVQTLSQNPLITNRDYGNKQLLDLSSKIKEATTGITRNRAGQGMMMGMSTKSSDKAVDKLAKEANLIASKERSGLIANQVKASLFNDLGSKANPTSE

SEQ ID NO: 8625 - DNA, 1122 bp, Kluyveromyces lactis
  CDS (1)..(1122)
atgagctccataaaatttcatgagaaatccttgaaagaagtcactcgatggattcaagctaacgaagacatcaatacagaaacttcactttccagttctagtgattcaagcacgacgattcctgtaatagaccacctaccagcaagaatcccgtatgctaccgatttgaaacgaaatccgtgtcactttcagaaatgccttatatcaagacttgctactacaaagatgttatctcatgcggttgatggtggagatattgaagttatggggatgctagtaggatacactagcaatgatatgatagttgtcaaggattgctattctttacctgttcaaggaactgaaacaagggttaatgcgcatatggaatcatatgaatatatggtccagtatttagacgcatttgtcacaaaagaagataagatagtgggctggtaccactctcatccaggatatggttgttggttgagcaatatcgacatccaaacacagtctttaaatcaaaattaccaagacccgtaccttgccatagtggtcgatcccaagaagtctttatccggaaacactttggacattggagcatttaggacactgccgtctaaagataacaacgagcatgttgattattatccacttaacattcaattatatcaaaactcacttgatgttaacatttcaaaattaaaattgaaattcaaggtagatccagcaattcagaacaatcctaacgaaccggaactaatgaaagagctacatgaatgtgtagagaattggtttcatgccaaaaaagtgatgaagtcaactgtaggattcaatgctatcggatccaccgtggttaatgaaactgagataggaaatgaagattttacacacgagaggtccaattcaatctcctcgacctcttccttaaccacaaggcatactactgatgtagaaatggatgatcaagagagtgctcaaagtagtcttgatataccggccaatgtgatacctggcatgcagtttcaggaggcagagataaagcatgaatacgaactgaagaagaagaaactactcttattgaaggttaagcaatatcaaaagttaaggacctacagacaactatttaatgcatccgaataa

SEQ ID NO: 8626 - protein, 373 aa, Kluyveromyces lactis
MSSIKFHEKSLKEVTRWIQANEDINTETSLSSSSDSSTTIPVIDHLPARIPYATDLKRNPCHFQKCLISRLATTKMLSHAVDGGDIEVMGMLVGYTSNDMIVVKDCYSLPVQGTETRVNAHMESYEYMVQYLDAFVTKEDKIVGWYHSHPGYGCWLSNIDIQTQSLNQNYQDPYLAIVVDPKKSLSGNTLDIGAFRTLPSKDNNEHVDYYPLNIQLYQNSLDVNISKLKLKFKVDPAIQNNPNEPELMKELHECVENWFHAKKVMKSTVGFNAIGSTVVNETEIGNEDFTHERSNSISSTSSLTTRHTTDVEMDDQESAQSSLDIPANVIPGMQFQEAEIKHEYELKKKKLLLLKVKQYQKLRTYRQLFNASE

SEQ ID NO: 8627 - DNA, 1011 bp, Neurospora crassa
  CDS (1)..(1011)
atggagctgccaccgaatcccggcctcgtggacgtccaacgcgatgctctttacgcctacgactcagaagcccacaaagccgttgtcaactcgcgaccatggaccaacgatcacaaatacttcaagaccgtccgcatctcctccgttgccatgatcaagatggtcatgcacgcccgctccggcggcaatctcgaggtcatgggtatgatgcagggctacattgagggcagcaccatggtcattaccgacgcctatcgtttaccggtagagggcacagaaacccgcgtcaacgcccaggacgaagcgaacgagtacatggtcgagtatctccgtctctgccgtgaggagaaccgccttgagaacgttatcgggtggtaccactcacacccgggctatggctgctggctaagcggtatcgacgtcggcacccaatccctacaacagcagttcaacgagccgttcgtcgcagtggtgatcgacccggacaggacagtaagccagaacaaggttgagatcggcgcgtttaggacaattccagaagggatcaagcctttcgcagcaaccaacacgacaacgggtgatggacagagcgtccctctgaacaaggtggaggactttggcgctcatagccatcgatactacgcgctcgacgtcgagcacttcaagagcacactcgatagcaagctgttggagacgttgtggaacaagtactgggtgcagacgctggcccaaaacccgctgcttaccaacagggactacacgagcagccaaatggtggatttgggatcccgcatttcgaaggcgtcgaaatcgctggagatgctctcaacgactgggcaaagaggtccaaagagtgatgcggtcgatcaaaacatagagaaattgcttagcgaagtgaagcagattgctgcaaaggagaggtctggactgatggcggcggaggtcaaaggcaaggtgtttggctgtggctgtcgtgggcaggcagagggtgtccagcctgaaaaatcatga

SEQ ID NO: 8628 - protein, 336 aa, Neurospora crassa
MELPPNPGLVDVQRDALYAYDSEAHKAVVNSRPWTNDHKYFKTVRISSVAMIKMVMHARSGGNLEVMGMMQGYIEGSTMVITDAYRLPVEGTETRVNAQDEANEYMVEYLRLCREENRLENVIGWYHSHPGYGCWLSGIDVGTQSLQQQFNEPFVAVVIDPDRTVSQNKVEIGAFRTIPEGIKPFAATNTTTGDGQSVPLNKVEDFGAHSHRYYALDVEHFKSTLDSKLLETLWNKYWVQTLAQNPLLTNRDYTSSQMVDLGSRISKASKSLEMLSTTGQRGPKSDAVDQNIEKLLSEVKQIAAKERSGLMAAEVKGKVFGCGCRGQAEGVQPEKS

SEQ ID NO: 8629 - DNA, 900 bp, Schizosaccharomyces pombe
  CDS (1)..(900)
atgaataatcaactcgaaaatgtttttagatttgatgaagaaaaagagagggctaaaattcgtgaatcgccgtggaaacatgacccagagtttttccgttctgtcaaaatctcagcagtagctttgttgaaaatgttacggcatgtatctcaaggcatgccattagaggtaatgggctatgttcaggggaaggttgaaggggcctccttgattattttagattcttttgcgttaccagttgaaggtactgagactcgtgtcaatgcacatgaagaagcacaagaatacagtgtacaatatcatactctttgcaagtctgtttacagacatgaaaatgtcataggatggtaccattcacatcctaactatggttgctggctttcaggtgtagatgttgaaactcagcgccaaaatcaaaaatatcaggatccatttgttgccgttgtgttggacccgaagcgatccttggaatctccatatgtaaacattggagcatttcgaacctatcctgtcggtaatgatggctctatccgcacaaaatctcgtcatcacccgtctgtcttatttaaaaatttaccttcttccaaaatcgaagatgccggagcccacgcagaagcgtactacagtctccctataacttactttcattccaaagctgaaaaaaaggttacggagtttttaaggaatagaaactggtctaggtcaatcaccgagtgttctattttacaaaacaatgaatttttacatgacagcgaaaaattaatcgatcatcttattcatgaaacagggaataatgaattacctgttgcatctgcctacgaacaatccaaagcttgttgtaacgaattatctacttttctgtctcaaattgatgtccaagataaattatttaaagaatga

SEQ ID NO: 8630 - protein, 299 aa, Schizosaccharomyces pombe
MNNQLENVFRFDEEKERAKIRESPWKHDPEFFRSVKISAVALLKMLRHVSQGMPLEVMGYVQGKVEGASLIILDSFALPVEGTETRVNAHEEAQEYSVQYHTLCKSVYRHENVIGWYHSHPNYGCWLSGVDVETQRQNQKYQDPFVAVVLDPKRSLESPYVNIGAFRTYPVGNDGSIRTKSRHHPSVLFKNLPSSKIEDAGAHAEAYYSLPITYFHSKAEKKVTEFLRNRNWSRSITECSILQNNEFLHDSEKLIDHLIHETGNNELPVASAYEQSKACCNELSTFLSQIDVQDKLFKE

SEQ ID NO: 8631 - DNA, 1221 bp, Ustilago maydis
  CDS (1)..(1221)
atgaccgcgccatcatcgtcctcgtctgcctcgatggcccgcgctaacttcgagctaaataatgccatcatcccgctatcatccaccacgctcgactccatttttgcatatgacaatgaagcacaacgtgccatcctccacgcccaaccgtggaagacggacccgcacttcttccaaaaagtgcgcatcagcgcggtggctttgatcaagatggtgatgcacgcacgatccggtggtatctacgagatcatgggtctgatgcagggcaagatcgatgtcgagaaccgaacactttacgttatggatagcttcgccctaccggtcgagggaaccgagacgcgtgtaaacgcacagaacgaagcgtacgaatacatggttcagtaccttgaccactcaaaagaggtcggacgtctggaaaatgtggtgggctggtaccacagtcatccgggttacggatgctggctttctggtatcgacgtcaatacccaacgcaccaaccaacagtttcaagacccgttcgtagccatcgtcattgatcccaaccgcaccatctcctcaggaaaagtcgacattggcgcttttcgaaccttcccggaaggctacacatcttcctcttctattggaggcggagatagcgagtaccagagcatccctctctccaagatcgaggatttcggcgtacacgccaacgaatactatccgttggaagtggagcatttcaagagcagcttggacggcaaattgctggatttgctgtggaacaagtattggcaaaatacattgtctcagagtccgctggtaagcaatcgggcgtatacgacgagtcagatccgcgatttggcggacaagttggcacagacgaatgcggcggtgttgaatcgaaacagtgtcagtagtgctccttttacaacgacagcaggagctgcgtccgttcgcattggggcaggtaaggacgtagcagcggagacagagcagaatagcggtgggtccgccaaggacacgccagctggtacggcgcaagacgccgcgggcctagtaaaggagttcgaacagaggtctaaaatgtcggcgatatctcgagcttcaaacgacgccgccaagttggccagcgaagccaaccacggcttgctagcaagccagctcaaacatacgctctttcacaatcacaccgccaccccaactcctgcatccgcatctgcgcccaccccaatccgcttatga

SEQ ID NO: 8632 - protein, 406 aa, Ustilago maydis
MTAPSSSSSASMARANFELNNAIIPLSSTTLDSIFAYDNEAQRAILHAQPWKTDPHFFQKVRISAVALIKMVMHARSGGIYEIMGLMQGKIDVENRTLYVMDSFALPVEGTETRVNAQNEAYEYMVQYLDHSKEVGRLENVVGWYHSHPGYGCWLSGIDVNTQRTNQQFQDPFVAIVIDPNRTISSGKVDIGAFRTFPEGYTSSSSIGGGDSEYQSIPLSKIEDFGVHANEYYPLEVEHFKSSLDGKLLDLLWNKYWQNTLSQSPLVSNRAYTTSQIRDLADKLAQTNAAVLNRNSVSSAPFTTTAGAASVRIGAGKDVAAETEQNSGGSAKDTPAGTAQDAAGLVKEFEQRSKMSAISRASNDAAKLASEANHGLLASQLKHTLFHNHTATPTPASASAPTPIRL

SEQ ID NO: 8633 - DNA, 1065 bp, Yarrowia lipolytica
  CDS (1)..(1065)
atggcatctctagcaacatttcaggtggagaacgacattgtggacgtcgacagcacgccccaacaaggatttgatcgagacgacctgtacaagtacgacgatgttgaacaaaaggcgatccttgcagcccatccatggagaacagatccctcgtactttcggaacgtgctggtgtcttcaattgcattggtgaagatggcgatgcatgctcgatcaggtggtgctattgaggtcatgggaatgatgactggaaagatcttgcccaacacatttgttgtcatggactgctatcctcttccagtggagggtacagagacaagggtcaatgcccagcaggagggtatcgagttcatggtggagtatctgcagggcctcaaggacgtgggacgccgagaaaacattgtcggatggtaccattcgcatcccggctacggttgttggctcagtggtattgacgtggacacacagtttcagaaccagcagttccaggaaccgttcctggcggtggtggtggaccccaaccgaaccatctcagctggaaaggtcgagatcggtgctttccgaacctatcccaaggattacaagccccccaagaaggctactaaacaaaaccaggaccagagcgtgcctttatccaaggccaaggactacggagcgcactctgagcgatactacgagctggacgtgtcatttttcaagtcctcgctggatgaaaacctgctgcaattactctggaacaaaaactgggccgccaccttatctcagtcgactattcagctaaaccacgactacacatccaagctgatgcttgatctgagtgagaagaatgcacagctagcgatcgggctcggcgagaaaactccccagtctcagggtcgaggtttccgagaggctatgtcaaaggctgacaacgagcctcacactaacctgctcaactacagcacaaagggccagtgggaggctgtgaaccggtctgtaaaggatggagttcagatcgggtccgacgagctgcagggtctcatgtctcttgagatccagagacggctgtttggtcgagcgaagtag

SEQ ID NO: 8634 - protein, 354 aa, Yarrowia lipolytica
MASLATFQVENDIVDVDSTPQQGFDRDDLYKYDDVEQKAILAAHPWRTDPSYFRNVLVSSIALVKMAMHARSGGAIEVMGMMTGKILPNTFVVMDCYPLPVEGTETRVNAQQEGIEFMVEYLQGLKDVGRRENIVGWYHSHPGYGCWLSGIDVDTQFQNQQFQEPFLAVVVDPNRTISAGKVEIGAFRTYPKDYKPPKKATKQNQDQSVPLSKAKDYGAHSERYYELDVSFFKSSLDENLLQLLWNKNWAATLSQSTIQLNHDYTSKLMLDLSEKNAQLAIGLGEKTPQSQGRGFREAMSKADNEPHTNLLNYSTKGQWEAVNRSVKDGVQIGSDELQGLMSLEIQRRLFGRAK

SEQ ID NO: 8635 - DNA, 1083 bp, Oryza sativa
  CDS (1)..(1083)
atggagcccacctcgtcggcggcgatggcgaggcagacgtgggagctggagaacaacatcccggcggcggcctccgacccggacgccctggacgcgatctaccgctacgacgaggcggcgcaggcgcgggtgcagcaggagaagccctgggcgaacgacccccaccccttccgccgcgccaagatctccgccctcgcgctcctcaagatggtcgtccacgcccgcgccggcggcactatcgaggtcatgggcctcatgcagggcaagtgcgagggcgacgccatcgtcgtcatggacgccttcgcgctccccgtcgagggcaccgagaccagggtcaacgcccaggccgacgcctacgagtatatggtcgagtactccaccatcaacaagcaggctggaaggttggagaatgtggttggctggtatcactcacaccctggttatggatgctggttatcaggcattgatgtgtctactcagatgcttaatcagcaatttcaagagccattcttggctgttgtgatagaccctacaaggactgtttctgctggtaaagtggaaattggagcttttaggacatatccaaaagattacaagccaccagatgaacctgtgtcagagtatcagacgataccactcaacaagatagaagattttggtgtccactgcaaacagtactatgctctggatataacttatttcaaatcatccctggattctcatctccttgatctactttggaataagtactgggtcaatacgttatcttcatcacctctcctgggcaacagggattatgttgctggccagatatttgatttagctgataaactagagcaagctgagggtcaactggcacacagtcgatatggcatgcttatgccatcgcaacgaaagaaagagcaagaggagtctccactggctaaggtaactcgggatagctcaaaaattactgctgaacaggtccatggtctcatgtcacaggtcattaaggatatcctcttcaactctgtgcacccgtcaaacaaggcaagcacaagcgcaccagattcatccgggcctgagcctatggttgaagcatga

SEQ ID NO: 8636 - protein, 360 aa, Oryza sativa
MEPTSSAAMARQTWELENNIPAAASDPDALDAIYRYDEAAQARVQQEKPWANDPHPFRRAKISALALLKMVVHARAGGTIEVMGLMQGKCEGDAIVVMDAFALPVEGTETRVNAQADAYEYMVEYSTINKQAGRLENVVGWYHSHPGYGCWLSGIDVSTQMLNQQFQEPFLAVVIDPTRTVSAGKVEIGAFRTYPKDYKPPDEPVSEYQTIPLNKIEDFGVHCKQYYALDITYFKSSLDSHLLDLLWNKYWVNTLSSSPLLGNRDYVAGQIFDLADKLEQAEGQLAHSRYGMLMPSQRKKEQEESPLAKVTRDSSKITAEQVHGLMSQVIKDILFNSVHPSNKASTSAPDSSGPEPMVEA

SEQ ID NO: 8637 - DNA, 1071 bp, Brassica napus
  CDS (1)..(1071)
atggatgactcttcgaccatcgctcgcaagacgtgggagctcgagaacaacatcctcaccgtagagcaaccggattcgtcctcctccgacggcatattctactacgacgaagcttcccagaccaaggtccagcaggagaagccgtgggccacggatcccaactacttcaagcgcgtccaaatctcggccctcgcgctcctcaagatggtcgtacacgcgcgctccggcggcacgatcgagatcatgggtcttatgcaggggaagaccgagggggataccatcatcgtcatggacgctttcgccttgcctgttgaaggaaccgagactagggttaatgctcaggctgatgcctatgagtacatggttgagtactctcagaccaacaagctggctgggagattggagaatgttgtgggatggtatcactctcaccctgggtatggatgctggctctcgggtattgatgtctcgacacagatgcttaaccaacagtaccaggagcctttcttggctgttgttattgatccgacgaggactgtttcggctggtaaggttgagattggggcgttcaggacttatccggaggggcataagatctctgatgatcatgtttctgagtatcagactattcctttgaacaagattgaggattttggtgttcattgcaaacagtactattcgttggacatcacttacttcaagtcatctcttgatagccaccttctggatctcctttggaacaagtactgggtgaacactctttcttcttccccactgctcggcaatggagactatgttgccggacagatatcagacttggctgagaagcttgagcaagccgagagtcagctggcgcactcccggtttggaggaataccggccagtcttcacaggaagaaagaggatgagcctccacttgctaagataactcgggacagtgcaaagataacggtggagcaggtccatggattaatgtcacaggttatcaaagacatattgttcaactcagcacgtcagtccgacaaaactcccagcgacccgtcagatccagagccgatgattacatcttaa

SEQ ID NO: 8638 - protein, 356 aa, Brassica napus
MDDSSTIARKTWELENNILTVEQPDSSSSDGIFYYDEASQTKVQQEKPWATDPNYFKRVQISALALLKMVVHARSGGTIEIMGLMQGKTEGDTIIVMDAFALPVEGTETRVNAQADAYEYMVEYSQTNKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLAHSRFGGIPASLHRKKEDEPPLAKITRDSAKITVEQVHGLMSQVIKDILFNSARQSDKTPSDPSDPEPMITS

SEQ ID NO: 8639 - DNA, 20 bp, Artificial sequence
  primer
atggaaggttcctcgtcagc

SEQ ID NO: 8640 - DNA, 23 bp, Artificial sequence
  primer
tcacgatgtaatcatgggctctg

SEQ ID NO: 8641 - protein, 401 aa, Artificial sequence
  consensus sequence
  Variant (2)..(9): Xaa in position 2 to 9 is any amino acid
  Variant (10)..(32): Xaa in position 10 to 32 is any or no amino acid
  Variant (34)..(41): Xaa in position 34 to 41 is any amino acid
  Variant (42)..(44): Xaa in position 42 to 44 is any or no amino acid
  Variant (47)..(47): Xaa in position 47 is any amino acid
  Variant (48)..(48): Xaa in position 48 is any or no amino acid
  Variant (51)..(52): Xaa in position 51 to 52 is any amino acid
  Variant (54)..(57): Xaa in position 54 to 57 is any amino acid
  Variant (61)..(61): Xaa in position 61 is any amino acid
  Variant (64)..(64): Xaa in position 64 is any amino acid
  Variant (67)..(68): Xaa in position 67 to 68 is any amino acid
  Variant (72)..(72): Xaa in position 72 is any amino acid
  Variant (75)..(76): Xaa in position 75 to 76 is any amino acid
  Variant (81)..(81): Xaa in position 81 is any amino acid
  Variant (83)..(83): Xaa in position 83 is any amino acid
  Variant (85)..(92): Xaa in position 85 to 92 is any amino acid
  Variant (93)..(94): Xaa in position 93 to 94 is any or no amino acid
  Variant (96)..(96): Xaa in position 96 is any amino acid
  Variant (98)..(98): Xaa in position 98 is any amino acid
  Variant (100)..(100): Xaa in position 100 is any amino acid
  Variant (114)..(115): Xaa in position 114 to 115 is any amino acid
  Variant (117)..(117): Xaa in position 117 is any amino acid
  Variant (121)..(122): Xaa in position 121 to 122 is any amino acid
  Variant (124)..(130): Xaa in position 124 to 130 is any amino acid
  Variant (133)..(133): Xaa in position 133 is any amino acid
  Variant (136)..(137): Xaa in position 136 to 137 is any amino acid
  Variant (156)..(156): Xaa in position 156 is any amino acid
  Variant (159)..(161): Xaa in position 159 to 161 is any amino acid
  Variant (163)..(165): Xaa in position 163 to 165 is any amino acid
  Variant (166)..(166): Xaa in position 166 is any or no amino acid
  Variant (168)..(169): Xaa in position 168 to 169 is any amino acid
  Variant (171)..(171): Xaa in position 171 is any amino acid
  Variant (173)..(173): Xaa in position 173 is any amino acid
  Variant (176)..(176): Xaa in position 176 is any amino acid
  Variant (179)..(179): Xaa in position 179 is any amino acid
  Variant (181)..(181): Xaa in position 181 is any amino acid
  Variant (185)..(185): Xaa in position 185 is any amino acid
  Variant (192)..(192): Xaa in position 192 is any amino acid
  Variant (194)..(206): Xaa in position 194 to 206 is any amino acid
  Variant (207)..(225): Xaa in position 207 to 225 is any or no amino acid
  Variant (227)..(228): Xaa in position 227 to 228 is any amino acid
  Variant (230)..(231): Xaa in position 230 to 231 is any amino acid
  Variant (233)..(234): Xaa in position 233 to 234 is any amino acid
  Variant (238)..(238): Xaa in position 238 is any amino acid
  Variant (240)..(240): Xaa in position 240 is any amino acid
  Variant (241)..(242): Xaa in position 241 to 242 is any or no amino acid
  Variant (245)..(245): Xaa in position 245 is any amino acid
  Variant (247)..(250): Xaa in position 247 to 250 is any amino acid
  Variant (254)..(254): Xaa in position 254 is any amino acid
  Variant (257)..(259): Xaa in position 257 to 259 is any amino acid
  Variant (261)..(262): Xaa in position 261 to 262 is any amino acid
  Variant (267)..(267): Xaa in position 267 is any amino acid
  Variant (269)..(270): Xaa in position 269 to 270 is any amino acid
  Variant (273)..(282): Xaa in position 273 to 282 is any amino acid
  Variant (283)..(286): Xaa in position 283 to 286 is any or no amino acid
  Variant (288)..(293): Xaa in position 288 to 293 is any amino acid
  Variant (296)..(325): Xaa in position 296 to 325 is any amino acid
  Variant (326)..(389): Xaa in position 326 to 389 is any or no amino acid
  Variant (392)..(393): Xaa in position 392 to 393 is any amino acid
  Variant (394)..(396): Xaa in position 394 to 396 is any or no amino acid
  Variant (398)..(400): Xaa in position 398 to 400 is any amino acid
NXXXXXXXXXXXXXXXXXXXXXXXXXXXXXXXDXXXXXXXXXXXPWXXDPXXFXXXXISAXALXKMXXHARXGGXXEVMGXMXGXXXXXXXXXXVXDXFXLPVEGTETRVNAQXXAXEYMXXYXXXXXXXGRXENXXGWYHSHPGYGCWLSGIDVXTQXXXQXXXXPXXAXVXDPXRTXSXGKVXIGAFRTXPXXXXXXXXXXXXXXXXXXXXXXXXXXXXXXXXQXXPXXKXXDFGXHXXXYYXLXXXXFKSXLDXXXLXXLWNKXWXXTLXXXXXXXXXXXXXXYXXXXXXDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLXXXXXKXXXF

SEQ ID NO: 8642 - protein, 25 aa, Artificial sequence
  protein pattern
  Variant (19)..(19): Xaa in position 19 is Ala, Asp, Gly, Asn, Ser or Thr
  Variant (22)..(23): Xaa in position 22 to 23 is any amino acid
  Variant (24)..(24): Xaa in position 24 is Asn or Gln
GWYHSHPGYGCWLSGIDVXTQXXXQ

SEQ ID NO: 8643 - protein, 36 aa, Artificial sequence
  protein pattern
  Variant (2)..(7): Xaa in position 2 to 7 is any amino acid
  Variant (8)..(9): Xaa in position 8 to 9 is any or no amino acid
  Variant (12)..(13): Xaa in position 12 to 13 is any or no amino acid
  Variant (16)..(16): Xaa in position 16 is Ala, Ile or Leu
  Variant (19)..(20): Xaa in position 19 to 20 is any amino acid
  Variant (22)..(22): Xaa in position 22 is Ala, Gly or Ser
  Variant (24)..(24): Xaa in position 24 is Ala or Ser
  Variant (26)..(26): Xaa in position 26 is Gly or Val
  Variant (27)..(28): Xaa in position 27 to 28 is any amino acid
  Variant (30)..(30): Xaa in position 30 is Ile or Val
  Variant (33)..(34): Xaa in position 33 to 34 is Ile, Leu or Met
  Variant (35)..(35): Xaa in position 35 is any amino acid
DXXXXXXXXISXXALXKMXXHXRXGXXXEXMGXXXG

SEQ ID NO: 8644 - protein, 27 aa, Artificial sequence
  protein pattern
  Variant (2)..(2): Xaa in position 2 is Ala or Ser
  Variant (3)..(3): Xaa in position 3 is Phe or Tyr
  Variant (4)..(4): Xaa in position 4 is any amino acid
  Variant (17)..(18): Xaa in position 17 to 18 is any amino acid
  Variant (19)..(19): Xaa in position 19 is Asp, Glu or Gln
  Variant (20)..(20): Xaa in position 20 is Ala or Ser
  Variant (21)..(21): Xaa in position 21 is any amino acid
  Variant (24)..(24): Xaa in position 24 is any amino acid
  Variant (25)..(25): Xaa in position 25 is Ser, Thr or Val
  Variant (26)..(26): Xaa in position 26 is Ala, Asp, Glu, Gln or Ser
  Variant (27)..(27): Xaa in position 27 is Phe or Tyr
DXXXLPVEGTETRVNAXXXXXEYXXXX

SEQ ID NO: 8645 - protein, 15 aa, Artificial sequence
  protein pattern
  Variant (3)..(3): Xaa in position 3 is Ile or Val
  Variant (4)..(4): Xaa in position 4 is Asn or Ser
  Variant (5)..(5): Xaa in position 5 is Ala, Gln or Ser
  Variant (6)..(6): Xaa in position 6 is Gly or Asn
  Variant (9)..(9): Xaa in position 9 is any amino acid
  Variant (10)..(10): Xaa in position 10 is Ile or Leu
RTXXXXKVXXGAFRT

SEQ ID NO: 8646 - protein, 14 aa, Artificial sequence
  protein pattern
  Variant (3)..(3): Xaa in position 3 is any amino acid
  Variant (5)..(5): Xaa in position 5 is Asp or Glu
  Variant (6)..(6): Xaa in position 6 is any amino acid
  Variant (7)..(7): Xaa in position 7 is Glu, Gln, Ser or Thr
  Variant (8)..(8): Xaa in position 8 is any amino acid
  Variant (9)..(9): Xaa in position 9 is Phe or Tyr
  Variant (12)..(12): Xaa in position 12 is Ala, Asn, Ser, Thr or Val
YYXLXXXXXKSXLD

SEQ ID NO: 8647 - protein, 22 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any or no amino acid
  Variant (7)..(7): Xaa in position 7 is any amino acid
  Variant (9)..(9): Xaa in position 9 is any amino acid
  Variant (11)..(11): Xaa in position 11 is any amino acid
  Variant (12)..(12): Xaa in position 12 is Ala, Asn or Gln
  Variant (15)..(15): Xaa in position 15 is Ala, Gly or Ser
  Variant (16)..(16): Xaa in position 16 is Gln or Ser
  Variant (17)..(17): Xaa in position 17 is Asn or Ser
  Variant (18)..(18): Xaa in position 18 is Gly, Pro, Ser or Thr
  Variant (19)..(19): Xaa in position 19 is Ile or Leu
  Variant (20)..(21): Xaa in position 20 to 21 is any amino acid
  Variant (22)..(22): Xaa in position 22 is Asn or Thr
LXXLXWXKXWXXTLXXXXXXXX

SEQ ID NO: 8648 - DNA, 366 bp, ESCHERICHIA COLI
  CDS (1)..(366): transl_table=11
atgtatatttattggattttattaggtctggctattgctacagaaattaccggtacgctgtcaatgaaatgggcgagcgtcagtgagggaaatggcggctttattttaatgctggtgatgatttctctgtcgtatatatttctctctttcgccgttaaaaaaatcgccttaggcgtagcttatgcgctgtgggaaggtatcggtattttatttattaccttgtttagcgttttgttattcgacgaaagtttatcgctgatgaaaattgccgggttaaccaccctggtcgccgggattgtgttgataaaatcaggtacccgtaaagcgcgtaaacctgaactggaggtgaaccatggcgcagtttaa

SEQ ID NO: 8649 - protein, 121 aa, ESCHERICHIA COLI
MYIYWILLGLAIATEITGTLSMKWASVSEGNGGFILMLVMISLSYIFLSFAVKKIALGVAYALWEGIGILFITLFSVLLFDESLSLMKIAGLTTLVAGIVLIKSGTRKARKPELEVNHGAV

SEQ ID NO: 8650 - DNA, 351 bp, Xenorhabdus bovienii
  CDS (1)..(351): transl_table=11
atgatttattggatatttcttgcactggcgattttgacagaagtgattggtactctgtccatgaaacaagccagtgtttcaggtgattttaccggcatgattgtgatgtacaccatgatcacaacttcttatattttgctggccattgccgtgaaaaaggtcgctctgggagtggcttatgctctatgggaagggattggcatcctgtttattacagcttttagcgtattgtggttcaatgaatcactgtcacccatgaaaatcggtggattggccctgttgatagccggaattgcactgattaaatccggtacaaaaaaagcctcgaattatcaaatgaaggaggcatag

SEQ ID NO: 8651 - protein, 116 aa, Xenorhabdus bovienii
MIYWIFLALAILTEVIGTLSMKQASVSGDFTGMIVMYTMITTSYILLAIAVKKVALGVAYALWEGIGILFITAFSVLWFNESLSPMKIGGLALLIAGIALIKSGTKKASNYQMKEA

SEQ ID NO: 8652 - DNA, 330 bp, Pseudomonas aeruginosa PAO1
  CDS (1)..(330): transl_table=11
atgctgaccctgaactggattcccttcgcctggctcggcctggcaatcgccctcgaggtcgtcgccaacctgctgttgaaatactccgacggtttccgcaggcgcggcctcgggatcgcctcgatcctctgcgtgatggccgccttcaccgcgctggcgcaggcggtgaaggacatcgagctgtcactcgcctatgcgatctggggcggcttcggcatcctcgccaccgtcgccatgggctgggcgctgttcggccagcgcctggcctggcgcggctggctcggcctgttgctgctgctggccggcatgagcctgctcaagctggcctga

SEQ ID NO: 8653 - protein, 109 aa, Pseudomonas aeruginosa PAO1
MLTLNWIPFAWLGLAIALEVVANLLLKYSDGFRRRGLGIASILCVMAAFTALAQAVKDIELSLAYAIWGGFGILATVAMGWALFGQRLAWRGWLGLLLLLAGMSLLKLA

SEQ ID NO: 8654 - DNA, 369 bp, Pseudomonas aeruginosa PAO1
  CDS (1)..(369): transl_table=11
atgcgttcctggatctatctgttactggctatcggcgccgaagtgatcggcaccacctcgatgaaactggccgccacccacgcccctgtcgcaggcatgctgctgatgtacgggatgatcggcctgtcctatttcttcctcgccctggcggtcaagcgtgtccccgtcggagtcgcctacgccctttgggaaggcattggcatcgtcctgatcacggcggtcagcgtcgcctggctgggcgaaagcatcggcctgtacaaggccgtcggcctcggcgtgatgatcgccggcatcctgctgatcaagtccggcacccgcaacgccagcggcacgccggcgcagtcccgtggggaggccgtcacatgctga

SEQ ID NO: 8655 - protein, 122 aa, Pseudomonas aeruginosa PAO1
MRSWIYLLLAIGAEVIGTTSMKLAATHAPVAGMLLMYGMIGLSYFFLALAVKRVPVGVAYALWEGIGIVLITAVSVAWLGESIGLYKAVGLGVMIAGILLIKSGTRNASGTPAQSRGEAVTC

SEQ ID NO: 8656 - DNA, 324 bp, Pseudomonas aeruginosa PAO1
  CDS (1)..(324): transl_table=11
atggcgtggatctatctcttgctcgccggtgtcttcgaaatcgtctgggccacggccatgaaggagtcggccggcttcacccgcctgtggccgagcctggtcaccctgctgttcatgatcctcagcttcggcctgctggccgtttccatgaaaaccctgcccctcggcacggcctacaccatctgggtcggcatcggtgcggtcggcgccttcgccctgggcatcctgctcttcggcgaaagcccgagcccgttgcggctgctggcggtggggctgatcgtggccggcatcgtcattctcaagctggcgacccgtcagggctga

SEQ ID NO: 8657 - protein, 107 aa, Pseudomonas aeruginosa PAO1
MAWIYLLLAGVFEIVWATAMKESAGFTRLWPSLVTLLFMILSFGLLAVSMKTLPLGTAYTIWVGIGAVGAFALGILLFGESPSPLRLLAVGLIVAGIVILKLATRQG

SEQ ID NO: 8658 - DNA, 315 bp, Campylobacter jejuni subsp. jejuni NCTC 11168
  CDS (1)..(315): transl_table=11
atggaatggttttatttgtttttagctactgcctgtgaaatttttggcgtggtgatcatgaaagaacttgtaagcactaaaaacaagctttaccttttagctttgatagtgtgttttggattttcttttacttttttaagcttaagtatgcaaaatatcgctatgagcgttgcttatgctatatggacaggagctggaaccgctggtggggtaatgataggagtgcttttttataaagaaagtaaaagttttttgaaactttttttaatcgctgtgattattacttgtacagcgggtttaaaatttctttcttga

SEQ ID NO: 8659 - protein, 104 aa, Campylobacter jejuni subsp. jejuni NCTC 11168
MEWFYLFLATACEIFGVVIMKELVSTKNKLYLLALIVCFGFSFTFLSLSMQNIAMSVAYAIWTGAGTAGGVMIGVLFYKESKSFLKLFLIAVIITCTAGLKFLS

SEQ ID NO: 8660 - DNA, 342 bp, Campylobacter jejuni subsp. jejuni NCTC 11168
  CDS (1)..(342): transl_table=11
ttgaatatcgcaaaaaaagaactttttgttgcttggtttttcttgattgctgctattgtatttgaagttttaggcactagttttttaaaaatggaaaatcaaattttaggctatatatttatggctttatttatagctttttcttatttttttatgggtaaggcgattaaaaaaattcaagtaggcatagcctatgctgtatgggagcttttagggattattctcatacttttagtttcttttatagtttttaaagagagtttaaccttaactcaaattctaggcattgttctttctatcgttggaattatcatgattaatataggcgaggttaaagaataa

SEQ ID NO: 8661 - protein, 113 aa, Campylobacter jejuni subsp. jejuni NCTC 11168
MNIAKKELFVAWFFLIAAIVFEVLGTSFLKMENQILGYIFMALFIAFSYFFMGKAIKKIQVGIAYAVWELLGIILILLVSFIVFKESLTLTQILGIVLSIVGIIMINIGEVKE

SEQ ID NO: 8662 - DNA, 324 bp, Clostridium acetobutylicum ATCC 824
  CDS (1)..(324): transl_table=11
atgagttggatttacttgattttagctataatatttgaggtttctggaacaacttttatgaagcagtctaaaggatttagtgattttaaatatgctattgtaatgatggttttctatatcctaagtttgagtatgcttacacttgcactaaagaagatagatataggagttgcatatgctatatggtctgctgtaggcatagttttaatagttacaataggaattttagtatttaaagagccagttaatattagtaaaatattatgtatcttactaataatagtaggagtagttggattgaatttaacttcgaaagtacattga

SEQ ID NO: 8663 - protein, 107 aa, Clostridium acetobutylicum ATCC 824
MSWIYLILAIIFEVSGTTFMKQSKGFSDFKYAIVMMVFYILSLSMLTLALKKIDIGVAYAIWSAVGIVLIVTIGILVFKEPVNISKILCILLIIVGVVGLNLTSKVH

SEQ ID NO: 8664 - DNA, 345 bp, Sinorhizobium meliloti 1021
  CDS (1)..(345): transl_table=11
atgcgtcttgcatggcttttcctggtcctcgcgatcgcgaccgaggtcgtcggcctgactgtgatgaaggcggcatccggctccggctcctattgggggcatgtggtcatgtatgcctcgatcgcgctctcctacgtcttcctggcacgagcggtgaagaccattccggttggcgtcgcctatgccgtctgggaaggatccggcgtcgccgtgataacgctcgtctctgttttcgttttcggccatgcgctctccggccgcgagatgctgggcctcgcgatggctgttgcgggaatacttctcctcaatgccggcaggagcgatgcggaggaagccgccgcatga

SEQ ID NO: 8665 - protein, 114 aa, Sinorhizobium meliloti 1021
MRLAWLFLVLAIATEVVGLTVMKAASGSGSYWGHVVMYASIALSYVFLARAVKTIPVGVAYAVWEGSGVAVITLVSVFVFGHALSGREMLGLAMAVAGILLLNAGRSDAEEAAA

SEQ ID NO: 8666 - DNA, 330 bp, Salmonella enterica subsp. enterica serovar Typhi str. CT18
  CDS (1)..(330): transl_table=11
gtgcaacaatttgaatggatacacggcgcctggcttgggctggcaataatgctggaaatcgcggctaacgttctgttgaaattttcggacggctttcgccgtaaatgctatggcatcttatcgcttgccgctgttctggccgccttcagcgcgctttcccaggcggtaaaagggatagacctgtcggtggcgtatgcgctatggggcggttttggtattgccgccacgctggcggcgggctgggtgctcttcggccagcgcttaaatcccaaaggctgggttggcgtgatattgctgctcgccggaatggtcatgataaaatttgcctga

SEQ ID NO: 8667 - protein, 109 aa, Salmonella enterica subsp. enterica serovar Typhi str. CT18
MQQFEWIHGAWLGLAIMLEIAANVLLKFSDGFRRKCYGILSLAAVLAAFSALSQAVKGIDLSVAYALWGGFGIAATLAAGWVLFGQRLNPKGWVGVILLLAGMVMIKFA

SEQ ID NO: 8668 - DNA, 363 bp, Salmonella enterica subsp. enterica serovar Typhi str. CT18
  CDS (1)..(363): transl_table=11
atgttttactggattttattagctctggctatcgcgactgaaattaccggcacgctctcaatgaaatgggctagcgtgggtaatggcaatgcgggttttattttaatgctggtgatgatcacgctgtcatatatatttctttcttttgcggtaaaaaagattgccctgggtgtagcgtatgccttatgggaagggatcggcattttatttattaccatttttagcgtgctgctatttgatgaagcattatcaaccatgaagattgccggcttgctgacgctggtcgccggcatcgtattgatcaaatcagggacgcgtaaacccggcaaaccggtgaaggaggcgactcgtgcaacaatttga

SEQ ID NO: 8669 - protein, 120 aa, Salmonella enterica subsp. enterica serovar Typhi str. CT18
MFYWILLALAIATEITGTLSMKWASVGNGNAGFILMLVMITLSYIFLSFAVKKIALGVAYALWEGIGILFITIFSVLLFDEALSTMKIAGLLTLVAGIVLIKSGTRKPGKPVKEATRATI

SEQ ID NO: 8670 - DNA, 330 bp, Methanosarcina acetivorans C2A
  CDS (1)..(330): transl_table=11
ttgatgaactactattacctgctgttactggcaatagcatttgaagtatgcgggactacctgcatgaaattatccgaaggctttacaaaactgctcccttcggtattgattttcgtgttctatgcgatcagtttctttctcttcacacttgcccttaaaggaatagatgtgagcgttgcatatgcaatatgggctggtctcggaactgcccttatcaccatcgtagggattttatggttcagggaacctgccacagctctcaaaatgatttctcttatcgttgtaattacaggagttatcgggcttcatctgagtgataaagtcacataa

SEQ ID NO: 8671 - protein, 109 aa, Methanosarcina acetivorans C2A
MMNYYYLLLLAIAFEVCGTTCMKLSEGFTKLLPSVLIFVFYAISFFLFTLALKGIDVSVAYAIWAGLGTALITIVGILWFREPATALKMISLIVVITGVIGLHLSDKVT

SEQ ID NO: 8672 - DNA, 327 bp, Methanosarcina mazei Go1
  CDS (1)..(327): transl_table=11
atgaattattattatcttctgttacttgcaatactgtttgaagtttgcggaacaacctgcatgaaattatctgatggcttttcaaaactgaccccatcgattttgattttcgtattttatgctatcagtttctttttctttactcttgcccttaaagggctggatgtgagcattgcatacgcaatatgggcagggttagggaccgcttttataacagttataggaatattctggttcagagaaccttcctcggccttcaggctaatttctcttgcctttgtagttatgggagtgatcgggcttcatctgagcgatagagtagcataa

SEQ ID NO: 8673 - protein, 108 aa, Methanosarcina mazei Go1
MNYYYLLLLAILFEVCGTTCMKLSDGFSKLTPSILIFVFYAISFFFFTLALKGLDVSIAYAIWAGLGTAFITVIGIFWFREPSSAFRLISLAFVVMGVIGLHLSDRVA

SEQ ID NO: 8674 - DNA, 465 bp, Yersinia pestis KIM
  CDS (1)..(465): transl_table=11
atgcgtgttaggagaagaaaagtgatttattggatatttttaggtctggcaattattgctgaaattattggcaccctatcaatgaaatatgccagtgttagcggcgagatgaccgggcatatcgtgatgtattttatgataacgggctcctatgtcatgctctcgttagcggttaagaaagtagcattgggtgtggcttatgcgctgtgggaggggatcggcatccttattattactattttcagtgtgatgtggtttggcgagacgttatcgccactgaaaatagccggtttagtgacactgattggtgggatcctcttggtgaaatcgggtactcggaaaccaaaacaaccgaactgccatcgcggtaatcgacccccttcggtacaggaattaaaaacacagactaccggccatcataagggtgttgctgttgagtcaggtgagcatcatgcagcagcttga

SEQ ID NO: 8675 - protein, 154 aa, Yersinia pestis KIM
MRVRRRKVIYWIFLGLAIIAEIIGTLSMKYASVSGEMTGHIVMYFMITGSYVMLSLAVKKVALGVAYALWEGIGILIITIFSVMWFGETLSPLKIAGLVTLIGGILLVKSGTRKPKQPNCHRGNRPPSVQELKTQTTGHHKGVAVESGEHHAAA

SEQ ID NO: 8676 - DNA, 324 bp, Bradyrhizobium japonicum USDA 110
  CDS (1)..(324): transl_table=11
atgtcaccatcattggcctggctcatgctggtgatcgccggcgtgctcgatgtcggctgggcgatctcgatgaaatatgcggaaggctacacgcggccgggctggagcatcgcgtcgctcgcgctgctcgcggccttcgtgttcctgctcggacgcgcgctgaaggtgctcgaggtcggcgtcgcctattcggtctggaccggcattggtgctgccggcaccttcgtcatgggcgtggtgctgttcggcgagaccctgagtgcaatgaagatcgccggtatcgtgctggtgctgacagggatcgccgcgctgaagctggcctag

SEQ ID NO: 8677 - protein, 107 aa, Bradyrhizobium japonicum USDA 110
MSPSLAWLMLVIAGVLDVGWAISMKYAEGYTRPGWSIASLALLAAFVFLLGRALKVLEVGVAYSVWTGIGAAGTFVMGVVLFGETLSAMKIAGIVLVLTGIAALKLA

SEQ ID NO: 8678 - DNA, 405 bp, Vibrio parahaemolyticus RIMD 2210633
  CDS (1)..(405): transl_table=11
atgctagttgcacgtctatttttattgctcgccatcgttgccgaagtggctggcaccagcactatgtctcttatcggacaagggcacgggtggtggggctacatcgtaatgtatgtgctgatcgcaatctcttactactttctcgcgtttgccgcgaagaaaatatctatcggtgtggcatacgctgtctgggaagggttaggtatctcgttgatcaccgtggtgtcgatcatcgcctttgatgccaacttaaaccatcaagagctgtttggtttgatgttagccgttgtcggcattgtgtgtgtgactttaggggaatcacacgatcaacctaacgctgagaaaaacgccgataaactggcaaaaaaacgttcattttctgctagtacaaggtgcgaatcatga

SEQ ID NO: 8679 - protein, 134 aa, Vibrio parahaemolyticus RIMD 2210633
MLVARLFLLLAIVAEVAGTSTMSLIGQGHGWWGYIVMYVLIAISYYFLAFAAKKISIGVAYAVWEGLGISLITVVSIIAFDANLNHQELFGLMLAVVGIVCVTLGESHDQPNAEKNADKLAKKRSFSASTRCES

SEQ ID NO: 8680 - DNA, 357 bp, Helicobacter hepaticus ATCC 51449
  CDS (1)..(357): transl_table=11
gtgagtctaaaaaaaagttatttatttttgatgttcgctattttgactgaagtgcttgcagtgaatttaatgaaagcaagtgagggagagatttgggggcttatgtgtatgtatgtgttgcttgtgctttcttattattttatggctctctcattaaagcgtatttctgtgggtgtagcatatgcgatatgggaagtgttaggtgcgatttgtgtggtgtgcattagtgtattttattttggcgaagagatttcatttatacaaaagattggcattgtattgtccattagcggcattgctttaatcaattatgccgaaattaagcgtgaatcaaagatagattctatggagggctag

SEQ ID NO: 8681 - protein, 118 aa, Helicobacter hepaticus ATCC 51449
MSLKKSYLFLMFAILTEVLAVNLMKASEGEIWGLMCMYVLLVLSYYFMALSLKRISVGVAYAIWEVLGAICVVCISVFYFGEEISFIQKIGIVLSISGIALINYAEIKRESKIDSMEG

SEQ ID NO: 8682 - DNA, 315 bp, Helicobacter hepaticus ATCC 51449
  CDS (1)..(315): transl_table=11
atgagttgggtgtatctcataatggctggttgtatggaaatcataggcgtaattacgatgaaaaaatactccctaagtgggcgaaaaatctttttgcttgggcttttggtgcagtttatgctaagctttgctctgctatcaatggctatgcagggcattgcgatggcgacagcctatgcgatatggacaggcattggcgcagctggaggcgtgcttgtgggcgtggtgttttttaaagaaagtaaaagtgcaaaaaaactctttttcatcgcacttattattatctctgtcgtgggattaaaggcactatcataa

SEQ ID NO: 8683 - protein, 104 aa, Helicobacter hepaticus ATCC 51449
MSWVYLIMAGCMEIIGVITMKKYSLSGRKIFLLGLLVQFMLSFALLSMAMQGIAMATAYAIWTGIGAAGGVLVGVVFFKESKSAKKLFFIALIIISVVGLKALS

SEQ ID NO: 8684 - DNA, 315 bp, Wigglesworthia glossinidia endosymbiont of Glossina brevipalpis
  CDS (1)..(315): transl_table=11
atgatttgttatatttatttatttatagcaatattagcagaagttttttctacttctttgcttaaaatttctgaaggatttactaaaatttttccatctattttaattattcttggatatatagtatcttcgttttttttatctcttgcattgaaagatatccctataggaatagcttattctagttggtctggatttggtattgtatttgtaactatttctggatattttttatataatcaaaaaataaatttaattgaaatttttggaataattcttattattactggagtattgataattaatatatattaa

SEQ ID NO: 8685 - protein, 104 aa, Wigglesworthia glossinidia endosymbiont of Glossina brevipalpis
MICYIYLFIAILAEVFSTSLLKISEGFTKIFPSILIILGYIVSSFFLSLALKDIPIGIAYSSWSGFGIVFVTISGYFLYNQKINLIEIFGIILIITGVLIINIY

SEQ ID NO: 8686 - DNA, 333 bp, Bordetella pertussis Tohama I
  CDS (1)..(333): transl_table=11
atgaacagctggatccatctgtcgatggccatcgtggccgaaatcatcgccaccagcgccctgaaaagctcggagggcttcacccgcctgctcccctcgctggtcaccgtggcgggctacgcgatcgcgttctacttcctggccctcacgctgcgggtcatcccggtgggggtcgcctacgccatctggtccggcgtgggcatcgtgctgatctcgctggttggcgcgctgttgttcaagcagcacctggacctgcccgccatcatcggcatcgcgctgatcctggcgggcgtggtggtcatgaacgtgttctcgaagtccgtcggccactga

SEQ ID NO: 8687 - protein, 110 aa, Bordetella pertussis Tohama I
MNSWIHLSMAIVAEIIATSALKSSEGFTRLLPSLVTVAGYAIAFYFLALTLRVIPVGVAYAIWSGVGIVLISLVGALLFKQHLDLPAIIGIALILAGVVVMNVFSKSVGH

SEQ ID NO: 8688 - DNA, 333 bp, Bordetella bronchiseptica RB50
  CDS (1)..(333): transl_table=11
atgaacagctggatccatctgtcggtggccatcgtggccgaaatcatcgccaccagcgccctgaaaagctcggagggcttcacccgcctgctcccctcgctggtcaccgtggcgggctacgcgatcgcgttctacttcctggccctcacgctgcgggtcatcccggtgggggtcgcctacgccatctggtccggcgtgggcatcgtgctgatctcgctggttggcgcgctgttgttcaagcagcacctggacctgcccgccatcatcggcatcgcgctgatcctggcgggcgtggtggtcatgaacgtgttctcgaagtccgtcggccactga

SEQ ID NO: 8689 - protein, 110 aa, Bordetella bronchiseptica RB50
MNSWIHLSVAIVAEIIATSALKSSEGFTRLLPSLVTVAGYAIAFYFLALTLRVIPVGVAYAIWSGVGIVLISLVGALLFKQHLDLPAIIGIALILAGVVVMNVFSKSVGH

SEQ ID NO: 8690 - DNA, 390 bp, Chromobacterium violaceum ATCC 12472
  CDS (1)..(390): transl_table=11
ttgtttattttatttaacactatgtataaaaaattcttctctccattgatcgtcgcctggctggtgctgctggcggccatcgtctgtgaaatcgtcggcacctccttcatggcggtcgccgcccgcagcggcggctatctgggctatgtctggatgtcgctggcgctggcgctgtcctactacctgctgtctctcgccctgcgcgcgatttcggtcggcgtcgcctacgcggtgtgggaaggtttgggcctggtcggcctgaccgcggtcagcgtcttgctgttcggcgaaaagctggtgccgcaggaaatcgtcggcctcggcctcgccttgctgggcctggtctgcgtgacgatgggcgaaacccatgatgaggaggccgcggcatga

SEQ ID NO: 8691 - protein, 129 aa, Chromobacterium violaceum ATCC 12472
MFILFNTMYKKFFSPLIVAWLVLLAAIVCEIVGTSFMAVAARSGGYLGYVWMSLALALSYYLLSLALRAISVGVAYAVWEGLGLVGLTAVSVLLFGEKLVPQEIVGLGLALLGLVCVTMGETHDEEAAA

SEQ ID NO: 8692 - DNA, 333 bp, Chromobacterium violaceum ATCC 12472
  CDS (1)..(333): transl_table=11
atgaaagtctggctgttcctgatgggggccatcctgtccgaagtggtggccacctccgcgctgaaggcctccgacggttttacccggctgtggccgtcgttgttgaccgccggcggctacgtgctggccttctacctgttgtcccagacactgcgccacattccggtgggcatcgcctacgcgctgtggtcgggcatcggcatcgtgttggtgtcgctgatcgcctggctgctgtacggccagaagctggatctggctgcggtggcgggcatgggcttgatcatcgccggcgtggcggtgatcaatctgttttcgcatagcgccgcgcactga

SEQ ID NO: 8693 - protein, 110 aa, Chromobacterium violaceum ATCC 12472
MKVWLFLMGAILSEVVATSALKASDGFTRLWPSLLTAGGYVLAFYLLSQTLRHIPVGIAYALWSGIGIVLVSLIAWLLYGQKLDLAAVAGMGLIIAGVAVINLFSHSAAH

SEQ ID NO: 8694 - DNA, 417 bp, Photorhabdus luminescens subsp. laumondii TTO1
  CDS (1)..(417): transl_table=11
atgatttattggttattccttgcaatggcaattattaccgaagttatcggtaccttatcgatgaaacatgccagcgtttccggtggtgtagttggcatggccgttatgtacatcatgatcgccacatcctatatcttgctggcaatggcggtgaaaaaagtggcattgggcgttgcgtacgctttatgggaaggggttggcattctatttattactgtttttagtgtcatgtggtttgatgaatcattgtcattgatgaaagtagggggattggctctgctgataacagggattatgttgattaaatccggtacgagaaaagccgcagtcaaaaaatcggcagaggtagtgaagcagatggcaaataaggctgtcagtgttgcaacaaccaaaagcagtaaaataaaggaggcgtaa

SEQ ID NO: 8695 - protein, 138 aa, Photorhabdus luminescens subsp. laumondii TTO1
MIYWLFLAMAIITEVIGTLSMKHASVSGGVVGMAVMYIMIATSYILLAMAVKKVALGVAYALWEGVGILFITVFSVMWFDESLSLMKVGGLALLITGIMLIKSGTRKAAVKKSAEVVKQMANKAVSVATTKSSKIKEA

SEQ ID NO: 8696 - DNA, 363 bp, Bacillus cereus ATCC 10987
  CDS (1)..(363): transl_table=11
atgcagtggatttatttatgcttcgcaattttatttgaggtagcaggtacaactgcaatgaaactatctgatggattaacgaaacttgtaccaagcattcttatttttgtattttatgtagtaagttttgcatttctgtcatttgcattaaaggggatggaaatgtccgttgcatatgcggtatggtcaggtatgggaattgtaacgattacaacaattggttttatttattttggagaaagtatcaatataattaagatactagcaattctttttattttagttggagtcgtaatattaaattttaatagtacggcacatgaagcgaagaaaaaagaaatggtggaggaacgtatacattga

SEQ ID NO: 8697 - protein, 120 aa, Bacillus cereus ATCC 10987
MQWIYLCFAILFEVAGTTAMKLSDGLTKLVPSILIFVFYVVSFAFLSFALKGMEMSVAYAVWSGMGIVTITTIGFIYFGESINIIKILAILFILVGVVILNFNSTAHEAKKKEMVEERIH

SEQ ID NO: 8698 - DNA, 363 bp, Klebsiella pneumoniae subsp. pneumoniae MGH 78578
  CDS (1)..(363): transl_table=11
atgttttattggattttattagctttagcaattattgctgaaattaccggcaccttgtctatgaaatgggcaagcgtgagcggcgggcacaccggctttattttaatgctggccatgattgccctgtcatatatttttcttgcctttgcggttaaaaagattgccctcggtgtggcctatgcgttgtgggaagggatcggtattttactgattaccctgttcagcgtgctgctgtttgatgagagtctgtccctgctgaaaatagccggcttgaccaccctggtgatagggatcgtcttaattaagtccggcacccagaaaaaagcgtcttccaagcaggaggtggcccatgcagcagtttga

SEQ ID NO: 8699 - protein, 120 aa, Klebsiella pneumoniae subsp. pneumoniae MGH 78578
MFYWILLALAIIAEITGTLSMKWASVSGGHTGFILMLAMIALSYIFLAFAVKKIALGVAYALWEGIGILLITLFSVLLFDESLSLLKIAGLTTLVIGIVLIKSGTQKKASSKQEVAHAAV

SEQ ID NO: 8700 - DNA, 330 bp, Klebsiella pneumoniae subsp. pneumoniae MGH 78578
  CDS (1)..(330): transl_table=11
atgcagcagtttgagtggatccacgccgcctggctggcaatcgccattgtgctggaaattattgccaacgtctttttgaagttttccgacggcttccgccgcaagatctacggcatcctgtccctggcggcagtattgggcgcgttcagcgccctgtcgcaggcggttaaagggatcgatctctcggtcgcctatgcgctgtggggcggcttcggtatcgcggcgaccatcgccgccggctgggtgctgtttggtcagcgtctgaataacaaaggctgggcgggggttatcctgctggtagccggcatggtgttaattaaactcgcctga

SEQ ID NO: 8701 - protein, 109 aa, Klebsiella pneumoniae subsp. pneumoniae MGH 78578
MQQFEWIHAAWLAIAIVLEIIANVFLKFSDGFRRKIYGILSLAAVLGAFSALSQAVKGIDLSVAYALWGGFGIAATIAAGWVLFGQRLNNKGWAGVILLVAGMVLIKLA

SEQ ID NO: 8702 - DNA, 318 bp, Xanthobacter autotrophicus Py2
  CDS (1)..(318): transl_table=11
atggcgtggatctatctgttcgtcgccggtgtcatggaaatcgcctgggccatcggcatgaagcagtcggaaggcttcacccggctgtggcccagcgtcttcaccctgtcggccatcgccgtcagtctgttcctgctgtcgctggcgctcaggggcattcccatcggcaccgcctatgcggtgtgggcggggatcggcaccgtgggcacggcgctcgtcggcattctcttcttctccgaatccaccgacctgctgcggctcgcctccatcggcctcatcggcgccgggatcgtggggctgaagctggtcacgccctga

SEQ ID NO: 8703 - protein, 105 aa, Xanthobacter autotrophicus Py2
MAWIYLFVAGVMEIAWAIGMKQSEGFTRLWPSVFTLSAIAVSLFLLSLALRGIPIGTAYAVWAGIGTVGTALVGILFFSESTDLLRLASIGLIGAGIVGLKLVTP

SEQ ID NO: 8704 - DNA, 363 bp, Salmonella enterica subsp. arizonae serovar 62:z4,z23:--
  CDS (1)..(363): transl_table=11
atgttttactggattttattagctctggctattgtggctgaaattacaggcacgctctcaatgaaatgggctagcgtgggcaatggtaacgctggttatattttaatgctggtgatgatcacgctatcatatatatttctttcttttgcggtaaaaaagattgccctgggtgtggcgtatgccttatgggaagggatcggtattttatttattaccgtatttagcgtactgctatttgatgaagtattatcaaccatgaagattgtcggtttgctgacgctaattgtcggcatcgtattgatcaaatcagggacgcgtaaacccggcaaaccggtgaaggaggcgacccgtgcaacaatttga

SEQ ID NO: 8705 - protein, 120 aa, Salmonella enterica subsp. arizonae serovar 62:z4,z23:--
MFYWILLALAIVAEITGTLSMKWASVGNGNAGYILMLVMITLSYIFLSFAVKKIALGVAYALWEGIGILFITVFSVLLFDEVLSTMKIVGLLTLIVGIVLIKSGTRKPGKPVKEATRATI

SEQ ID NO: 8706 - DNA, 384 bp, Desulfovibrio vulgaris subsp. vulgaris str. Hildenborough
  CDS (1)..(384): transl_table=11
atgtcaacgacctactactggctgtgcctgctcgcttccatcgtcttcgaggtggcgggcacaagcgtgatgaaactctcgcaggagacgtggcctttgctcggcatgggctgcatgtacctgctgctggggctttcgtacttctttctcgcccgtgcggtggtgaagctgcccgtgggcgttgcctatgccttctgggaaggcctcggcctcacgctcatcaccatcgtcagcgtgacgttgctcgacgaacggcttgatgccatgcgccttgccgcccttggcatggtgctggcgggtacgctgctggtgcaccatggcaccgcacacggcagggacgatgaagaggcagaggctgcctccggcggcgagggacggatatga

SEQ ID NO: 8707 - protein, 127 aa, Desulfovibrio vulgaris subsp. vulgaris str. Hildenborough
MSTTYYWLCLLASIVFEVAGTSVMKLSQETWPLLGMGCMYLLLGLSYFFLARAVVKLPVGVAYAFWEGLGLTLITIVSVTLLDERLDAMRLAALGMVLAGTLLVHHGTAHGRDDEEAEAASGGEGRI

SEQ ID NO: 8708 - DNA, 363 bp, Bacillus anthracis str. Sterne
  CDS (1)..(363): transl_table=11
gtgcagtggatttatttatgtttagcgattttatttgaggtagcaggtacaactgcgataaaactatctgatggattaacgaaacttgtaccaagcattcttatttttgtattttatgtagtaagttttgcatttctgtcatttgcattaaaagggatggaaatgtccgttgcatatgcggtttggtcaggtatgggaattgtaacgattacaacaattggttttatctattttggagaaagtatcaatataattaagatagtagcaattctttttattttaattggagtcgtaattttaaattttaatagtacggcacatgaagcgaagaaaaaagaaatggtggaggaacgtatacattga

SEQ ID NO: 8709 - protein, 120 aa, Bacillus anthracis str. Sterne
MQWIYLCLAILFEVAGTTAIKLSDGLTKLVPSILIFVFYVVSFAFLSFALKGMEMSVAYAVWSGMGIVTITTIGFIYFGESINIIKIVAILFILIGVVILNFNSTAHEAKKKEMVEERIH

SEQ ID NO: 8710 - DNA, 363 bp, Bacillus thuringiensis serovar konkukian str. 97-27
  CDS (1)..(363): transl_table=11
gtgcagtggatttatttatgcttagcaattttatttgaggtagcaggtacaactgcgatgaaattatctgatggattaacgaaactagtaccaagcattcttatttttgtattttatgtagtaagttttgcatttctttcatttgcattaaaagggatggaaatgtccgttgcatatgcggtttggtcaggtatgggaattgtaacgattacaacaattggttttatttattttggagaaagcatcaatgtaattaagatactagcaattctttttattttagttggagtcgtaatattaaattttaatagtgcggcacatgaaacgaagaaaaaagaaatggtggaggaacgtatacattga

SEQ ID NO: 8711 - protein, 120 aa, Bacillus thuringiensis serovar konkukian str. 97-27
MQWIYLCLAILFEVAGTTAMKLSDGLTKLVPSILIFVFYVVSFAFLSFALKGMEMSVAYAVWSGMGIVTITTIGFIYFGESINVIKILAILFILVGVVILNFNSAAHETKKKEMVEERIH

SEQ ID NO: 8712 - DNA, 465 bp, Yersinia pseudotuberculosis IP 32953
  CDS (1)..(465): transl_table=11
atgcgtgttaggagaagaaaagtgatttattggatatttttaggtctggcaattattgctgaaattattggcaccctatcaatgaaatatgccagtgttagcggcgagatgaccgggcatgtcgtgatgtattttatgataacgggttcctatgtcatgctctcgttagcggttaagaaagtagcattgggtgtggcttatgcgctgtgggaggggatcggcatccttattattactattttcagtgtgatgtggtttggcgagacgttatcgccactgaaaatagccggtttagtgacactgattggtgggatcctcttggtgaaatcgggtacgcggaaaccaaaacaaccgaaccgccatcgcggtaatcgacccccttcggtacagggattaaaaacacagactaccggccatcataagggtgttgctgttgagtcaggtgagcatcatgcagcagcttga

SEQ ID NO: 8713 - protein, 154 aa, Yersinia pseudotuberculosis IP 32953
MRVRRRKVIYWIFLGLAIIAEIIGTLSMKYASVSGEMTGHVVMYFMITGSYVMLSLAVKKVALGVAYALWEGIGILIITIFSVMWFGETLSPLKIAGLVTLIGGILLVKSGTRKPKQPNRHRGNRPPSVQGLKTQTTGHHKGVAVESGEHHAAA

SEQ ID NO: 8714 - DNA, 321 bp, Symbiobacterium thermophilum IAM 14863
  CDS (1)..(321): transl_table=11
gtggcttggctgtacttgttcgtggcaggtgccatggaaatcgcctggtcgacggcgatgaaatactccgagggtttcacccggttctggccctccgtggcgacgatcgtgctcagcctgaccagcttcgtcctgctcagccaggcgatgaagacgctgccgctgggcaccgcctacggcgtctggacgggcatcggcgccctcggctccgcgctggtgggcatcgtcttcctgggagagccgcgggagccgttgcggctgctctgcatcttcctcatcttcgccggcatcgtgggcctgaagctcacgagccggtcatga

SEQ ID NO: 8715 - protein, 106 aa, Symbiobacterium thermophilum IAM 14863
MAWLYLFVAGAMEIAWSTAMKYSEGFTRFWPSVATIVLSLTSFVLLSQAMKTLPLGTAYGVWTGIGALGSALVGIVFLGEPREPLRLLCIFLIFAGIVGLKLTSRS

SEQ ID NO: 8716 - DNA, 315 bp, Bacillus cereus E33L
  CDS (1)..(315): transl_table=11
atggcttgggtatttttaattctagctggtatttgtgaaattattggtgtactctttatgaaagtagccactgaaaagaaaggctgggcaccaaaagttattttaatcgctaacttcggcgtaagcttcttcttcttatcccttgcgatgaacacattaccgatgggaactgcttacgcgatttggactggaatcggaactgccggaagtgcacttctaggcatccttattttccgcgaatcagcggattggcgtcgccttgccttcttaagctgtattctatgcggcgctgttggcttaaaactattaagctaa

SEQ ID NO: 8717 - protein, 104 aa, Bacillus cereus E33L
MAWVFLILAGICEIIGVLFMKVATEKKGWAPKVILIANFGVSFFFLSLAMNTLPMGTAYAIWTGIGTAGSALLGILIFRESADWRRLAFLSCILCGAVGLKLLS

SEQ ID NO: 8718 - DNA, 318 bp, Methylococcus capsulatus str. Bath
  CDS (1)..(318): transl_table=11
atgagctgggcctatctgatcctggccggttgcctggaaatcggctggccgctgggtttcaaactgtcgcaaaccgaaggcacgcgactggccggcctggtgctggccgtgctgtgcatggtgctgagtggcattttcctgtggctggcgcaacgggagattcccatgggcacggcatacgcggtatggaccggtatcggagcggccggtacctttttcgtcggtgtgtggtttttcggcgatgcggccaccccgggacgttacttgggggcggcgctgatcgttgccggtgtgatgacactcaagctggcgcattga

SEQ ID NO: 8719 - protein, 105 aa, Methylococcus capsulatus str. Bath
MSWAYLILAGCLEIGWPLGFKLSQTEGTRLAGLVLAVLCMVLSGIFLWLAQREIPMGTAYAVWTGIGAAGTFFVGVWFFGDAATPGRYLGAALIVAGVMTLKLAH

SEQ ID NO: 8720 - DNA, 315 bp, Campylobacter jejuni RM1221
  CDS (1)..(315): transl_table=11
atggaatggttttatttgtttttagctactgcttgtgaaatttttggtgtggtgatcatgaaagaacttgtaaacactaaaaacaagctttactttttagctttgatagtgtgttttggattttcttttacttttttaagcttaagtatgcaaaatatcgctatgagcgttgcttatgctatatggacaggagctggaaccgctggtggggtaatgataggagtgcttttttataaagaaagtaaaagttttttaaaactttttttaatcactgtgattattgcttgtacagtaggtttaaaatttctttcttaa

SEQ ID NO: 8721 - protein, 104 aa, Campylobacter jejuni RM1221
MEWFYLFLATACEIFGVVIMKELVNTKNKLYFLALIVCFGFSFTFLSLSMQNIAMSVAYAIWTGAGTAGGVMIGVLFYKESKSFLKLFLITVIIACTVGLKFLS

SEQ ID NO: 8722 - DNA, 342 bp, Campylobacter jejuni RM1221
  CDS (1)..(342): transl_table=11
ttgaatatcgcaaaaaaagaactttttgttgcttggtttttcttgattgctgctattgtatttgaagttttaggcactagttttttaaaaatggaaaatcaagttttaggctatatatttatggctttatttatagctttttcttatttttttatgggcaaggcgattaaaaaaattcaagtaggtatagcctatgctgtatgggaacttttagggattattcttatacttttagtttcttttatagtttttaaagagagtttaaccttaactcaaattctaggcattattctttctatcgttggaattatcatgattaatataggcgaggttaaagaataa

SEQ ID NO: 8723 - protein, 113 aa, Campylobacter jejuni RM1221
MNIAKKELFVAWFFLIAAIVFEVLGTSFLKMENQVLGYIFMALFIAFSYFFMGKAIKKIQVGIAYAVWELLGIILILLVSFIVFKESLTLTQILGIILSIVGIIMINIGEVKE

SEQ ID NO: 8724 - DNA, 411 bp, Desulfovibrio desulfuricans G20
  CDS (1)..(411): transl_table=11
atgtccgcaccacgtgcgtatcactggctgtgtcttaccggcgcggtctttttcgaggtggccggtaccacactgatgaaggcttcacaaagctggagcatggctttcggggccgaggccggagtggtgatcatgctgctgttcatcggtgtttcgtattatctgctttcactttccaccacggcgctgcccgtgggggtggcttttgctttctgggaaggggtcggacttgcattcatcacgctcgccagtgtgttcattctgggcgaacagatgagtctgctgcgttttgctgcgctgtgtgctgtgctgggcggcgtgctgctggtgcaccacggcacttcttccggcaaccggcaacaggcggaacccgccggtgcggttcagccgcgcggaggggaacagtcatga

SEQ ID NO: 8725 - protein, 136 aa, Desulfovibrio desulfuricans G20
MSAPRAYHWLCLTGAVFFEVAGTTLMKASQSWSMAFGAEAGVVIMLLFIGVSYYLLSLSTTALPVGVAFAFWEGVGLAFITLASVFILGEQMSLLRFAALCAVLGGVLLVHHGTSSGNRQQAEPAGAVQPRGGEQS

SEQ ID NO: 8726 - DNA, 324 bp, Desulfitobacterium hafniense Y51
  CDS (1)..(324): transl_table=11
atgcaatgggtttacttagccctggctattttactggaaattttagggacaacactgatgaaaatgtccgagggactgacgaaaatgctgccaacgttagggatgttcctggcctatgttttatgttttagttccttcgccctggccttaaagaaaataccagtcagcgtcgcctatgccgtatggtccggagtggggattgtggttatatcggccataggaatagcagtgttcaaagaaaccgtcactaccctgaaagtcgtatccatcgtcctgattgtagcaggagtagtgggtttgaacctgggcggtaccgctcattaa

SEQ ID NO: 8727 - protein, 107 aa, Desulfitobacterium hafniense Y51
MQWVYLALAILLEILGTTLMKMSEGLTKMLPTLGMFLAYVLCFSSFALALKKIPVSVAYAVWSGVGIVVISAIGIAVFKETVTTLKVVSIVLIVAGVVGLNLGGTAH

SEQ ID NO: 8728 - DNA, 411 bp, Acidobacteria bacterium Ellin345
  CDS (1)..(411): transl_table=11
atgtgctggctatggttgtttttagcaatcgctcttgaagtcgcagcaacgatcctgatgaagtattccgacggtttcacccgcttcggcccgacggtgggcatgcttgtgctctacgccctcagcctggcgccgttggcccgcgtcctgaaagaacttgaagtaggcgcggtctacgccatctggtcggccctcggcacggtcgcagtggccctgctcggcatggtcctgttccacgaacccgccaatgccctgaaggtcttctcgatcgtcctgatcattgtcggagtcgtcggcttgaacctgagtggccgcagttcgaagaacgagatcgaggcccataacaaagccgacatccgcctggccgcgaccgccgtaaccccggtggtgaaagcctccaaccaccgctaa

SEQ ID NO: 8729 - protein, 136 aa, Acidobacteria bacterium Ellin345
MCWLWLFLAIALEVAATILMKYSDGFTRFGPTVGMLVLYALSLAPLARVLKELEVGAVYAIWSALGTVAVALLGMVLFHEPANALKVFSIVLIIVGVVGLNLSGRSSKNEIEAHNKADIRLAATAVTPVVKASNHR

SEQ ID NO: 8730 - DNA, 330 bp, Synechococcus sp. CC9311
  CDS (1)..(330): transl_table=11
atgcccgcaccctggattctgttaatgctggcgatcggttccgaagtgattggaacctcctgcctcaaactctctgagggtttcagcaggccaattcccacactcgttgtgctggccgcttactccacctcgatgctgttgctctctcgagtggtgcagaccattcctctcggcatcacctacgccctatggagtggaatcgggatcatcgccatcgtgctggttggcttgcttgcctacaagcaagttccctccccaggtcagctagtgggaatcgccacaatcacagctggggtgatcatcgtgaatctcactggcaagcatccctga

SEQ ID NO: 8731 - protein, 109 aa, Synechococcus sp. CC9311
MPAPWILLMLAIGSEVIGTSCLKLSEGFSRPIPTLVVLAAYSTSMLLLSRVVQTIPLGITYALWSGIGIIAIVLVGLLAYKQVPSPGQLVGIATITAGVIIVNLTGKHP

SEQ ID NO: 8732 - DNA, 369 bp, Pseudomonas aeruginosa UCBPP-PA14
  CDS (1)..(369): transl_table=11
atgcgttcctggatctatctgttactggctatcggcgccgaagtgatcggcaccacctcgatgaaactggccgccacccacgcccctgtcgcaggcatgctgctgatgtacgggatgatcggcctgtcctatttcttcctcgccctggcggtcaagcgtgtccccgtcggagtcgcctacgccctttgggaaggcattggcatcgtcctgatcacggcggtcagcgtcgcctggctgggcgaaagcatcggcctgtacaaggccgtcggcctcggcgtgatgatcgccggcatcctgctgatcaagtccggcacccgcaacgccagcggcacgccggcgcagccccgtggggaggccgtcacatgctga

SEQ ID NO: 8733 - protein, 122 aa, Pseudomonas aeruginosa UCBPP-PA14
MRSWIYLLLAIGAEVIGTTSMKLAATHAPVAGMLLMYGMIGLSYFFLALAVKRVPVGVAYALWEGIGIVLITAVSVAWLGESIGLYKAVGLGVMIAGILLIKSGTRNASGTPAQPRGEAVTC

SEQ ID NO: 8734 - DNA, 363 bp, Bacillus cereus G9241
  CDS (1)..(363): transl_table=11
atgcagtggatttatttatgcttcgcaattttatttgaggtagcaggtacaactgcaatgaaactatctgatggattaacgaaacttgtaccaagcattcttatttttgtcttttatgtagtaagttttgcatttctatcatttgcattaaaagggatggaaatgtccgtagcatatgcggtatggtcaggcatgggaattgttacgattacaataattggttttgtttattttggagaaagtatcaatataattaagatactagcaattctatttattttaattggagtcgtaattttaaattttaatagtacggcacatgaagcgaagaaaaaagaaatggtggaggaacgtatacattga

SEQ ID NO: 8735 - protein, 120 aa, Bacillus cereus G9241
MQWIYLCFAILFEVAGTTAMKLSDGLTKLVPSILIFVFYVVSFAFLSFALKGMEMSVAYAVWSGMGIVTITIIGFVYFGESINIIKILAILFILIGVVILNFNSTAHEAKKKEMVEERIH

SEQ ID NO: 8736 - DNA, 324 bp, Roseovarius nubinhibens ISM
  CDS (1)..(324): transl_table=11
atggcctggatcattctctgttttgccgggttgctggaaatcggctgggccatggggctgaaactgtccgacggcttcacccgcctcgtgcccacggtgctgaccctcgccctcgcggtgttcagcatctatctcgtcggcctctccgcgcgcagcatcccggtcggcaccgcctatgcggtctgggccgggatcggcgcggtcggcacggtgatcttcggcatcgtgatctttgccgaacccgtctcgctcatgcggatggcctgcgtcggtttgatcgtcgcgggcatcgtcgggctgaaactggtggacggcagcgcctga

SEQ ID NO: 8737 - protein, 107 aa, Roseovarius nubinhibens ISM
MAWIILCFAGLLEIGWAMGLKLSDGFTRLVPTVLTLALAVFSIYLVGLSARSIPVGTAYAVWAGIGAVGTVIFGIVIFAEPVSLMRMACVGLIVAGIVGLKLVDGSA

SEQ ID NO: 8738 - DNA, 336 bp, Synechococcus sp. RS9917
  CDS (1)..(336): transl_table=11
atgacctctccctggatcctgttgctgttcgccatcgccgctgaggtggtgggcacctcctgcctcaagctgtcggagggtttcagccggccgctgccgaccttgctggtgctggcggcctacgccacctcgatggccctgatgtcgcgggtggtgcaaagcatccctctgggcctcacctatgccctctggagtggcatcggcatcgtggcgatcgtgctggtgggggtgctggcctatcgccaggtgcccagctccggccaactgatcggcatgggcctgatcgccgccggggtggtgatcgtgaatctcaccgggtcgctggagcacggctga

SEQ ID NO: 8739 - protein, 111 aa, Synechococcus sp. RS9917
MTSPWILLLFAIAAEVVGTSCLKLSEGFSRPLPTLLVLAAYATSMALMSRVVQSIPLGLTYALWSGIGIVAIVLVGVLAYRQVPSSGQLIGMGLIAAGVVIVNLTGSLEHG

SEQ ID NO: 8740 - DNA, 333 bp, Oceanobacter sp. RED65
  CDS (1)..(333): transl_table=11
atgaatagctggttactcttaatggtcgcgattcttgccgaagttattggaacatcgtcattgaaagcaagtgaaggcttcaccaaactctggccgagtattggcactgtcatcggtttctcaattgcattctattgtctgtctttgacgttaaaggtcattcctgttggcgttgcctacgctgtttgggctggtttgggtattgtcttgattactctgatcggatggtggctgtttggtcaaacattagattgggctgcagtattaggaatggggcttattgttacaggtgttgtaataatgaatgttttttccaaaagtgtgagccactaa

SEQ ID NO: 8741 - protein, 110 aa, Oceanobacter sp. RED65
MNSWLLLMVAILAEVIGTSSLKASEGFTKLWPSIGTVIGFSIAFYCLSLTLKVIPVGVAYAVWAGLGIVLITLIGWWLFGQTLDWAAVLGMGLIVTGVVIMNVFSKSVSH

SEQ ID NO: 8742 - DNA, 324 bp, Desulfitobacterium hafniense DCB-2
  CDS (1)..(324): transl_table=11
atgcaatggatttatttagccctggctattttactggaaattttggggacaacactgatgaaaatgtccgagggactgacgaaaatgctgccaacgttagggatgtttctggcctatgttttatgttttagttccttcgccctggccttaaagaaaataccggtcagcgtcgcctatgccgtatggtccggagtggggattgtggttatatcggccataggaatagcagtgttcaaagaaaccgtcactaccctgaaagtcgtatccatcgtcctgattgtagcaggagtagtgggtttgaacctgggcggtaccgctcattaa

SEQ ID NO: 8743 - protein, 107 aa, Desulfitobacterium hafniense DCB-2
MQWIYLALAILLEILGTTLMKMSEGLTKMLPTLGMFLAYVLCFSSFALALKKIPVSVAYAVWSGVGIVVISAIGIAVFKETVTTLKVVSIVLIVAGVVGLNLGGTAH

SEQ ID NO: 8744 - DNA, 405 bp, Vibrio sp. Ex25
  CDS (1)..(405): transl_table=11
atgctagttgcacgtctatttttattgctcgccatcgttgccgaagtagcaggcaccagcaccatgtcttttatcggacaaggtcatggatggttgggctacatcgtgatgtacgtattgattgcggtgtcgtactacttcctctcgattgcagcgaaaaagatttctatcggcgtggcatacgctgtttgggaagggttgggtatctcattgatcacggtcgtttcgatcgtgttgtttgattctgacttaaatacccaagagctgcttggtttgatgttagctgtcatcggcatcgtttgtgtgactttaggtgagtcacacgggcaatctaacaccaagaaaaacgccgataaactggcaaaagaacgttcattttctacaagtgtaaggtgtgaatcatga

SEQ ID NO: 8745 - protein, 134 aa, Vibrio sp. Ex25
MLVARLFLLLAIVAEVAGTSTMSFIGQGHGWLGYIVMYVLIAVSYYFLSIAAKKISIGVAYAVWEGLGISLITVVSIVLFDSDLNTQELLGLMLAVIGIVCVTLGESHGQSNTKKNADKLAKERSFSTSVRCES

SEQ ID NO: 8746 - DNA, 324 bp, Staphylococcus aureus
  CDS (1)..(324): transl_table=11
atgccatatatatatttacttatagcaataataaccgaaataatagggacaagttttttaaaatcagcagaaggttttacaaaactatggccaacactaggaacacttatttcgttcggaatatgtttttactttttaagtacagccatgaaatatttaccactaaatatttcatatgcaacatgggcaggattaggtttagtacttacaactctagtttcagtcattatttttaaagaaaatattaatctaattagtatattttcaataaccctaattattattggagtagtacttctgaatgtttttggatcaggacactaa

SEQ ID NO: 8747 - protein, 107 aa, Staphylococcus aureus
MPYIYLLIAIITEIIGTSFLKSAEGFTKLWPTLGTLISFGICFYFLSTAMKYLPLNISYATWAGLGLVLTTLVSVIIFKENINLISIFSITLIIIGVVLLNVFGSGH

SEQ ID NO: 8748 - DNA, 348 bp, Escherichia coli
  CDS (1)..(348): transl_table=11
atgaaaggctggctttttcttgttatcgcaatagttggcgaagtaatcgcaacatccgcattaaaatctagcgagggctttattaagcttgccccttccgccgttgtcataatcggttatggcatcgcattttattttctttctctggttctgaaatccatccctgtcggtgttgcttatgcagtctggtcgggactcggcgtcgtcataattacagccattgcctggttgcttcatgggcaaaagcttgatgcgtggggctttgtaggtatggggctcataattgctgcctttttgctcgcccgatccccatcgtggaagtcgctgcggaggccgacgccatggtga

SEQ ID NO: 8749 - protein, 115 aa, Escherichia coli
MKGWLFLVIAIVGEVIATSALKSSEGFIKLAPSAVVIIGYGIAFYFLSLVLKSIPVGVAYAVWSGLGVVIITAIAWLLHGQKLDAWGFVGMGLIIAAFLLARSPSWKSLRRPTPW

SEQ ID NO: 8750 - DNA, 354 bp, Bacillus subtilis
  CDS (1)..(354): transl_table=11
atgagaggattgctttatttggctctcgccattgtatctgaagtgtttgggagcacgatgttgaagctttcagaaggatttacacaagcctggcccattgccggagtcatagtcggatttctttctgcttttacgtttctaagcttttctttaaaaacaattgacttatcaagcgcgtatgcaacatggtcgggcgttggtaccgcgcttacagcaattgtcgggtttttgctttttggcgaaaccatcagtttaaaaggtgtattcggtctcacgcttgtcattgcaggcgtggtcgtgctaaatcaatcgaaagcccacgctgaagataaaaaacagacggcctgtgagtga

SEQ ID NO: 8751 - protein, 117 aa, Bacillus subtilis
MRGLLYLALAIVSEVFGSTMLKLSEGFTQAWPIAGVIVGFLSAFTFLSFSLKTIDLSSAYATWSGVGTALTAIVGFLLFGETISLKGVFGLTLVIAGVVVLNQSKAHAEDKKQTACE

SEQ ID NO: 8752 - DNA, 366 bp, Escherichia coli O6
  CDS (1)..(366): transl_table=11
atgtatatttattggattttattaggtctggctgttgctacagaaattaccggtacgctgtctatgaaatgggcgagcgtcagtgagggaaatggcggctttattttaatgctggtgatgatttctctgtcgtatatatttctctctttcgccgttaaaaagatcgccttaggcgtggcttatgcgctgtgggaaggtatcggtattttatttattaccttgtttagcgttttgttattcgacgaaagtctatcgctgatgaaaattgccgggttaaccaccctggtcgccgggattgtattgatcaaatcaggtacccgtaaagcgcgtaaacctgaactggaggtgaaccatggcgcagtttga

SEQ ID NO: 8753 - protein, 121 aa, Escherichia coli O6
MYIYWILLGLAVATEITGTLSMKWASVSEGNGGFILMLVMISLSYIFLSFAVKKIALGVAYALWEGIGILFITLFSVLLFDESLSLMKIAGLTTLVAGIVLIKSGTRKARKPELEVNHGAV

SEQ ID NO: 8754 - DNA, 360 bp, Bacillus subtilis
  CDS (1)..(360): transl_table=11
atgaattgggtgtttctatgcttggcgattttgtttgaggttgcgggaactgtcagcatgaagctatcgtctggttttacaaagcttattcccagtttgctgttgattttcttttatggagggagtcttttctttctgacgcttacgcttaaatccattgatgtatcagttgcttatgctgtatggtcagggatgggaattgtcttgattacagtcgttggttttttgttttttcaagaacatgtgagtgtcatgaaagtcatttcaattggattgattattgccggtgttgtgtctttaaacctgatcgagcatgttgcggtgtctgagccggtacataaaagcgggcagtacaaatga

SEQ ID NO: 8755 - protein, 119 aa, Bacillus subtilis
MNWVFLCLAILFEVAGTVSMKLSSGFTKLIPSLLLIFFYGGSLFFLTLTLKSIDVSVAYAVWSGMGIVLITVVGFLFFQEHVSVMKVISIGLIIAGVVSLNLIEHVAVSEPVHKSGQYK

SEQ ID NO: 8756 - DNA, 28 bp, Artificial sequence
  primer
atgtatatttattggattttattaggtc

SEQ ID NO: 8757 - DNA, 24 bp, Artificial sequence
  primer
ttaaactgcgccatggttcacctc

SEQ ID NO: 8758 - protein, 95 aa, Artificial sequence
  consensus sequence
  Variant (2)..(3): Xaa in position 2 to 3 is any amino acid
  Variant (5)..(7): Xaa in position 5 to 7 is any amino acid
  Variant (9)..(15): Xaa in position 9 to 15 is any amino acid
  Variant (17)..(37): Xaa in position 17 to 37 is any amino acid
  Variant (38)..(44): Xaa in position 38 to 44 is any or no amino acid
  Variant (46)..(56): Xaa in position 46 to 56 is any amino acid
  Variant (60)..(60): Xaa in position 60 is any amino acid
  Variant (62)..(62): Xaa in position 62 is any amino acid
  Variant (64)..(64): Xaa in position 64 is any amino acid
  Variant (66)..(94): Xaa in position 66 to 94 is any amino acid
LXXAXXXEXXXXXXXKXXXXXXXXXXXXXXXXXXXXXXXXXXXXLXXXXXXXXXXXAYAXWXGXGXXXXXXXXXXXXXXXXXXXXXXXXXXXXXG

SEQ ID NO: 8759 - protein, 51 aa, Artificial sequence
  protein pattern
  Variant (2)..(10): Xaa in position 2 to 10 is any amino acid
  Variant (11)..(12): Xaa in position 11 to 12 is any or no amino acid
  Variant (15)..(15): Xaa in position 15 is Ala, Ser or Thr
  Variant (16)..(16): Xaa in position 16 is any amino acid
  Variant (18)..(18): Xaa in position 18 is any amino acid
  Variant (20)..(20): Xaa in position 20 is any amino acid
  Variant (22)..(28): Xaa in position 22 to 28 is any amino acid
  Variant (29)..(29): Xaa in position 29 is Ala, Gly or Ser
  Variant (30)..(37): Xaa in position 30 to 37 is any amino acid
  Variant (38)..(38): Xaa in position 38 is Ala, Asp, Gly, Asn, Ser, Thr or Val
  Variant (39)..(48): Xaa in position 39 to 48 is any amino acid
  Variant (49)..(49): Xaa in position 49 is Gly, Ile, Leu or Val
  Variant (50)..(50): Xaa in position 50 is any amino acid
  Variant (51)..(51): Xaa in position 51 is Ala, Cys, Gly or Ser
LXXXXXXXXXXXAYXXWXGXGXXXXXXXXXXXXXXXXXXXXXXXXXXXXXX

SEQ ID NO: 8760 - DNA, 1515 bp, ESCHERICHIA COLI
  CDS (1)..(1515): transl_table=11
atgcaacagtctaccccgtatctctcatttcgcggcatcggtaaaacgtttcccggcgttaaggcgctgacggatattagttttgactgctatgccggtcaggttcatgcgttgatgggtgaaaatggcgcaggaaaatcaactctcttaaaaatcctcagcggcaactatgcgccaaccacgggttctgtagtgattaatgggcaggaaatgtccttttccgacacgaccgcagcacttaacgcgggcgtggcgattatttaccaggaactgcatctcgtgccggaaatgaccgtcgcggaaaacatctatctcggccagctgccgcataaaggcggcattgtgaatcgctcattgctgaattatgaggcgggtttacaacttaaacatcttggtatggatattgacccggacacgccgctgaaatatctctccattggtcagtggcagatggttgaaatcgccaaagcgctggcgcgtaacgccaaaattatcgcctttgatgagccaaccagctccctctctgcccgtgaaatcgacaatcttttccgcgttattcgtgaactgcgaaaagaggggcgggtaatcttatacgtttctcaccgtatggaagaaatatttgccctcagcgatgccattactgtctttaaagatggacgttatgtcaaaacctttaccgatatgcagcaggttgaccacgacgcgctggtgcaggcgatggtcgggcgcgacattggcgatatctacggctggcaaccgcgtagttatggcgaggagcgcctacgtcttgatgctgtgaaagcaccaggcgtgcgtacgccaataagtctggcggttcgcagtggtgaaattgttgggctgtttggtctggtaggggcggggcgtagcgaattaatgaaaggcatgtttggcgggacgcaaatcaccgccggtcaggtttatatcgaccaacagccgatcgatattcgtaaaccgagccacgccattgccgcaggcatgatgctctgcccggaagatcgcaaagcggaaggcattattcccgtgcactccgttcgcgacaatatcaacatcagtgccagacgtaaacatgtgctcggcggttgtgtaatcaacaacggttgggaagaaaacaatgccgatcaccacattcgttcgctcaacatcaaaacgccgggcgcggagcaactgatcatgaatctctcaggcggaaatcagcaaaaagccattctgggccgctggttatcggaagagatgaaggtcattttgctggatgaacctacgcgcggcattgatgttggcgctaagcacgaaatatataacgtaatttatgcgctggcggcgcagggcgtggcggtgctgtttgcctccagcgacttacctgaagtcctcggcgttgccgaccggattgtggtgatgcgggaaggtgaaatcgccggtgaattgttacacgagcaggcagatgagcgtcaggcactgagccttgcgatgcctaaagtcagccaggctgttgcctaa

SEQ ID NO: 8761 - protein, 504 aa, ESCHERICHIA COLI
MQQSTPYLSFRGIGKTFPGVKALTDISFDCYAGQVHALMGENGAGKSTLLKILSGNYAPTTGSVVINGQEMSFSDTTAALNAGVAIIYQELHLVPEMTVAENIYLGQLPHKGGIVNRSLLNYEAGLQLKHLGMDIDPDTPLKYLSIGQWQMVEIAKALARNAKIIAFDEPTSSLSAREIDNLFRVIRELRKEGRVILYVSHRMEEIFALSDAITVFKDGRYVKTFTDMQQVDHDALVQAMVGRDIGDIYGWQPRSYGEERLRLDAVKAPGVRTPISLAVRSGEIVGLFGLVGAGRSELMKGMFGGTQITAGQVYIDQQPIDIRKPSHAIAAGMMLCPEDRKAEGIIPVHSVRDNINISARRKHVLGGCVINNGWEENNADHHIRSLNIKTPGAEQLIMNLSGGNQQKAILGRWLSEEMKVILLDEPTRGIDVGAKHEIYNVIYALAAQGVAVLFASSDLPEVLGVADRIVVMREGEIAGELLHEQADERQALSLAMPKVSQAVA

SEQ ID NO: 8762 - DNA, 1545 bp, Mesorhizobium loti MAFF303099
  CDS (1)..(1545): transl_table=11
atgagcgcgacggcgcagaaacaggcaagcagccatccggtgctggagatgcggcacatctccaagaccttcggtgcgatccgcgccttgcatgatgtttcactcaccgtccatgccggggagctgcatgctcttatgggcgagaacggcgccggcaagtcgacgctgatgaaggtgctgtcgggcgcctatcggccggatgccggcggcgagatcctgatcgatggcgcgcccgccgcaaccggcgatccgatcaaggcgcgtgccgcaggtatcgcggtgatctatcaggagctgtcgctggcgcccaatctgacggtggcgcagaacatcttcctcggcaacgagccgcggcggttcggcattgtcgaccgcgatcagtgcaaccggcgggcgaacgaaatcatcgcgcggctcggcgtctccttctcggcgcgtgcgctggtctccagcctgtcgctcggcgagcgccagctggtcgagattgcgcgcgcgctgtcgaccaatgcgcgcatcatcgtcatggacgagccgacgacgtcgctgacgtcgcgcgagaccgatagcctgtttgaagtgatcgcgacgctgaagacgcaaggcatcgccatcatctacatcagccatcgcatggaagaggtctaccagctcgccgaccgtgtcagcgtgctgcgcgacagcggctatgtcggcacgctggagcgcgccgacctcaacgcctcgcggctggtgtcgatgatggtcggccgcgatctctccgccttctacaagaaggatcatcgtccgccggacgcgaagcgcgccatcgcactctcggtgcgcggcatgtccgacgggcgcctgctgaagaactgctcgttcgacctgcacaagggcgaggtgctggccctggcgggcctcgtcggctccggccgcaccgagctcgcccggctgatcttcggcgccgacaggcgcagcgccggcacgctggagctcgacggcaaaccgatctccattggctcgccgcgcgaagcgctcgacgccggcattgcctacctgaccgaggaccgcaaggaactcggcctgttcctcgacatgtcgatctccgacaacatcagcatgggcgtgctggccagggacgcgctgaccggcggattgcgcgacttcggcgccgccgaaaggcgcgcggcaaaggcgatcgcggacctgtcgatccgcaccagctcggcgcaggccaatgccggctcgctgtcgggcggcaaccagcagaaggtgctgctcgcccggctgctggagaccgagccgaaagtcgtcatcctcgacgagccgacccgcggcgtcgatgtcggcgccaagtcggaaatctaccggctgatcgacaacctcgccaaccggggcatcgccatcctgatgatctcaagcgaattgcccgaggtgatcggcgtcgccgaccgcgtgctggtgatgcgcgacggcgccatagcaggcgaggtgacggcatccggaggcgagccgctgcgtcaggaggcgatcatggaacttgcgacgggagcggcccaggaatga

SEQ ID NO: 8763 - protein, 514 aa, Mesorhizobium loti MAFF303099
MSATAQKQASSHPVLEMRHISKTFGAIRALHDVSLTVHAGELHALMGENGAGKSTLMKVLSGAYRPDAGGEILIDGAPAATGDPIKARAAGIAVIYQELSLAPNLTVAQNIFLGNEPRRFGIVDRDQCNRRANEIIARLGVSFSARALVSSLSLGERQLVEIARALSTNARIIVMDEPTTSLTSRETDSLFEVIATLKTQGIAIIYISHRMEEVYQLADRVSVLRDSGYVGTLERADLNASRLVSMMVGRDLSAFYKKDHRPPDAKRAIALSVRGMSDGRLLKNCSFDLHKGEVLALAGLVGSGRTELARLIFGADRRSAGTLELDGKPISIGSPREALDAGIAYLTEDRKELGLFLDMSISDNISMGVLARDALTGGLRDFGAAERRAAKAIADLSIRTSSAQANAGSLSGGNQQKVLLARLLETEPKVVILDEPTRGVDVGAKSEIYRLIDNLANRGIAILMISSELPEVIGVADRVLVMRDGAIAGEVTASGGEPLRQEAIMELATGAAQE

SEQ ID NO: 8764 - DNA, 1515 bp, Escherichia coli O157:H7 EDL933
  CDS (1)..(1515): transl_table=11
atgcaacagtctaccccgtatctctcatttcgcggcatcggtaaaacgtttcccggcgttaaggcgctgacggatattagttttgactgctatgccggtcaggttcatgcgttgatgggtgaaaatggcgcaggaaaatcaactctcttaaaaatcctcagcggcaactatgcgccaaccacgggttctgtagtgattaatgggcaggaaatgtccttttccgacacgaccgcagcacttaacgcgggtgtggcgattatttaccaggaactgcatctcgtgccggaaatgaccgtcgcggaaaacatctatctcggccagctgccgcataaaggcggcattgtgaatcgctcattgctgaattatgaggcgggtttacaacttaaacatcttggtatggatattgacccggacacgccgctgaaatatctctccattggtcagtggcagatggttgaaatcgccaaggcgctggcgcgtaacgctaaaattatcgcctttgatgagccaaccagctccctttctgcccgcgaaatcgacaatcttttccgcgttatttgtgaactgcgaaaagaggggcgggtgatcttatacgtttctcaccgtatggaagaaatatttgccctcagcgatgccatcactgtctttaaagatggacgttatgtcaaaacctttaccgatatgcagcaggttgaccacgacgcgctggtgcaggcgatggtcgggcgcgacattggcgatatctacggctggcaaccgcgtagttatggcgaggagcgcctgcgtcttgatgctgtgaaagcaccaggcgtgcgtacgccaataagtctggcggttcgcagtggtgaaattgttgggctgtttggtctggtaggggcggggcgtagcgaattaatgaaaggcatgtttggcgggacgcaaatcaccgccggtcaggtttatatcgaccaacagccgatcgatattcgtaaaccgagccacgccattgccgcaggcatgatgctctgcccggaagatcgcaaagcggaaggcattattcctgtgcactccgttcgcgacaatatcaacatcagtgccagacgtaaacatgtgctcggcggttgtgtaatcaacaacggttgggaagaaaacaatgccgatcaccacattcgttcgctcaacatcaaaacgccgggcgctgagcaactgattatgaatctctcaggtggaaatcagcaaaaagccattctgggccgctggttatcggaagagatgaaggtcattttgctggatgaacctacgcgcggcattgatgttggtgctaagcacgaaatatataacgtgatttatgcgctggcggcgcagggtgtggcggtgctgtttgcctccagcgacttacctgaagtcctcggcgttgccgaccggattgtggtgatgcgcgaaggtgaaatcgccggtgaattgttacacgagcaggcagatgagcgtcaggcactgagccttgcgatgcctaaagtcagccaggcagttgcctga

SEQ ID NO: 8765 - protein, 504 aa, Escherichia coli O157:H7 EDL933
MQQSTPYLSFRGIGKTFPGVKALTDISFDCYAGQVHALMGENGAGKSTLLKILSGNYAPTTGSVVINGQEMSFSDTTAALNAGVAIIYQELHLVPEMTVAENIYLGQLPHKGGIVNRSLLNYEAGLQLKHLGMDIDPDTPLKYLSIGQWQMVEIAKALARNAKIIAFDEPTSSLSAREIDNLFRVICELRKEGRVILYVSHRMEEIFALSDAITVFKDGRYVKTFTDMQQVDHDALVQAMVGRDIGDIYGWQPRSYGEERLRLDAVKAPGVRTPISLAVRSGEIVGLFGLVGAGRSELMKGMFGGTQITAGQVYIDQQPIDIRKPSHAIAAGMMLCPEDRKAEGIIPVHSVRDNINISARRKHVLGGCVINNGWEENNADHHIRSLNIKTPGAEQLIMNLSGGNQQKAILGRWLSEEMKVILLDEPTRGIDVGAKHEIYNVIYALAAQGVAVLFASSDLPEVLGVADRIVVMREGEIAGELLHEQADERQALSLAMPKVSQAVA

SEQ ID NO: 8766 - DNA, 1524 bp, Bradyrhizobium japonicum USDA 110
  CDS (1)..(1524): transl_table=11
atgagcgacgcgcttccgatcgaggtcacctcacccacgccgctgctcgagctgcgcggcatcagcaaggagtttcccggcgtcaaggcgctggatgacgtgtcctttgccgtcttccccggcgaagtccatatgctgctgggggagaacggcgccggcaagtcgagcctgatgaaggtgctgtgcggcgcctaccgcgccgatgccggcgagttctactacaagggcgagaaggtcgcgatcggctcggccgcggatgcacagaagctcggcattgccgtgatcttccaggagttctcgctggtcccccatctcgacatcgcccagaacatcttcctcggccgcgagccgaagggccgcatccccggcacgatcgaccggagcaagatcctcgccgacgccaaacgcgtgctcggcaccatcggcttcgacatcgatccctccacgatcgtggacaagctcggggtggcgcagcagcagatggtcgagatcgccaaggcgatcagccagaacgcacgcatcctcgtcatggacgagccgaccgcggcgctgtccgaccgcgagaccgagctcctgttcgcgctgatcgcgcggctgaaagccgacggcgtgtcgatcgtctatatctcgcaccgcatggcggaggtgttcgcgctcggcgatcgcatcacggtgctgcgcgacggccgccgcatcgacggcgtccgcccggccgacgtcacgccggaccagctcgtccgcatgatggtcggacgcaccgtcgacatgacctatccgcgcaatttcgccgacaagcccggcgaggtactgctgcaggtcaagggcctgagctcctcgaccgggatctccgacatcaacatcgaggtgcgccggggcgagatcgtcggcctgtgcggcctggtcggctccggccgcagcgaagtcgcgcgcgccatcttcggcgccgatcccgtcagctccggcgagatcatcttcgacggcaagaccatctccggcgagcctgatctcgccgcccgccgcggcatcgcgctgatcccggagagccgcaagagcgagggcctcgctctgctgcggtcggtgagcgacaatctggtggtgtcggcgctgcgaaaactgttcccgagcggactgttcgaccagcgttcggcgcagcgcacctccgacggcctgatccggcagctgaggatcgcgacgcccagcgcgcgccagaccgtcggcctgctctcgggcggcaaccagcagaaggtcgtgatcggcaagtggctggccgccggctcgaagctcttcatcttcgacgagccgacgcgaggcatcgacatcggcgccaagtccgagatttttgcgctgatcgaccgcctggtcgcggaaggcgccgccgcactgatgatctcgtccgagcaggtcgagatctgccatgtctgcgaccgcgcctatgtgatgcgcgagggccgcatcgcgggacacctgacgcgcaacgaactgaccgaggagaacatcgtgcgactggggatgcatcatgcgtga

SEQ ID NO: 8767 - protein, 507 aa, Bradyrhizobium japonicum USDA 110
MSDALPIEVTSPTPLLELRGISKEFPGVKALDDVSFAVFPGEVHMLLGENGAGKSSLMKVLCGAYRADAGEFYYKGEKVAIGSAADAQKLGIAVIFQEFSLVPHLDIAQNIFLGREPKGRIPGTIDRSKILADAKRVLGTIGFDIDPSTIVDKLGVAQQQMVEIAKAISQNARILVMDEPTAALSDRETELLFALIARLKADGVSIVYISHRMAEVFALGDRITVLRDGRRIDGVRPADVTPDQLVRMMVGRTVDMTYPRNFADKPGEVLLQVKGLSSSTGISDINIEVRRGEIVGLCGLVGSGRSEVARAIFGADPVSSGEIIFDGKTISGEPDLAARRGIALIPESRKSEGLALLRSVSDNLVVSALRKLFPSGLFDQRSAQRTSDGLIRQLRIATPSARQTVGLLSGGNQQKVVIGKWLAAGSKLFIFDEPTRGIDIGAKSEIFALIDRLVAEGAAALMISSEQVEICHVCDRAYVMREGRIAGHLTRNELTEENIVRLGMHHA

SEQ ID NO: 8768 - DNA, 1563 bp, Burkholderia vietnamiensis G4
  CDS (1)..(1563): transl_table=11
atgacgatgcagacgatcacggccgtgcccggcaacggcgccgcggccacgcccggcgccgcgacgccgctcgccggcggcgcgctgctcgcgctcgacggcatcacggtgacgttcccgggcgtgcgcgcgctcgacggcgtgtcgctggcggtgcgcgcgggcgaggtgcacgggctgatgggcgagaacggcgccggcaagtcgacgctgctgaaggtgctgtccggcgtgaaccagccgcaggccggcacgttgacgctgaacggcaccgagcagcgcttcgcgtcgacgcgcgcggcgctcgaggccggcatcgcgatcatctatcaggaactgcacctggtgccggagctgacggtcgcggaaaacctgatgctcggccaactgccgagccggctcggcgtggtcgacgaacgcgcgctcgccgtgcgcgcgctcgacgcgctggagcggctcggcgagcacatcgatcccgacatcccggtgaagtacctgtcgatcggccagcgccagatgatcgagatcggcaaggcgctgatgcgcgacgcgcgcgtgatcgcattcgacgaaccgaccagctcgctgtcggcgcgcgagacgacgcagctgttccgcatcatccgctcgctgcgcgaacagggccgcgcgatcatctacgtgacgcaccggatggaggaggtcgacgcgctgtgcgatcgcgtgacggtgttccgcgacggccggcggatcgagacgttcgagtcggtcgccgatctcgaccgcgaccggctgatcggctgcatggtcggccgctcgatcgaggacgtctacggctaccggccgcgcgcggccggcgacgtgatgatcgaggcgaaggccttgaccggccccggcctgtccgagccggtgtcgttcgccgcgcggcgcggcgagatcgtcggcttcttcgggctggtcggcgcaggccgctcggagctgatgaagctgctgtacggcgccgtgcgtccgaccggcgggcacgtcgagctgggcggcgcgcgcgtcgcgttcaggagcccgcgcgacgcggtgcgcgccggtatcgcgctgtgtccggaggaccgcaagcacgagggcatcgtcgcgatcgcgtcggtggccgacaacctgaacatcagcgcgcgccgccacttcagcccggcgcgcatgctgctcgacgggcggcgcgagcgcgagctcgcgcagaagtacatcgagcggctcgcgatcaagacgcgcgacggcgacacgccgatcggcgcgctgtcgggcggcaaccagcagaaggtcgtgctcgcgcgctggctggccgagcgcatcgacgtgttcctgatggacgagccgacgcgcggcatcgacgtcggcgcgcgcgccgaaatctacaacctgttttacgaactcgcggaagcgggccgcaccgtgatcatcgtgtcgagcgatctcgccgaagtgatcggcgtggcggaccgcatcatcgtgatgaaggaagggcgcatcgcgggcgaggtcgcgaaggcgcaggcgacgcccgacacgctgatcaagctcgcgctgccgcgctag

SEQ ID NO: 8769 - protein, 520 aa, Burkholderia vietnamiensis G4
MTMQTITAVPGNGAAATPGAATPLAGGALLALDGITVTFPGVRALDGVSLAVRAGEVHGLMGENGAGKSTLLKVLSGVNQPQAGTLTLNGTEQRFASTRAALEAGIAIIYQELHLVPELTVAENLMLGQLPSRLGVVDERALAVRALDALERLGEHIDPDIPVKYLSIGQRQMIEIGKALMRDARVIAFDEPTSSLSARETTQLFRIIRSLREQGRAIIYVTHRMEEVDALCDRVTVFRDGRRIETFESVADLDRDRLIGCMVGRSIEDVYGYRPRAAGDVMIEAKALTGPGLSEPVSFAARRGEIVGFFGLVGAGRSELMKLLYGAVRPTGGHVELGGARVAFRSPRDAVRAGIALCPEDRKHEGIVAIASVADNLNISARRHFSPARMLLDGRRERELAQKYIERLAIKTRDGDTPIGALSGGNQQKVVLARWLAERIDVFLMDEPTRGIDVGARAEIYNLFYELAEAGRTVIIVSSDLAEVIGVADRIIVMKEGRIAGEVAKAQATPDTLIKLALPR

SEQ ID NO: 8770 - DNA, 1512 bp, Burkholderia vietnamiensis G4
  CDS (1)..(1512): transl_table=11
gtgtcagcggcactgcgttttgacaatatcggcaaggtatttcccggcgtgcgcgcactcgacggcatctcgttcgacgtgcatgcgggcgaggtgcatggcctgatgggcgagaacggcgcgggcaagtcgacgctgctgaagattctcggcggcgaataccagcccgatgcgggcagcgtgctggtggacggccagccggtgcatttttcgagtgcggccgcgtcgatcgcggccggcatcgcggtgattcaccaggaactgcagtacgtgcccgacctgacggtcgcggagaacctgctgctcggccggctgccgaacgcgctcggctgggtgaagaagggcgacgcgaagcgccacgtgcgcgagcggctcgccgcgatgggcgtcgatctcgatcccgacgcgaagctcgggcggctgtcgatcgcgcagcgccagatggtcgagatctgcaaggcgctgatgcgcaacgcgcgcgtgatcgcgctcgacgaaccgaccagctcgctgtcgcatcgcgagacggaagtgctgttcaagctcgtcgacgatctgcgcgcgcagggccgcgcgctgatctacatctcgcaccggatggacgagatctaccggctgtgcgacgcatgcacgatcttccgcgacggccgcaagatcgcgtcgcaccaggcgcttgccgacgtgccgcgcgagcggctggtcgccgagatggtcgggcgcgagatcgcggacatctaccactacgcgccgcgcgcgctcggcgacgtgcggttttcggccgaaggcgtcgatggcccggcgctgcgtgagccggcgagcttctcggtgcgcgcgggcgagatcgtcggcttcttcgggctggtgggcgcgggacgcagcgagctgatgcggctcgtgtacggcgcggaccgccggcgcgcgggcgtgctgacgctcgacggccggcgcatcgacgtgaagcgcaccggcgacgcgatccgtcacggcatcgtgctgtgtccggaggaccgcaaggaggaagggatcatcgcgatggcgtcggtcgcggagaacatcaacatcagctgccgccgccattcgctgcgcgcggggctgttcatcgaccgcaagaccgaaatcgaaacggccgaccgcttcatccagcggctgaagatcaagacgccgaaccgccggcagaagatccgcttcctgtcgggcggcaatcagcagaaggcgatcctgtcgcgctggctcgcggagcccgacctgaaggtcgtgatcctcgacgagccgacgcgcggcatcgacgtgggcgcgaagcacgagatctacgacgtgatctaccggcttgccgagcgcggctgcgcgatcgtgatggtgtcgtcggagctgcccgaagtgctgggcgtgtccgatcgcatcgtcgtgatgcgcgaagggcgcatcgcgggcgagctgccgcgcgagcgcgcgaacgagcatgcggtgctgagcctcgctctgccgcagacgagcgccgcgcaggcggcctga

SEQ ID NO: 8771 - protein, 503 aa, Burkholderia vietnamiensis G4
MSAALRFDNIGKVFPGVRALDGISFDVHAGEVHGLMGENGAGKSTLLKILGGEYQPDAGSVLVDGQPVHFSSAAASIAAGIAVIHQELQYVPDLTVAENLLLGRLPNALGWVKKGDAKRHVRERLAAMGVDLDPDAKLGRLSIAQRQMVEICKALMRNARVIALDEPTSSLSHRETEVLFKLVDDLRAQGRALIYISHRMDEIYRLCDACTIFRDGRKIASHQALADVPRERLVAEMVGREIADIYHYAPRALGDVRFSAEGVDGPALREPASFSVRAGEIVGFFGLVGAGRSELMRLVYGADRRRAGVLTLDGRRIDVKRTGDAIRHGIVLCPEDRKEEGIIAMASVAENINISCRRHSLRAGLFIDRKTEIETADRFIQRLKIKTPNRRQKIRFLSGGNQQKAILSRWLAEPDLKVVILDEPTRGIDVGAKHEIYDVIYRLAERGCAIVMVSSELPEVLGVSDRIVVMREGRIAGELPRERANEHAVLSLALPQTSAAQAA

SEQ ID NO: 8772 - DNA, 1554 bp, Burkholderia vietnamiensis G4
  CDS (1)..(1554): transl_table=11
atgtcgcgatctgagtcgccgcggccgctgctcgaaatgcgcggaatcagcaagacgttcccggccgtgcgcgcgctcgacaacgtcagcctgaccgtctatccgggcgagatccactcgctgatgggcgagaacggcgcgggcaagtcgacgctgatgaaaatcctctcgggcgcgtatcgtgccgacgccggcggcgaaatcctgatcgacggccagcgcatcgacgtcgacggcccgctcgccgcgcgcgatgccggcgtcgcggtgatctatcaggagctgtgcctcgcgccgaacctcaccgtcgcggagaacatctacgtcgggcgcgagctgcgctgcggcaaccggcgctggggcaccatcgaccgcgcggcgatggcgcgcggctgccaggacgtgctggcgcgcctcggcgcgccgttcgggccggacacgctggtcggcacgctgtcgatcgccgagcagcagctcgtcgagatcgcgcgcgccgtgcatacccgcgcacgcattctggtgatggacgaaccgacgacgccgctgtcgtcgcgcgaaacggaacatctgttcggcctgatccgccagctgcgcgaggaaggcctcgcgatcatctacatcagccaccgaatggccgagatctacgagctgtccgaccgcgtgtcggtgctgcgtgacggcacctacgtcggtacgctcgagcgcgcggcgctgtcggccgaccgcctcgtcgcgatgatggtgggccgcgacatctccggcttctacaagaaggaacacgcgccgtacgaccccggccacctgctgctgtcggtgcgcgacatcgccgacgacgagcgcgtgcgcggctgcagcctcgacctgcacgcgggcgaagtgctcggcatcgccgggctggtcggcgcgggccgcaccgaactcgcgcggctgatcttcggcgcggagccgcgcacgcgcggcgacgtgaagctcggcgagcgcacgttcggcgcacattcgccgcgcgatgcgatcgacgccggcctcgtctatctgaccgaagaccgcaagcgccagggcctgttcctcgacatgagcgtgcgcgacaacatcaacatctcggtgtgcaaccgcgacgcgcggctcggcacgctcgatctcgcgcgcggcgccgagcgcgcgcgcgacgcgatcgcgtcgctgtcgatccgcgtgccgcacgcgaacgtgaacgtcggcgcgctgtcgggcggcaatcagcagaaggtactgctgtcgcggctgctcgagaccaagccgcgcgtgctgatcctcgacgaaccgacgcgcggcgtcgacatcggcgccaagtccgagatctaccggatcatcaacgaactggcccgcgcgggcgtcggcgtgatcgtgatctcgagcgagctgccggagatcatcggcgtcgccgaccgcgtgctcgtgatgcgcgaaggcgaaatcgccggcgaactcggcggccacacgcacacgccgatcacgcaggaagcgatcatcgcgctcgcgaccggctcgcaggccgaactcgccgacgcgcactga

SEQ ID NO: 8773 - protein, 517 aa, Burkholderia vietnamiensis G4
MSRSESPRPLLEMRGISKTFPAVRALDNVSLTVYPGEIHSLMGENGAGKSTLMKILSGAYRADAGGEILIDGQRIDVDGPLAARDAGVAVIYQELCLAPNLTVAENIYVGRELRCGNRRWGTIDRAAMARGCQDVLARLGAPFGPDTLVGTLSIAEQQLVEIARAVHTRARILVMDEPTTPLSSRETEHLFGLIRQLREEGLAIIYISHRMAEIYELSDRVSVLRDGTYVGTLERAALSADRLVAMMVGRDISGFYKKEHAPYDPGHLLLSVRDIADDERVRGCSLDLHAGEVLGIAGLVGAGRTELARLIFGAEPRTRGDVKLGERTFGAHSPRDAIDAGLVYLTEDRKRQGLFLDMSVRDNINISVCNRDARLGTLDLARGAERARDAIASLSIRVPHANVNVGALSGGNQQKVLLSRLLETKPRVLILDEPTRGVDIGAKSEIYRIINELARAGVGVIVISSELPEIIGVADRVLVMREGEIAGELGGHTHTPITQEAIIALATGSQAELADAH

SEQ ID NO: 8774 - DNA, 1536 bp, Bradyrhizobium sp. ORS278
  CDS (1)..(1536): transl_table=11
ttgggaggcacgatgaaaggtccgatcctcgagatgcgcggggtgtcgaagtcattcttcgccatcaaggccctgcagaaggtcgacctgaccgtctatgccggcgaagttcatgcgctgatgggcgaaaacggcgccggcaaatccaccttgatgaaaatcctctccggcgcctaccgccccgatcccggcggcgagatccgcatcgatggcgaggtcgtgcgtatcgaggggccgatgggcggccgcaatgccggcatcgcgatcatctaccaggagttgtcgctggcgccgaacctgacggtcgccgagaacatctatctcggacgcgagctgtcgcaatccggcctgctcgcgcgcaatgccatgcgcgacgccgttggaccgatcctgcagcggctcggcgccgacttctcggccgcgacgctggttgccgaattgtcgatgggacagcgtcagctggtcgagatcgcccgcgcgctgcatgcgcgctcgaagatcctgatcatggacgagccgaccacctcgctatcagccggcgagagcgagaagctgtttgccttgatccgccagctgcgctcggaaggccttgccatcatctacatctcgcaccgcatggacgaggtctacgcgctcggcgatcgcgtcactgtgctgcgcgacggccggctggtgggctcgctcgacaagccggagatccgcgccgacagcatcgtgcgcatgatggtcgggcgtgacgtgtcgtcgttctacaagaaggaccacgacccgcacgccaagcgcgaccgcgcggtgctcacggcggtcgatctcggcgacggccatcgcgtcaagggatgctcgctcacggtgcatgccggcgaagtcgtcggtctcgccggattgatcggcgccgggcgcaccgagctcgcgcatctcatcatcggcgcgacgcccaggacgacagggcatctggagctcgacggcgagcgtatcgagatcgagacgccgcgcgacgcgctcgacgccggcatcgcctatctcaccgaggaccgcaaggcgctcggcctgttcctcgacatgtcctgtgccgacaacatcaacctcgcggtgatcggccgcgacgccaggctcggcggcctcctcgaccgcgacaaggcgcgcgagcgggccgacgaggcgttcagcgcgctcggcatccgggcgcccaatcccggcgtcaccgtcggcggcctgtcgggcggcaatcagcagaaggtgctgctgtcgcgcctgctcgcgaccgcgccgaaggtcctgatcctagacgagccgacgcgcggcgtcgatgtcggcgccaagtcggagatctattcgatcatcgacaatctcgccaaggccggcaccgcgatcctggtgatctcgtccgacctgccggagattctcggcatctgcgaccgcgtgcttgtcatgcgcgaaggccatctcgccggcgagttgcagcagagcacggcatcacccatcacccaggaagacatcatggcgctggccaccgggacggagcacgtcgatgcctga

SEQ ID NO: 8775 - protein, 511 aa, Bradyrhizobium sp. ORS278
MGGTMKGPILEMRGVSKSFFAIKALQKVDLTVYAGEVHALMGENGAGKSTLMKILSGAYRPDPGGEIRIDGEVVRIEGPMGGRNAGIAIIYQELSLAPNLTVAENIYLGRELSQSGLLARNAMRDAVGPILQRLGADFSAATLVAELSMGQRQLVEIARALHARSKILIMDEPTTSLSAGESEKLFALIRQLRSEGLAIIYISHRMDEVYALGDRVTVLRDGRLVGSLDKPEIRADSIVRMMVGRDVSSFYKKDHDPHAKRDRAVLTAVDLGDGHRVKGCSLTVHAGEVVGLAGLIGAGRTELAHLIIGATPRTTGHLELDGERIEIETPRDALDAGIAYLTEDRKALGLFLDMSCADNINLAVIGRDARLGGLLDRDKARERADEAFSALGIRAPNPGVTVGGLSGGNQQKVLLSRLLATAPKVLILDEPTRGVDVGAKSEIYSIIDNLAKAGTAILVISSDLPEILGICDRVLVMREGHLAGELQQSTASPITQEDIMALATGTEHVDA

SEQ ID NO: 8776 - DNA, 1485 bp, Klebsiella pneumoniae subsp. pneumoniae MGH 78578
  CDS (1)..(1485): transl_table=11
atgaacgcttttgcccttgaagccgaaggtatcagtaagttcttccccggcgtgaaggcgctcgataatgtctcattgcgcgtgcgtccgggaacggtgcatgccctgatgggcgagaacggcgccggtaaatccacgctgatgaaatgcctgatcggtatctatcgccccgataaagggtcgattcgcgtgaaaggggagccggtggagtttaccgacaccatggatgcgctgcgctcggggatctcgatgatccaccaggagctcaatctggtgccgcatatgacggtggcggagaatatctggctggggcgcgagccgatgaaatacggctttgtcgaccacggccagctgacccgccagacccaggcgctgctggataagctcaatatccgcttaaccgctgaccggctggtgggcgacctgagcatcgccgcccagcagatggtggagattgccaaagcggtttcatggaacgcggatatcgtgatcatggatgagcccacctcggcgctgaccgaaggcgaggtggctcacctgttcaccatcatccgcgacctgcgcgcccagggtaaagcgatcatctatatcagccacaaaatggatgagatctttgccatcaccgatgagatcagcgtctttcgcgacggcacctgggtggggagcaaaaacaccaccgaatttacccggcagtcgctgatcacccagatggtgggccgcgaattaacccagctgtttccgaaatttaataacaccatcggcgaagaggtgctgacggtgcgcaacctgacgcgtcagggcgtgttccatgacgtcagctttagcgtacgccgtggcgaaatcctgggcgtggccgggctggtgggcgccgggcgcagcgaggtgatggaaagcctgttcggtatggagcgcttcgacagcggcgaagtgctgatcgacggggcgccggtgaccatcgattccccctccgtggcgattgaaaaggggatggcattattaaccgaagaccggaaaaagtcgggcctgtttctggtgctgtcggtgctggaaaatatgagtatcgtcaaaatgccggaatatatcggcaagagcggttttgtccagcacgtgaaaatggccgaagactgcatggagcaaatacgccggctcaatattaaaacgccgacgatggatcaaattattaataacctcagcggggggaatcagcaaaaagtcctgattgcgcgctggctgttagcgcaaccgaaaatcttaattctcgatgagccgacccgcggtatcgacgtcggggcgaaggcggagatttatcatcttatcagtgaactggcgaatcggggggtggcggtgattatggtctcctctgaactgccggaaatccttggcatgagcgatcgggtcatggtgatgcatgaaggtcgtatcaccggcatcctggaaaaagacgaagccgaccaggaaaccattttgtcgttggcatcccattga

SEQ ID NO: 8777 - protein, 494 aa, Klebsiella pneumoniae subsp. pneumoniae MGH 78578
MNAFALEAEGISKFFPGVKALDNVSLRVRPGTVHALMGENGAGKSTLMKCLIGIYRPDKGSIRVKGEPVEFTDTMDALRSGISMIHQELNLVPHMTVAENIWLGREPMKYGFVDHGQLTRQTQALLDKLNIRLTADRLVGDLSIAAQQMVEIAKAVSWNADIVIMDEPTSALTEGEVAHLFTIIRDLRAQGKAIIYISHKMDEIFAITDEISVFRDGTWVGSKNTTEFTRQSLITQMVGRELTQLFPKFNNTIGEEVLTVRNLTRQGVFHDVSFSVRRGEILGVAGLVGAGRSEVMESLFGMERFDSGEVLIDGAPVTIDSPSVAIEKGMALLTEDRKKSGLFLVLSVLENMSIVKMPEYIGKSGFVQHVKMAEDCMEQIRRLNIKTPTMDQIINNLSGGNQQKVLIARWLLAQPKILILDEPTRGIDVGAKAEIYHLISELANRGVAVIMVSSELPEILGMSDRVMVMHEGRITGILEKDEADQETILSLASH

SEQ ID NO: 8778 - DNA, 1515 bp, Klebsiella pneumoniae subsp. pneumoniae MGH 78578
  CDS (1)..(1515): transl_table=11
atgcaacagtctaccccttatctctcatttcgcggcatcaccatgacgttccctggcgtaaaggccttgtccgatatcagttttgactgctacccaggacagatccacgcgctgatgggcgaaaatggcgcaggcaaatcgacgctgttgaaaattctcagcggcaactatatcccgaccgcgggccatctgcagatcggcggccagcagatggcattcgccaataccatggaggcgctgaatgccggcgtggcaatcatctaccaggagctgcatctgatcccggagatgaccgtcgccgaaaatatctatctcggtcagctgccgcacagaggcggcatcgtcaatcgctcgctgctcaactatgaggcccgcctgcagctggagcatctgggtctggatatcgacccggagacgccgctgaaatatctctccattggtcaatggcagatggtggagattgccaaagcgctggcgcgtaacgccaagattatcgcgttcgatgagccgaccagctcgctctccgccagagagatcgacaacctgtttcgcgtcatccgcgagttgcgggaggagggaagggtcatcatctatgtttcacaccggatggaagagatttttgccctcagcgatgccatcaccgtctttaaagatggccgctacgtttgcacctttgacgatatgccgagcgtcagccacgacgccctggtccaggcaatggtaggccgcaatctgggcgatatttatggctggaagcctcgcccctatggcgaggagcggctgcgcctggaggaggtcaaagcgccgggcgtgcgcacgccggttagtctctcggtgcgcagcggtgaaattgtcggtttgttcggactggtgggtgccgggcgcagcgaactaatgaaaggcctgtttggcggcacgcagataaccggcggtcaggtgtatatcgatggccagcccgtctccattcgcaaaccggcccaggccatccaggccgggatgatgctgtgcccggaggatcgtaaagcggaggggattattccggtgcattccgtgcgcgataacatcaatatcagcgcccggcgcaagcatattcacgctggctgcctgatcaacaacgcctgggaggcggacaacgccgatcaacatatccagtcgctgaatattaaaacgccgggcccggaacagctgattatgaacctgtcgggcggcaaccagcagaaagcgatccttggccgctggctgtcggaagagatgaaggtgatcctgcttgatgagccaacccgcggcatcgacgtcggcgccaaacatgaaatttacaatgtgatctatggcctcgccgcctccggtgtcgccgtggtgtttgcctccagcgacctgccggaagtgctgggcgtcgctgaccgcatcgtggtgatgcgcgaaggacaaatcgctggcgaactgctgcatgaagaagccaatgaacagcaggcgttaagccttgcgatgccaacagtgagccaggctgtcgcctga

SEQ ID NO: 8779 - protein, 504 aa, Klebsiella pneumoniae subsp. pneumoniae MGH 78578
MQQSTPYLSFRGITMTFPGVKALSDISFDCYPGQIHALMGENGAGKSTLLKILSGNYIPTAGHLQIGGQQMAFANTMEALNAGVAIIYQELHLIPEMTVAENIYLGQLPHRGGIVNRSLLNYEARLQLEHLGLDIDPETPLKYLSIGQWQMVEIAKALARNAKIIAFDEPTSSLSAREIDNLFRVIRELREEGRVIIYVSHRMEEIFALSDAITVFKDGRYVCTFDDMPSVSHDALVQAMVGRNLGDIYGWKPRPYGEERLRLEEVKAPGVRTPVSLSVRSGEIVGLFGLVGAGRSELMKGLFGGTQITGGQVYIDGQPVSIRKPAQAIQAGMMLCPEDRKAEGIIPVHSVRDNINISARRKHIHAGCLINNAWEADNADQHIQSLNIKTPGPEQLIMNLSGGNQQKAILGRWLSEEMKVILLDEPTRGIDVGAKHEIYNVIYGLAASGVAVVFASSDLPEVLGVADRIVVMREGQIAGELLHEEANEQQALSLAMPTVSQAVA

SEQ ID NO: 8780 - DNA, 1536 bp, Symbiobacterium thermophilum IAM 14863
  CDS (1)..(1536): transl_table=11
atggaaccgctcgttcggatggatcacatcaccaagacgtttccgggggtcagggccctcagcgacatcaccttcgacatccgtcccggcgaggtgcacgtgctgctgggggaaaacggcgccggcaagtcgacgctcatgaagatcctgagcggcgcttacgaacccaccagcgggaccatcaccgtcgatggccgcgcgtacccgcggctcaccccggcgctctcggccaagctgggcatcagcatcatctatcaggaactgagcgtgatcaacgagctcagcatcgaggagaacatcttcgtcggccgcctgccggtgcggaaggtgatgggcgtcccggtcgtcgactacgcgttcatgcggcagcggacccaggagctgctggacatcctggacctgcgccggtcgccggagacgctcgtcggggatctgagcatctcggagaagcagatggtggagatcgccaaggctgtggcgttcaacgccagggtcatcatcatggacgagccgacctcgtcgctgaccgacgccgaggtggagaagctctttgcgatcatccgccggctgaagggcgagggaaagggcatcgtctacatctcccacaagctgaaggagatcctcgccatcggcgaccggatcaccgtcctgaaggacgggacctacgtggggacgcgggacgtgcaggacgtcaccatggacggcctggtgacgatgatggtgggccgggagctgaaggacaagtaccaggccaacaccgacgtccaccggaccggaaaggtcatcttcgaggtccggaacctgacccgccgggacgggcgcgtgcaggacgtctccttcgccctccgggagggcgaggtgctgggattcgcagggctggtcggcgccggacggagtgagaccatgtgcgccatctacggcaccgaccccatccgctcgggcgagatctggctgcacggcgaacgaatggagatccgctcgccctacgacgccttgaagaaaggcatcggtctggtcaccgaaaaccgccgcgagacgggcttcttcccgaatttcagcatccggcggaacgtggccatcgcccggcagctgaagctcgcccgctggggcggcctgtgggggctcgtgaacgagcgggacgagcagaagacggccgagaaggcgcgggccgacatgcagatcaagtgcgcctcgctggagcagaacatcaccgagctctcgggcggcaaccagcagaaggtgatcctcggcaagtggctggcggcgggcgtgaaagtcttgatcttcgacgagcccacccggggcattgacgtgggcaccaaggcggagatctacaagctgatgcggtcgctggccgaaagcggcatcggggtcatcgtcgtctcgtcggagctgccggaactcttgtcggtgtgcgaccgcattatcgtcatgagcgagggccggatcagcgcggagttcacggccgcggaagcgaccgaggaaaagattgtgaaggcggccaccgtcggcgccggagcgagtggagggaactga

SEQ ID NO: 8781 - protein, 511 aa, Symbiobacterium thermophilum IAM 14863
MEPLVRMDHITKTFPGVRALSDITFDIRPGEVHVLLGENGAGKSTLMKILSGAYEPTSGTITVDGRAYPRLTPALSAKLGISIIYQELSVINELSIEENIFVGRLPVRKVMGVPVVDYAFMRQRTQELLDILDLRRSPETLVGDLSISEKQMVEIAKAVAFNARVIIMDEPTSSLTDAEVEKLFAIIRRLKGEGKGIVYISHKLKEILAIGDRITVLKDGTYVGTRDVQDVTMDGLVTMMVGRELKDKYQANTDVHRTGKVIFEVRNLTRRDGRVQDVSFALREGEVLGFAGLVGAGRSETMCAIYGTDPIRSGEIWLHGERMEIRSPYDALKKGIGLVTENRRETGFFPNFSIRRNVAIARQLKLARWGGLWGLVNERDEQKTAEKARADMQIKCASLEQNITELSGGNQQKVILGKWLAAGVKVLIFDEPTRGIDVGTKAEIYKLMRSLAESGIGVIVVSSELPELLSVCDRIIVMSEGRISAEFTAAEATEEKIVKAATVGAGASGGN

SEQ ID NO: 8782 - DNA, 1560 bp, Ralstonia eutropha JMP134
  CDS (1)..(1560): transl_table=11
atgccactgtctgaagccactgccgccgcggcgccgctgctggaaatgcgcaacatttccaagactttcccgggtgtgaaggcactcagcaatgtccagctcacgatcttcccgggcgaagtccacgcgttgatgggcgaaaacggcgcgggcaaatccacgctgatgaagatactctccggcgcctatatcgccgatgagggcgctgagtgccgcatcggcagccggcccgtggtcatcgacggcccgctcgcggcccgcgcgcatggtgtggcggtgatctaccaggagctgagcctggcccccaacctgagtgtggccgagaacatctatctgggacggcacctgcaccgccacggcatggtggaccgcgccgcaatggcgcgcgcctgcgaaggcacgctagccaggcttggtgctgacttcacgccgcagacgctggtcgagcgcctgtcgatcgcccagcgccaactggtggaaatcgcacgcgcggtgcatttcgagactcgcattctggtgatggacgaacccaccacgccactgtccacccgcgaaaccgaccgcctgttcgcgctgatccgccagctgcgggccgacggcatggccatcatctacatcagccaccgcatggccgagatcgacgaactcgcggatcgcgtcaccgtgctgcgcgacggctactacgtcggcacgctggaaaaggcccagctgacccaggcggggctggtcaagatgatggtcggccgcgacctgtcgggcttctacaccaagacgcatggcgagacgcaggtcggcgacatggtgctgtcggtgcgcaatatgtcggacggccgccgcgtgcgcgattgcagcttcgacctgcatgccggagaggtcctgggcctggctggcctcgtcggcgcgggccgcacggaactggcgaggctggtgtttggcgcggatgcgcgcagcagcggcgcggtgttcctcgccggctcgccactggcgatcagccagccgcgccaggccatcgacgcgggcattgcctacctgacggaagaccgcaagctgcagggcctgttcctcgaccagagcgtgcacgagaacatcaacctgatcgttgccgcgcgcgatgcgctgcgcggcggccggctcaaccgtgcctgcgcacgccggcgtacggccgatgccgtcagttcgctgggcatccgcgtggcgcatccgcgcgtcaatgtcggtgcgctgtcgggcggcaaccagcagaaggtgatgctgtcgcgcctgctggaaaccaagccgcgtgtgctgattctggacgagcccacgcgtggcgtggacatcggtgccaaggcggagatctaccgcctgatcgacgccctcgcccgctccggcgtggccgtcctgctgatctccagcgaattgccggaagtggtaggcctctgcgaccgcgtgctggtgatgcgtgaaggccggctggtgggcgaggtgcaagcctgcccggatgccgcagccacgcaggaacgcatcatcgcactcgccaccggcgcggatgagccggcacaggccaccgtactgcactga

SEQ ID NO: 8783 - protein, 519 aa, Ralstonia eutropha JMP134
MPLSEATAAAAPLLEMRNISKTFPGVKALSNVQLTIFPGEVHALMGENGAGKSTLMKILSGAYIADEGAECRIGSRPVVIDGPLAARAHGVAVIYQELSLAPNLSVAENIYLGRHLHRHGMVDRAAMARACEGTLARLGADFTPQTLVERLSIAQRQLVEIARAVHFETRILVMDEPTTPLSTRETDRLFALIRQLRADGMAIIYISHRMAEIDELADRVTVLRDGYYVGTLEKAQLTQAGLVKMMVGRDLSGFYTKTHGETQVGDMVLSVRNMSDGRRVRDCSFDLHAGEVLGLAGLVGAGRTELARLVFGADARSSGAVFLAGSPLAISQPRQAIDAGIAYLTEDRKLQGLFLDQSVHENINLIVAARDALRGGRLNRACARRRTADAVSSLGIRVAHPRVNVGALSGGNQQKVMLSRLLETKPRVLILDEPTRGVDIGAKAEIYRLIDALARSGVAVLLISSELPEVVGLCDRVLVMREGRLVGEVQACPDAAATQERIIALATGADEPAQATVLH

SEQ ID NO: 8784 - DNA, 1509 bp, Ralstonia eutropha JMP134
  CDS (1)..(1509): transl_table=11
atgaacgcgatgacccaggtcagcccactgctcgagatgcgtggcatctgcaaaacttttccaggcgtcaaggcgctggacgacgtctccttcgacatctatcccggcgaggtgcacatgctccttggcgagaacggcgcaggcaagtcgtcgctgatgaaggtgctgtgcggcgtttatgtggccgatgccggcgagttccaccatcagggccagcgcgtcgaggtatcggggccggcggacacgatgcggctcggcatcgccgtgatcttccaggaattctcgctggtgccctacctcgacatcgcgcagaacatttttcttggccgtgagccgcgcggacgggtgccgggctcggtggaccatgcaaagatgcatgccgaagcgcggcgcctgctggacacgctcggcatggacatcagcacgcatacgcccgtgcatcgcctgggcgtggcgcagcagcagatgatcgagattgccaaggcgctgtcgcagaacgcacgcatcctcgtgctggatgagcccacggccgctctctccgagcgcgagaccgaaaagctgttcggcgtcatcgcacgcctcaaggccgacggcgtgtcgatgatctatatctcgcaccgcatggcggaagtcttcgcgctcggtgaccgcatcaccgtcatgcgagacggccgcaaggtcggcagctacatgcccggcgatgccacgcctgatgaactggtggcgcgcatggtcggccgcaaggtggacatgggctacacccgcacacgcggcggcccggtcggcgaggtggcgctcgacatgcaaggcgtcagcgctgacaacggcattgacgacatcacgctgcaggtgcgtgccggtgagatcgtcgggctggccgggctcgtcggctcagggcgcagcgaggtcgcgcgggctgtgtttggcgcggacccggtgcgcgcgggcgaaatccgcattttcggcaagtccatgcgcggcggtcccgacaaggcacgcgcgctcggcgcggcgctgatccccgaaagtcgcaagaccgaagggctcgcgctgatccgctcggtgcgcgacaacctgctcctggccggcctgcgccgcgcctttcccgcacactggtatcgcagcggcaaggcggcgcagctgtccacgcgcgagattggacggctgcgcattgccacgccgagcggcgaccagctcgcgcagttcctgtcgggcggtaaccagcagaagatcgtgatcggcaagtggctggtcgccgaatcgcgcctgttcattttcgacgagcctacgcgcggcatcgacgttggcgccaaggccgaaatcttcgcgctgatcgacgggctggtgaagcaaggcgccgccgtgctgctgatcagttccgagctgccagagatcatcaacgtatgcgaccgcacctatgtcatgcgcggcggccgcgtcgccggcgagcttgcgcatgacgccatgaccgaggaaagcattctgcaactggggatgaacgatgcctga

SEQ ID NO: 8785 - protein, 502 aa, Ralstonia eutropha JMP134
MNAMTQVSPLLEMRGICKTFPGVKALDDVSFDIYPGEVHMLLGENGAGKSSLMKVLCGVYVADAGEFHHQGQRVEVSGPADTMRLGIAVIFQEFSLVPYLDIAQNIFLGREPRGRVPGSVDHAKMHAEARRLLDTLGMDISTHTPVHRLGVAQQQMIEIAKALSQNARILVLDEPTAALSERETEKLFGVIARLKADGVSMIYISHRMAEVFALGDRITVMRDGRKVGSYMPGDATPDELVARMVGRKVDMGYTRTRGGPVGEVALDMQGVSADNGIDDITLQVRAGEIVGLAGLVGSGRSEVARAVFGADPVRAGEIRIFGKSMRGGPDKARALGAALIPESRKTEGLALIRSVRDNLLLAGLRRAFPAHWYRSGKAAQLSTREIGRLRIATPSGDQLAQFLSGGNQQKIVIGKWLVAESRLFIFDEPTRGIDVGAKAEIFALIDGLVKQGAAVLLISSELPEIINVCDRTYVMRGGRVAGELAHDAMTEESILQLGMNDA

SEQ ID NO: 8786 - DNA, 1554 bp, Acidobacteria bacterium Ellin345
  CDS (1)..(1554): transl_table=11
atgccagaacctctgttgcgcatggtcgacgtgtctaaagacttctccggcgtacacgcgctggacggagtcagcttcgacctgctcggaggcgagattcacgctctcgtaggtgagaacggcgccggcaaatctacgctcatgaaagttctgagcggtgtctattctcacagggaatattccggaagtgttgtgatcgagggcgctcagcagcagtttgacggaattcgcgctgccgagcgcgccggaatcgcgatcgtattccaggaattgtctttggttcctgagctttccattgctgagaatattttcctcggacggctgcaggcttccggtccgtttgtgcgctggagcgatgttcacaaaacagcgcgggttctgctcgattcgcttggcgtcgacctgccgacagaaaggctcgtccgtgatctcggtattggccaacagcaactggttgagatagcgaaggctctttcgcacaatgcgagaattctcattctcgatgagcccacggctgctctaaacgaagccgaatcgcagacactcttcgacattctgggtgcgctccgggggcggggcctcggacttatatatatttcgcaccgcctcgatgaggttctcgcgctcgcggaccggatcacaatcctgcgagatggacgtacgatcgcaactaaactccgcggggacgtcaatcgtcagcagatgatttctctcatggtgggccgcgacatccagcaggtcttccctgagccgcagcgtgcggcaggtaaagttgctttagaactccgggacctaaccgttaagcatccgacattgccaaaccgcaatgtgctaacaaacgtttcgcttcaggtgcgtgctggcgaagtggtcggccttgcggggttgatgggatcgggtcgcacagcgctgctcaatgtactgttcggatcctttccagagcacggtactgggtcgatcctcgtcgaaggcgaggacgtggcgcttacccaacctgcagacgcgatcgcccacaacattgcctttgtgacggaagatcgcaaacgactcggtttgtcgcttgatcattccgtccagagcaatatgagcctcgtcgccttgaagggtttcgcgaaagcatccgtcttggaccaagttagcgaagttgctcgcgttgagcagacaatgaaggacctgcgcgtaaaggcgaactcaccagagacggtcgtaggcacgctgtcgggtggcaaccagcaaaaggtcgtactcggcaagtggttgatgaagaatccaaaaatcctcctgctcgacgaacccacccgcggcatcgacgttggcgccaaacaggagatctactcccgaatcgacgaacttgcgcatcgaggccttgctctactcgtggtttcatcggagttagaagagttgcgcggaatttgtgaccgaattcttgtacttcacgaaggacgtgtcaggggcgaactgaagcgcgccgaggcaactcctgaaaagatcatgagccttgctactggaatcaaagaaatcaattcgtcgtcgcacggcaggagcgacgcatga

SEQ ID NO: 8787 - protein, 517 aa, Acidobacteria bacterium Ellin345
MPEPLLRMVDVSKDFSGVHALDGVSFDLLGGEIHALVGENGAGKSTLMKVLSGVYSHREYSGSVVIEGAQQQFDGIRAAERAGIAIVFQELSLVPELSIAENIFLGRLQASGPFVRWSDVHKTARVLLDSLGVDLPTERLVRDLGIGQQQLVEIAKALSHNARILILDEPTAALNEAESQTLFDILGALRGRGLGLIYISHRLDEVLALADRITILRDGRTIATKLRGDVNRQQMISLMVGRDIQQVFPEPQRAAGKVALELRDLTVKHPTLPNRNVLTNVSLQVRAGEVVGLAGLMGSGRTALLNVLFGSFPEHGTGSILVEGEDVALTQPADAIAHNIAFVTEDRKRLGLSLDHSVQSNMSLVALKGFAKASVLDQVSEVARVEQTMKDLRVKANSPETVVGTLSGGNQQKVVLGKWLMKNPKILLLDEPTRGIDVGAKQEIYSRIDELAHRGLALLVVSSELEELRGICDRILVLHEGRVRGELKRAEATPEKIMSLATGIKEINSSSHGRSDA

SEQ ID NO: 8788 - DNA, 1557 bp, Nostoc punctiforme PCC 73102
  CDS (1)..(1557): transl_table=11
atggcaacaagtatagaaacctcatttcctgatgcaccaagcaccacccctgtattagaaatgcaagggattaccaaacgatttcatggtgtatctgcgctccaaaatgttaatctcacgatttatccgggagaagttcatgccctgatgggtgaaaacggggcaggcaaaagcacattgatgaaaatcttggctggagcttacattgctgatgaaggagaaattcgcatcaatggtcaacccttgaaaattaccgatccggcgacagcacgcaaggcgggtattaatcttatttatcaagaactgaatgttgcacctaatttaaccgttaccgaaaatatgtttatgggtagcgagttgcgtcggggtcagtttttagaccgcaaagccatgcaacttgaagcagagcaagtgttagatagcttgggagccaattttacagcgcagactatagttgggactttatccatcgcagaacagcagcaagtcgaaattgccagagcgctgaaagataaaagccgggttttggtgatggatgagccaacagcagcattatctgaccgcgagagcgaccatttattcgaagtaattcgcaaactacggagtgatggcattgcgattatttacatcagtcatcgtatggaagaaatctatgctttagctgaccggattagcgtactgcgcgatggtcaatatattggtagtcttacacgcagcgaaatttctccacagcgattggtgcagatgatggttggtcgctccatgcaagacttttacgaacatcaacggcaaatgaatcctggccctgtggtgctggaagtcagaaacatgagtgatgctcgcaaaaagattgagcctgctagctttgaacttcatgcaggggaaattctcggtttagcggggttagttggtgcaggacgcacagaattatcccggctaatttttggtgctgaccgtaaagctagtggcgaagtatttttaaatggcaaaaaactagaaattaatacgcccagtgatgcgatcgctgccggaattggctatgtcccggaagaccgcaaagaccaaggtttatttctagagatgagcgcccgcaagaatattgctatcaacacactcaagcaggatgctaaaggtggaattgttaactggccttcagtgaatcggctgtcaacagaagcggtggaaaactttaatatccgcctggccaatttggaaattagagcattggatctttctggtgggaatcaacagaagctactgctagcgcgttggttagccattaaacctagagtactgatgttagatgagccgacacgcggcgtagatattggtgccaaaagcgaaatttaccgaattatgagtgaattggcagcacaaggtgttgctattttaatggtttccagcgaactatcagagattgtcggtatgagcgatcgcgtcttagtgatgcgagaaggacaactggtaggcgaactagacggcagccttggcaaagaaatcaaacaagaaaagattatgcactacgcaactggagcatcggaggtatcagcattatga

SEQ ID NO: 8789 - protein, 518 aa, Nostoc punctiforme PCC 73102
MATSIETSFPDAPSTTPVLEMQGITKRFHGVSALQNVNLTIYPGEVHALMGENGAGKSTLMKILAGAYIADEGEIRINGQPLKITDPATARKAGINLIYQELNVAPNLTVTENMFMGSELRRGQFLDRKAMQLEAEQVLDSLGANFTAQTIVGTLSIAEQQQVEIARALKDKSRVLVMDEPTAALSDRESDHLFEVIRKLRSDGIAIIYISHRMEEIYALADRISVLRDGQYIGSLTRSEISPQRLVQMMVGRSMQDFYEHQRQMNPGPVVLEVRNMSDARKKIEPASFELHAGEILGLAGLVGAGRTELSRLIFGADRKASGEVFLNGKKLEINTPSDAIAAGIGYVPEDRKDQGLFLEMSARKNIAINTLKQDAKGGIVNWPSVNRLSTEAVENFNIRLANLEIRALDLSGGNQQKLLLARWLAIKPRVLMLDEPTRGVDIGAKSEIYRIMSELAAQGVAILMVSSELSEIVGMSDRVLVMREGQLVGELDGSLGKEIKQEKIMHYATGASEVSAL

SEQ ID NO: 8790 - DNA, 1509 bp, Haemophilus somnus 2336
  CDS (1)..(1509): transl_table=11
atggagcaggctgtcaatatttccgtaacaccgttgttggaaatgcgtcatatcgccaaacgtttcggcgatttttatgcattgcaagatgttgatttagatgtatatcgtggtgaaattcatgcgttaatgggtgaaaatggtgccggtaaaagtacattaatgaaaattttggcaggtgcgtatattgctacttccggtgaaatcaacattgacggcaaactctttccgatttcttcgccgaaagatgccattcttgcgggaattactttaatttatcaagaaattcatctttcaccgaatttgacagttgcagaaaatatttttttaggtcgtgaaatcggtacggtatttggcttgaatcgcaagaaaatggaagaagaagcacaggaagtattagaccgtttaggtgctcaatttttcgcctatcaaaaagtgtcctctctcaccattgctgagcaacagcaagtagaaattgcccgcgcgttacatcgtaaaagtcgaattttagtgatggatgagccgactgctgcattatcctcccgtgaaacagaaaaattgtttgagttgatcaaaaaattacggtcggaaggattggcaattatctatattagtcaccgaatggcggaaatttacgaattggcggatcgtgtgagtgtattacgtgacggaaagtatgttggatctttactacgtgagaatttgcatgccaacactttagtacaaatgatggtaggacgaccactaacagatttgtttaataaagaaaaagtaccaataggcgaggaagtcattcgcattgaaaatctttctgacggtaataaaataaaaaatgcttctttggttgtaagagcaggtgaaattattggcttatccggtttggttggtgcaggtcgttctgaattagctcatttattatttggtgttagtcgacctacacaaggcaaaatgtatttaaacggtgccgaaattagtttcagctcacctcgagaagccattattcatcacgtagcattattaccggaaaatcgtaaagaagaaggattattccttgatatgaacgtatttaaaaacataactattgcgaccattgaacgtgatgccaccatgatggtgattaatcagacaaaaggaaaagcggatactgatcaggcaattaaaagtttaaaaatccgagtgccgaatgctaatgtcgatgtgagtggactatccggcggtaatcaacaaaaagtattgttgtcccgttggatgggaattcatccgaagttattcattttagatgaaccgacacgaggtgtggatgttggtgcaaaaagtgagatttataaaatgatgattgaaatggcaaaacaaggtgtagcgattttaatgatttccagtgaattacctgaaattgtcggtatgagcgatcgtgtttatgtaatgcgggaaggctatgttgtcggtgaagttctaggtgaacaaattaatcaagaaagcattatggcattggcctgtggtgcagcgtaa

SEQ ID NO: 8791 - protein, 502 aa, Haemophilus somnus 2336
MEQAVNISVTPLLEMRHIAKRFGDFYALQDVDLDVYRGEIHALMGENGAGKSTLMKILAGAYIATSGEINIDGKLFPISSPKDAILAGITLIYQEIHLSPNLTVAENIFLGREIGTVFGLNRKKMEEEAQEVLDRLGAQFFAYQKVSSLTIAEQQQVEIARALHRKSRILVMDEPTAALSSRETEKLFELIKKLRSEGLAIIYISHRMAEIYELADRVSVLRDGKYVGSLLRENLHANTLVQMMVGRPLTDLFNKEKVPIGEEVIRIENLSDGNKIKNASLVVRAGEIIGLSGLVGAGRSELAHLLFGVSRPTQGKMYLNGAEISFSSPREAIIHHVALLPENRKEEGLFLDMNVFKNITIATIERDATMMVINQTKGKADTDQAIKSLKIRVPNANVDVSGLSGGNQQKVLLSRWMGIHPKLFILDEPTRGVDVGAKSEIYKMMIEMAKQGVAILMISSELPEIVGMSDRVYVMREGYVVGEVLGEQINQESIMALACGAA

SEQ ID NO: 8792 - DNA, 1515 bp, Enterobacter cowanii
  CDS (1)..(1515): transl_table=11
atgcaacactccactccctatctctcgtttcgcggcatcagcaaaacctttcccggcgtcaaagcgctgagcgatatcacctttgactgttatgccgggcaggtgcacgcgctgatgggcgaaaatggcgcggggaaatccaccctgctaaaaatcctcagcggtaactacgcgcccaccggcggcacgctggcgattaaaggtgaagaggtggtgtttagcgacaccactgcggcgctgaatgccggtgtggcgattatctatcaggagctgcacctggtgccggagatgactgtcgcggaaaatatctaccttggtcaactgccgcaaaaaggcggcattgtgaaccgctcgctgctcaactacgaagcgggcctgcaattacagcatctggggctggatatcgatccccagacgccacttaagtatctctctatcggtcaatggcagatggtggagattgccaaagcgctggcgcgcaacgccaaagtgatcgcctttgacgaaccgaccagctccctttcggcacgtgaaatcgacaatctgttccgcgtgatccgcgaactgcgcaaagagggcagggtgatcctctatgtttcccaccgcatggaggagatttttgccctcagcgacgccattaccgtgtttaaagatggtcgctacgtgcgcaccttcagcgatatgcagcaggtcaaccacgatcagctggtgcaggcaatggttggccgcgagctgggcgatatctacggctggcagccgcgcccctgtggcgaagagcgtttgcgcctggagcaggtgaaagcgccgggcgtacgcacgcccatcagcttaagcgtgcgcagcggcgaaatcgtcggcctcttcggtctggtcggtgccggtcgcagcgagttgatgaaagggctgttcggcgggacgaagatcaccgaagggcaggtctttattgatggcgaagcgatcaacatccagaaaccggcccacgccattcgcgcagggatgatgctctgcccggaagatcgtaaagcagaagggattatcccggtgcactcggtgcaggagaacatcaatatcagcgcccggcgcaaatacattcgcgcaggctgcctgattaacgatggctgggagagcgagaacgccgcgcaccatattcgcgcgctcaatatcaaaacccccggcgccgaacagctgattatgaatctctccggcggcaaccagcagaaggcgatcctcggtcgctggctgtcggaggagatgaaagtgatcctgcttgatgagccgacgcgcggtattgatgtgggtgccaagcatgagatctacaacgtgatatacgcgctggccgcgcgtggcgtcgcggtgctctttgcttcaagtgacttacccgaagtgctcggcgttgccgaccgcatcgtggtaatgcgcgaaggggagattgccggtgaggtgttacacggccagggtgatgaacagcaggtgttgagcctggctatgccaaaagtgagccaggcggtcgcctga

SEQ ID NO: 8793 - protein, 504 aa, Enterobacter cowanii
MQHSTPYLSFRGISKTFPGVKALSDITFDCYAGQVHALMGENGAGKSTLLKILSGNYAPTGGTLAIKGEEVVFSDTTAALNAGVAIIYQELHLVPEMTVAENIYLGQLPQKGGIVNRSLLNYEAGLQLQHLGLDIDPQTPLKYLSIGQWQMVEIAKALARNAKVIAFDEPTSSLSAREIDNLFRVIRELRKEGRVILYVSHRMEEIFALSDAITVFKDGRYVRTFSDMQQVNHDQLVQAMVGRELGDIYGWQPRPCGEERLRLEQVKAPGVRTPISLSVRSGEIVGLFGLVGAGRSELMKGLFGGTKITEGQVFIDGEAINIQKPAHAIRAGMMLCPEDRKAEGIIPVHSVQENINISARRKYIRAGCLINDGWESENAAHHIRALNIKTPGAEQLIMNLSGGNQQKAILGRWLSEEMKVILLDEPTRGIDVGAKHEIYNVIYALAARGVAVLFASSDLPEVLGVADRIVVMREGEIAGEVLHGQGDEQQVLSLAMPKVSQAVA

SEQ ID NO: 8794 - DNA, 1512 bp, Burkholderia sp
  CDS (1)..(1512): transl_table=11
gtgtcagcggcactgcgttttgacaatatcggcaaggtctttcctggcgtgcgcgcactcgacggcatctcgttcgacgtgcacgcgggcgaggtgcatggcctgatgggcgagaacggcgcgggcaagtcgacgctgctgaagattctcggcggcgaataccagcccgatgcgggcagcgtgctggtcgatggccagcccgtgcagttcgcgagtgcggccgcgtcgatcgcggccggcatcgcggtgattcaccaggagctgcagtacgtgccggacctgacggtcgcggaaaacctgctgctcggccgcctgccgaatgcgttcggctgggtgcgcaagcgcgaggcgaagcgttacgtgcgcgagcggctcgccgcgatgggcgtcgatctcgatcccgatgcgaagctcgggcggctgtcgatcgcgcagcggcagatggtcgagatctgcaaggcgctgatgcgcaatgcgcgcgtgatcgcgctcgacgaaccgaccagctcgctgtcgcatcgcgagacggaagtgctgttcaagctcgtcgacgacctgcgtgcgcagggccgcgcgctgatctacatctcgcaccggatggacgagatctaccggctctgcaatgcgtgcacgatcttccgcgacgggcgcaagatcgcgtcgcacgagtcgctcgccgacgtgccgcgcgaacggctcgtcgccgagatggtcgggcgcgagatttcggacatctaccattacgcgccgcgtgcgctcggcgatgtgcgcttcgccgccgaaggcatcgacggcccggcattgcgcgaacccgcgagcttctcggtgcgcgcgggcgagattgtcggctttttcgggctcgtcggcgcgggccgcagcgaactgatgcggctcgtgtacggcgcggatcaccggcgcgcgggcgtgctgacgcttgacggcgcgcgcatcgacgtgaagcgcaccggcgacgcgatccgccacggcatcgtgctgtgccccgaggaccgcaaggaagaggggatcatcgcgatcgcgtcggtcgcggagaacatcaacatcagctgccgccgccattcgctgcgcgcggggctcttcatcaaccgcaaggccgaaagcgaaacggccgaccgtttcatccagcggctcaagatcaagacgccgaaccggcggcagaagatccgcttcctgtcgggcggcaaccagcagaaggcgatcctgtcgcgctggctcgcggagcccgacctgaaggtcgtgatcctcgacgaaccgacgcgcgggatcgacgtcggcgcgaagcacgagatctacgacgtgatctaccggctcgcggaacgcggctgcgcgatcgtgatggtgtcgtcggagctgccggaagtgctcggcgtgtccgaccgcatcgtcgtgatgcgcgaaggccggatcgcgggcgaactgccgcgcgaacaggcgaacgagcacgcggtgctgagcctggcgctgccgcagacgagcgccgtcgaggcggcctga

SEQ ID NO: 8795 - protein, 503 aa, Burkholderia sp
MSAALRFDNIGKVFPGVRALDGISFDVHAGEVHGLMGENGAGKSTLLKILGGEYQPDAGSVLVDGQPVQFASAAASIAAGIAVIHQELQYVPDLTVAENLLLGRLPNAFGWVRKREAKRYVRERLAAMGVDLDPDAKLGRLSIAQRQMVEICKALMRNARVIALDEPTSSLSHRETEVLFKLVDDLRAQGRALIYISHRMDEIYRLCNACTIFRDGRKIASHESLADVPRERLVAEMVGREISDIYHYAPRALGDVRFAAEGIDGPALREPASFSVRAGEIVGFFGLVGAGRSELMRLVYGADHRRAGVLTLDGARIDVKRTGDAIRHGIVLCPEDRKEEGIIAIASVAENINISCRRHSLRAGLFINRKAESETADRFIQRLKIKTPNRRQKIRFLSGGNQQKAILSRWLAEPDLKVVILDEPTRGIDVGAKHEIYDVIYRLAERGCAIVMVSSELPEVLGVSDRIVVMREGRIAGELPREQANEHAVLSLALPQTSAVEAA

SEQ ID NO: 8796 - DNA, 1512 bp, Burkholderia thailandensis
  CDS (1)..(1512): transl_table=11
gtggctgcggcactgcgttttgacaatatcggcaaggtctttcccggcgtgcgcgcgctcgacggcatttcgttcgacgtgcaggcggggcaggtgcacggcctgatgggcgagaacggcgcgggcaagtcgacgctgctcaagattctcggcggcgaatatcagcccgattcgggcggcgtgctcgtcgacgggcaggcgatgcgctttccgagcgcggccgcgtcgatcgcggcgggcgtcgcggtgatccatcaggaactgcagtacgtgcccgatctgacggtggccgagaacctgctgctcggccggctgccgagcgcgctcggctgggtcaggaagcacacggcgcaacgcttcgtgcgcgagcggcttgccgcgatgggcgtcgatctcgacccgcaggcgaagctgcggcggctgtcgatcgcgcagcggcagatggtggagatctgcaaggcgctcatgcgaaacgcgcgcgtgatcgcgctcgacgagccgacgagctcgctgtcgcaccgcgagaccgaggtgctgttcaagctcgtcgacgatctgcgtcgagacgggcgcgcgctcatctacatctcgcaccggatggacgagatctaccggctctgcgacgcatgcacgatctttcgcgacggcaggcaggtcgcgtcgcacgcgtcgctcgcgcaggtgccgcgcgagacgctcgtgcggcagatggtcggccgcgagatcagcgacatctatcactacgagccgcgcgcgctcggcgacgtgcgcctgtcggcgcgcgcgctcgaaggcgacgcgctgcgctcgggcgcgagcttcgacgtgcgggcgggcgagatcgtcggcttcttcgggctcgtcggcgcggggcgcagcgaactgatgcgcgtgatctacggcgcggaccgcagaacgggcggcgcgctcacgctcgacggcaagccgctcgacatccgctcgacgcgcgacgcgattcgccacgggatcgtgctgtgtcccgaggatcgcaaggaagaggggatcgtcgcgcacgcgtcggtcgccgagaacatcaacatcagctgtcgccgccatgcgctgcgcgcggggctatttctcgacctcaagcgcgaggccgagacggccgagcgcttcatcaagctgctgaagatcaagacgcccaaccgccggcagaagatccgtttcctgtcgggcggcaatcagcagaaggcgattctcgcgcgctggctcgccgagccggatctgaaggtcgtgatcctcgacgagccgacgcgcggcatcgacgtcggcgcgaagcacgagatctacggcgtgatctacgagctcgcgaagcgcggctgcgcgatcgtgatggtgtcgtccgagctgccggaggtgctcggcgtatcggatcgcatcgtcgtgatgcgtgaaggtcggatcgcgggcgagctcgcgcgcggcgaagcgaacgaagaggcggtgctcaatctcgcgctgccgcagggggcgatcgcgcacgcggcgtga

SEQ ID NO: 8797 - protein, 503 aa, Burkholderia thailandensis
MAAALRFDNIGKVFPGVRALDGISFDVQAGQVHGLMGENGAGKSTLLKILGGEYQPDSGGVLVDGQAMRFPSAAASIAAGVAVIHQELQYVPDLTVAENLLLGRLPSALGWVRKHTAQRFVRERLAAMGVDLDPQAKLRRLSIAQRQMVEICKALMRNARVIALDEPTSSLSHRETEVLFKLVDDLRRDGRALIYISHRMDEIYRLCDACTIFRDGRQVASHASLAQVPRETLVRQMVGREISDIYHYEPRALGDVRLSARALEGDALRSGASFDVRAGEIVGFFGLVGAGRSELMRVIYGADRRTGGALTLDGKPLDIRSTRDAIRHGIVLCPEDRKEEGIVAHASVAENINISCRRHALRAGLFLDLKREAETAERFIKLLKIKTPNRRQKIRFLSGGNQQKAILARWLAEPDLKVVILDEPTRGIDVGAKHEIYGVIYELAKRGCAIVMVSSELPEVLGVSDRIVVMREGRIAGELARGEANEEAVLNLALPQGAIAHAA

SEQ ID NO: 8798 - DNA, 1569 bp, Burkholderia sp
  CDS (1)..(1569): transl_table=11
atgaccacgcagacgatgacggccgtatccggcaacgacggcgacaccggtgccgatgtcgatgctggcgcgcggaagcccggcggcccgctgctcgcgctcgacgggatcacggtgacgttcccgggcgtgcgcgcgctcgatgccgtgtcgctgtcggtgcgcgcgggcgaggtgcacgggctgatgggcgagaacggcgcggggaagtcgacgctgctgaaggtgctgtcgggcgtgaaccagccgcaggccggcacgctggcgctgaacggcaccgcgcagcgcttcgcgtcgacgcgcgcggcgctcgaggccggcatcgcgatcatctaccaggagctgcatctggtgcccgagctgacggtcgccgaaaacctgatgctcgggcagttgccgagccggctcggcgtggtcgacgagcgcacgctcgcggcgcgtgcgctcgatgcgctggagcggctcggcgagcacatcgatccgggcatcccggtgaagtatctgtcgatcggccagcgccagatgatcgagatcggcaaggcgctgatgcgcgatgcgcgcgtgatcgcgttcgacgaaccgacgagttcgttgtccgcgcgcgagaccacgcagctgttccggatcatccgggcgctgcgtgcggagggccgcgcgatcatctacgtcacgcaccggatggaagaggtttatgaactgtgcgaccgggtgacggtgttccgcgacggccgccgcatcgacacgttcgattccgtgaccgatctcgatcgcgaccggttgatcggctgcatggtcggccgttcgatcgaggatgtgtacggctaccggccgcgcacggccggcgacgtgctgatcgaggcgaaagggctggcggggcccgggttgtccgagcccgtgtcgttcaccgcgcggcgcggcgagatcgtcggcttcttcgggctggtcggcgcgggccgctcggagttgatgaagctgctgtacggcgccgcgcgcccgagcgcggggcacgtcgagctgaacgggaagcgggtggcgttcgggagcccgcgcgacgcggtgcgcgccggcctcgcgctgtgcccggaagaccgcaagcaggagggcatcgtcgcgatcgcgtcggtggccgacaacctgaacatcagcgcacgccggcatttcagcccggcgcgcatgctgctcgacgcgcggcgcgaacgcgagcttgcgcaacgctacatcgagcggctcgcgatcaagacccgcgacggcgacacgccgatcggcgcgctgtccggcggcaaccagcagaaggtcgtgctcgcgcgctggttggccgaacgcatcgacgtgttcctgatggacgagccgacgcgcggcatcgacgtcggcgcgcgcgcggaaatctacaacctgttctacgaactcgcggaagcgggccgcacggtgattctcgtgtcgagcgacctggccgaggtgatcggcgtgtcggaccggatcatcgtgatgaaggaaggacggatcgcgggcgaggtcgcgaaggcgcaggcgacgcccgacgcgctgatcaaactcgcgctgccgcgctag

SEQ ID NO: 8799 - protein, 522 aa, Burkholderia sp
MTTQTMTAVSGNDGDTGADVDAGARKPGGPLLALDGITVTFPGVRALDAVSLSVRAGEVHGLMGENGAGKSTLLKVLSGVNQPQAGTLALNGTAQRFASTRAALEAGIAIIYQELHLVPELTVAENLMLGQLPSRLGVVDERTLAARALDALERLGEHIDPGIPVKYLSIGQRQMIEIGKALMRDARVIAFDEPTSSLSARETTQLFRIIRALRAEGRAIIYVTHRMEEVYELCDRVTVFRDGRRIDTFDSVTDLDRDRLIGCMVGRSIEDVYGYRPRTAGDVLIEAKGLAGPGLSEPVSFTARRGEIVGFFGLVGAGRSELMKLLYGAARPSAGHVELNGKRVAFGSPRDAVRAGLALCPEDRKQEGIVAIASVADNLNISARRHFSPARMLLDARRERELAQRYIERLAIKTRDGDTPIGALSGGNQQKVVLARWLAERIDVFLMDEPTRGIDVGARAEIYNLFYELAEAGRTVILVSSDLAEVIGVSDRIIVMKEGRIAGEVAKAQATPDALIKLALPR

SEQ ID NO: 8800 - DNA, 1578 bp, Burkholderia thailandensis
  CDS (1)..(1578): transl_table=11
atgactgatacgacgatacgcgcgcgcggcgcgcaggccgccggctcgccggcgggcgcggggcccctcgacgcgccggacggcgcgccgcgcgccgcgtgcctcgagctcgacggcatcaccgtgacgtttcccggcgtgcgcgcgctcgacgcggtgtcgctgtcggtgcgcgcgggcgaggtgcacgggctgatgggcgagaacggcgcgggcaagtcgacgctcctgaaggtgctctcgggcgtgaaccagccgcaggcgggcacgctgcggctgaacgggctcgcgcagcgcttcggctcgacgcgcgcggcgctcgaggcgggcatcgcgatcatctatcaggaactgcatctcgtgcccgagctgacggtcgccgagaacctgatgctcgggcaactgccgaaccgcgccggcgtgctcgacgagcgcgcgctcgtcgcgcgcgcgacggccgagctcgagcggctcggcgagcggatcgatccgaacacgccggtgaagctgctgtcgatcgggcagcggcagatgatcgagatcggcaaggcgctgatgcgcgacgcgcgcgtgatcgcgttcgacgagccgacgagctcgctgtccgcgcgcgagaccgagcgcctgttccggatcattcacgcgctgcgcgcggacggccgcgcgatcatctacgtcacgcaccggatggaggaagtcgacgcgctctgcgaccgcgtgacggtgtttcgcgacggccgccgcatcgagacgttcgaatcggtcgccgatctcgatcgcgaccggctgatcggctgcatggtcggccgcccgatcgccgacgtgtacggctatcggccgcgcgagccgggcgacgtggcgatcgaggcgaagggtctgcgcgggccggggctcgccgagccggtgtcgttcagcgcgcggcgcggcgagatcgtcggcttcttcgggctcgtcggcgccgggcgctcggagctgatgaagctgctgtacggcgccgcgcgcccgagcgcgggccacgtcgagctgaacggccggcgcgtgtcgttcgcgagcccgcgagacgcggtgcgcgccggcatcgcgctgtgcccggaggaccgcaagcaggaggggatcgtcgcgatcgcgtcggtggcggacaacctgaacctgagcgcgcggcgccacttcagccccgcgcgcttgctgctcgacgcgcggcgcgagcgcgagctcgccgcgcgctacatcgcgcggctcgcgatcaagacgcgcgacgccgatacgccgatcggcgcgctgtcgggcggcaaccagcagaaggtgatcctcgcgcgctggctcgccgagcgcatcgacgtgttcctgatggatgagcccacgcgcggcatcgacgtcggcgcgcgcgcggaaatctacaacctgttctacgagctcgccgacgcgggccgcacggtgctcatcgtgtcgagcgatctggccgaggtgatcggcgtgtcggaccgcatcgtcgtgatgaagcaagggcggatcgccggctgcgtggcgaaggcgcaggcgagccccgacgcattgatcaagctcgcgctgcctcgctaa

SEQ ID NO: 8801 - protein, 525 aa, Burkholderia thailandensis
MTDTTIRARGAQAAGSPAGAGPLDAPDGAPRAACLELDGITVTFPGVRALDAVSLSVRAGEVHGLMGENGAGKSTLLKVLSGVNQPQAGTLRLNGLAQRFGSTRAALEAGIAIIYQELHLVPELTVAENLMLGQLPNRAGVLDERALVARATAELERLGERIDPNTPVKLLSIGQRQMIEIGKALMRDARVIAFDEPTSSLSARETERLFRIIHALRADGRAIIYVTHRMEEVDALCDRVTVFRDGRRIETFESVADLDRDRLIGCMVGRPIADVYGYRPREPGDVAIEAKGLRGPGLAEPVSFSARRGEIVGFFGLVGAGRSELMKLLYGAARPSAGHVELNGRRVSFASPRDAVRAGIALCPEDRKQEGIVAIASVADNLNLSARRHFSPARLLLDARRERELAARYIARLAIKTRDADTPIGALSGGNQQKVILARWLAERIDVFLMDEPTRGIDVGARAEIYNLFYELADAGRTVLIVSSDLAEVIGVSDRIVVMKQGRIAGCVAKAQASPDALIKLALPR

SEQ ID NO: 8802 - DNA, 1563 bp, Azospirillum brasilense
  CDS (1)..(1563): transl_table=11
atgacgacgcagacgatgacggccgtatccggcaacgatggcgacaccggcggcgatgccgccgagtcgccgccgggcggcccgctgctcgcgctcgacggcatcacggtgacgttcccgggcgtgcgtgcgctcgacgccgtgtcgctgtcggtgcgcgcgggcgaagtgcacgggctgatgggcgagaacggcgcggggaagtcgacgctgctgaaggtgctgtccggcgtgaaccagccgcaggccggcacgctgacgctgaacggcaccgagcagcgcttcgcgtcgacgcgcgcggcgctcgaggccggcatcgcgatcatctaccaggagctgcatctggtgcccgagttgacggtggccgagaacctgatgctcgggcagctgccgagccggctcggcgtggtcgacgaacgcacgcttgccgcgcgcgcgctcgatgcgctggagcgactcggcgagcacatcgatccgggcatcccggtgaagtacctgtcgatcggccagcgccagatgatcgagatcggcaaggcgctgatgcgcgacgcgcgcgtgatcgcgttcgacgagccgacgagttcgctgtccgcgcgcgaaaccacgcaactgttccggatcatccgcgcgctgcgcgcggaaggccgcgcgatcatctacgtcacgcaccggatggaagaggtgtacgaactgtgcgaccgcgtgacggtgttccgcgacggccgccgcatcgacacgttcgattccgtcaccgatctcgaccgcgaccggttgatcggctgcatggtcggccgctcgatcgaggacgtgtacggctaccggccgcgcgcggccggtgacgtgctgatcgaggcgaaggggctggcggggcccgggttgtccgagcccgtgtcgttcaccgcgcggcgcggcgagatcgtcggcttcttcgggctcgtgggcgcgggccgctcggagttgatgaagctgctgtacggcgccgcgcgcccgagcgcggggcacgtcgaactgaacggcaagcgcgtggcgttcgggagcccgcgcgacgcggtgcgcgccggcctcgcgctgtgcccggaagaccgcaagcaggaaggcatcgtcgcgatcgcgtcggtggccgacaacctgaacatcagcgcgcgccggcatttcagcccggcgcgggtgctgctcgacgggcggcgcgaacgcgaactcgcgcagcgctacatcgagcggctcgcgatcaagacgcgcgatggcgacacgccgatcggcgcgctgtccggcggcaaccagcagaaagtcgtgctcgcgcgctggctggccgagcgcatcgacgtgttcctgatggacgagccgacgcgcggcatcgacgtcggcgcgcgcgcggaaatctacaacctgttctacgaactcgcggaagcgggccgcacggtgatcctcgtgtcgagcgacctggccgaggtgatcggcgtgtcggaccggatcatcgtgatgaaggaagggcggatcgcgggcgaggtcgcgaaggcgcacgcgacgcccgacgcgctgatcaagctcgcgctgccgcgctag

SEQ ID NO: 8803 - protein, 520 aa, Azospirillum brasilense
MTTQTMTAVSGNDGDTGGDAAESPPGGPLLALDGITVTFPGVRALDAVSLSVRAGEVHGLMGENGAGKSTLLKVLSGVNQPQAGTLTLNGTEQRFASTRAALEAGIAIIYQELHLVPELTVAENLMLGQLPSRLGVVDERTLAARALDALERLGEHIDPGIPVKYLSIGQRQMIEIGKALMRDARVIAFDEPTSSLSARETTQLFRIIRALRAEGRAIIYVTHRMEEVYELCDRVTVFRDGRRIDTFDSVTDLDRDRLIGCMVGRSIEDVYGYRPRAAGDVLIEAKGLAGPGLSEPVSFTARRGEIVGFFGLVGAGRSELMKLLYGAARPSAGHVELNGKRVAFGSPRDAVRAGLALCPEDRKQEGIVAIASVADNLNISARRHFSPARVLLDGRRERELAQRYIERLAIKTRDGDTPIGALSGGNQQKVVLARWLAERIDVFLMDEPTRGIDVGARAEIYNLFYELAEAGRTVILVSSDLAEVIGVSDRIIVMKEGRIAGEVAKAHATPDALIKLALPR

SEQ ID NO: 8804 - DNA, 1512 bp, Burkholderia mallei
  CDS (1)..(1512): transl_table=11
gtggctgcggcactgcgttttgacaatatcggcaaggtctttcccggcgtgcgtgcgctcgacggcatttcgttcgacgtgcaggcgggacaggtgcacgggctgatgggcgagaacggggcgggcaagtcgacgctgctcaagattctcggcggcgaatatcagctcgattcgggcagcgtgctcgtcgacgggcgggcgatgcgctttccgagcgcggccgcgtcgatcgcggcgggcgtcgcggtgatccatcaggagctgcaatacgtgcccgatctgacggtggccgagaacctgctgctcggccggctgccgagcgcgctcggctgggtccgcaagcgcgacgcgcagcgcttcgtgcgcgagcggctcgccgcgatgggcgtcgatctcgatgcgcaggcgaagctgcggcggctgtcgatcgcgcagcggcagatggtcgagatctgcaaggcgctgctgcgcaacgcgcgggtgatcgcgctcgacgagccgacgagctcgctgtcgcatcgcgagaccgaggtgctcttcaagctcgtcgacgatctgcgccgcgacggccgcgcgctcatctacatctcgcaccggatggacgagatctaccggctctgcgacgcgtgcacgatctttcgcgacggccgacaggtggcgtcgcacgcgtcgctcgccaacgtgccgcgcgagacgctcgtgcggcagatggtcggccgcgagatcagcgacatctatcactacgcgccgcgcgcgctcggcgacgtgcgcctgtcggcgcgcgcgctcgagggcgatgcgctgcgcgcgggggcgagcttcgacgtgcgcgcgggcgagatcgtcggctttttcgggctcgtcggcgcggggcgcagcgaactgatgcgcgtgatctacggcgcgcagcgcaggacgggcggcgcgctcatgctggacggcgagccgctcgacatccgctcgacgcgcgacgcgatccgccgcgggatcgtgctgtgccccgaggatcgcaaggaagagggaatcgtcgcgcatgcgtcggtcgccgagaacatcaacatcagttgccgccgccacgggctgcgcgcggggctttttctcgaccgcaagcgcgaggccgagacggccgatcgcttcatcaagctgctgaagatcaagacgcccaaccgccggcagaagatccgcttcctgtcgggcggcaatcagcagaaggcgattctcgcgcgctggctcgccgagccggatctgaaggtcgtgatcctcgacgagccgacgcgcggcatcgatgtcggcgcgaagcacgagatctacggcgtgatctacgagctcgcgaagcgcggctgcgcgatcgtgatggtgtcgtccgagctgccggaagtgctcggcgtatcggatcgcatcgtcgtgatgcgcgaagggcggatcgcgggcgagctcgcgcgcggcgaagcgaacgaagaggcggtgctcaatctcgcgctgccgcagggcgcgaccgcgcacgccgcgtga

SEQ ID NO: 8805 - protein, 503 aa, Burkholderia mallei
MAAALRFDNIGKVFPGVRALDGISFDVQAGQVHGLMGENGAGKSTLLKILGGEYQLDSGSVLVDGRAMRFPSAAASIAAGVAVIHQELQYVPDLTVAENLLLGRLPSALGWVRKRDAQRFVRERLAAMGVDLDAQAKLRRLSIAQRQMVEICKALLRNARVIALDEPTSSLSHRETEVLFKLVDDLRRDGRALIYISHRMDEIYRLCDACTIFRDGRQVASHASLANVPRETLVRQMVGREISDIYHYAPRALGDVRLSARALEGDALRAGASFDVRAGEIVGFFGLVGAGRSELMRVIYGAQRRTGGALMLDGEPLDIRSTRDAIRRGIVLCPEDRKEEGIVAHASVAENINISCRRHGLRAGLFLDRKREAETADRFIKLLKIKTPNRRQKIRFLSGGNQQKAILARWLAEPDLKVVILDEPTRGIDVGAKHEIYGVIYELAKRGCAIVMVSSELPEVLGVSDRIVVMREGRIAGELARGEANEEAVLNLALPQGATAHAA

SEQ ID NO: 8806 - DNA, 1551 bp, Burkholderia xenovorans
  CDS (1)..(1551): transl_table=11
gtgtcagcgacgctacgttttgacaatatcggcaaggtctttccaggcgtgcgcgcgctcgacggtgtgtccttcgacgtcaacgtcggccaggtgcacggcctgatgggcgaaaacggcgcagggaaatcgaccctgctgaagattctcggcggtgaatatcagcccgactcgggccgcgtgatgatcgacggcaacgaggtgcgcttcacgagcgcggcgtcgtcgatcgcggcgggcatcgcggtgattcaccaggaactgcaatacgtgcccgatctgacggtcgcggaaaacctgctgctcgggcaactgccgaactcgctcggctgggtcaacaaacgcgaagccaaacgcttcgtgcgcgaacgcctcgaagcgatgggcgtggcgctcgatccgaacgcgaagctgcgcaagctctcgatcgcgcaacggcagatggtggaaatctgcaaggcgctgctgcgcaacgcgcgcgtgatcgcgctggacgagccgaccagttcgctgtcccaccgtgagaccgaagtgctgttcaagctggtgcgcgacttgcgcgccgacaaccgcgcgatgatctacatctcgcaccgcatggatgagatctacgagctgtgcgacgcctgcacgatcttccgggatggccgcaagatcgcctcgcatccgacgctcgaaggtgtgtcgcgcgacaccatcgtcagcgagatggtggggcgggaaatttcggacatctataactattcggcgcggccgctcggcgaagtacgcttcgcggcgaaagcgatcgaaggccacgcgctcgcgcagccggccagcttcgaagtgcggcgcggcgagatcgtcggcttcttcggtctggtgggcgcgggccgcagcgaactgatgcatctggtgtacggcgccgatcgcaagaagggcggcgaactgacgctcgacggcaagccgatcaaggtgcgcagcgcgggcgaagcgatccggcacggcatcgtgctgtgtcccgaagaccgcaaggaagagggcatcgtcgcgatggcgagcgtgtcggagaacatcaatatcagttgccgccgccactatctgcgcgcgggcatgttcctcgatcgcaagaaggaggcggaaacggcggaccgtttcatcaagctgctgaagatcaagacgccgagccgccgccagaagatccgctttctctcgggcggcaatcagcagaaggcgatcctgtcgcgctggctggccgagccggatctgaaagtggtgattctcgatgagccgacgcgcggcatcgacgtcggcgcgaagcatgaaatctacaacgtgatctatcagcttgccgaacgcggctgcgcgatcgtgatgatttcgtcggagttgccggaagtgctgggcgtgtccgaccgcattgtcgtgatgcgtcagggccggatttccggcgagctggcgcgccaggatgcaacggaacagtcggtgttgagtctcgcgctaccgcaaagctcgaccgccttacctggcaccgacgccggaacggaaaccgccgcccaacaggcggcctga

SEQ ID NO: 8807 - protein, 516 aa, Burkholderia xenovorans
MSATLRFDNIGKVFPGVRALDGVSFDVNVGQVHGLMGENGAGKSTLLKILGGEYQPDSGRVMIDGNEVRFTSAASSIAAGIAVIHQELQYVPDLTVAENLLLGQLPNSLGWVNKREAKRFVRERLEAMGVALDPNAKLRKLSIAQRQMVEICKALLRNARVIALDEPTSSLSHRETEVLFKLVRDLRADNRAMIYISHRMDEIYELCDACTIFRDGRKIASHPTLEGVSRDTIVSEMVGREISDIYNYSARPLGEVRFAAKAIEGHALAQPASFEVRRGEIVGFFGLVGAGRSELMHLVYGADRKKGGELTLDGKPIKVRSAGEAIRHGIVLCPEDRKEEGIVAMASVSENINISCRRHYLRAGMFLDRKKEAETADRFIKLLKIKTPSRRQKIRFLSGGNQQKAILSRWLAEPDLKVVILDEPTRGIDVGAKHEIYNVIYQLAERGCAIVMISSELPEVLGVSDRIVVMRQGRISGELARQDATEQSVLSLALPQSSTALPGTDAGTETAAQQAA

SEQ ID NO: 8808 - DNA, 1524 bp, Erwinia carotovora subsp
  CDS (1)..(1524): transl_table=11
atgacagcacagtcaccctatttgtcgtttcatgggattggtaaagaatttcccggtgttaaggcgctttcggatatcagcttttcctgccatgccggccagatccatgcattgatgggggaaaacggggcgggcaagtcgacgctgttaaaaatcctgagcggcaactattcaccgtcagcgggcgaaatccacattcagggcaagcctgtgcagtttagtaatacgatggatgccctgaatgcgggcgttgccattatttatcaggaactgcatttggtgccagaaatgacggtcgccgagaatatctatctgggtcaattgccgcataaatacggcatggtgaactactcactgctgcgctatgaagccaaactgcaattacagcatctggggctggatatcgatcctgataccccgctgaaatacctgtctatcgggcagtggcaaatggtggaaatcgccaaagcgctggcgcgtaatgccaagattatcgcttttgatgaaccgaccagttcgctgtctgcccgtgaaatcgagcaacttttccgggtgattactgaattgcgtagtgaaggccggatcattttgtatgtttcgcaccggatggaagaaatttttgcgctgagcgatgccattaccgtgtttaaagatggtcgctacgtgtgcacgtttgacgatatgcaacaggtgaaccatgagtcgctggtacaggcgatggtagggcgtaacttggggaatatctatggttacgcgccgcgtccgcacggcgaagaccgcttgacgctgaaagacgtaaaagcgccgggcgtgaaatccacgatttccctgaacgtcaagcagggggaaattgtcgggctatttggtctggtgggggccggccgcagcgaactgatgaaagggctgtttggtgcgaccaaaatcaccagcggtcaggtgttgctggatggcaaaccgctggtggtgaattcccccatcgatgcgattcgccaaggcgtgatgctctgccctgaggatcgcaaagcggacggtatcattccggtgcactcggtgcgtgacaacatcaatatcagcgcaagacgtaagagcctgaaagccggttttattattaataatcagtgggaagcagataacgccgcgcagcgcattgacgcgttgaatatcaaaacgccgtccgatgaacagctgattatgaatctttccggcggaaatcagcagaaagtcattcttggtcgctggttgtccgaagagatgaaagtcattttgctcgatgagcccacgcgcggcatcgatgtcggcgcgaagcacgaaatttatcatgtcatctatgaactggcgaatcaggggatcgcggtgctgtttgcctccagcgatttacccgaagtgcttgggctggccgaccggattatcgtcatgcgcgaaggtgccgtctccggcgaactgctacatgctgatgccacggaacagaaggtgctcagcctagccatgttacgaatccccgatatcgaatctgcggttgcctga

SEQ ID NO: 8809 - protein, 507 aa, Erwinia carotovora subsp
MTAQSPYLSFHGIGKEFPGVKALSDISFSCHAGQIHALMGENGAGKSTLLKILSGNYSPSAGEIHIQGKPVQFSNTMDALNAGVAIIYQELHLVPEMTVAENIYLGQLPHKYGMVNYSLLRYEAKLQLQHLGLDIDPDTPLKYLSIGQWQMVEIAKALARNAKIIAFDEPTSSLSAREIEQLFRVITELRSEGRIILYVSHRMEEIFALSDAITVFKDGRYVCTFDDMQQVNHESLVQAMVGRNLGNIYGYAPRPHGEDRLTLKDVKAPGVKSTISLNVKQGEIVGLFGLVGAGRSELMKGLFGATKITSGQVLLDGKPLVVNSPIDAIRQGVMLCPEDRKADGIIPVHSVRDNINISARRKSLKAGFIINNQWEADNAAQRIDALNIKTPSDEQLIMNLSGGNQQKVILGRWLSEEMKVILLDEPTRGIDVGAKHEIYHVIYELANQGIAVLFASSDLPEVLGLADRIIVMREGAVSGELLHADATEQKVLSLAMLRIPDIESAVA

SEQ ID NO: 8810 - DNA, 1509 bp, Mannheimia succiniciproducens
  CDS (1)..(1509): transl_table=11
atgcaagttccatatttagaatttgataatgtgagcaaaagctttcccggcgttaaagcattgcaaaatatttcctttaaatgctatgagggcaaagttcatgcgttaatgggtgagaatggtgcgggcaagtccaccttgttaaaaattttaagcggcaactatctgcctagcgagggcaaattaagtatcggcggtcgccaactggttttccgtaatactaaagaagccttattagccggtgtcgccattatttaccaggaattaaatattgtgccggaaatgaccgttgcggagaatttatgcttaggtcagttaccccattctttcggcattgtagataaagcggaattaattgagagaacacaacaatacctggataaactggatctcaatatttcgcctaatacccctttaaaagaattatctatcggtcaatggcaaatgatcgagattgccaaagccttaagccggggcgcaaaaatcattgcatttgacgaacccaccagcagcctttccgctcctgaaattgagaaattattcagcgtaattaacgagttacgggatgaaggcaaggtgattttatatgtatctcaccgaatggaagaaattttccgtatcagtgatgaaattaccgtgctgaaagacgggcaatttgtggagactttctccgatctttcaaaaatcaccaatgacgatttagtacgcagcatggtcggacgcaatttgggtgatatttaccattatcgtccccgtgaagtgggtgatgtccgtttgaaaattgcacatttatccggtgaaaaactgcaaggtgattttagtttaacggttcgggccggtgaggttttaggcttattcggcctggtcggcgcagggcgttcggaattattaaaagtgattttcggtgcggatccttgtgtgtcgggaagcattgaattagacggtaaaaccttgtctatccgcagccctaaagacgctattgaacaaggtatcgtcctttgtccggaagaccgtaaaaaagaaggcattgtccccactgccagcgtaggggaaaatattaatatcagcgcccgcagattacataatttttttaaatttattattaatgataaatgggaaaagaaaaacgctgaaaaacaacgccaacaaatgaatgtgaaaaccccgtctatcgagcaattaattgtcaatctttccggtggtaatcaacaaaaagcgattttaggccgttggctttccgaagatattaaagtgttattgctggacgaaccgacccggggtatcgacgtgggggcgaagtccgaaatttacgatttaatttttaagctggccgaccaaaaattagccattattgtggtttccagtgatttacccgaagttatcggcgtatccgatagaattatggtaatgcgcgcccatcaaattaccggtgtggtagaacgcgcggatgcaacggaagaaaaagtattaaaacttgctatggtagaaagccttaatgtaggagattga

SEQ ID NO: 8811 - protein, 502 aa, Mannheimia succiniciproducens
MQVPYLEFDNVSKSFPGVKALQNISFKCYEGKVHALMGENGAGKSTLLKILSGNYLPSEGKLSIGGRQLVFRNTKEALLAGVAIIYQELNIVPEMTVAENLCLGQLPHSFGIVDKAELIERTQQYLDKLDLNISPNTPLKELSIGQWQMIEIAKALSRGAKIIAFDEPTSSLSAPEIEKLFSVINELRDEGKVILYVSHRMEEIFRISDEITVLKDGQFVETFSDLSKITNDDLVRSMVGRNLGDIYHYRPREVGDVRLKIAHLSGEKLQGDFSLTVRAGEVLGLFGLVGAGRSELLKVIFGADPCVSGSIELDGKTLSIRSPKDAIEQGIVLCPEDRKKEGIVPTASVGENINISARRLHNFFKFIINDKWEKKNAEKQRQQMNVKTPSIEQLIVNLSGGNQQKAILGRWLSEDIKVLLLDEPTRGIDVGAKSEIYDLIFKLADQKLAIIVVSSDLPEVIGVSDRIMVMRAHQITGVVERADATEEKVLKLAMVESLNVGD

SEQ ID NO: 8812 - DNA, 1524 bp, Pseudomonas syringae pv
  CDS (1)..(1524): transl_table=11
atgcaacaggctatcgagcaaacatccataaacggtgccttgcgcttcaatggcatcggcaaggtcttccccggcgtaaaggcgctttcggacatcagcttcgaagcgcgccccggcagtgttcacgccttgatgggcgagaacggtgccggtaaatccacgctgctgaaaatcctcggcggctcttatcagcccaatagcggcaccttgcagatcggtgagcagagctaccagttcaaatccaccgccgagagtattgcggcgggtgtggcggtgattcaccaggaattgcatctggtgccggaaatgaccgtcgccgagaacctgctgcttgggcacatgcccaatcgtttcggtttgatcaatcgtggcgcgatgtaccgtcgggcaggtgagctgctcaaaggcctggctgacgaaatcgacccgcgcactcgcctgggtgatctttcactgggccagcggcaattggtggagatcgccaaggccatgtcacgcaatgcgcacgtcatcgcctttgacgaacccaccagcagcctgtcggcacgtgaaattgaccggttgatggcgattatcgtgcggctgcgcgacgaggggcgggtgattctctacgtgtctcatcgcatggaagaaatcttccgtgtctgtgatgccgtaacagtgttcaaggacggtcgttttgtaaaaacctttgagcagatggctgatctggatcatgaccggctggtgacctgcatggtcggccgggatattcagaacatctacaattatcgtccgcgccagcatcaagggcctagcctgcgagtgaccgggttactggggccggggctgcacgaacccgtgagttttgccgtagagaaaggtgaagtgctgggtttcttcgggctggtgggcgccgggcgtaccgagctgttccgtctgctgtcggggttgacgcgcagcacggcaggcacgttgcagctggacggcaagccattgacgctcaagtccccacgcgattcgatcgaagcaggcattctgctctgcccggaggaccgcaagaaggaaggtatcgtgccgctgtccagcgtcgcggagaacatcaacatcggtgcacggccccggcatgtgaatctcggctgcctgattcagggccgctgggagcgcgacaacgcacgcagccagatcaagtcgatgaacgtcaagacaccatcgcctgagcaacagatcatgttcctctccggcggcaatcagcagaaggcgattctcggtcgctggctgtcgatgccgatgaaggtcctgttgctggacgagcccacccgcgggattgacgtcggtgccaagtccgagatctacgagatcattcacaacctggccgccgacgggattgcggtcattgtggtgtccagtgacctgatggaagtcatgggtatttccgaccgcattctggtgatgagcgaaggcgcgatcactggtgaactcaaccgcgatgaggctgatgagtcgcgactcctgcaattggctctgcctcgcacgcgtagctga

SEQ ID NO: 8813 - protein, 507 aa, Pseudomonas syringae pv
MQQAIEQTSINGALRFNGIGKVFPGVKALSDISFEARPGSVHALMGENGAGKSTLLKILGGSYQPNSGTLQIGEQSYQFKSTAESIAAGVAVIHQELHLVPEMTVAENLLLGHMPNRFGLINRGAMYRRAGELLKGLADEIDPRTRLGDLSLGQRQLVEIAKAMSRNAHVIAFDEPTSSLSAREIDRLMAIIVRLRDEGRVILYVSHRMEEIFRVCDAVTVFKDGRFVKTFEQMADLDHDRLVTCMVGRDIQNIYNYRPRQHQGPSLRVTGLLGPGLHEPVSFAVEKGEVLGFFGLVGAGRTELFRLLSGLTRSTAGTLQLDGKPLTLKSPRDSIEAGILLCPEDRKKEGIVPLSSVAENINIGARPRHVNLGCLIQGRWERDNARSQIKSMNVKTPSPEQQIMFLSGGNQQKAILGRWLSMPMKVLLLDEPTRGIDVGAKSEIYEIIHNLAADGIAVIVVSSDLMEVMGISDRILVMSEGAITGELNRDEADESRLLQLALPRTRS

SEQ ID NO: 8814 - DNA, 1545 bp, Pseudomonas fluorescens
  CDS (1)..(1545): transl_table=11
atgcacgcgcaagtacagacacaagaacacagcgccagcggcagcctgcgtttcaacgggatcggcaagaccttcccgggcgtgaaggcgctggacggcatcagtttcgtcgcgcatcccgggcaggttcacgccttgatgggcgagaacggcgccggcaaatcgaccctgctgaaaatcctcggtggcgcctacattccgagcagcggcgagctgcagatcggcgagcagacgatggccttcaagtccactgccgacagcatcggcagcggcgtggcggtgattcaccaggaactgcatctggtgccggaaatgaccgtggcggagaacctgtttctcggtcacctgccggccagtttcggcctgatcaatcgcggcgcgctgcgccagcaagccttggcttgcctcaaaggcctggccgatgaaatcgacccgcagaccaaggtcggacgcctgtccctcggtcagcggcaactggtggaaatcgccaaggcgctgtcccgtggcgcgcacgtgattgccttcgacgaaccgaccagcagcctctcggctcgggaaatcgaccggttgatggcgatcatcggccggctgcgtgacgagggcaaagtagtgctctacgtctcccatcgcatggaagaagtgttccgcatctgcgacgcggtgacggtgttcaaggacggtcgctacgtgcgcaccttcgacgacatgagccagttgacccacgatcaactggtgacctgcatggtcggtcgcgacattcaggacatctacgattatcgcggtcgcccgcgcggtgccgtggcgctgagagtcgatggcttgctcggcccgggcctgcgcgagccgatcagtttcgatgcgcacaagggcgagattctgggcctgttcgggctggtcggggcagggcgcaccgagctgttccggctgctcagcggtctggagcgcaacaccgccggacgcctggaattgcgcggccatgaactgaagctgcgttcgccccgcgatgcgattgccgccgggattctgctatgcccggaggatcgcaagaaggaaggcatcattccgctcgccagtgtcgccgagaacatcaacatcagtgcgcgcggtgcgcattccgggctcggctgcctgctgcgcgggatttgggaaaagggcaacgccgagaaacagatcaaggccctgaaagtgaaaacgccccacgccgggcaacagatcaagttcctgtccggcggcaatcagcagaaggcgattctcggccgctggctgtcgatgccgatgaaagtcctgctgctcgacgagccgacccggggtatcgacatcggcgccaaggccgagatctaccagatcatccataacctggccgccgacggtatttcggtaatcgtggtgtccagcgatctgatggaagtgatgggtatttccgaccgcattctggtgctgtgcgagggcgccttgcgtggcgaagtcagccgcgaccaggccaacgaatccaacctgctgcaactggctttgccgcgccaccgcgctgacggcgtggcgaactga

SEQ ID NO: 8815 - protein, 514 aa, Pseudomonas fluorescens
MHAQVQTQEHSASGSLRFNGIGKTFPGVKALDGISFVAHPGQVHALMGENGAGKSTLLKILGGAYIPSSGELQIGEQTMAFKSTADSIGSGVAVIHQELHLVPEMTVAENLFLGHLPASFGLINRGALRQQALACLKGLADEIDPQTKVGRLSLGQRQLVEIAKALSRGAHVIAFDEPTSSLSAREIDRLMAIIGRLRDEGKVVLYVSHRMEEVFRICDAVTVFKDGRYVRTFDDMSQLTHDQLVTCMVGRDIQDIYDYRGRPRGAVALRVDGLLGPGLREPISFDAHKGEILGLFGLVGAGRTELFRLLSGLERNTAGRLELRGHELKLRSPRDAIAAGILLCPEDRKKEGIIPLASVAENINISARGAHSGLGCLLRGIWEKGNAEKQIKALKVKTPHAGQQIKFLSGGNQQKAILGRWLSMPMKVLLLDEPTRGIDIGAKAEIYQIIHNLAADGISVIVVSSDLMEVMGISDRILVLCEGALRGEVSRDQANESNLLQLALPRHRADGVAN

SEQ ID NO: 8816 - DNA, 1524 bp, Pseudomonas syringae pv
  CDS (1)..(1524): transl_table=11
atgcaacaggctatcgagcaaacagccacaggcggtgccttgcgcttcaatggcatctgcaaggtatttcccggcgtcaaggcgctttcggacatcagcttcgaggcccgccctggcagtgtccatgcgctgatgggggagaacggcgcaggcaaatccacgctgctgaagattctgggcggctcttatcagcccaacagcggcaccctgcagatcggtgagcacagctatcaattcaaatccaccgccgagagtatcgcggcgggtgtggcggtgattcatcaggagctgcatctggtgccggaaatgaccgtcgccgagaacctgctgctcgggcacatgcctaatcgtttcggcttgatcaatcgtggcgccatgtaccgtcgagccggtgagctgctcaaaggtctggccgacgagatcgacccgcgcacgcgcttgggcgacctgtcgctgggccagcggcaactggtggaaatcgccaaggccatgtcgcgcaacgctcatgtcatcgcgttcgacgaacccaccagcagcctgtcggcgcgcgagatcgaccgtttgatggcgatcatcgtgcggctgcgggatgaggggcgggtgattctgtatgtgtcgcatcgtatggaagaaatcttccgggtctgcgatgccgtgaccgtcttcaaggacgggcgctttgtcaaaaccttcgagcagatggctgatctggaccacgaccggctggtgacttgcatggtcggtcgcgatattcaggacatctacaactatcgtccacgtcagcatcaggggccgagcctgcgggtcaccggtctgttggggctgggcttgcaggagccagtgagtttcgccgtgcagaaaggcgaggtgctgggctttttcggtctggtgggcgcaggtcgtaccgagctgtttcgcattctttccgggctgacgcgcagtaccgccggcagcctgcaactggacggtcagccgctgactttgaagtcgccacgtgatgccattgcggccggggtgctgctctgcccggaagaccgcaagaaagaaggcatcgtgccgctgtccagcgtcgcggagaacatcaacatcggtgcgcggccccggcatgtgaatcttggctgcctgatccagggcggctgggagcgggacaacgcgcgtgctcagatcaagtcgatgaacgtcaagacgccatcgcccgagcaacagatcatgtttctgtccggcggtaatcagcaaaaagccattctcggtcgctggctgtcgatgccgatgaaagtcctgctgctggacgagccgacccgcgggatcgatgtcggagccaaatccgagatctacgagatcattcacacattggccgccgatggcattgccgtgatcgtggtgtccagcgacctgatggaagtcatgggcatttccgatcgtattctggtgatgagtgaaggcgccattaccggtgaactcaaccgcgacgaggctgacgagtcgcgacttctgcaattggctctgccacgcacgcgcggctaa

SEQ ID NO: 8817 - protein, 507 aa, Pseudomonas syringae pv
MQQAIEQTATGGALRFNGICKVFPGVKALSDISFEARPGSVHALMGENGAGKSTLLKILGGSYQPNSGTLQIGEHSYQFKSTAESIAAGVAVIHQELHLVPEMTVAENLLLGHMPNRFGLINRGAMYRRAGELLKGLADEIDPRTRLGDLSLGQRQLVEIAKAMSRNAHVIAFDEPTSSLSAREIDRLMAIIVRLRDEGRVILYVSHRMEEIFRVCDAVTVFKDGRFVKTFEQMADLDHDRLVTCMVGRDIQDIYNYRPRQHQGPSLRVTGLLGLGLQEPVSFAVQKGEVLGFFGLVGAGRTELFRILSGLTRSTAGSLQLDGQPLTLKSPRDAIAAGVLLCPEDRKKEGIVPLSSVAENINIGARPRHVNLGCLIQGGWERDNARAQIKSMNVKTPSPEQQIMFLSGGNQQKAILGRWLSMPMKVLLLDEPTRGIDVGAKSEIYEIIHTLAADGIAVIVVSSDLMEVMGISDRILVMSEGAITGELNRDEADESRLLQLALPRTRG

SEQ ID NO: 8818 - DNA, 1524 bp, Pseudomonas syringae pv
  CDS (1)..(1524): transl_table=11
atgcaacaggctatcgagcaatacgccacaggcggtgccttgcgcttcaacggcatcggcaaggtcttccccggcgtcaaggcgctttcggacatcagtttcgaagcgcgccccggcagtgttcacgcattgatgggagagaacggtgccggcaaatccacgctgctgaaaatccttggcgggtcgtatcagcccaacagcggcaccttgcagatcggcgagcagagctatcagttcaagtccaccgccgagagcatcgcggcgggtgtggcggtgattcaccaggagctgcatctggtgccggaaatgaccgttgccgagaacctgctgctcgggcacatgcccaatcgcttcgggctgatcaatcgcggtgcgatgtatcgccgggccggcgagctgctcaagggtctggctgacgaaattgacccgcacacacgcttgggcgacctttcgctggggcagcggcaattggtcgagatcgccaaggccatgtcgcgcaatgctcatgtcatcgcctttgacgagcccaccagcagcctgtcggcgcgtgagatcgaccgactgatggcgatcatcgtgcgcctgcgcgacgagggccgagtgattctttacgtgtcgcatcgcatggaagaaatcttccgcgtctgtgatgcggtgacggtgttcaaggacggacgcttcgtcaagacgttcgagcaaatggccgatctcgaccatgaccgactggtgacctgcatggtcggtcgcgatatccagaacatctacaactaccgccctcgccagcatcaggggccgagcctgcgggttaccggcctgctggggccgggcctgcacgagccggtcaccttcgccgtgcagaagggcgaagtgctgggcttcttcggcctggtcggcgccgggcgtaccgagctgttccggctgctctcggggcttacccgcagctctgcaggcaccctgcaactggacggcaaaccgctgacactcaagtctccccgagatgccatcgaggctggaattctgctctgcccggaggaccgcaagaaagaaggcatcgtgccgctgtccagcgtcgcagagaacatcaacatcggtgcgcgcccccggcacgtgaacctcggttgcctgattcagggtcgctgggagcgtgacaacgcacgcagccagatcaagtcgatgaacgtcaagacgccatcgcccgagcagcagatcatgttcctctccggcggcaatcaacagaaggcgattcttggccgctggctgtcgatgcccatgaaagtcctgctgctggacgagccgactcgcgggatcgacgtcggggccaagtccgagatttacgagatcattcacaacctggccgcggacggtatcgcggtgattgtggtctccagcgatctgatggaagtgatgggcatttcagaccgcattctggtgatgagcgaaggcgcaatcaccggtgaactcaatcgcgacgaggctgacgagtcgcgactcctgcaattggctctgcctcgcacgcgcggctga

SEQ ID NO: 8819 - protein, 507 aa, Pseudomonas syringae pv
MQQAIEQYATGGALRFNGIGKVFPGVKALSDISFEARPGSVHALMGENGAGKSTLLKILGGSYQPNSGTLQIGEQSYQFKSTAESIAAGVAVIHQELHLVPEMTVAENLLLGHMPNRFGLINRGAMYRRAGELLKGLADEIDPHTRLGDLSLGQRQLVEIAKAMSRNAHVIAFDEPTSSLSAREIDRLMAIIVRLRDEGRVILYVSHRMEEIFRVCDAVTVFKDGRFVKTFEQMADLDHDRLVTCMVGRDIQNIYNYRPRQHQGPSLRVTGLLGPGLHEPVTFAVQKGEVLGFFGLVGAGRTELFRLLSGLTRSSAGTLQLDGKPLTLKSPRDAIEAGILLCPEDRKKEGIVPLSSVAENINIGARPRHVNLGCLIQGRWERDNARSQIKSMNVKTPSPEQQIMFLSGGNQQKAILGRWLSMPMKVLLLDEPTRGIDVGAKSEIYEIIHNLAADGIAVIVVSSDLMEVMGISDRILVMSEGAITGELNRDEADESRLLQLALPRTRG

SEQ ID NO: 8820 - DNA, 1536 bp, Ralstonia solanacearum
  CDS (1)..(1536): transl_table=11
atgtcggcctttcttgagtttcgcggtatcagcaaggtgtttcccggcgtgcgcgcgctgtcggaggtgtcgttcggcatcgaatgcggccgcgtgcacggcctgctgggcgagaacggcgcgggcaagtcgacgctgctgaagatcctcggcggcgactaccagcccgatggcgggcagatcgccgtcgagggccggcccgtggcgttcccgaacgcgcgggcggcgctggcggcgggcatcgccgtcatccaccaggagctgcagacggtgcccgagctgacggtgatggacaacctgctgctcggccacctgcccagccgcggcggcttcatccgccagggcgaggcgatggcgtggacgcgcgcgcagctggcgcgcatcggcgtcgatctcgacccgaaggccaggctgaagcacctgtcgatcgggcagcgccagatggtggagatctgcaaggcgatcctgcgcgatgcgcgcgtgatcgcgctcgatgagcccaccagctcgctgtcggtgcgcgagacggacatcctgttccggctggtgaaggacctgcgcgcgcagggccgggcgctgatctacatctcgcaccgcctcgacgagatcttcgcgttatgcgacggctgcaccatcttccgcgacggtcgcaaggtggcggatttccggtcgatggccgacgtcacgcgcgagcagctcgtcgcccagatggtcggccgtcagatcgacgacatcttcggctaccggccgcgcgcgccgggcgacgtccggctgcgggtggagggcctgatgggcccgaagctggccgagccggcgagcttcgcggtgcggcgcggcgagatcgtcgggctgttcggcctggtgggcgcggggcgctcggagctggcgcggctggtgtacggcgccgaccgcaagaccgccggcaccgtcgtgcttgacggcgagccgatccgcatccgcgccgtggccgacgcgattcgccagggcatcgtgctgtgcccggaggaccgcaaggaggaaggcatcatcggctgccgctcggtgtcggagaacatcaacatcagctgccggcgcaaccggcgcccgggttggggcgggttcaacctgttcgtcgatgaccggcaggaagcgaagaccgccgaccactacatcgcccggctgcgcatcaagacgccgcatcgcgaccagcccatccgcctgctctcgggcggtaatcagcagaaggccatcctggcgcgctggctggccgaggacggcatgcgcgtgctgatcatcgacgagccgacgcgcggcatcgatgtcggcgccaagaacgagatctaccaggtgctgtacgagctggccgagcgcggtgtggcggtgctgatgatctccagcgaactgccggagatcctgggcgtggccgaccgcgtgctggtgatgagcgaaggccgcatcgccggcgagctgccgcgcgcgcaggccaccgaacacgccgtgctgaacctggccttgcggccgcggcgcgacccatgcgttgcggcccaggccgcttga

SEQ ID NO: 8821 - protein, 511 aa, Ralstonia solanacearum
MSAFLEFRGISKVFPGVRALSEVSFGIECGRVHGLLGENGAGKSTLLKILGGDYQPDGGQIAVEGRPVAFPNARAALAAGIAVIHQELQTVPELTVMDNLLLGHLPSRGGFIRQGEAMAWTRAQLARIGVDLDPKARLKHLSIGQRQMVEICKAILRDARVIALDEPTSSLSVRETDILFRLVKDLRAQGRALIYISHRLDEIFALCDGCTIFRDGRKVADFRSMADVTREQLVAQMVGRQIDDIFGYRPRAPGDVRLRVEGLMGPKLAEPASFAVRRGEIVGLFGLVGAGRSELARLVYGADRKTAGTVVLDGEPIRIRAVADAIRQGIVLCPEDRKEEGIIGCRSVSENINISCRRNRRPGWGGFNLFVDDRQEAKTADHYIARLRIKTPHRDQPIRLLSGGNQQKAILARWLAEDGMRVLIIDEPTRGIDVGAKNEIYQVLYELAERGVAVLMISSELPEILGVADRVLVMSEGRIAGELPRAQATEHAVLNLALRPRRDPCVAAQAA

SEQ ID NO: 8822 - DNA, 1509 bp, Rhizobium leguminosarum bv
  CDS (1)..(1509): transl_table=11
atgatggctttcctcgaattcagcaatatctccaagggttatcccggtgtgcaggcgctggcgaatgtttccttcaccgtcgagaagggcgccgtccacggcctgatgggcgaaaacggcgccggtaaatcgacgttgatccgcgtactgtccggcgatcaggccgccgatgccggcaacatccttatcgacggcgaggagcagaaatacggatccgtccgcgacgccttccatgccggcgtcatcgtcatccaccaggaactgcagctcgttccggagttgacggtcgccgaaaatctctggctcggacgctttccggccaagggtggcgtcatccattcgaagacgctgatcgagacggtgcggtcgaagctcgaagagatcggcatcgatatcgatccgtcggccaaggtcgcctcgctttcgatcggcgcacggcagatggtcgagatcgccaaggccgtcatgctcgatgcacgggtgattgcgctcgacgagccgacttcctcgctttcctcgcgcgaaagcgaaatcctgttttcgctcatcgacaggctgaaggcgaagggaacggtcattctctacgtctcgcatcgtctcgacgagattttcaggctttgcgacagcctgacggtgctgcgcgacggcaagcttgccgcccaccatccacagatcgccgaaacgacgcgcgaacagatcatctcggaaatggtcggacgcgagatcagcaatgtctggggctggcgcgaacgtccgctcggcggcattcggctggaggtcaacggcctgtcggggccgaggctgcgccatccgatcagcttttccgtccgccagggcgaaatcctcggtttcttcggcctgatcggcgctggccgtagcgagatggcgcggctgctttatggcgccgatgccaggcatcagggccaggtgaccattgacggcgttgccgtttcgccgaacaatccgaaagcggcgatcaatgccggcatggtgctttgccccgaggaccgcaagttcgacggcatcgtccagggccgatcgatcgaagaaaatatcgcgatctcgtcacgccggcacttttcgcccttcggcattctgagcccgagacaagaggcggcgctggcagatcggttcatcgccaagcttcgggtgcgaacaccgtcgcgcaagcaggacatcatcaatctatcgggcggcaaccagcagaaggtcattctcggccgctggctgtccgagcaggggatcaaggtgctggtcatcgacgagccgacgcgcggcatcgatgtcggggcgaaatcggaaatctacgaaattctctatgagcttgcggccggcggcatggcgatcgtggtgatctccagcgagttgcccgaagtcatgggcatctccgatcgcatcatggtgatgtgccagggcagggtggcggccaacgtcgcccgtccggatttcgacgagcgcagcatcctgacggcagcgcttcccgacaagaatgccgcaggcaccctttag

SEQ ID NO: 8823 - protein, 502 aa, Rhizobium leguminosarum bv
MMAFLEFSNISKGYPGVQALANVSFTVEKGAVHGLMGENGAGKSTLIRVLSGDQAADAGNILIDGEEQKYGSVRDAFHAGVIVIHQELQLVPELTVAENLWLGRFPAKGGVIHSKTLIETVRSKLEEIGIDIDPSAKVASLSIGARQMVEIAKAVMLDARVIALDEPTSSLSSRESEILFSLIDRLKAKGTVILYVSHRLDEIFRLCDSLTVLRDGKLAAHHPQIAETTREQIISEMVGREISNVWGWRERPLGGIRLEVNGLSGPRLRHPISFSVRQGEILGFFGLIGAGRSEMARLLYGADARHQGQVTIDGVAVSPNNPKAAINAGMVLCPEDRKFDGIVQGRSIEENIAISSRRHFSPFGILSPRQEAALADRFIAKLRVRTPSRKQDIINLSGGNQQKVILGRWLSEQGIKVLVIDEPTRGIDVGAKSEIYEILYELAAGGMAIVVISSELPEVMGISDRIMVMCQGRVAANVARPDFDERSILTAALPDKNAAGTL

SEQ ID NO: 8824 - DNA, 1527 bp, Rhizobium meliloti
  CDS (1)..(1527): transl_table=11
atgcaggactttctggaattccaatcgatttcaaagggctatcccggcgtccaggcgctgtcggaagtctccttctctgtccgaaagggcgccgttcacgggctgatgggcgaaaacggagcgggaaagtccaccttgatacgggtgctctccggagaccaggcggccgacaccggcgagatccgcataaacggcgagccgcagcactatcgttccgtacgcgatgccttcaacgcaggcgtcatcgtcatccatcaggaactgcagctcgtaccggagctgacggtggccgaaaacctctggctcggccgtttccccggcaaggccggcgtcatcgaccgtcgacaattgatccgcgtcgtctccgacagactcgccgaaatcggtatcgacgtcgatcctgaggcaaaggttgcgtccctgtcgatcggcgagcggcagatggtcgagatcgccaaagcggtgatgaccgacgctcgcgtgattgccttggacgagccgacctcttcgctctcatcgcgagaaagcgaaatcctcttcgccctgatcgacagattgcggtcgaatggtacggtcatcctctatgtctcgcatcggctggacgagatcttccgtctgtgcaacagcctgactgtgctgagagacggccggcttgcagcccatcatccggacatctcgaaagtcggccgcgaacagattatcgctgaaatggtcgggcgcgaaatttcgaatatctggggttggcgcgcccggacgctcggagccgcgaggcttacggtcgaacgcgtttccggcgccaacctgccccagccgatcagctttaccgtccgcgccggcgagattctcggcttctttggcctcatcggcgcgggccgcagcgaaatggcccgtttggtctatggtgccgatcgccgccggcagggcaaggttctggtggacggccttgccgtgccggcggacagcccgcggctgtcgatccgtgccggcgtcgttctgtgcccggaagacaggaagttcgatggcatcgtccaagggcgctccatcgaggagaacatggcgatctcctcccgccgtcatttctcgccattcggggttgtcgacaagggtaaggaggcggagcttgccgagcgtttcatcgcgaagctgcgggtgcgcacgccctcgcgtcaccaggacatcgtcaatctttccggcggaaaccagcagaaggtgatccttggacgctggctgtcggaagagggcgtcaaggtgcttctgatcgacgagccgacccgcggcatcgacgtcggcgcgaaatcggaaatctacgaaattctttacgagcttgcggctcaaggcatggcgatcgtcgttatctctagcgaattgccggaggttatggggattgcggaccgcattctcgtgatgtgcgagggccggatcgcggccgaaatcgaccggagcgattttgacgaacaccggattctcgcagcagcacttccggatgcctcagccacgacggccacccttcccgaacaggtaagctga

SEQ ID NO: 8825 - protein, 508 aa, Rhizobium meliloti
MQDFLEFQSISKGYPGVQALSEVSFSVRKGAVHGLMGENGAGKSTLIRVLSGDQAADTGEIRINGEPQHYRSVRDAFNAGVIVIHQELQLVPELTVAENLWLGRFPGKAGVIDRRQLIRVVSDRLAEIGIDVDPEAKVASLSIGERQMVEIAKAVMTDARVIALDEPTSSLSSRESEILFALIDRLRSNGTVILYVSHRLDEIFRLCNSLTVLRDGRLAAHHPDISKVGREQIIAEMVGREISNIWGWRARTLGAARLTVERVSGANLPQPISFTVRAGEILGFFGLIGAGRSEMARLVYGADRRRQGKVLVDGLAVPADSPRLSIRAGVVLCPEDRKFDGIVQGRSIEENMAISSRRHFSPFGVVDKGKEAELAERFIAKLRVRTPSRHQDIVNLSGGNQQKVILGRWLSEEGVKVLLIDEPTRGIDVGAKSEIYEILYELAAQGMAIVVISSELPEVMGIADRILVMCEGRIAAEIDRSDFDEHRILAAALPDASATTATLPEQVS

SEQ ID NO: 8826 - DNA, 1515 bp, Shigella flexneri
  CDS (1)..(1515): transl_table=11
atgcaacagtctaccccgtatctctcatttcgcggcatcggtaaaacgtttcccggcgttaaggcgctgacggatattagttttgactgctatgccggtcaggttcatgcgttgatgggtgaaaatggcgcaggaaaatcaactctcttaaaaatcctcagcggcaactatgcgccaaccacgggttctgtagtgattaatgggcaggaaatgtccttttccgacacgaccgcagcacttaacgcgggtgtggcgattatttaccaggaactgcatctcgtgccggaaatgaccgtcgcggaaaacatctatctcggccagctgccgcataaaggcggcattgtgaatcgctcattgctgaattatgaggcgggtttacaacttaaacatcttggtatggatattgacccggacacgccgctgaaatatctcgccattggtcagtggcagatggttgaaatcgccaaagcgctggcgcgtaacgctaaaattatcgcctttgatgagccaaccagctccctttctgcccgcgaaatcggcaatcttttccgcgttattcgtgaactgcgaaaagaggggcgggtgatcttatacgtttctcaccgtatggaagaaatatttgccctcagcgatgccatcactgtctttaaagatggacgttatgtcaaaacctttaccgatatgcagcaggttgaccacgacgcgctggtgcaggcgatggtcgggcgcgacattggcgatatctacggctggcaacctcgtagttatggcgaggagcgcctgcgtcttgatgctgtgaaagcactaggcgtgcgtacgccaataagtctggcggttcgcagtggtgaaattgttgggctgtttggtctggtaggggcggggcgtagcgaattaatgaaaggcttgtttggcgggacgcaaatcaccgccggtcaggtttatatcgaccaacagccgatcgatattcgtaaaccgagccacgccattgccgcaggcatgatgctctgcccggaagctcgcaaagcggaaggcattattcccgtgcactccgttcgcgacaatatcaacatcagtgccagacgcaaacatgtgctcggcggttgtgtaatcaacaacagttgggaagaaaacaatgccgatcagcacattcgttcgctcaacatcaaaacgccgggcgcggagcaactgatcatgaatctctcaggcggaaatcagcaaaaagccattctgggccgctggttatcggaagagatgaaggtcattttgctggatgaacctacgcgcggcattgatgttggcgctaagcacgaaatatataacgtaatttatgcgctggcggcgcagggcgtggcggtgctgtttgcctccagcgacttacctgaagtcctcggcgttgccgaccggattgtggtgatgcgggaaggcgaaatcgccggtgaattgttacacgagcaggcagatgagcgtcaggcactgagccttgcgatgcctaaagtcagccaggcagttgcctga

SEQ ID NO: 8827 - protein, 504 aa, Shigella flexneri
MQQSTPYLSFRGIGKTFPGVKALTDISFDCYAGQVHALMGENGAGKSTLLKILSGNYAPTTGSVVINGQEMSFSDTTAALNAGVAIIYQELHLVPEMTVAENIYLGQLPHKGGIVNRSLLNYEAGLQLKHLGMDIDPDTPLKYLAIGQWQMVEIAKALARNAKIIAFDEPTSSLSAREIGNLFRVIRELRKEGRVILYVSHRMEEIFALSDAITVFKDGRYVKTFTDMQQVDHDALVQAMVGRDIGDIYGWQPRSYGEERLRLDAVKALGVRTPISLAVRSGEIVGLFGLVGAGRSELMKGLFGGTQITAGQVYIDQQPIDIRKPSHAIAAGMMLCPEARKAEGIIPVHSVRDNINISARRKHVLGGCVINNSWEENNADQHIRSLNIKTPGAEQLIMNLSGGNQQKAILGRWLSEEMKVILLDEPTRGIDVGAKHEIYNVIYALAAQGVAVLFASSDLPEVLGVADRIVVMREGEIAGELLHEQADERQALSLAMPKVSQAVA

SEQ ID NO: 8828 - DNA, 1521 bp, Vibrio parahaemolyticus
  CDS (1)..(1521): transl_table=11
atgatcatgataaattccccttcttaccttgagttttgcaacatatcgaagcatttcccaggagttaaggcattgagcaacattagttttcgcgccaacaaaggcagtattcatgcgctaatgggtgaaaacggtgcaggtaaatcaacgttgcttaaaactctcagtggcttacaccaacctactgaaggcgagttggtcgtcgatggtaaagctttggtgttcaactcagcgactgatgcgcttgagcaaggtatcgccattatttaccaagagctgaacttggtacctgagcttagtgtggcagaaaacatctacctaggtcagttgccaacaaaaggtggcagtgtagatgtggaaacattgaacgcccgagcgcgagaacagctaaaacgtttgggggaggattttgatccttctcgcccacttaaagagttttctatcggccagtggcaaatggtggaaattgccaaagcactaagccgcaatgctcagattatcgcgtttgatgaaccaaccagcagtttgtctcaacgcgagattcaaaacttattcaaagttattcgcgaattgcgcgatgacggcaaaatcattctgtacgtttcccatcgtatggaagagatcttcgatttgtgcgatgccattaccatcttcaaagatgggacacatgtacaaacatttgacgacatgaccgacttaacccatgaaaaattggttgagctgatggtcggtcgtgaaatcaacgatatctacaactaccgttcgcgttctctcggcgaaagtggcctacgcattgaaaaccttgaaggaaaagggttaacccaaccagtctcactcgatattcgtcaaggtgaaattctgggtctgtttggtttagttggggcagggcgaacagaactaacccgtctcattttcggcgcggaaaaagcgcaagccggacaaatttacattcatgggcagcccatcagtgtcagaagtccacaagatgcgattcgcgcaggcattacgttatgcccagaagaccgtaaagcggacgctatcgttcctattctctcggtggaagagaacaccaacatcagtgctcgtccatggaatttgaaattgggcggtttgatcgatttcaaatgggaaagagacaacgcagagcagcaacgtaaggctttgaacgttaaaaccgcctcattacaacaggctatagggcagttgtctggtggtaaccaacaaaaagtgattctaggtcgctggctctccaccgatatgagtgtgattttgttggacgagccaacacgaggcattgacgttggtgcgaaatcagagatctacgaactgattttcaatcttgctgagcgcggtgtcactgtgctggtggtgtcgagtgatttgccagaagttcttggtatatccgatcgcgtaatggtgatgaaagaaggtgcggtaacaggtgaactacagcgccatgagtttaaagaacaaactgctttgagtttagccatgctaggcaacaaccaagctgctgcataa

SEQ ID NO: 8829 - protein, 506 aa, Vibrio parahaemolyticus
MIMINSPSYLEFCNISKHFPGVKALSNISFRANKGSIHALMGENGAGKSTLLKTLSGLHQPTEGELVVDGKALVFNSATDALEQGIAIIYQELNLVPELSVAENIYLGQLPTKGGSVDVETLNARAREQLKRLGEDFDPSRPLKEFSIGQWQMVEIAKALSRNAQIIAFDEPTSSLSQREIQNLFKVIRELRDDGKIILYVSHRMEEIFDLCDAITIFKDGTHVQTFDDMTDLTHEKLVELMVGREINDIYNYRSRSLGESGLRIENLEGKGLTQPVSLDIRQGEILGLFGLVGAGRTELTRLIFGAEKAQAGQIYIHGQPISVRSPQDAIRAGITLCPEDRKADAIVPILSVEENTNISARPWNLKLGGLIDFKWERDNAEQQRKALNVKTASLQQAIGQLSGGNQQKVILGRWLSTDMSVILLDEPTRGIDVGAKSEIYELIFNLAERGVTVLVVSSDLPEVLGISDRVMVMKEGAVTGELQRHEFKEQTALSLAMLGNNQAAA

SEQ ID NO: 8830 - DNA, 1554 bp, Burkholderia sp
  CDS (1)..(1554): transl_table=11
atgtcgcgatctgagtcgccccgcccgttgctcgagatgcgcggaatcagcaagacgttcccggccgtgcgtgcgctcgacaacgtcagcctgaccgtctatcccggcgagatccactcgctgatgggtgaaaacggcgcgggcaaatcgacgctgatgaaaatcctgtcgggcgcgtaccgcgccgacgccggcggcgagatcctgatcgacggcacccgcatcgacatcgacggcccgcttgccgcgcgcgatgcgggcgtcgcggtgatctaccaggagctgtgcctgtcgccgaacctgagcgtcgcggaaaacatctacatcggccgtgaactgcggcgcggcaaccggcgctggggcacgatcgaccgcgcggcgatggcgcgcggctgcgaggacgtgctcgcgcgcctgagcgcgtcgttcggtcccgacacgctcgtcgacacgctgtcgatcgcggagcagcagctcgtcgagatcgcgcgcgccgtgcacacccgtgcgcgcatcctcgtgatggatgagccgaccacgccgctgtcgtcgcgcgaaaccgaacacctgttccgcctgattcgccagttgcgcgaggaaggtctcgcgatcatctacatcagccaccggatggcggagatctacgaattgtccgaccgggtgtcggtgctgcgcgacggcacgtacgtcggcacgctcgaacgcgcatcgttgtcggccgagcgtctcgtcgcgatgatggtcggccgcgacatctccggcttctacaagaaggaacacgcgccgtacgaccccggccacctgctgctgtcggtccgcgacatcgccgacgacgcacgcgtgcgcggctgcagcctcgacctgcacgccggcgaagtgctcggcatcgcggggctcgtcggcgcgggccgcaccgagctcgcgcggctgatcttcggcgccgaaccgcgcgtgcgcggcgacgtgaaggtcggcgaacgcacgttcggcgcgcactcgccgcgcgacgcgatcgatgccggcctcgtctacctgaccgaagaccgcaagcgccagggcctgttcctcgacatgagcgtgcgcgacaacatcaacatttcggtctgcaaccgcgacgcgcggctcggttcgctcgacctcgcgcgcggcgccgaacgcgcgcgcgacgccattgcatcgctgtcgatccgcgtacccgatgcgaacgtcaacgtcggcgcgctgtcgggcggcaaccagcagaaagtgctgctgtcgcgcctgctcgagacgaagccgcgcgtgctgatcctcgatgaaccgacgcgcggcgtcgacatcggcgcgaaatccgagatctaccggatcatcaacgaattggcacgggccggtgttggcgtgatcgtgatctcgagcgaactgccggagatcatcggtgtggccgaccgcgtgctcgtgatgcgcgaaggcgagatcgccggagaactcggcggctacacgcagacacccatcacgcaggaagccatcatcgcgctcgccaccggctcgcaagccgagctcgccgacgcgcactga

SEQ ID NO: 8831 - protein, 517 aa, Burkholderia sp
MSRSESPRPLLEMRGISKTFPAVRALDNVSLTVYPGEIHSLMGENGAGKSTLMKILSGAYRADAGGEILIDGTRIDIDGPLAARDAGVAVIYQELCLSPNLSVAENIYIGRELRRGNRRWGTIDRAAMARGCEDVLARLSASFGPDTLVDTLSIAEQQLVEIARAVHTRARILVMDEPTTPLSSRETEHLFRLIRQLREEGLAIIYISHRMAEIYELSDRVSVLRDGTYVGTLERASLSAERLVAMMVGRDISGFYKKEHAPYDPGHLLLSVRDIADDARVRGCSLDLHAGEVLGIAGLVGAGRTELARLIFGAEPRVRGDVKVGERTFGAHSPRDAIDAGLVYLTEDRKRQGLFLDMSVRDNINISVCNRDARLGSLDLARGAERARDAIASLSIRVPDANVNVGALSGGNQQKVLLSRLLETKPRVLILDEPTRGVDIGAKSEIYRIINELARAGVGVIVISSELPEIIGVADRVLVMREGEIAGELGGYTQTPITQEAIIALATGSQAELADAH

SEQ ID NO: 8832 - DNA, 1554 bp, Burkholderia thailandensis
  CDS (1)..(1554): transl_table=11
atgcagcgttctgatccgtcccgtccgctgctcgagatgcgcggcatcagcaagacgttcccggccgtgcgcgcgctcgccggcgtgagcctcaccgtccatccgggcgagatccattcattgatgggcgagaacggcgcgggcaagtcgacgctcatcaagatcctgtcgggcgcgtatcaggccgatcccggcggcgagatcctgatcgacggcgcgccgatctcgatcgacggtccgctcgccgcgcgcgacgcaggcgtcgccgtgatctaccaggagctgtgcctcgcgccgaatctgaccgtcgcggagaacatctacgtcggccgcgagctgcgccgcggcaacggccgctggggcacgatcgaccgcgccgcgatggcgcgcggctgtcaggacgtgctcgcgcggctcggcgccgatttcgggccgaacacgctcgtcggcacgctgtcgatcgccgagcagcagctcgtcgagatcgcgcgcgcggttcatacgaaagcgcgcatcctcgtgatggacgagccgacgacgccgctttcgtcgcgcgaaaccgagaacctgttccggctcattcgccagttgcgcgccgaagggctcgcgatcatctacatcagccaccggatggcggagatctacgagctgtccgaccgcgtgtcggtgctgcgcgacggcgcgtacgtcggcacgctcgatcgcgattcgctgtcggccgagcggctcgtcggcatgatggtcggccgcgatatttcgggcttctacaagaaagcgcatgcgccgtacgatccgggcaacctgctgctgtcggtgcgcgacgtcgcggacggcgggcgcgtgcgcggctgcagcctcgatctgcacgcgggcgaagtgctcggcatcgcgggcctcgtcggcgcgggccgcaccgagctcgcgcggctcatcttcggcgccgagccgcgcgtgcgcggcgaagtgaagctcggcggcaaggcgttcggcgggcactccccgtgcgacgcgatcgacgccgggctcgtctatctgaccgaagaccgcaagcgccaggggctgttcctcgacatgagcgtgcgcgacaacatcaacatctccgtgtgcggacgcgacgcgcggctcggcgcgctcgatctggcgcgcggcgcgcagcgcgcgcgcgatgcgatcgccgcgctgtcgattcgcgtgccgcatgcaaacgttagtgtcggcgcgctgtccggcggcaaccagcagaaagtgctgctgtcgcgcctgctggaaacgaagccgcgcgtgctgatcctcgacgagccgacgcgcggcgtcgacatcggcgcgaagtccgagatctaccggatcatcaacgatctcgcgcgcgccggcgtcggcgtgatcgtgatctcgagcgagctgccggagatcatcggcgtcgcggatcgcgtgctcgtgatgcgcgaaggccgcgtggccggcgagctcggcggccatacgggcgcgccgatcacgcaggaggcgatcatcgcgctcgccaccggctccagcaccgaggcggcggccgcgcactga

SEQ ID NO: 8833 - protein, 517 aa, Burkholderia thailandensis
MQRSDPSRPLLEMRGISKTFPAVRALAGVSLTVHPGEIHSLMGENGAGKSTLIKILSGAYQADPGGEILIDGAPISIDGPLAARDAGVAVIYQELCLAPNLTVAENIYVGRELRRGNGRWGTIDRAAMARGCQDVLARLGADFGPNTLVGTLSIAEQQLVEIARAVHTKARILVMDEPTTPLSSRETENLFRLIRQLRAEGLAIIYISHRMAEIYELSDRVSVLRDGAYVGTLDRDSLSAERLVGMMVGRDISGFYKKAHAPYDPGNLLLSVRDVADGGRVRGCSLDLHAGEVLGIAGLVGAGRTELARLIFGAEPRVRGEVKLGGKAFGGHSPCDAIDAGLVYLTEDRKRQGLFLDMSVRDNINISVCGRDARLGALDLARGAQRARDAIAALSIRVPHANVSVGALSGGNQQKVLLSRLLETKPRVLILDEPTRGVDIGAKSEIYRIINDLARAGVGVIVISSELPEIIGVADRVLVMREGRVAGELGGHTGAPITQEAIIALATGSSTEAAAAH

SEQ ID NO: 8834 - DNA, 1554 bp, Streptomyces coelicolor
  CDS (1)..(1554): transl_table=11
gtgagcagccgcagtccggacgagttgctgcgcatcgagggcatccgcaagaccttccccggcgtggtcgcgctcgacagcgtcgacttcgacctgcgccggggcgaggtgcacgtgctcctcggtgagaacggcgcgggcaagagcaccctcatcaagatgctctccggcgcctacacgcccgacgccgggcggatcctggccggtggcgaggaggtgcgcatccacggtgcgcaggactccgagcgcctcgggatcgccaccatctaccaggagttcaacctggtccccgacctgacggtggccgagaacatcttcctggggcgccagccccgccggctcggcatgatcgaccggaagcggatggacgccgacgcggaggtgctgctgaagcgggtgggggtcaacgtgtctccccgtgcgcgggtgcgtgaactcggcatcgcgcggctccagatggtcgagatcgccaaggcgctcagcctcgacgcgcgcgtgctcatcatggacgagccgaccgccgtactgacctccgaggaggtcgacaagctgttcgccatcgtgcggcggctgcgcgaggacggcgtcgggatcgtcttcatcacccaccacctggaggagatcgccgcgctcggcgaccgggtcaccgtcatccgggacggccggagcgtcgggcaggtgcccgcctccacgcccgaggacgagctggtccggctcatggtggggcggtcgatcgagcagcagtacccgcgcgagcggaccgacgccggtgaggcgctgctcaaggtggaggggctgacgagggacggtgtcttccacgacgtcggcttcgaggtgcgggccggtgaggtcgtcggcatcgcggggctggtcggggccgggcggacggaggtggtgcgggcggtgttcggcgccgatccgtacgacgccgggaccgtgcacgtcgccggtgcgccgctgcggcggcacgacgtgaacgccgccatggccgccgggatcgggctggtgcccgaggaccgcaaggggcaggggctcgtcctcgacgcctccgtcgaggagaacctcgggctcgtcacgctccggtccaccgcccgcgccgggctcgtcgacctcaaggggcagcacacggcggccgagcggatcgccggacagctcggcgtgcggatggccgggctcggccagcacgtgcgcacgctgtccggcggcaaccagcagaaggtcgtcatcggcaagtggctgctggcgaacaccaaggtgctgatcctcgacgagccgacgcgcggcatcgacgtcggcgccaaggtcgagatctaccagctcatcaacgaactgacggccgccggtgccgccgtgctcatgatctccagcgatctgccggaggtgctcggcatgagcgaccgcgtggtcgtcatggcgcaggggcgcgtcgcgggtgaactcaccgccgaacaggccacccaggacgccgtgatggcgctcgccgtcagtacgcacaccggcaactccccgcacagcggcggaacggatggaacggaggcctcccgtggccactga

SEQ ID NO: 8835 - protein, 517 aa, Streptomyces coelicolor
MSSRSPDELLRIEGIRKTFPGVVALDSVDFDLRRGEVHVLLGENGAGKSTLIKMLSGAYTPDAGRILAGGEEVRIHGAQDSERLGIATIYQEFNLVPDLTVAENIFLGRQPRRLGMIDRKRMDADAEVLLKRVGVNVSPRARVRELGIARLQMVEIAKALSLDARVLIMDEPTAVLTSEEVDKLFAIVRRLREDGVGIVFITHHLEEIAALGDRVTVIRDGRSVGQVPASTPEDELVRLMVGRSIEQQYPRERTDAGEALLKVEGLTRDGVFHDVGFEVRAGEVVGIAGLVGAGRTEVVRAVFGADPYDAGTVHVAGAPLRRHDVNAAMAAGIGLVPEDRKGQGLVLDASVEENLGLVTLRSTARAGLVDLKGQHTAAERIAGQLGVRMAGLGQHVRTLSGGNQQKVVIGKWLLANTKVLILDEPTRGIDVGAKVEIYQLINELTAAGAAVLMISSDLPEVLGMSDRVVVMAQGRVAGELTAEQATQDAVMALAVSTHTGNSPHSGGTDGTEASRGH

SEQ ID NO: 8836 - DNA, 1572 bp, Thermotoga maritima
  CDS (1)..(1572): transl_table=11
atgatgctcaacacagaaaaagaaagggaagtattgctggaagccagaaatattaccaaaacttttccgggagtaatcgctgtcaataatgtaactcttcaaatatataaaggggaagtttgcgctctggttggagaaaacggagctggcaaatccactctcatgaagattttggccggggtatatccggattacgagggacagatctttctggaaggaaaagaggttcgattcaggaatccaagagaagcccaggagaatggaatcgccttaattcctcaagaactagatcttgtacctaatcttagttcagctgaaaatatctttctctccagagaaccggtcaacgagtttggtgtgattgaataccagaaaatgtttgaacaagcttcaaaattattttcaaagctaggagttaatatcgatccaaaaacaaaagtggaagatctgagcactagtcaacaacaaatggtagctattgctaaagcactttcacttgacgccaaaataatcatcatggacgaaccaacctctgccataggtaaacgtgaaactgaacaactgttcaatattataagatctttaaaaaatgaaggaaaatctgtgatttacatttctcatcgattagaggaaatattcgaaatagctgacagggttgttgtgatgagagatggtagaaaggtaggagagggtcccatagaagaatttgatcatgataaacttgttagattaatggtaggaagaagtatagatcagttttttataaaagaacgtgcgacaataacagacgaaattttcagagtggaaggtattaaactgtggagtttggacagaaagaaacttttagttgatgatgtgagtttttacgtcaggaagggagaagtattgggaatatatggattagtcggcgctggaagaacagaacttttggaggctatattcggcgcccatccaggtcgtacagaaggaaaggtattcattggaggaaaagaaataaaaattcactctcctagggacgctgtaaagaatgggataggattagtcccagaggatagaaaaactgcaggactgattcttcaaatgtctgttttgcataatataaccctcccttcagtggtaatgaaacttatcgttagaaaatttggattaatagatagtcaactcgaaaaagaaatcgttcgttcgtttatagaaaaattaaacattaaaactccttcaccctatcaaatcgtggagaacctcagtggaggaaaccagcaaaaagtagttctggcaaaatggcttgcaataaaaccaaaggtacttctcttagatgaacctaccagaggaattgatgtaaacgcaaagagtgagatttacaaactcataagtgaaatggctgtttcaggaatgggtgtagttatggtttcctctgaacttccagagatacttgccatgtccgacagaattcttgttatgtctgaggggcggaaaacagctgagtttctcagagaagaagtcaccgaggaagatcttctgaaagcagcaatccccagaagtgtgaaggtagaaacaacacaaagggaggagtga

SEQ ID NO: 8837 - protein, 523 aa, Thermotoga maritima
MMLNTEKEREVLLEARNITKTFPGVIAVNNVTLQIYKGEVCALVGENGAGKSTLMKILAGVYPDYEGQIFLEGKEVRFRNPREAQENGIALIPQELDLVPNLSSAENIFLSREPVNEFGVIEYQKMFEQASKLFSKLGVNIDPKTKVEDLSTSQQQMVAIAKALSLDAKIIIMDEPTSAIGKRETEQLFNIIRSLKNEGKSVIYISHRLEEIFEIADRVVVMRDGRKVGEGPIEEFDHDKLVRLMVGRSIDQFFIKERATITDEIFRVEGIKLWSLDRKKLLVDDVSFYVRKGEVLGIYGLVGAGRTELLEAIFGAHPGRTEGKVFIGGKEIKIHSPRDAVKNGIGLVPEDRKTAGLILQMSVLHNITLPSVVMKLIVRKFGLIDSQLEKEIVRSFIEKLNIKTPSPYQIVENLSGGNQQKVVLAKWLAIKPKVLLLDEPTRGIDVNAKSEIYKLISEMAVSGMGVVMVSSELPEILAMSDRILVMSEGRKTAEFLREEVTEEDLLKAAIPRSVKVETTQREE

SEQ ID NO: 8838 - DNA, 1554 bp, Anabaena variabilis
  CDS (1)..(1554): transl_table=11
atgacaacaaatattaaaacagatttttctccacctgcgactgccacccctgtattagaaatgcaggggattgcgaaacgatttcatggtgttccggctttgcaaggtgttaatctcaccatttatccgggggaagttcacgccctcatgggtgaaaatggggctggtaaaagtacattgatgaaaattctcgctggggcttatattgccgatgaaggggagattcgcatcaatggtaaaggggtgaaaattaccgatccggggacagcacgccaagccggtatcaatttgatttatcaagaactcaatgttgcacccaatttaaccgttaccgaaaacatttttatggggagcgagttaacacggggtcaatttttagaccgcaaggctatggaactggaagcccaacaagtgttagcaagcttgggggctagctttgcaccaactgatattgttggcacattagcgatcgccgaacaacagcaagtagaaattgctagagccttgaaagacaatagccggattttggtaatggatgaaccaacagccgcactgtctgaccgtgagacggagcgtttgtttgaggtgattcgcaaactccgcaatgatgggattgccattatctacatcagtcatcgcatggaagaaatctatgccctagctgaccggattagtgtactacgggatggtcaatacatcggtagtttaacccgtgaggagatttctccccagcgattggtacagatgatggtcggtcgctccatgcaggacttttatgaacatcaaaggcaaagcaatcctggcccagtggtcctagaagtgagaaatattagtgatgggcgcaaagtccaaccagctagttttcaactgcgggctggggaaattctcggactagcggggttagttggtgcaggacgcacagaggtatcccggctgatttttggcgcagatcgcaaagtaagcggtgaagtatttttaaatggcaaaaaactagagattcattcccccagtgatgcgatcgccgtcggtattggctatgtcccagaagaccgcaaagaccaaggtttatttctggagatgagttcccgtaagaacattggactcaatagactcaagcaagatgctaatttgggcatcgttaactggggttcagtgaataagattgccacagatgcagtagaaaacttccatatccgcctggcgaacttagaaattagagccgtggatctttccggtgggaatcaacaaaaactgctgctggcgcgttggttagccattaaccccagagtcttgatgctagatgagccgacaaggggcgtagatatcggtgctaaaagcgaaatttaccggattatcagcgacctatcagcccaaggggtagccattctcatggtttccagcgaactaccagagattgtgggcttgagcgatcgcgttttagtgatgcgagaaggacaactggtaggtgaactagacaatagcatcggcaaagaaatcacccaagaaaacattatgcactatgcaactggagcatcggaggtaaccgcatcatga

SEQ ID NO: 8839 - protein, 517 aa, Anabaena variabilis
MTTNIKTDFSPPATATPVLEMQGIAKRFHGVPALQGVNLTIYPGEVHALMGENGAGKSTLMKILAGAYIADEGEIRINGKGVKITDPGTARQAGINLIYQELNVAPNLTVTENIFMGSELTRGQFLDRKAMELEAQQVLASLGASFAPTDIVGTLAIAEQQQVEIARALKDNSRILVMDEPTAALSDRETERLFEVIRKLRNDGIAIIYISHRMEEIYALADRISVLRDGQYIGSLTREEISPQRLVQMMVGRSMQDFYEHQRQSNPGPVVLEVRNISDGRKVQPASFQLRAGEILGLAGLVGAGRTEVSRLIFGADRKVSGEVFLNGKKLEIHSPSDAIAVGIGYVPEDRKDQGLFLEMSSRKNIGLNRLKQDANLGIVNWGSVNKIATDAVENFHIRLANLEIRAVDLSGGNQQKLLLARWLAINPRVLMLDEPTRGVDIGAKSEIYRIISDLSAQGVAILMVSSELPEIVGLSDRVLVMREGQLVGELDNSIGKEITQENIMHYATGASEVTAS

SEQ ID NO: 8840 - DNA, 1554 bp, Burkholderia pseudomallei
  CDS (1)..(1554): transl_table=11
atgcagcgttctgatccgccccgcccgttgctcgagatgcgcggcatcagcaagacgttcccggccgtgcgcgcgctcgccggcgtgagcctcaccgtccatccgggcgaggtccattcgctgatgggcgagaacggcgcgggcaagtcgacgctcatgaagatcctgtcgggcgcgtatcaggccgatcccggcggcgagatcctgatcgacggccggccgatctcgatcgacgggccgctcgccgcgcgcgatgcgggcgtcgcggtgatctatcaggagctctgcctcgcgccgaacctgagcgtcgcggagaacatccatgtcggccgcgagctgcgccgcggcaacggccgccggggcacgatcgaccgcgccgcgatggcgcgcggctgtcaggacgtgctcgagcggctcggcgcggatttcgggccgaacacgctcgtcggcacgctgtcgatcgccgagcagcagctcgtcgagatcgcgcgcgccgttcacacccgggcgcgcatcctcgtgatggacgaaccgacgacgccgctgtcgtcgcgcgaaaccgataacctgttccggctgatccgccagttgcgcgccgaagggctcgcgatcatctacatcagccaccggatggcggaaatctacgagctgtccgaccgcgtctcggtgctgcgcgacggcgcgtacgtcggcacgctcgagcgcgacgcgctgtcggccgagcggctcgtcggcatgatggtcggccgcgatatttcgggcttctacaagaaagcgcacgcgccctacgatccgggcaacctgctgctgtcggtgcgcgacatcgcggacggcgcgcgcgtgcgcggctgcagcctcgatctgcacgcgggcgaagtgctcggcatcgcgggtcttgtcggcgcgggccgcaccgagctcgcgcggctcatcttcggcgccgagccgcgcgtgcgcggcgaggtgacgctcgccggcaaggcgttcgccgcgcattcgccgcgcgaggcgatcgacgccgggctcgtgtatctgaccgaggaccgcaagcgccagggcctgttcctcgacatgagcgtgcgcgagaacatcaacatctccgtgtgcgggcgcgacgcgcggctcggcgcgctcgatctcgcgcgcggcgcgcagcgcgcgcgcgacgcgatcgccgcgctgtcgattcgcgtgccgcatgcgaacgtgaacgtcggcgcgctgtcgggcggcaaccagcagaaggtgctgctgtcgcgcctgctggagacgaagccgcgcgtgctgattctcgacgagccgacgcgcggcgtcgacatcggcgcgaaatccgagatctaccggatcatcaacgagctcgcgcgcgccggcgtcggcgtgatcgtgatctcgagcgagctgccggagatcatcggcgtggccgaccgcgtgctcgtgatgcgcgaaggccgcattgccggcgagctcggcgggcgcacggacgcgccgatcacgcaggaggcgatcatcgcgctcgccaccggctcccgcaccgaagcgtcggccgcgcactga

SEQ ID NO: 8841 - protein, 517 aa, Burkholderia pseudomallei
MQRSDPPRPLLEMRGISKTFPAVRALAGVSLTVHPGEVHSLMGENGAGKSTLMKILSGAYQADPGGEILIDGRPISIDGPLAARDAGVAVIYQELCLAPNLSVAENIHVGRELRRGNGRRGTIDRAAMARGCQDVLERLGADFGPNTLVGTLSIAEQQLVEIARAVHTRARILVMDEPTTPLSSRETDNLFRLIRQLRAEGLAIIYISHRMAEIYELSDRVSVLRDGAYVGTLERDALSAERLVGMMVGRDISGFYKKAHAPYDPGNLLLSVRDIADGARVRGCSLDLHAGEVLGIAGLVGAGRTELARLIFGAEPRVRGEVTLAGKAFAAHSPREAIDAGLVYLTEDRKRQGLFLDMSVRENINISVCGRDARLGALDLARGAQRARDAIAALSIRVPHANVNVGALSGGNQQKVLLSRLLETKPRVLILDEPTRGVDIGAKSEIYRIINELARAGVGVIVISSELPEIIGVADRVLVMREGRIAGELGGRTDAPITQEAIIALATGSRTEASAAH

SEQ ID NO: 8842 - DNA, 1509 bp, Chromobacterium violaceum
  CDS (1)..(1509): transl_table=11
atgcaagtgaccatgcgcggcatcagcaaggctttcgggccggtcaaggtgctggagaacgtggagttcacgctgcgcggcggcgagatccacgcgctgatgggcgagaacggcgccggcaagtccacgctgatgaagatactcagcggcgtgcaccgcgccgacgccggcgagatcctgctggacggccgcaaggccgaactgaggagcaccgaggcggcggaagcggccggcatcgccatcatccaccaggaattgaacctgattccgcagctgtcggtgatggagaacctgtttctcggccgcgagccgtcccgcttcggcatcatcgactacgcggcgatgcggcgcgaggcgcgggcgcagctggaggcgctgggcgccggcggcatcgatccggacgccgaggccggcagcctgtccatcggccagcagcagatggtggagatcgccaaggcgctggcgctgaacgcccgcgtgctgatcatggacgagccgacggcggcgctcaccgagcgcgagatcgaccggctgttcgagctgatggcccagctgagggaaaacggcgcggccatcgtctacgtctcgcaccggatggaagagatcttccgcgtctgcgaccgcatcagcgtgctgcgcgatggctgcttcgtcggcgagcgcgaaatcgcccgcaccgatttcgacgaagtggtgcggatgatggtggggcgcgagatcggcgaccgctatccgaagcgcgaggccgcgccgggcgaggtgaggctgaaggtggagaacctggccgacgagaacatgatcgccggcatcggcttcgaggtgcgcgccggcgaggtgctgggcatcgccgggctgatgggctcgggacgcagcgacatcctgaagacgctgttcggcgccaagcgccgcaccgccggccgcgtcgagctggacggtaaggaattgaaagtggccgcgccgggcgacgccatcgccgccggcctgggcttcgtgcccgaagaccgcaaaagcaaggggctggtgctgggcatgtcgctgcgcgaaaacgcgaccctggtgcatctggaccagtacgcccggctgggcgtggtcagcgccgccgaggaaaagcgggcggtggacggcttgatcgctcagctgcgcatccgcgcccgcgacgccgagctcgacgtcaagtcgctgtccggcggcaaccagcagaaagtggtgttcgccaaatggctggcgaatccgcccaaggtgctgctgctggacgagccgacgcgcggcgtcgacgtcggcggcaaggccgagatctaccacatcgtcaaccagctggccgccgccggcaccgccatcgtgatggtgtcgtccgagctgccggaagtgctggcgctgagcaaccgcatcctggtgctgcacgaaggccgccaggccggcatcttcgacgccgccggctgcagccaggaaaccctgatggccgccgcgaccggcggcgccgttcactccgaaaccaggaagcaagcatga

SEQ ID NO: 8843 - protein, 502 aa, Chromobacterium violaceum
MQVTMRGISKAFGPVKVLENVEFTLRGGEIHALMGENGAGKSTLMKILSGVHRADAGEILLDGRKAELRSTEAAEAAGIAIIHQELNLIPQLSVMENLFLGREPSRFGIIDYAAMRREARAQLEALGAGGIDPDAEAGSLSIGQQQMVEIAKALALNARVLIMDEPTAALTEREIDRLFELMAQLRENGAAIVYVSHRMEEIFRVCDRISVLRDGCFVGEREIARTDFDEVVRMMVGREIGDRYPKREAAPGEVRLKVENLADENMIAGIGFEVRAGEVLGIAGLMGSGRSDILKTLFGAKRRTAGRVELDGKELKVAAPGDAIAAGLGFVPEDRKSKGLVLGMSLRENATLVHLDQYARLGVVSAAEEKRAVDGLIAQLRIRARDAELDVKSLSGGNQQKVVFAKWLANPPKVLLLDEPTRGVDVGGKAEIYHIVNQLAAAGTAIVMVSSELPEVLALSNRILVLHEGRQAGIFDAAGCSQETLMAAATGGAVHSETRKQA

SEQ ID NO: 8844 - DNA, 1506 bp, Clostridium perfringens
  CDS (1)..(1506): transl_table=11
atgggtgaaagaacaccaatgctaaaaatggtaggtgtatcaaaatcctttccaggagtcaaagctttagataatgttagtttaatggcttatggtggagaagttactgctttaatgggagaaaatggagcagggaaatcaactttaatgaaaatactaagtggagtatataaaaaagatgaaggtaagatattcattgaaggaagggaagtagaagtaaagggaattaaatcagcagaagaagctggtataacaataattcaccaagaacttagtgttttaaataacttaactgtttcagaaaatatatttttaggtaatgaaaaacatagtaaatttacaggaagaataaataaaaaattattagatgaaagaagtaaaatgttcttagaacaaattggttgtgatatagatccaaatagattagttagtactcttaatgtaggtgaaaagcaaatgatagaaatagcaaaagctttaactaagaatgctagaataattattatggacgaacctactacagccttaactgatgtagagactgaaaacctttttaaagtaatagagaatttaagaaaaaagggaatagcaataatatacatatcacatagaatggaagaaatatttaaaatatgtcatagagtagaagtattaagagatggtaaatatgcaggaagtgcagaaataaaagacatagataatgataagcttatagcaatgatggttggaagaaccatagaggatcaatttccatacagagatgttaaaaaaggagatttagctttagaagttaaaaatcttagctgtaaggaaggagttaaaggagcttcatttactcttagaaagggagaaatattaggaattgcaggtcttatgggatcaggcagaacagagcttgcaaaaacaatatttggagaatataaaaaaacaagtggtgaaatttctttaaatggaagtcctattaatataaattgcataagtgatgccataaataatggtatatgttatctttcagaggatagaaaaaaagagggatgtattttaggaatgtctgttggagaaaatatgaccttatgtaacttaaagaaatatgaaaataagtttaaatctcttgataaaaaagaagaagcaaaggatatagagtactatattaagaagataaacataaaaactccaaataaggaacaatttattaagaatttaagtggaggtaatcaacagaaggttatacttgctaaatggcttatgctatctccagaagtattaataattgacgagccaactagaggaatagacgtaggtgcaaagaaagaaatttatgaacttttaaatgaacttaaagctagtggaaaagccataataatgatttcttcagacttaccagaggttttaggaattagtgatagaattatggttatgagtgaaggaagaatctctggggaattaaatagagatgaagcaaaccaagaaagtataatgaaattagccgttggaataaacaattag

SEQ ID NO: 8845 - protein, 501 aa, Clostridium perfringens
MGERTPMLKMVGVSKSFPGVKALDNVSLMAYGGEVTALMGENGAGKSTLMKILSGVYKKDEGKIFIEGREVEVKGIKSAEEAGITIIHQELSVLNNLTVSENIFLGNEKHSKFTGRINKKLLDERSKMFLEQIGCDIDPNRLVSTLNVGEKQMIEIAKALTKNARIIIMDEPTTALTDVETENLFKVIENLRKKGIAIIYISHRMEEIFKICHRVEVLRDGKYAGSAEIKDIDNDKLIAMMVGRTIEDQFPYRDVKKGDLALEVKNLSCKEGVKGASFTLRKGEILGIAGLMGSGRTELAKTIFGEYKKTSGEISLNGSPININCISDAINNGICYLSEDRKKEGCILGMSVGENMTLCNLKKYENKFKSLDKKEEAKDIEYYIKKINIKTPNKEQFIKNLSGGNQQKVILAKWLMLSPEVLIIDEPTRGIDVGAKKEIYELLNELKASGKAIIMISSDLPEVLGISDRIMVMSEGRISGELNRDEANQESIMKLAVGINN

SEQ ID NO: 8846 - DNA, 1506 bp, Clostridium perfringens
  CDS (1)..(1506): transl_table=11
atgggtgaaagaacaccaatgctaaaaatggtaggtgtatcaaaatcctttccaggagtcaaagctttagataatgttagcttaatggcttatggtggagaagttactgctttaatgggagaaaatggagcagggaaatcaactttaatgaaaatactaagtggagtatataaaaaagatgaaggtaagatattcattgaaggaagggaagtagaagtaaagggaattaaatcagcagaagaagctggtataacaataattcaccaagaacttagtgttttaaataacttaactatttcagaaaatatatttttaggtaatgaaaaacatagtaaatttacaggaagaataaataaaaaattattagatgaaagaagcaaaatgttcttagaacaaattggttgtgatatagatccaaatagattagttagtactcttaatgtaggtgaaaagcaaatgatagaaatagcaaaagccttaactaagaatgcgagaataattattatggacgagcctactacagccttaactgatgtagagactgaaaacctttttaaagtaatagagaatttaagaaaaaagggaatagcaataatatacatatcacatagaatggaagaaatatttaaaatatgtcatagagtagaagtattaagagatggtaaatatgcaggaagtgcagaaataaaagacatagataatgataagcttatagcaatgatggttggaagaaccatagaggatcaatttccatacagagatgttaaaaaaggagatttagctttagaagttaaaaatcttagctgtaaggaaggagttaaaggagcttcatttactctgagaaagggagaaatattaggaattgcaggtcttatgggatcaggcagaacagagcttgcaaaaacaatatttggagaatataaaagaacaagtggtgaaatttctttaaatggaagtcctattaatataaattgcataagtgacgcaataaataatggtatatgttatctttcagaggatagaaaaaaagaaggctgtattttaggaatgtctgttggagaaaatatgaccttatgtaacttaaagaaatatgagaataagtttaaatctcttgataaaaaagaagaagcaaaggatatagagtactatattaagaagataaacataaaaactccaaataaggagcagtttattaagaatttaagtggaggtaatcaacagaaggttatacttgctaaatggcttatgctatctccagaagtattaataattgacgagccaactagaggaatagacgtaggtgcaaagaaagaaatttatgaacttttaaatgaacttaaagctagtggaaaagccataataatgatttcttcagacttaccagaggttttaggaattagtgatagaattatggttatgagtgaaggaagaatctctggagaattaaatagagatgaagcaaatcaagaaagtataatgaaattagccgttggaataaacaattag

SEQ ID NO: 8847 - protein, 501 aa, Clostridium perfringens
MGERTPMLKMVGVSKSFPGVKALDNVSLMAYGGEVTALMGENGAGKSTLMKILSGVYKKDEGKIFIEGREVEVKGIKSAEEAGITIIHQELSVLNNLTISENIFLGNEKHSKFTGRINKKLLDERSKMFLEQIGCDIDPNRLVSTLNVGEKQMIEIAKALTKNARIIIMDEPTTALTDVETENLFKVIENLRKKGIAIIYISHRMEEIFKICHRVEVLRDGKYAGSAEIKDIDNDKLIAMMVGRTIEDQFPYRDVKKGDLALEVKNLSCKEGVKGASFTLRKGEILGIAGLMGSGRTELAKTIFGEYKRTSGEISLNGSPININCISDAINNGICYLSEDRKKEGCILGMSVGENMTLCNLKKYENKFKSLDKKEEAKDIEYYIKKINIKTPNKEQFIKNLSGGNQQKVILAKWLMLSPEVLIIDEPTRGIDVGAKKEIYELLNELKASGKAIIMISSDLPEVLGISDRIMVMSEGRISGELNRDEANQESIMKLAVGINN

SEQ ID NO: 8848 - DNA, 1506 bp, Photorhabdus luminescens subsp
  CDS (1)..(1506): transl_table=11
atgcagcctgtactggaactaaaaggaattagtaaatcttttcctggtgtcaaagcattatctggtgcggcattacgtgtttatccaggtaaagtgatggcactggtgggagagaatggtgcaggtaagtccacgatgatgaaagtgttgactgggatatataccagagatacaggcacagttcattatttaggaaaagaagtgattttttctggccctagatcctctcaggaagcggggatcgggattatccatcaggaattaaatcttattccccaactgactattgctgaaaatattttcctgggacgcgaatttgttaataaattcggtgcaattgactggagaaaaatgtatcaggaagccgatcgcctgttaaaaaaattgaatctgagttacagcagtcaccgtttagtcgctgaactttctatcggtgatcaacaaatggttgaaattgctaaggtgctgagttttaaatccaaagttatcattatggatgagccgacggatgcgctgactgatacagaaactgaatcattatttcgcgtaatatatgaactaaaatctcagagatgtggcattgtttatatctcccatcgtttgagagaaatttttgaaatttgcgatgatgtaacggtatttcgtgatggacaatttattggtgaaaagtcagtaaaagagctaaaagaagagactctgattgaaatgatggttgggcgaaaactggaagatcagtatcctcgcctgaatttacctcggggtaaaaaacgacttgaagttaagcagatttctggccccggtgtgacaaatgccagtttttccctttatagcggggaaattttgggtatatcagggctaatgggggctggccgcactgaattgatgaaaattatttatggtgcgttgccaaaaactcaggggcaaatcacactggatggaacccccattgtaattcgtaaccctcaggatgggttagcttgtgggattgtttatatttcagaagatcgtaaacgtgatggcttagttttgggaatgtcaatcaaagataatatgtctcttactgccttgcgttatttcagtaaccggttaggtggtcttaatcataaagaagaacagaatgcagttagtgactttattaaattgtttagtatcaagacaccttcaatgggacaagttattggtttactttctggtggtaatcagcaaaaagtagctattgcccgtggattaatgaccagaccaaaagttcttattctggatgaacctacgcgtggtgtagatgttggtgcaaaaaaagaaatttatcagttaattaatcaattcaagaaagaggggttaagcattattctcgtttcttctgaaatgccagaagtgataggaatgagtgatcgtattttggttatgtgtgaaggccagatcagtggagaattttttgctgaacaggcaactcaagaaattttgatggcagcggctgtaggcaaacaatatggagcgattcaggagtaa

SEQ ID NO: 8849 - protein, 501 aa, Photorhabdus luminescens subsp
MQPVLELKGISKSFPGVKALSGAALRVYPGKVMALVGENGAGKSTMMKVLTGIYTRDTGTVHYLGKEVIFSGPRSSQEAGIGIIHQELNLIPQLTIAENIFLGREFVNKFGAIDWRKMYQEADRLLKKLNLSYSSHRLVAELSIGDQQMVEIAKVLSFKSKVIIMDEPTDALTDTETESLFRVIYELKSQRCGIVYISHRLREIFEICDDVTVFRDGQFIGEKSVKELKEETLIEMMVGRKLEDQYPRLNLPRGKKRLEVKQISGPGVTNASFSLYSGEILGISGLMGAGRTELMKIIYGALPKTQGQITLDGTPIVIRNPQDGLACGIVYISEDRKRDGLVLGMSIKDNMSLTALRYFSNRLGGLNHKEEQNAVSDFIKLFSIKTPSMGQVIGLLSGGNQQKVAIARGLMTRPKVLILDEPTRGVDVGAKKEIYQLINQFKKEGLSIILVSSEMPEVIGMSDRILVMCEGQISGEFFAEQATQEILMAAAVGKQYGAIQE

SEQ ID NO: 8850 - DNA, 23 bp, Artificial sequence
  primer
atgcaacagtctaccccgtatct

SEQ ID NO: 8851 - DNA, 24 bp, Artificial sequence
  primer
ttaggcaacagcctggctgacttt

SEQ ID NO: 8852 - protein, 512 aa, Artificial sequence
  consensus sequence
  Variant (2)..(5): Xaa in position 2 to 5 is any amino acid
  Variant (7)..(7): Xaa in position 7 is any amino acid
  Variant (9)..(9): Xaa in position 9 is any amino acid
  Variant (14)..(14): Xaa in position 14 is any amino acid
  Variant (17)..(25): Xaa in position 17 to 25 is any amino acid
  Variant (27)..(28): Xaa in position 27 to 28 is any amino acid
  Variant (30)..(30): Xaa in position 30 is any amino acid
  Variant (43)..(43): Xaa in position 43 is any amino acid
  Variant (45)..(45): Xaa in position 45 is any amino acid
  Variant (47)..(47): Xaa in position 47 is any amino acid
  Variant (49)..(49): Xaa in position 49 is any amino acid
  Variant (51)..(54): Xaa in position 51 to 54 is any amino acid
  Variant (55)..(56): Xaa in position 55 to 56 is any or no amino acid
  Variant (58)..(62): Xaa in position 58 to 62 is any amino acid
  Variant (63)..(63): Xaa in position 63 is any or no amino acid
  Variant (65)..(77): Xaa in position 65 to 77 is any amino acid
  Variant (80)..(82): Xaa in position 80 to 82 is any amino acid
  Variant (84)..(84): Xaa in position 84 is any amino acid
  Variant (88)..(90): Xaa in position 88 to 90 is any amino acid
  Variant (92)..(94): Xaa in position 92 to 94 is any amino acid
  Variant (99)..(100): Xaa in position 99 to 100 is any amino acid
  Variant (103)..(123): Xaa in position 103 to 123 is any amino acid
  Variant (124)..(127): Xaa in position 124 to 127 is any or no amino acid
  Variant (129)..(131): Xaa in position 129 to 131 is any amino acid
  Variant (133)..(136): Xaa in position 133 to 136 is any amino acid
  Variant (137)..(137): Xaa in position 137 is any or no amino acid
  Variant (139)..(144): Xaa in position 139 to 144 is any amino acid
  Variant (147)..(150): Xaa in position 147 to 150 is any amino acid
  Variant (152)..(152): Xaa in position 152 is any amino acid
  Variant (156)..(157): Xaa in position 156 to 157 is any amino acid
  Variant (159)..(162): Xaa in position 159 to 162 is any amino acid
  Variant (164)..(168): Xaa in position 164 to 168 is any amino acid
  Variant (173)..(174): Xaa in position 173 to 174 is any amino acid
  Variant (176)..(177): Xaa in position 176 to 177 is any amino acid
  Variant (180)..(182): Xaa in position 180 to 182 is any amino acid
  Variant (185)..(186): Xaa in position 185 to 186 is any amino acid
  Variant (188)..(189): Xaa in position 188 to 189 is any amino acid
  Variant (192)..(193): Xaa in position 192 to 193 is any amino acid
  Variant (195)..(198): Xaa in position 195 to 198 is any amino acid
  Variant (200)..(200): Xaa in position 200 is any amino acid
  Variant (205)..(205): Xaa in position 205 is any amino acid
  Variant (207)..(211): Xaa in position 207 to 211 is any amino acid
  Variant (213)..(215): Xaa in position 213 to 215 is any amino acid
  Variant (217)..(218): Xaa in position 217 to 218 is any amino acid
  Variant (221)..(234): Xaa in position 221 to 234 is any amino acid
  Variant (235)..(236): Xaa in position 235 to 236 is any or no amino acid
  Variant (238)..(240): Xaa in position 238 to 240 is any amino acid
  Variant (245)..(249): Xaa in position 245 to 249 is any amino acid
  Variant (251)..(275): Xaa in position 251 to 275 is any amino acid
  Variant (276)..(283): Xaa in position 276 to 283 is any or no amino acid
  Variant (285)..(289): Xaa in position 285 to 289 is any amino acid
  Variant (292)..(293): Xaa in position 292 to 293 is any amino acid
  Variant (295)..(296): Xaa in position 295 to 296 is any amino acid
  Variant (304)..(304): Xaa in position 304 is any amino acid
  Variant (307)..(311): Xaa in position 307 to 311 is any amino acid
  Variant (313)..(318): Xaa in position 313 to 318 is any amino acid
  Variant (319)..(319): Xaa in position 319 is any or no amino acid
  Variant (321)..(325): Xaa in position 321 to 325 is any amino acid
  Variant (327)..(332): Xaa in position 327 to 332 is any amino acid
  Variant (333)..(333): Xaa in position 333 is any or no amino acid
  Variant (335)..(336): Xaa in position 335 to 336 is any amino acid
  Variant (338)..(340): Xaa in position 338 to 340 is any amino acid
  Variant (342)..(346): Xaa in position 342 to 346 is any amino acid
  Variant (351)..(352): Xaa in position 351 to 352 is any amino acid
  Variant (354)..(358): Xaa in position 354 to 358 is any amino acid
  Variant (361)..(362): Xaa in position 361 to 362 is any amino acid
  Variant (364)..(390): Xaa in position 364 to 390 is any amino acid
  Variant (391)..(395): Xaa in position 391 to 395 is any or no amino acid
  Variant (397)..(412): Xaa in position 397 to 412 is any amino acid
  Variant (421)..(422): Xaa in position 421 to 422 is any amino acid
  Variant (424)..(424): Xaa in position 424 is any amino acid
  Variant (428)..(432): Xaa in position 428 to 432 is any amino acid
  Variant (433)..(433): Xaa in position 433 is any or no amino acid
  Variant (435)..(437): Xaa in position 435 to 437 is any amino acid
  Variant (444)..(444): Xaa in position 444 is any amino acid
  Variant (450)..(450): Xaa in position 450 is any amino acid
  Variant (454)..(458): Xaa in position 454 to 458 is any amino acid
  Variant (461)..(462): Xaa in position 461 to 462 is any amino acid
  Variant (464)..(469): Xaa in position 464 to 469 is any amino acid
  Variant (472)..(472): Xaa in position 472 is any amino acid
  Variant (474)..(474): Xaa in position 474 is any amino acid
  Variant (476)..(477): Xaa in position 476 to 477 is any amino acid
  Variant (479)..(480): Xaa in position 479 to 480 is any amino acid
  Variant (483)..(484): Xaa in position 483 to 484 is any amino acid
  Variant (487)..(487): Xaa in position 487 is any amino acid
  Variant (490)..(492): Xaa in position 490 to 492 is any amino acid
  Variant (495)..(507): Xaa in position 495 to 507 is any amino acid
  Variant (508)..(510): Xaa in position 508 to 510 is any or no amino acid
LXXXXIXKXFPGVXALXXXXXXXXXGXXHXLMGENGAGKSTLXKXLXGXYXXXXXXGXXXXXXGXXXXXXXXXXXXXAGXXXIXQELXXXPXXXVAENXXLGXXXXXXXXXXXXXXXXXXXXXXXXXLXXXGXXXXXPXXXXXXLSXXXXQXVEIXXAXXXXAXXXXXDEPTXXLXXREXXXLFXXIXXLRXXGXXXXYXSHRMXEXXXXXDXXXVXXDGXXXXXXXXXXXXXXXXLXXXMVGRXXXXXYXXXXXXXXXXXXXXXXXXXXXXXXXXXXXXXXXSXXXXXGEXXGXXGLVGAGRXELXXXXXGXXXXXXXGXXXXXGXXXXXXXPXXAXXXGXXXXXEDRKXXGXXXXXSVXXNXXXXXXXXXXXXXXXXXXXXXXXXXXXXXXXXIXXXXXXXXXXXXXXXXLSGGNQQKXXLXRWLXXXXXXVXXXDEPTRGXDVGAKXEIYXXXXXLAXXGXXXXXXSSXLXEXXGXXDRXXVMXEGXXXGEXXXXXXXXXXXXXXXXLA

SEQ ID NO: 8853 - protein, 59 aa, Artificial sequence
  protein pattern
  Variant (2)..(2): Xaa in position 2 is any or no amino acid
  Variant (4)..(4): Xaa in position 4 is any amino acid
  Variant (5)..(5): Xaa in position 5 is Ile or Val
  Variant (8)..(8): Xaa in position 8 is Ala, Cys or Gly
  Variant (9)..(9): Xaa in position 9 is Lys or Arg
  Variant (11)..(11): Xaa in position 11 is Ile, Leu, Met or Val
  Variant (12)..(14): Xaa in position 12 to 14 is any amino acid
  Variant (15)..(15): Xaa in position 15 is Ala, Ser or Thr
  Variant (16)..(16): Xaa in position 16 is any amino acid
  Variant (17)..(17): Xaa in position 17 is Ile or Val
  Variant (18)..(18): Xaa in position 18 is Ile, Leu or Val
  Variant (19)..(19): Xaa in position 19 is Ala, Ile or Val
  Variant (20)..(20): Xaa in position 20 is Phe, Leu or Met
  Variant (25)..(25): Xaa in position 25 is Ala, Ser or Thr
  Variant (26)..(26): Xaa in position 26 is Ala, Pro or Ser
  Variant (28)..(28): Xaa in position 28 is Asn, Ser or Thr
  Variant (29)..(30): Xaa in position 29 to 30 is any amino acid
  Variant (32)..(32): Xaa in position 32 is any amino acid
  Variant (33)..(33): Xaa in position 33 is Ala, Asp, Glu, Gly, Gln or Thr
  Variant (34)..(34): Xaa in position 34 is any amino acid
  Variant (36)..(37): Xaa in position 36 to 37 is any amino acid
  Variant (38)..(41): Xaa in position 38 to 41 is any or no amino acid
  Variant (43)..(43): Xaa in position 43 is Lys or Arg
  Variant (44)..(44): Xaa in position 44 is any amino acid
  Variant (45)..(45): Xaa in position 45 is Asp, Glu, Asn, Gln or Arg
  Variant (46)..(46): Xaa in position 46 is Gly or Asn
  Variant (47)..(48): Xaa in position 47 to 48 is any amino acid
  Variant (49)..(49): Xaa in position 49 is Ile, Leu, Met or Val
  Variant (50)..(50): Xaa in position 50 is Ile, Leu or Val
  Variant (52)..(52): Xaa in position 52 is Ile or Val
  Variant (53)..(53): Xaa in position 53 is Ser or Thr
  Variant (55)..(55): Xaa in position 55 is Lys or Arg
  Variant (56)..(56): Xaa in position 56 is Leu or Met
  Variant (57)..(57): Xaa in position 57 is Ala, Asp or Glu
  Variant (59)..(59): Xaa in position 59 is Ile or Val
QXQXXEIXXAXXXXXXXXXXDEPTXXLXXXEXXXLXXXXXXLXXXXXXXXYXXHXXXEX

SEQ ID NO: 8854 - protein, 60 aa, Artificial sequence
  protein pattern
  Variant (2)..(2): Xaa in position 2 is any or no amino acid
  Variant (9)..(9): Xaa in position 9 is Ile or Val
  Variant (11)..(11): Xaa in position 11 is Ile or Val
  Variant (14)..(14): Xaa in position 14 is Lys or Arg
  Variant (15)..(15): Xaa in position 15 is any amino acid
  Variant (19)..(20): Xaa in position 19 to 20 is any amino acid
  Variant (21)..(21): Xaa in position 21 is Phe, Ile, Leu or Met
  Variant (22)..(23): Xaa in position 22 to 23 is any amino acid
  Variant (24)..(24): Xaa in position 24 is Phe, Leu or Met
  Variant (25)..(29): Xaa in position 25 to 29 is any amino acid
  Variant (30)..(30): Xaa in position 30 is Ala, Gly, Ser or Thr
  Variant (31)..(32): Xaa in position 31 to 32 is Ile, Leu or Val
  Variant (33)..(33): Xaa in position 33 is Phe, Ile, Leu, Met or Val
  Variant (34)..(34): Xaa in position 34 is Ala, Ile or Val
  Variant (37)..(37): Xaa in position 37 is Asp or Glu
  Variant (38)..(38): Xaa in position 38 is Leu or Met
  Variant (39)..(39): Xaa in position 39 is any amino acid
  Variant (41)..(41): Xaa in position 41 is Ile, Leu or Val
  Variant (42)..(42): Xaa in position 42 is any amino acid
  Variant (44)..(44): Xaa in position 44 is Ile, Leu, Met or Val
  Variant (45)..(45): Xaa in position 45 is Ala, Cys or Ser
  Variant (48)..(48): Xaa in position 48 is any amino acid
  Variant (49)..(49): Xaa in position 49 is any or no amino acid
  Variant (51)..(51): Xaa in position 51 is Leu, Met or Val
  Variant (52)..(55): Xaa in position 52 to 55 is any amino acid
  Variant (56)..(56): Xaa in position 56 is Ile, Leu or Val
  Variant (57)..(57): Xaa in position 57 is any amino acid
  Variant (58)..(58): Xaa in position 58 is Ala or Gly
  Variant (59)..(59): Xaa in position 59 is any amino acid
  Variant (60)..(60): Xaa in position 60 is Phe, Ile, Leu or Val
LXDEPTRGXDXGAXXEIYXXXXXXXXXXXXXXXXSSXXXEXXGXXDRXXVXXXXXXXXXX

SEQ ID NO: 8855 - protein, 56 aa, Artificial sequence
  protein pattern
  Variant (2)..(10): Xaa in position 2 to 10 is any amino acid
  Variant (11)..(11): Xaa in position 11 is any or no amino acid
  Variant (13)..(13): Xaa in position 13 is Ala or Gly
  Variant (15)..(15): Xaa in position 15 is any amino acid
  Variant (18)..(18): Xaa in position 18 is Ala, Asp, Gln, Ser or Thr
  Variant (19)..(19): Xaa in position 19 is Ala, Asp, Glu, Gly, Asn or Ser
  Variant (20)..(20): Xaa in position 20 is Ile or Val
  Variant (21)..(21): Xaa in position 21 is Asp, Gln, Ser or Thr
  Variant (22)..(22): Xaa in position 22 is Phe or Leu
  Variant (23)..(26): Xaa in position 23 to 26 is any amino acid
  Variant (28)..(28): Xaa in position 28 is any amino acid
  Variant (29)..(29): Xaa in position 29 is Ile or Val
  Variant (30)..(31): Xaa in position 30 to 31 is any amino acid
  Variant (33)..(33): Xaa in position 33 is Leu or Met
  Variant (42)..(42): Xaa in position 42 is Ser or Thr
  Variant (44)..(44): Xaa in position 44 is Ile, Leu or Met
  Variant (45)..(45): Xaa in position 45 is Lys or Arg
  Variant (46)..(46): Xaa in position 46 is any amino acid
  Variant (48)..(48): Xaa in position 48 is any amino acid
  Variant (50)..(53): Xaa in position 50 to 53 is any amino acid
  Variant (54)..(54): Xaa in position 54 is Asp, Asn, Gln, Ser or Thr
  Variant (55)..(55): Xaa in position 55 is any amino acid
LXXXXXXXXXXPXVXALXXXXXXXXXGXXXXLXGENGAGKSXLXXXLXGXXXXXXG

SEQ ID NO: 8856 - protein, 33 aa, Artificial sequence
  protein pattern
  Variant (2)..(3): Xaa in position 2 to 3 is any amino acid
  Variant (4)..(4): Xaa in position 4 is any or no amino acid
  Variant (6)..(9): Xaa in position 6 to 9 is any or no amino acid
  Variant (11)..(11): Xaa in position 11 is Ile or Val
  Variant (12)..(12): Xaa in position 12 is any amino acid
  Variant (13)..(13): Xaa in position 13 is Ile, Leu or Val
  Variant (15)..(15): Xaa in position 15 is His or Tyr
  Variant (18)..(18): Xaa in position 18 is Ile or Leu
  Variant (19)..(21): Xaa in position 19 to 21 is any amino acid
  Variant (22)..(22): Xaa in position 22 is Asn or Pro
  Variant (23)..(23): Xaa in position 23 is Asp, Glu, Asn or Gln
  Variant (24)..(24): Xaa in position 24 is Leu or Met
  Variant (25)..(25): Xaa in position 25 is Ser or Thr
  Variant (26)..(26): Xaa in position 26 is Ile or Val
  Variant (27)..(27): Xaa in position 27 is any amino acid
  Variant (28)..(28): Xaa in position 28 is Asp, Glu or Gln
  Variant (30)..(30): Xaa in position 30 is Ile, Leu or Met
  Variant (31)..(31): Xaa in position 31 is any amino acid
  Variant (32)..(32): Xaa in position 32 is Ile, Leu, Met or Val
AXXXAXXXXGXXXIXQEXXXXXXXXXXXNXXXG

SEQ ID NO: 8857 - protein, 15 aa, Artificial sequence
  protein pattern
  Variant (9)..(9): Xaa in position 9 is Ala or Val
  Variant (10)..(10): Xaa in position 10 is Ile, Leu, Met or Val
  Variant (12)..(12): Xaa in position 12 is Ala, Gly or Ser
  Variant (13)..(13): Xaa in position 13 is Lys or Arg
  Variant (14)..(14): Xaa in position 14 is any amino acid
LSGGNQQKXXLXXXL

SEQ ID NO: 8858 - protein, 29 aa, Artificial sequence
  protein pattern
  Variant (2)..(2): Xaa in position 2 is Phe or Leu
  Variant (3)..(3): Xaa in position 3 is any amino acid
  Variant (4)..(4): Xaa in position 4 is Ala, Ile, Leu or Val
  Variant (5)..(6): Xaa in position 5 to 6 is any amino acid
  Variant (9)..(9): Xaa in position 9 is Ile or Val
  Variant (10)..(10): Xaa in position 10 is Ile, Leu or Val
  Variant (12)..(12): Xaa in position 12 is Phe, Ile, Leu or Val
  Variant (13)..(13): Xaa in position 13 is any amino acid
  Variant (16)..(16): Xaa in position 16 is Ile, Met or Val
  Variant (21)..(21): Xaa in position 21 is Ser or Thr
  Variant (23)..(26): Xaa in position 23 to 26 is any amino acid
  Variant (27)..(27): Xaa in position 27 is Ile, Leu, Met or Val
  Variant (28)..(28): Xaa in position 28 is any amino acid
SXXXXXGEXXGXXGLXGAGRXEXXXXXXG

SEQ ID NO: 8859 - protein, 26 aa, Artificial sequence
  protein pattern
  Variant (2)..(2): Xaa in position 2 is Ile, Leu, Met or Val
  Variant (3)..(5): Xaa in position 3 to 5 is any amino acid
  Variant (6)..(6): Xaa in position 6 is Pro, Ser or Thr
  Variant (11)..(12): Xaa in position 11 to 12 is any amino acid
  Variant (14)..(14): Xaa in position 14 is Ile or Leu
  Variant (15)..(15): Xaa in position 15 is Phe, Ile or Val
  Variant (16)..(18): Xaa in position 16 to 18 is any amino acid
  Variant (20)..(21): Xaa in position 20 to 21 is any amino acid
  Variant (22)..(22): Xaa in position 22 is Asp, Glu, His or Lys
  Variant (24)..(24): Xaa in position 24 is any amino acid
  Variant (25)..(25): Xaa in position 25 is Ala, Gly, Asn, Ser or Thr
  Variant (26)..(26): Xaa in position 26 is Ile, Leu or Met
GXXXXXEDRKXXGXXXXXSXXXNXXX

SEQ ID NO: 8860 - protein, 14 aa, Artificial sequence
  protein pattern
  Variant (2)..(3): Xaa in position 2 to 3 is any amino acid
  Variant (4)..(4): Xaa in position 4 is Ser or Thr
  Variant (5)..(5): Xaa in position 5 is Ile or Val
  Variant (6)..(6): Xaa in position 6 is Phe or Leu
  Variant (7)..(7): Xaa in position 7 is Lys or Arg
  Variant (10)..(11): Xaa in position 10 to 11 is any amino acid
  Variant (12)..(12): Xaa in position 12 is Ile or Val
  Variant (13)..(13): Xaa in position 13 is any amino acid
  Variant (14)..(14): Xaa in position 14 is Asp, Glu, Gly, Ser or Thr
DXXXXXXDGXXXXX

SEQ ID NO: 8861 - DNA, 1278 bp, SYNECHOCYSTIS SP.
  CDS (1)..(1278): transl_table=11
atgatccatgtggtgggcattggcctgaatggtgccgaagggttaactagttcaacactagaattaattgcccaagcaaaaatattggccggcggcgatcgccatttgagttacttcccgcagtacggcaaaaaaagtttagtcatcaaggatttttcagcagatttaaagaaaatcaagcagtttcatcagactttaaagtcacacgaaactattgttgttttagcttccggtgatcccctgtactttggcttgggacggttattactggaaaaattttccccggaacaattaaaatttcatccccatttgagttccattcagctagcctttaatcgtttaaaaatgccctggcaggatgccaccatcatcagtgcccacggaagatccaacgagttgctcatacaagccctgcaaaaaggagcaaaaaaattagccattctcaccgatgggcaaaatcatccaggggcgatcgccaatttatgtttatctttggggttgaccaccacttaccaagcttgggtttgtgaaaacttagcggcaacaaatgaacagattcaagcctttgatttgccatctttagcatccctaaccgcaacggatttttcccccctcaatgtagtggtgctagttaaacaaaagccagaaaatcccctaattgatctggatcagttacccattttgggcatcgccgatcatcactttgctagctttgacgatcgccctggcatgattaccaaacagcctatccgggtgcaaattttagccgctttatccttgcaaccccgacaaattatttgggacattggggccggtaccgggtcagtggcgatcgagggtgcccggttgtgtccccagggaaaagtttttgccattgaaaaaactagcgctggtcaacggttaatcgaacaaaattgccaacgatttcaactgcaaaacgtcgaggtagtggccggctctgccccggaagttttagccaatttacctactcctaaccgagttttcattggtggtaacggtgggcaattaacctctattttgcagacttgcggggaacgtttagcgataaatggtttggtggtgatggcgatcgccagtttggagcatttgagcttagccctgggctggtttaaacaacaacaatggcaggtgaaagtgcaacaggtgcaaattagccagagcgttaaatttgccgaactgacccgctttgatcccctcaatccgatttatttactcactgcggggaggaactccatgggaaacgacgaccttggttaa

SEQ ID NO: 8862 - protein, 425 aa, SYNECHOCYSTIS SP.
MIHVVGIGLNGAEGLTSSTLELIAQAKILAGGDRHLSYFPQYGKKSLVIKDFSADLKKIKQFHQTLKSHETIVVLASGDPLYFGLGRLLLEKFSPEQLKFHPHLSSIQLAFNRLKMPWQDATIISAHGRSNELLIQALQKGAKKLAILTDGQNHPGAIANLCLSLGLTTTYQAWVCENLAATNEQIQAFDLPSLASLTATDFSPLNVVVLVKQKPENPLIDLDQLPILGIADHHFASFDDRPGMITKQPIRVQILAALSLQPRQIIWDIGAGTGSVAIEGARLCPQGKVFAIEKTSAGQRLIEQNCQRFQLQNVEVVAGSAPEVLANLPTPNRVFIGGNGGQLTSILQTCGERLAINGLVVMAIASLEHLSLALGWFKQQQWQVKVQQVQISQSVKFAELTRFDPLNPIYLLTAGRNSMGNDDLG

SEQ ID NO: 8863 - DNA, 1212 bp, Pseudomonas putida GB-1
  CDS (1)..(1212): transl_table=11
atggcaccctggctgacagtagtaggcatcggcgaagacggcttcagtggcctgggcaaacaggcccggcgtgcgctgttgggcgctgcgcggatcttcggcagcccacgccagctggccctgctaccgcgctgcgtgcccggcgagcggctgggctggccaagcccgttttcgctggccccggtgctggccctgcgtggcgagcccgtgtgcgtactggccagcggcgacccgatgttctacggcgtcggtgccagccttgcacgccaggtacccgccgatgaaatgcgcgtactgtcgatgcccacctcttgcgcactggccgccgcccgcctgggctggccgctgcaggatgtgcaggtggtgtctctggtagcccgccccctggcggcgctcaatgctcacctgcacagcggcatacgtttgctggtgctgagcaacgacggcgacagcccggcggccattgccacgctgctgcgcgagcgtggctacgggccaagccgcctgcgtgtgttcgaacacctgggaggcccgcacgaacgtgtgttggccggcaccgcccaagactggccacacgccgatatcgcagcgctcaacctggtggccatcgaatgcctggccacgcccgaagcgccgcgtctgcaccggctggccgggctgccggacagcgccttccggcatgacggccaactgaccaaacgcgatgttcgcgccatcaccctggcgcgcctggcgccgcagcccggtgaactgctgtgggacgtgggcgcgggctgcggctcgatcggcatcgaatggatgcgcgcccacccggcctgccgcgcgctggccatcgaggccgacgaaggccgccaaggcttcatcgaacataaccgcgatgcattgggtgtacccggcctgcagctggtgcgcggcaaggccccagcggcactgcaaggcctggaacgcccggatgcgatcttcatcggcggcggcgtcacccgcgagggtgtgctcgacctgtgctgggccagcctgcgccccggtggccggctggtagccaacgcggtaaccctgcaaagcgaactggccctggcgtcttttcgcgagcagcacggtggtgagctgacccgcatccatgtcgcccacgcccagcccttgggtgcgttcgacacctggcgccaggcgctgccgatcaccctgctggatgtggtgaagcccgccgatgcgtga

SEQ ID NO: 8864 - protein, 403 aa, Pseudomonas putida GB-1
MAPWLTVVGIGEDGFSGLGKQARRALLGAARIFGSPRQLALLPRCVPGERLGWPSPFSLAPVLALRGEPVCVLASGDPMFYGVGASLARQVPADEMRVLSMPTSCALAAARLGWPLQDVQVVSLVARPLAALNAHLHSGIRLLVLSNDGDSPAAIATLLRERGYGPSRLRVFEHLGGPHERVLAGTAQDWPHADIAALNLVAIECLATPEAPRLHRLAGLPDSAFRHDGQLTKRDVRAITLARLAPQPGELLWDVGAGCGSIGIEWMRAHPACRALAIEADEGRQGFIEHNRDALGVPGLQLVRGKAPAALQGLERPDAIFIGGGVTREGVLDLCWASLRPGGRLVANAVTLQSELALASFREQHGGELTRIHVAHAQPLGAFDTWRQALPITLLDVVKPADA

SEQ ID NO: 8865 - DNA, 1236 bp, Mesorhizobium loti MAFF303099
  CDS (1)..(1236): transl_table=11
atgcctgctgaaagttcgcgcggcgccggaccgaaatggctgacggtgatcggcatcggcgaggacggtttagcgggtctcggcgacgaggccaagcagcggattgccaaggccgagatcatcttcggcggcaagcggcacctggcgctggtcgcgtccttcgccaagggcgagccacgtccctggccggtgcctttcgatgccgggatggccgacgtgctggccctagccggcagaaacgtctgtgtgctcgcctccggcgatccttttttccatggggtgggcgccaccctcgcccgcaaggtcaagccgggggagatgcatgtcattcccgcgccatcggccgtttcgctggcggccgcccgccttggctgggcgctgcaggatatcgagattgtctcgctgcatggccggccgctcgacctgatccgaccgctgctgcagcccaatgcgcgcatcctggcgctgacgtcggatgccgaagcgcctgatgcaattgcccgcctgctcaccgaactcgatttcggcgcctcgcggctgacggtactggaggcgctgggcgggccaaaggagaaccagcgctccgcccgcgccgataccttcgacctagaaaacatcaatccgctcaatgtgctggccatcgaaattgattcgaatccgcaagcccgcgtcctgccgctcacggtcggtcttgccgatcatctgttcgaccatgacgggcagatcaccaaacgcgaaatccgcgccatcaccctgtcgtcactggcgccgaggcgcggcgaattgctgtgggacatcggcgccggctcgggctccatcggcatcgaatggatgctcgcccacccctcgatgcgcacgatcgccatcgaagccgacccgacccgcgccgtccgcatccaccgcaacgccgccgcctgtggcgttcccggccttgtcgtggtggaaggcagcgcacccaaggcgctggccaggctggacacgccggacgcgatcttcatcggcggcggcggcagtgatagcggtgtgttgaacgctgccatcaaggcgctgcgttccggcggccggctcgtcgccaacgcggtgacgctggagatggaagccctgcttctcgcgcagcacgcaaagcttggtggtgacatcatccggataaacatttcgcgtgcctcgccggtcggttcgatgcaggcatggcggccggccatgccggtcacgcaatggagctgggtgaagccatga

SEQ ID NO: 8866 - protein, 411 aa, Mesorhizobium loti MAFF303099
MPAESSRGAGPKWLTVIGIGEDGLAGLGDEAKQRIAKAEIIFGGKRHLALVASFAKGEPRPWPVPFDAGMADVLALAGRNVCVLASGDPFFHGVGATLARKVKPGEMHVIPAPSAVSLAAARLGWALQDIEIVSLHGRPLDLIRPLLQPNARILALTSDAEAPDAIARLLTELDFGASRLTVLEALGGPKENQRSARADTFDLENINPLNVLAIEIDSNPQARVLPLTVGLADHLFDHDGQITKREIRAITLSSLAPRRGELLWDIGAGSGSIGIEWMLAHPSMRTIAIEADPTRAVRIHRNAAACGVPGLVVVEGSAPKALARLDTPDAIFIGGGGSDSGVLNAAIKALRSGGRLVANAVTLEMEALLLAQHAKLGGDIIRINISRASPVGSMQAWRPAMPVTQWSWVKP

SEQ ID NO: 8867 - DNA, 1260 bp, Agrobacterium tumefaciens str. C58
  CDS (1)..(1260): transl_table=11
atgacatctgaatattccggaacggcaaaggcttccactgaaaagaacgaaaagccgtggctgtccattgtcggtataggcgaggacgggcttcaggggctgggtgaaaatgcgcgtcaggcgatagaggcagccgaggtggttttcggcggcaaacgccatctggaactggcggctggggccattcgcggcgaagcgcgggcctggccggtgccgtttgatgtggacatgaacgatgttctcgcattgcgcggccgcctggtgtgtgtgctggcatcgggcgatccgttcttctatggtgcgggggtcacgcttctgcggcggattccggcggaggaaacggcttgttatccctcgccttccgccttttcgctggccgcctcgcggcttggctgggccctgcaatcggccgaatgcgtttcgctgcatgggcgctcaatcgatctgttgcggccacatctgcatcatggcgcgcggatcatcgcgctgacgtctgatgagcgcgacccagccttgattgcgcggctgctgtccgatgccggcttcggccgttcggaattcatcctgcttgaagcattgggcggagaccgggaaaagcgacggcaaatccgggctgctgattttggctttgaagatactgatccgctcaatgtcgtcgcgatcgaggtcgtggcggatgagggtgcgcgcctcctgccttttgctcacgggcttgatgacggcctgtttgaacatgacgggcagatcaccaagcgcgaaatccgcgcggtgacgctttcgtcactcgcctcccgtcggggagaactgctgtgggatattggtgcgggctccggctcgatcggcatcgaatggatgttgtcgcatccttcgctgcgcgccatcgccatcgagcagcatccggaaagggctgagcggattgcccgcaatgctgacgcttttggtgttccggggcttgaggtcatgatcggcacggctccggcggcttttgaaggcttgtcttcaccggatgcgatctttattggcggcggcggcagtgagacgggtgtgctggaggccgccatggatgctctgaaaccgggcgggcggctggtggccaatgcggtgacgctggaaatggaagcggtattgcttgctgcccatgcgaaattcggcgggtcgatgatccggctggaggtctcgcgggctgctgctgtcggttccatgtccggctggcgtccggctatgccggtgacacaatggagctgggtcaagccatggtga

SEQ ID NO: 8868 - protein, 419 aa, Agrobacterium tumefaciens str. C58
MTSEYSGTAKASTEKNEKPWLSIVGIGEDGLQGLGENARQAIEAAEVVFGGKRHLELAAGAIRGEARAWPVPFDVDMNDVLALRGRLVCVLASGDPFFYGAGVTLLRRIPAEETACYPSPSAFSLAASRLGWALQSAECVSLHGRSIDLLRPHLHHGARIIALTSDERDPALIARLLSDAGFGRSEFILLEALGGDREKRRQIRAADFGFEDTDPLNVVAIEVVADEGARLLPFAHGLDDGLFEHDGQITKREIRAVTLSSLASRRGELLWDIGAGSGSIGIEWMLSHPSLRAIAIEQHPERAERIARNADAFGVPGLEVMIGTAPAAFEGLSSPDAIFIGGGGSETGVLEAAMDALKPGGRLVANAVTLEMEAVLLAAHAKFGGSMIRLEVSRAAAVGSMSGWRPAMPVTQWSWVKPW

SEQ ID NO: 8869 - DNA, 1242 bp, Sinorhizobium meliloti 1021
  CDS (1)..(1242): transl_table=11
gtggctgacatgtcgaacagtggctcggccatcgtcgctccctggctcatcgtgatcggtatcggagaagacggtgtagccggtctcggcgacgaggccaagcgcctcattgaggccgctcccgtcgtcttcggcggggcccgccatttggaactcgctgcgccgctgatcggtggcgaacgccatatctggcagagcccgtttgaaagatcggtggaggcgatcgtcgcccgtcgcggcagccccgtcgttgtgctcgcctccggcgatccgtttctttacggcgtcggcgccacgctggcgcgccgcgtagatgccgcggaaatgcgcaccatccccgcgccgtccgccttcagcctcgcggcttcccggctcggctggccgctgcaggaggtcgcgaccgtttcgctgcacggccgtccgctcgatctcataaggccgcatcttcagccgggcgcgcgcgtcctgacgctgacctcggacgagagcgggccgaaggcgcttgccgggctgcttgcagaaagcggattcggtcagtcacggcttacggttctcgaggcgctcggcggcgcaggcgagcgtgtctcccgccacctcgcttccggcttcgcgatggaggaaatcaacgcgctgaacgtctgcgcgcttgaggtggtggccgatgccgatgcacgcgttctgacgcttgcgaacggcctggacgagcggcttttcgagcacgacggccagatcaccaagcgggaggtgcgggcgctgaccctctcggcactcgcgccgcgcaagggcgaactcctctgggacatcggcgccggatcaggctcgatcgcgatcgaatggatgcttgccgatccggcgatgcgcgccgtcgccgtagaggcgtcgtccgaacgggctgcgcggatcggccgcaatgcggtccgcttcggcgttccggggcttgtggtcgtcgaagggcaggcgccggaggcgctgcgagggcttccgcggccggacgtgatcttcatcggcggcggcggcagcgagcccggcgtgatggaggcggcgattgcagcgctcgcgcccggcggacgtctcgtggccaatgccgtgacgacggagatggaagcggtgctgctcgcccgacatgcgcagttcggcggctcgctgatccgcatcgacatcgcccgggcctcgcccgtcggcgccatgacgggctggcggccggccatgccggtcacgcaatggtcgtggataaaggcgtga

SEQ ID NO: 8870 - protein, 413 aa, Sinorhizobium meliloti 1021
MADMSNSGSAIVAPWLIVIGIGEDGVAGLGDEAKRLIEAAPVVFGGARHLELAAPLIGGERHIWQSPFERSVEAIVARRGSPVVVLASGDPFLYGVGATLARRVDAAEMRTIPAPSAFSLAASRLGWPLQEVATVSLHGRPLDLIRPHLQPGARVLTLTSDESGPKALAGLLAESGFGQSRLTVLEALGGAGERVSRHLASGFAMEEINALNVCALEVVADADARVLTLANGLDERLFEHDGQITKREVRALTLSALAPRKGELLWDIGAGSGSIAIEWMLADPAMRAVAVEASSERAARIGRNAVRFGVPGLVVVEGQAPEALRGLPRPDVIFIGGGGSEPGVMEAAIAALAPGGRLVANAVTTEMEAVLLARHAQFGGSLIRIDIARASPVGAMTGWRPAMPVTQWSWIKA

SEQ ID NO: 8871 - DNA, 1212 bp, Nostoc sp. PCC 7120
  CDS (1)..(1212): transl_table=11
atgacgcagaaatggctatctattatcggtattggtgaagatggattattggggttaagtgcgatcgctatttctctactcaatcaagcggaaatcgttgtaggaggcgatcgccatttagcaatgttacctccaaacgacccacgggaaaaaatcctctggacttctcctattactaccgcagtggcagaaattatccagcgtcggggtaaatctgtatgtgtgttagccagtggtgatcccatgtattacggtattggtgtcaccttggcgcgacaaatttccatatccgaaatgacaattatccccgcaccttcatcttttagcctggcctgcgcccgattaggatggtctttaacggaggtagaaaccttgagtttatgcggtcgtccctcggctttgctgcaatcttacatatatcctggtgcgcggttattaattttgagtgaggggaaaaatacaccgagtattgttgctgaaaccctcacacagcgaggttttgggaatagccaactcacagttttggaacggatgggcggtattcatgaaaggatattaacagggatagctgcaacttggcaggaaacagaactggcagatttaaatgcgatcgctgtacactgtatcgtcgatactggtgttgtcgccttacccagattaccaggattaccagatagcgtttatcaccacgacggacaacttaccaaacgggaagttagagcagttaccctatcaactttagcacccacaccaggacagttactttgggatgtgggggcgggttgtggttccatatcaatagaatggatgcggactaatcccagatgtcaggcgatcgccattgaacaaaactcatctagactacaatacattgcagataatgcggctgctttaggtactcccaacctgaaaattgttgcaggaaaagcacctcacatcctccaagacttacccacacccgatgccatttttatcggtggtggagttacagccacaggattgtttgatatttgttggcaagcactacgcccaggcggtaggttaattgctaatgtagtcaccatagaaggtgagcagactttatttcaatggtacgaaaaagtgggtggcagtttcacccgtattgccattcaacgagccgaaccaattggtaaatttttgggttggcgagcaatggctactgtcacacaatgggtagcggtgaaagattga

SEQ ID NO: 8872 - protein, 403 aa, Nostoc sp. PCC 7120
MTQKWLSIIGIGEDGLLGLSAIAISLLNQAEIVVGGDRHLAMLPPNDPREKILWTSPITTAVAEIIQRRGKSVCVLASGDPMYYGIGVTLARQISISEMTIIPAPSSFSLACARLGWSLTEVETLSLCGRPSALLQSYIYPGARLLILSEGKNTPSIVAETLTQRGFGNSQLTVLERMGGIHERILTGIAATWQETELADLNAIAVHCIVDTGVVALPRLPGLPDSVYHHDGQLTKREVRAVTLSTLAPTPGQLLWDVGAGCGSISIEWMRTNPRCQAIAIEQNSSRLQYIADNAAALGTPNLKIVAGKAPHILQDLPTPDAIFIGGGVTATGLFDICWQALRPGGRLIANVVTIEGEQTLFQWYEKVGGSFTRIAIQRAEPIGKFLGWRAMATVTQWVAVKD

SEQ ID NO: 8873 - DNA, 1206 bp, Brucella melitensis 16M
  CDS (1)..(1206): transl_table=11
atgggctgctggctgacggtaatcggtattggtgaagacgggctggatgggctggggcaggcagcacgcaatgctatcgccgaagcacaggcaatttttggcggcaagcgacatctggcctttctgggcaatgacacagaggcggaacgcatcgcatggccttcgcccttcgatgaagcctttgcggcgatccatgcgcgcagaggcaggcccatcgttgtgcttgcaagtggagatccgatgtttttcggcgtcggcgcgtcgcttgcgaagcatttttcgcccgatgagatgctggttctgccttatccctcatcgctgtcgctggctgccgcccggatgggctgggcgcttcaggacgtgcaaacggtgagcgtgcatggccgcccctttgaattgcttgttccgcacattctgccgggtgtgaggcttctggtgttgagcaatgacggtacgaccccggcaagggtggctacgctgctggcggccataggatttgggcaaagcgtcctgaccgttctggagcatctcggtgggccgaaagagcgcaccctccacggcaccgccgctaactggctgcatgagcgatgtgcggaccttcatgtgctcgccatcgcgtgtattgccgcgccggatgcggctgttttgtcgcctgttgcgggattgcccgatgaggcgtttgaaaatgatggccagcttaccaagcgcgatatccgtgctgtcacgctttcgcgattgcagcccttgccgcaccagcttctttgggatgtgggcgcaggctgcggctccatcggcatcgaatggatgcgtgttcatgcctcatgccgggcaattgcaatcgaggccgatgagggacggcaaggcatgatcgagcgcaaccgggtggcacttggcgttcccggtttgcagcttgtgcaaggcagggcgccttccgcgctgcgcgggcttgaagcgccggacgcaattttcattggcggcggcgtgacggatgaaggtgtgctggaagcctgctggaatgccctgaaaccgggcggacggctggttgccaatgccgtgaccttgcaaagcgaaatgcggcttttcgcctggcggcaggaatttggcggtgatctgacccgcgttggtgttgcacaggcgggcgaactcggctcgttcgatgtctggcgtcaggcgctccccgtcacgatttattgcgggttcaaatga

SEQ ID NO: 8874 - protein, 401 aa, Brucella melitensis 16M
MGCWLTVIGIGEDGLDGLGQAARNAIAEAQAIFGGKRHLAFLGNDTEAERIAWPSPFDEAFAAIHARRGRPIVVLASGDPMFFGVGASLAKHFSPDEMLVLPYPSSLSLAAARMGWALQDVQTVSVHGRPFELLVPHILPGVRLLVLSNDGTTPARVATLLAAIGFGQSVLTVLEHLGGPKERTLHGTAANWLHERCADLHVLAIACIAAPDAAVLSPVAGLPDEAFENDGQLTKRDIRAVTLSRLQPLPHQLLWDVGAGCGSIGIEWMRVHASCRAIAIEADEGRQGMIERNRVALGVPGLQLVQGRAPSALRGLEAPDAIFIGGGVTDEGVLEACWNALKPGGRLVANAVTLQSEMRLFAWRQEFGGDLTRVGVAQAGELGSFDVWRQALPVTIYCGFK

SEQ ID NO: 8875 - DNA, 1233 bp, Streptomyces coelicolor A3(2)
  CDS (1)..(1233): transl_table=11
atggtcgggatgggggccgcctccggtgcggctcccgccggggacgtcgccgcgggcgcggaactggtcgtcggcggacgtcggcacctggacgccgtacggctgccggagggggtccggacggtggtcctcggggcgttggcgcccgccctggacacggtcgcggagtacgtcgcccgggggcggccggtgaccgtgctggcctccggtgatccggggttcttcgggatcgtgcgggcgctggccgagcggttcggaccggagcggctggacgtgcgggccggggtgtcctccgtcgcggcggccttcgcgcgggtggggctgccgtgggacgacgccgtggtggcgagcgcgcacgggcgggacctgcggacggcggtgaacgtgtgccgggcgcacccgaaggtggccgtgctgaccggtcccggggcgggtccggcggagctgggggccgcgttgcgggacgacgggcgggtgttcgtcgtcgcctccgcactgggctcggccgaggagcgggtggagcgggtgacccccgccgaggccgccgcccgggactggggtacggcggtgagcgtggtgctgtgcctggacggggcgcgggcgccggggccggtgcgggccctcgcgggggtgcgccccgggcccgccgggtgggcgctggccgaggacgcgttcacgcaccgggactcgatgatcaccaagttcgaggtgcgggcgctggccctggcccgtctggggccgcgcccgggcgacctggtgtgggacgtcggcgccggttccgggtccgtggcggtggagtgcgcgcggctgggtgccgccgtcaccgccgtcgagcggacgccggacggtgtcgggcgggtccgcgccaacgccgccgcgcacggtgtcgacctgcgggtggtgcacggggcggcgcccgcggtgctggccgggctggacgaggtcccggacgcggtgttcgtgggcggcggcgggcgcgagctgccttcgatcgtcgccgagtgcgcgcggcgggcccggcgctcggtggtcgtcgccgtggccgcgctcgaccgggtgccggcggcccgcgaggcgctgctcggcgccggtctggactgcgacggggtgctgctgcagtcctcgcggctcgcgccgctgccgggggacgtgacccggctcgcggccaccaatcccgtcttcctgctgtggggcgtcaggccgcacggccgtaccgaaggagttgccccttga

SEQ ID NO: 8876 - protein, 410 aa, Streptomyces coelicolor A3(2)
MVGMGAASGAAPAGDVAAGAELVVGGRRHLDAVRLPEGVRTVVLGALAPALDTVAEYVARGRPVTVLASGDPGFFGIVRALAERFGPERLDVRAGVSSVAAAFARVGLPWDDAVVASAHGRDLRTAVNVCRAHPKVAVLTGPGAGPAELGAALRDDGRVFVVASALGSAEERVERVTPAEAAARDWGTAVSVVLCLDGARAPGPVRALAGVRPGPAGWALAEDAFTHRDSMITKFEVRALALARLGPRPGDLVWDVGAGSGSVAVECARLGAAVTAVERTPDGVGRVRANAAAHGVDLRVVHGAAPAVLAGLDEVPDAVFVGGGGRELPSIVAECARRARRSVVVAVAALDRVPAAREALLGAGLDCDGVLLQSSRLAPLPGDVTRLAATNPVFLLWGVRPHGRTEGVAP

SEQ ID NO: 8877 - DNA, 1248 bp, Thermosynechococcus elongatus BP-1
  CDS (1)..(1248): transl_table=11
gtgactccgattcatgtggtgggcattggcttggacggtctcccagggttggcagccgcggtgcagcagattattgattcagccacccttttggtggggagcgatcgccatctgcaattgattccccaaggggacactccccgcctctccctagggaactttaatgccagtctcaaggcgattcaaacgcacttggacaccacagccaacccccaagtggtcattctcaccagtggtgatccgctgttctatggattaggacgctggctccttgaagtctttgcccccgatcagttaacctttcatccccacctgagtgcagtgcaattggcctttagtcgcctcaagctcccttggcaggatgcggtgatctacagtgcccatgggcgggatctagcgggactggtgcccctgttgcagcggggggtggagaaaattgccatctacaccgatggcgaggccaatattgctgccattagccgtctataccaagcattgcacatacctgtaacctatcgggcgtgggtttgtcaggcccttgggagtgcagaggaagccattctgccctgggacttagcccaaccggtgacggcgctgccgccagtccatcccttgaatttggtggtgctcctgcgtcaaccccagcgcctaccccctagggaacagcccattgttggcttaggggatgatcagtttttcacctttgcagatcgccctagcctgatgacaaagcgggaagtgcgggtactggttttggcggaactggccctcaccagcactgtagaaatcgtttgggatattggtgctggcaccggcagtgtagccgtggaaatcgcccgccttgccccccaagccactatctatgcgatcgagaaaactgcgattggctttcaactgattgagcgcaaccgcagggcttttggtttggccaacctcatccccctccaagggacagcgccgcagtgcctcagggatttaccgccaccggatcgggtgtttattggcggcagtggtgctcagttactggccaatctcgactattgttggtcccacttgaacgctggcggccggctagtgctggcgatcgctaccctcgaacaccaaggtcaagttctccactggtgtcagacccatcaaatcaacccacaagtgctacaggtgcaactcagccgttcggttcccctgggtcaaggccaccgcctccacccccttaatccggtcaccctaatgaccttgactcagggatag

SEQ ID NO: 8878 - protein, 415 aa, Thermosynechococcus elongatus BP-1
MTPIHVVGIGLDGLPGLAAAVQQIIDSATLLVGSDRHLQLIPQGDTPRLSLGNFNASLKAIQTHLDTTANPQVVILTSGDPLFYGLGRWLLEVFAPDQLTFHPHLSAVQLAFSRLKLPWQDAVIYSAHGRDLAGLVPLLQRGVEKIAIYTDGEANIAAISRLYQALHIPVTYRAWVCQALGSAEEAILPWDLAQPVTALPPVHPLNLVVLLRQPQRLPPREQPIVGLGDDQFFTFADRPSLMTKREVRVLVLAELALTSTVEIVWDIGAGTGSVAVEIARLAPQATIYAIEKTAIGFQLIERNRRAFGLANLIPLQGTAPQCLRDLPPPDRVFIGGSGAQLLANLDYCWSHLNAGGRLVLAIATLEHQGQVLHWCQTHQINPQVLQVQLSRSVPLGQGHRLHPLNPVTLMTLTQG

SEQ ID NO: 8879 - DNA, 1206 bp, Brucella suis 1330
  CDS (1)..(1206): transl_table=11
atgggctgctggctgacggtaatcggtattggtgaagacgggctggatgggctggggcaggcagcacgcaatgctatcgccgaagcacaggcaatttttggcggcaagcgacatctggcctttctgggcaacgacacagaggcggaacgcatcgcatggccttcgcccttcgatgaagcctttgcggcgatccatgcgcgcagaggcaggcccatcgttgtgcttgcaagtggagatccgatgtttttcggcgtcggcgcgtcgcttgcgaagcatttttcgcccgatgagatgctggttctgccttatccctcatcgctgtcgctggctgccgcccggatgggctgggcgcttcaggacgtgcaaacggtgagcgtgcatggccgcccctatgaattgcttgttccgcacattctgccgggtgtgaggcttctggtgttgagcaatgacggtacgaccccggcaagggtggctacgctgctggcggccataggatttgggcaaagcgtcctgaccgttctggagcatctcggtgggccgaaagagcgcatcctccacggcaccgccgctaactggctgcatgagcgatgtgcggaccttcatgtgctcgccatcgcgtgtattgccgcgccggatgcggctgttttgtcgcctgttgcgggattgcccgatgaggcgtttgaaaatgatggccagcttaccaagcgcgatatccgtgctgtcacgctttcgcgattgcagcccttgccgcaccagcttctttgggatgtgggcgcaggctgcggctccatcggcatcgaatggatgcgtgttcatgcctcatgccgggcaattgcaatcgaggccgatgagggacggcaaggcatgatcgagcgcaaccgggtggcacttggcgttcccggtttgcagcttgtgcaaggcagggcgccttccgcgctgcgcgggcttgaagcgccggacgcaattttcattggcggcggcgtgacggatgaaggtgtgctggaagcctgctggaatgccctgaaaccgggcggacggctggttgccaatgccgtgaccttgcaaagcgaaatgcggcttttcgcctggcggcaggaatttggcggtgatctgacccgcgttggtgttgcacaggcgggcgaactcggctcgttcgatgtctggcgtcaggcgctccccgtcacgatttattgcgggttcaaatga

SEQ ID NO: 8880 - protein, 401 aa, Brucella suis 1330
MGCWLTVIGIGEDGLDGLGQAARNAIAEAQAIFGGKRHLAFLGNDTEAERIAWPSPFDEAFAAIHARRGRPIVVLASGDPMFFGVGASLAKHFSPDEMLVLPYPSSLSLAAARMGWALQDVQTVSVHGRPYELLVPHILPGVRLLVLSNDGTTPARVATLLAAIGFGQSVLTVLEHLGGPKERILHGTAANWLHERCADLHVLAIACIAAPDAAVLSPVAGLPDEAFENDGQLTKRDIRAVTLSRLQPLPHQLLWDVGAGCGSIGIEWMRVHASCRAIAIEADEGRQGMIERNRVALGVPGLQLVQGRAPSALRGLEAPDAIFIGGGVTDEGVLEACWNALKPGGRLVANAVTLQSEMRLFAWRQEFGGDLTRVGVAQAGELGSFDVWRQALPVTIYCGFK

SEQ ID NO: 8881 - DNA, 1236 bp, Leptospira interrogans serovar Lai str. 56601
  CDS (1)..(1236): transl_table=11
atgaaagcggttactgttgtcggtatgggcgatgaaggttgtccagggttatcaagtatcgctgccaatgcggtcgcaaaagctcaaatactcgctggcggaaaaaggcatttagatttttttcctcaattctccggagaaaaaatagtgttcaaagatgatttgacccaaaccatcaaaaggatcgcggaactttctttggaacatacaatatgtgttcttgcgtccggagatcctttgtttttcggaatcggaaatttaattcgtaaaaaagtaggtcctgaatacgtagattttattccagcccccagttccgttcaacacgcgtttgcaaaaattggaattccttgggacgacgccgaagtcttatccttacatggaagatcttcgaaaggactgattaccaaattacaatttcttaataaggttgcattgtttacggacaaaatcaatcacccgaaagaaatcgcttcttatctattgtctttcaacgaatctgaatggactgcatttgtatgcgaaaatctaggaggagaaaaagaaagaatccgtaaattcgacttaaaatcgttaagcgaagaagaaggaattgatcctctaaacgttttggttctcattagaaactcagtaaattggaaaccacctacagttgtgcctaacgtttcagaagaaaattattcaaaacgagttcccaaaaaagggctgattactaaaaaagaagttcgaattctttccatcgcgtttttaaatatcagagaagatagtgtaatctgggacattggagcaggctctggttctatagccatcgaagccgcacagatcgctaaaaacggcaagtcctatgcaatcgaaattgatcctgaaggaattgaaatttgtaaacagaacattcttctccaaaagacggataatgtacatgtgatttcaggaaaagctccagaagttctagaaaaacttccagatccagactgtatctttgtaggtggttctaatggagatatttatgagattattagaatatcattaaataaactttcgcctctcggaagtttggtaataaatgcagtaaccatagacaacgtttctcaaatctatcagagttttaaaaaattaaaacttgtacctgaagtaactcttttgaacgtttctagaggacgagtcctaaaggattatcttcggtacgaagctctcaatccgattcacatttttaagattaaaaaaccggagaaaatgtga

SEQ ID NO: 8882 - protein, 411 aa, Leptospira interrogans serovar Lai str. 56601
MKAVTVVGMGDEGCPGLSSIAANAVAKAQILAGGKRHLDFFPQFSGEKIVFKDDLTQTIKRIAELSLEHTICVLASGDPLFFGIGNLIRKKVGPEYVDFIPAPSSVQHAFAKIGIPWDDAEVLSLHGRSSKGLITKLQFLNKVALFTDKINHPKEIASYLLSFNESEWTAFVCENLGGEKERIRKFDLKSLSEEEGIDPLNVLVLIRNSVNWKPPTVVPNVSEENYSKRVPKKGLITKKEVRILSIAFLNIREDSVIWDIGAGSGSIAIEAAQIAKNGKSYAIEIDPEGIEICKQNILLQKTDNVHVISGKAPEVLEKLPDPDCIFVGGSNGDIYEIIRISLNKLSPLGSLVINAVTIDNVSQIYQSFKKLKLVPEVTLLNVSRGRVLKDYLRYEALNPIHIFKIKKPEKM

SEQ ID NO: 8883 - DNA, 1212 bp, Pseudomonas putida KT2440
  CDS (1)..(1212): transl_table=11
atgacaccctggctgacagtagtaggcatcggcgaagacggcttcagcggcctgggcaaacaggcccggcgcgccctgctgggcgctggccgggtcttcggcagcccgcgccagctggccttgctgccacgttgcgtgaccgctgaacagttggcctggcccagcccgttctcgctggccccagtgctggcccttcgcggcgagccggtgtgcgtgctggccagcggtgaccctatgttctacggcgtcggcgccagcctggcacgccaggtgcctgctgcagaaatgcgcgtgttgtcgctgccctcttcctgcgccctggccgctgcccgcctgggctggccgctgcaggacctgcaggtggtgtcgctggtggcccgccccctggcagcgctcaatgcccacttgcacagcggcatgcgcctgctggtgctgagcaacgatggcgacagcccggcggcaattgccgcgcagctgcgcgggcaaggcttcggcccaagccgcctgcaggtgttcgagcacttggggggcgtggacgaacgtgcactggccggcaccgcccaggactggccgcacaccggtatcgcggcgctcaacctggtcgccatcgaatgcctggctacaccggatgccccccgcctgcaccggctggccgggctgccagacgccgcataccggcacgatggccagttgaccaagcgtgatgtccgcgccatcaccctggcgcgcctggcaccgcagcctggcgaactgttgtgggatgtgggcgcgggctgcggctcgatcggcatcgaatggatgcgcgcccacccggcatgccgcgccctggccatcgaggccgacgaaggccgccagggtttgatcgagcacaatcgcgatgcactgggtgtacccggcctgcaactggttcgcggcaaggcgccagcggcgctgcaaggcctggaacaaccggatgcgatcttcatcggaggcggcgttacccgcacaggtgtactggacctgtgctgggcaagcctgcgccccggcggccgcctggtggccaacgccgtcaccctgcaaagcgaactggccctggcacattttcgcgaacagcacggtggtgagctgacccgcatccatgtcgcgcatgcccagcccttgggtgcattcgacacttggcgccaggcgctgccgatcacccttctcgaagtactgaaacccgccgatgcgtga

SEQ ID NO: 8884 - protein, 403 aa, Pseudomonas putida KT2440
MTPWLTVVGIGEDGFSGLGKQARRALLGAGRVFGSPRQLALLPRCVTAEQLAWPSPFSLAPVLALRGEPVCVLASGDPMFYGVGASLARQVPAAEMRVLSLPSSCALAAARLGWPLQDLQVVSLVARPLAALNAHLHSGMRLLVLSNDGDSPAAIAAQLRGQGFGPSRLQVFEHLGGVDERALAGTAQDWPHTGIAALNLVAIECLATPDAPRLHRLAGLPDAAYRHDGQLTKRDVRAITLARLAPQPGELLWDVGAGCGSIGIEWMRAHPACRALAIEADEGRQGLIEHNRDALGVPGLQLVRGKAPAALQGLEQPDAIFIGGGVTRTGVLDLCWASLRPGGRLVANAVTLQSELALAHFREQHGGELTRIHVAHAQPLGAFDTWRQALPITLLEVLKPADA

SEQ ID NO: 8885 - DNA, 1182 bp, Bradyrhizobium japonicum USDA 110
  CDS (1)..(1182): transl_table=11
atggctgatccctggctgaccatcatcggtatcggcgaagatggccttgccgggctgtcggacgcaagccgaaaggcgctgcgtgaggccgaaaccatcttcggtggtgagcgtcatctcgcgcttgccggtgtgaccgggcgcggccatccgtggccggtgccgttcgatgcggaggccgtgctcagccgccgcggccggccgaccgcggtgctggcctccggcgatccgttctggcacggcgccggcgcaagccttgccgagaagcttgaggcgggtgagtgggtcgcacattctgcgccgtcgacattctcgctcgccgctgcgcggctcggctggcgtcttgaatccgtcgtctgcctcggtctccacgccgcgcccttcgagcgcctcgtgccacaccttgcgcctggcgcgcgcatcatttgcctcgtgcgtgacggcaaggccgcaggcgaccttgcaaagtggctgagcgagcgcggatggggcgcctcggcattctggactctcgccgcgctcggcgggccacgcgaaagcattgcggaacatcgtgccgatggttttactggcgatctcgccggaaacctggtcgcggtggccgtggaggcgaagggagctcagggcattcctcgcagctcgggacttcccgacgatctcttcgctcatgacggccagatcaccaagcggccggtgcgtgcgctcgcgatttctgcgctggcaccacgcccgggcgaacggttgtgggatatcggcgccggatcgggttcgatctcggtcgagtgggcgctttgcggcgggacggcgacggcaatcgagatgcgcgaagatcgcgccgcgaatatccgcagcaatgcggcggcgttcggattggcgcatcggatcgctgttgtcacgggccgtgcgccagaggctctcgccgggctggacgcgccggatgcggtcttcttcggcggcggtctcgatagcgcgatgttcgatgccatctggtcgcgcatcggggcaggcacacggctcgttgcgcatgcggtgacgctggagacggaagcgctgcttggcgaactgcaccagcgccacggcggcgagttgatgcgggtcgagatcgcccatgccggcccgctcggccgctaccgatcctgggaagcggcgcgtcccgtggtgcagtggagtgcggtccgatga

SEQ ID NO: 8886 - protein, 393 aa, Bradyrhizobium japonicum USDA 110
MADPWLTIIGIGEDGLAGLSDASRKALREAETIFGGERHLALAGVTGRGHPWPVPFDAEAVLSRRGRPTAVLASGDPFWHGAGASLAEKLEAGEWVAHSAPSTFSLAAARLGWRLESVVCLGLHAAPFERLVPHLAPGARIICLVRDGKAAGDLAKWLSERGWGASAFWTLAALGGPRESIAEHRADGFTGDLAGNLVAVAVEAKGAQGIPRSSGLPDDLFAHDGQITKRPVRALAISALAPRPGERLWDIGAGSGSISVEWALCGGTATAIEMREDRAANIRSNAAAFGLAHRIAVVTGRAPEALAGLDAPDAVFFGGGLDSAMFDAIWSRIGAGTRLVAHAVTLETEALLGELHQRHGGELMRVEIAHAGPLGRYRSWEAARPVVQWSAVR

SEQ ID NO: 8887 - DNA, 1215 bp, Clostridium tetani E88
  CDS (1)..(1215): transl_table=11
atgaataatttaggaggtgaagaaatggtttatatagttggaataggaccaggtcataaagattatataatgcctaaagctatagagatattagaaaaagtagatataatagtaggctttggcagagctatggaaagtatagattttttaccaaccaagaaaataaaagtgggtaaaataaaagaggtagtagaagtattaaatgaaaatttaaataaaaacatagcggtagtggcatcaggagatcctctgttttttggtattacagaatatataaaaagagaatataaaaaagatatagagataataccgggtattagttcctttcaatatcttatgggaaaattaaataaaagttggaataatgcttatttaggtagccttcatggaagagaagatgaatttttaaaagtggtaaagaaaaatcctatatctatatggcttacagatagtaaaaatagtccagataagctagctaaatcattgcttgcaaatggattaaatccatatatgtatgtgggtgaggaactatcttatgaaggtgaaagaatagtgaaaggacaagcagagaaaataaaggatgaaaaattcttaaaactttctgtggtaattattgaaaataataattttatagcaaaagaagatattcattttataaaggacaatgaattcataagaggagattgtcctatgacaaaggaagaagtaagaatgcttactgctattaaaatggatataaaagaagaagataaagttttagatataggagcaggaactggctctgtaagtattcaagcatgtaaactatgtcccttaggaaaagttatagcaatagaaaaagaagaagaggccctaagggttataagagaaaataagaaaaagtttaatgcaaataatttagaaatagtagagggtgaagctttatccataaaagacacaatacaggaaagctttaattctatatttataggtggaagtggcggaaacctagaagagttaataaaagaatatagtaaaaaattaaaagataatgggaaaatagtgcttaattttataactataaataatttatataaggccatggatactttaaaagaactaggatttaaggtaaagtgtactcaagtgtccataagtaagactagagggcaaacttatatgttaatgggatataatccaatatttataatagaaggagaaaagacaaatggctaa

SEQ ID NO: 8888 - protein, 404 aa, Clostridium tetani E88
MNNLGGEEMVYIVGIGPGHKDYIMPKAIEILEKVDIIVGFGRAMESIDFLPTKKIKVGKIKEVVEVLNENLNKNIAVVASGDPLFFGITEYIKREYKKDIEIIPGISSFQYLMGKLNKSWNNAYLGSLHGREDEFLKVVKKNPISIWLTDSKNSPDKLAKSLLANGLNPYMYVGEELSYEGERIVKGQAEKIKDEKFLKLSVVIIENNNFIAKEDIHFIKDNEFIRGDCPMTKEEVRMLTAIKMDIKEEDKVLDIGAGTGSVSIQACKLCPLGKVIAIEKEEEALRVIRENKKKFNANNLEIVEGEALSIKDTIQESFNSIFIGGSGGNLEELIKEYSKKLKDNGKIVLNFITINNLYKAMDTLKELGFKVKCTQVSISKTRGQTYMLMGYNPIFIIEGEKTNG

SEQ ID NO: 8889 - DNA, 1203 bp, Pseudomonas syringae pv. tomato str. DC3000
  CDS (1)..(1203): transl_table=11
atgtcgccgtggctgacagtcgtgggaatcggagaagacggttacaagggcctgggaaagaacgcccggcacgcgctgctgcacgccgatcaggtgttcggcagcccgcgccagctggcgttgctgccgccctgcattggcgccgaacggcgcgcatggccaagcccgttctcgctgaacccggtgctggagcagcgcggtgccgagatttgtgtactggccagcggcgaccccatgctgttcggcgtcggtgccagcctggcgcgtgtggtcgccatcgaagaaatgcgcatcctgcccgcgccctcctcttattcgctggcagctgcacgccttggctggccgttgcaggaagtcgtcacgttgtcggtggttgcccggccggtggccgcgctgaacgcgcatttccatcacggcgtgcgcctgttggtgctgagtaatgacggcagtagcccagccgtgatcgccggtctgctgcgcgagcgaggcttgggccccagccgcatgaccgtgctggagcatctgggcggtgaagcggagcggcgtgtcgaagggctggccagcgaatggggcaatcctgaaatcgctgcgctcaatcttgtcgctatcgattgtcgcgccgatgccagcgctattcgcctgagcacgctggccggtttgccagacagtgcgttcgagcatgacggccagttgaccaagcgcgatgtgcgcgccatcaccctcgcccgccttgccccggtgccaggcgcattgctctgggatgtgggggcgggctgcggctcgatcggcatcgaatggatgcgggctcatccgacctgtcgggccatggccatcgaggccgacgagggtcgtcagcaactgattgaattcaatcgcgatgcgctgggcgtgcccggcctgcaactggtgcgcggcagtgcacctcaggcgctgaacggcctggaacgcccggatgcgattttcatcggcggcggcgtcacgcgtatcggcgtgctggaaacctgctgggagcaactgcgctccggcggacgactggtggccaacgccgtgaccctgcaaagcgaggtcgcactgatggcctggcgcgagcggcatggcggcgaactgacgcgcattcacgtcgcgcatgcccagcctctcggcgagttcgacacgtggcgtcaagcactgccgatcactctgctggacgtagtcaaaccctga

SEQ ID NO: 8890 - protein, 400 aa, Pseudomonas syringae pv. tomato str. DC3000
MSPWLTVVGIGEDGYKGLGKNARHALLHADQVFGSPRQLALLPPCIGAERRAWPSPFSLNPVLEQRGAEICVLASGDPMLFGVGASLARVVAIEEMRILPAPSSYSLAAARLGWPLQEVVTLSVVARPVAALNAHFHHGVRLLVLSNDGSSPAVIAGLLRERGLGPSRMTVLEHLGGEAERRVEGLASEWGNPEIAALNLVAIDCRADASAIRLSTLAGLPDSAFEHDGQLTKRDVRAITLARLAPVPGALLWDVGAGCGSIGIEWMRAHPTCRAMAIEADEGRQQLIEFNRDALGVPGLQLVRGSAPQALNGLERPDAIFIGGGVTRIGVLETCWEQLRSGGRLVANAVTLQSEVALMAWRERHGGELTRIHVAHAQPLGEFDTWRQALPITLLDVVKP

SEQ ID NO: 8891 - DNA, 1251 bp, Streptomyces avermitilis MA-4680
  CDS (1)..(1251): transl_table=11
gtgatcaccgtcgtcggtacgggaacgggggcgcccctgtccgcggacgccgcgcgcgccctggccggggcggggctcgtggtgggcggccgacggcatctggcggcggccgcgctgccggacggggccgagcggatcgtcctggggccgctggcgcccgctctcgacgcgatcgaggcggctctggagaagcaacggcgggtggtggtgctggcctccggcgacccggggttcttcgggatcgtacgggcactggccgagcggttcggcgccgagcggctggatgtgcgtccgggtgtctcgtccgtggcgaccgccttcgcgcggctcgggctgccctgggacgacgcggtggtggtgagcgcgcacggacgtgatctgcgcaccgccctgaacgtctgccggtcgcgtcccaaggtggcggtgctgaccgggcccggcgccgggcccgccgagctgggggccgcgctcgcccacgggttcggcgcgcgggtcctcgtggtggcgagcgcgctcggcgaccccgagcacgaacgcgtggagcgggtgacgccggccgaggccgcggcccgcgactggggtacggcggtcagcgtggtgctgtgcctggacgcctcccgggccctcgctcccgtgcgcacggtcgcgggcccgccggccggtcccgcccgctgggccctggaagagggcgacttcgcccaccgcgattcgatgatcaccaagttcgaggtgcgcgccctggcgctggcccggctcggcccgcggctcggggacctcgtctgggacgtcggcgcgggctccgggtcggtggccgtcgagtgcgcgcgcctcggtgccgccgtcacggcggtcgagaagacgctcgacggggtggagcggatccacgccaacgcgcgggcgcacggcgtggacgtccacgtcgtgcacggggccgcgccggacgcgctgaccgctctccccgacccggacgccgtgttcatcggcggcggcgggcgcgaactgcccgccctcgtcaccgcgtgcgcgcggcgcgcccggcggacggtcgtcgtggcgatggccgcgctcgaccgggtgccggccgtgcgcgaggcgctcaccggggccgggttcggctgcgacggtgtgctgttgcagtcgtcccggctcgccccgctgcccggggacgtcacccggctcgcggcgaccaatcccgtttttctgctgtggggcgcccggcctccggcccgtaccgaaggagcactccagtga

SEQ ID NO: 8892 - protein, 416 aa, Streptomyces avermitilis MA-4680
MITVVGTGTGAPLSADAARALAGAGLVVGGRRHLAAAALPDGAERIVLGPLAPALDAIEAALEKQRRVVVLASGDPGFFGIVRALAERFGAERLDVRPGVSSVATAFARLGLPWDDAVVVSAHGRDLRTALNVCRSRPKVAVLTGPGAGPAELGAALAHGFGARVLVVASALGDPEHERVERVTPAEAAARDWGTAVSVVLCLDASRALAPVRTVAGPPAGPARWALEEGDFAHRDSMITKFEVRALALARLGPRLGDLVWDVGAGSGSVAVECARLGAAVTAVEKTLDGVERIHANARAHGVDVHVVHGAAPDALTALPDPDAVFIGGGGRELPALVTACARRARRTVVVAMAALDRVPAVREALTGAGFGCDGVLLQSSRLAPLPGDVTRLAATNPVFLLWGARPPARTEGALQ

SEQ ID NO: 8893 - DNA, 1305 bp, Prochlorococcus marinus subsp. marinus str. CCMP1375
  CDS (1)..(1305): transl_table=11
atgctaagaaacaatataaattctgacaaagcttttcttccaataaatgttgttggggttacagcctcaggagttttcggtcttccattggaactccaacaattaatcctctcagcaaaaaatatttctgctcctaaaagaatattaaataatttcgttgaatggtgggagcatcaagctgcaaatgccccctctccagagcttttcccaagcgataaacccaatgaattaatcgaatggttgaagcaacgaaatcaaaagacagttttgctagcaagtggagaccctctttggtttggaataggaagagtcctacttaatcattttccatcagagcaactaatcttccatccttcacctacttcattgcaactagcttttgcgcaattaaagaggccttggcaagatacaagctggataagtttgcatggtagagatgccagccctctctttaatcttttacaacaaaggcctaacgcgattggaatactaatagatccaaataaaggaggtgcaaacgaagttcgagagatacttcattcctctgaacttgaagaccagtatgctttttggatatttgaaaagttaggacacaaagaagaacgtattttcagaatattttccaatgaaaagctatcaaagttagatccattgcatctagtagttcttataaaagaaaaaaaaattatcaagaccaaaaaagagctcccattatttggaatagaagatggtttctatctgcaacatgctgatcgacctggacttatgacaaagcgagaagttcgtactcaagtattagcagatcttgagcttccagaaactggtgttatttgggacataggtgcaggagtaggaactattggattggaagctttaaggttaaggccaaacttaaaattattgatgattgaaaagcgtattgggggtaaagagttaatcaatgaaaatgctaagcgcttatctgttaagccagaaatagtaattgaaggagaagctcttaattttctagaaaaagaatcaattcctattcatatttcaaaaccaaatagagtgattttaggaggagggaatagtcgtaaagatactcttctaaaaataattcttagcttcattcaacctctagggataatagttatccctttagcaacattggagcatcttgaaaaaacaattctagttttaaaagaagctggctgtgatgtgaaaatcagtcaacatcaaaactttagaggtgttcccttaatgcaagggactcgtcttcttccaatgaatccagtgtttattattaaaggaaaattaaaataa

SEQ ID NO: 8894 - protein, 434 aa, Prochlorococcus marinus subsp. marinus str. CCMP1375
MLRNNINSDKAFLPINVVGVTASGVFGLPLELQQLILSAKNISAPKRILNNFVEWWEHQAANAPSPELFPSDKPNELIEWLKQRNQKTVLLASGDPLWFGIGRVLLNHFPSEQLIFHPSPTSLQLAFAQLKRPWQDTSWISLHGRDASPLFNLLQQRPNAIGILIDPNKGGANEVREILHSSELEDQYAFWIFEKLGHKEERIFRIFSNEKLSKLDPLHLVVLIKEKKIIKTKKELPLFGIEDGFYLQHADRPGLMTKREVRTQVLADLELPETGVIWDIGAGVGTIGLEALRLRPNLKLLMIEKRIGGKELINENAKRLSVKPEIVIEGEALNFLEKESIPIHISKPNRVILGGGNSRKDTLLKIILSFIQPLGIIVIPLATLEHLEKTILVLKEAGCDVKISQHQNFRGVPLMQGTRLLPMNPVFIIKGKLK

SEQ ID NO: 8895 - DNA, 1281 bp, Prochlorococcus marinus subsp. pastoris str. CCMP1986
  CDS (1)..(1281): transl_table=11
atgactcagataataagaaaagttcatgtgataggaattaattcttttgaatttaacgagctacctttcaaattacaaaaattatttatagaaacagaaaatattgccgttccagattcatactttgcaaatattaaattatgggccaaaaataatgcaaaaaatgaaaagttattcttcgctagcagaagtgacaataaactgattaattggcttaaatctcaaaaaagcgacgtaattttattttctaggggcgatcctctttggtttggtattgggagaatacttatcgaaaacttttcaaaagaagaattaagtttctatccatcaaatacatgttttcaattagcatttagcaaactaaaaatatcttggcaagaagctatttatgtaagtattcacggaagagattcaactaaattgattgaggtactaaaaacaaagcccttaagtctagcgatcattacagattcaaaaaacaacggattagaaataattcaaaataatttattagagttaaatctagagaatctttacgaattttggatttgtgaggaaataggttttaaaaatgaaaagatcagaaaatttaacctcaaagaaaaattaccatctgacatttctaatttgaatattgctgttcttctgagaaaagaaaaagatcatgtagaaactgatatccctttatttggattaaaagatgatacttttaaaacttttgaagacagaccaaatttattaacaaaaagggaagttagaattcaaattttggctgatttagagttaccagaaaatggcacaatttgggatattggagcaggttgcggctccattggtttagaagcattaaaattaaggcctaatttaaaattattttgtattgataaaagaattggctcaaaagagttaatctcagaaaatgcaagaagattaggagtttcccctaaagatatttttgaagaagatgtaaataatttatttaattccaataatattaattctttgagagaggctaagagaataattattggtggctgtgataaaaagactaagcttcgaattattaatgaattgtctatacatatgaactgtggagatattgttgctattcctttaatagatatccaaaccattaaagatctaagagataccttaaaaggaaataatttcgaagtgaatttaaatcttatccagacttataaaagcttaagtatttcagaaggaataagaatggatccaaataatcctgtatttttgcttagaggaagaaaactttcttaa

SEQ ID NO: 8896 - protein, 426 aa, Prochlorococcus marinus subsp. pastoris str. CCMP1986
MTQIIRKVHVIGINSFEFNELPFKLQKLFIETENIAVPDSYFANIKLWAKNNAKNEKLFFASRSDNKLINWLKSQKSDVILFSRGDPLWFGIGRILIENFSKEELSFYPSNTCFQLAFSKLKISWQEAIYVSIHGRDSTKLIEVLKTKPLSLAIITDSKNNGLEIIQNNLLELNLENLYEFWICEEIGFKNEKIRKFNLKEKLPSDISNLNIAVLLRKEKDHVETDIPLFGLKDDTFKTFEDRPNLLTKREVRIQILADLELPENGTIWDIGAGCGSIGLEALKLRPNLKLFCIDKRIGSKELISENARRLGVSPKDIFEEDVNNLFNSNNINSLREAKRIIIGGCDKKTKLRIINELSIHMNCGDIVAIPLIDIQTIKDLRDTLKGNNFEVNLNLIQTYKSLSISEGIRMDPNNPVFLLRGRKLS

SEQ ID NO: 8897 - DNA, 1296 bp, Prochlorococcus marinus str. MIT 9313
  CDS (1)..(1296): transl_table=11
atgcccgcctcaatcagctccgcagcgatccacatcatcggcaccgatgccgcaggcctagatcaccttgctactccattgcacgagctagtgctctcagcccaagggctggctgcaccaactcggttattgcaacagctgccgagctggtggcagcagcagcaaacggatcagcctttgccagaactgatggcgagcgatcaaccagaggctctgattgcctggttgcaccagcggcagggcacagccatcgtgctagccagcggcgatccgctctggttcggcatcggcaggcggctactcgaggcctgttctgctgatcagctgcactttcatccagcaccttgttcgctgcaactagcctttgcccggcttggacgcccttggcaggatgccgcctggatcagcctgcatggccgtgacccggcccccttagctcaaaagctgcaacaacgccccgcagctctagctgtactaaccgatcccaaccgcggtggagccgaagaggtgcgtacgattttgcgcgcttctggcctagaagctgcctatgcagtgtggctttgcgaacagctcggacacgccaatgaacgggtgcaacggctgacgccacaggatgccttgccatcggatcttcatcccctacacatggtggtgctgcttgccgaacaagctgctccagcaggagatccagccaagcttccattgttcggtcttgacgatggcttgttcctgcaacacgacgatcgccctggcctgatgagcaaacgggagctccgtgttcagctcctctcagagttagagctaccagaacagggcgtgctctgggatttaggtgccggcgtcggcagcgttggcttagaagccctacgcttgcgcccacaactgcaattgcttgctgttgaaaagcgtggcggcggcgcagcgctgattaaggcaaatgctgcccggcttgccgttcatcctgctgctgtgctcgaagttgaggccctcagcctgctgaatggaactgatctaccagcaaaactcagcaaccccgaccgggtgctcctagggggtggcggccgccagggagctgctctactcaaggccgtattgcaaaaacttcaaccacatggagtcgtcgtgattccactggtaaccgttgaggccatggcagaactcaagcccttacttcaagattgcggttgcaccgtgaaagtgagtcaacaccaagcctggaggggcctgccgctggcaaacggcacacgcatggcgccgatgaacccggtgatgatcctcaaaggcacgatgccttaa

SEQ ID NO: 8898 - protein, 431 aa, Prochlorococcus marinus str. MIT 9313
MPASISSAAIHIIGTDAAGLDHLATPLHELVLSAQGLAAPTRLLQQLPSWWQQQQTDQPLPELMASDQPEALIAWLHQRQGTAIVLASGDPLWFGIGRRLLEACSADQLHFHPAPCSLQLAFARLGRPWQDAAWISLHGRDPAPLAQKLQQRPAALAVLTDPNRGGAEEVRTILRASGLEAAYAVWLCEQLGHANERVQRLTPQDALPSDLHPLHMVVLLAEQAAPAGDPAKLPLFGLDDGLFLQHDDRPGLMSKRELRVQLLSELELPEQGVLWDLGAGVGSVGLEALRLRPQLQLLAVEKRGGGAALIKANAARLAVHPAAVLEVEALSLLNGTDLPAKLSNPDRVLLGGGGRQGAALLKAVLQKLQPHGVVVIPLVTVEAMAELKPLLQDCGCTVKVSQHQAWRGLPLANGTRMAPMNPVMILKGTMP

SEQ ID NO: 8899 - DNA, 1248 bp, Synechococcus sp. WH 8102
  CDS (1)..(1248): transl_table=11
atgatcgatgtgatcggtactgacgcaggggcaccggcctcgctgcccgctgcgcagcaagccctgattcgagctgccgaacagatcgctgcaccgcgccgccttcagccagcccttgaaacatggctggaaagcccggttcccctgatcgacagcgacgacccccgccatctggtggaggtgctcagcgctctctccgctcaaaccaacgcggtggtgctggccagtggggacccgctctggttcggcatcggcagaatcctggcggagcgcctcgggccggagcggctgcgctttcatcccgcgcccaccagcctgcaactggcctttgcccgcatcggtcgtccctggcaggacgcccgctgggtgagcctgcatggacgcgatcccgagcccctggcccgggaactgcagacgcggccgagggccctggcggtgctcaccgaccctggccgtggcggtgccgacgccgtgcgccgctgtctgcgcagcagcggtctggaggcgagctatcagctctggctgggggaaaaccttggccatgccgacgaacggatgcggctgatcccggccgatgcccccctgccggagccactgcagccattgctggtggcactgttgattgccgaggaaccgtccattccgaactcgagggcgttgccgttgttcggtctggaggatggcctgtacctccagcacccggatcaccccgggctgatgaccaagcgggaggcacgcatccagttgctggcggatctggatctgcccgatcagggagtgctctgggaccttggcgccggcacgggcagcatcggactggaggcccttcgcctacggccccagctcaggctgctggcggtggagcgccgggccggtggggctgccttgatccaggccaatgcaaagcggctcgaggtgatgcccagcgccgtggtggaaaccgatgcgctgagcctgctgtccgccgatctgcctgacggcctggaccaaccggatcgcgtgttgctgggtggtggcggcccccatcgcgaggcgctgctgaaggcagtgctgcaacggttgcgtccatcggggatcgtggtgattccgctggcgacccttgaagcggtggccacgctgcggccgctgatggagcagtcaggactgacggtgcagctcaatcaattgcaggcctggcgaggccaacccctcagcgatggcacccgcctggcaccgatgaacccaatcctgagcctaaaaggcacgtaa

SEQ ID NO: 8900 - protein, 415 aa, Synechococcus sp. WH 8102
MIDVIGTDAGAPASLPAAQQALIRAAEQIAAPRRLQPALETWLESPVPLIDSDDPRHLVEVLSALSAQTNAVVLASGDPLWFGIGRILAERLGPERLRFHPAPTSLQLAFARIGRPWQDARWVSLHGRDPEPLARELQTRPRALAVLTDPGRGGADAVRRCLRSSGLEASYQLWLGENLGHADERMRLIPADAPLPEPLQPLLVALLIAEEPSIPNSRALPLFGLEDGLYLQHPDHPGLMTKREARIQLLADLDLPDQGVLWDLGAGTGSIGLEALRLRPQLRLLAVERRAGGAALIQANAKRLEVMPSAVVETDALSLLSADLPDGLDQPDRVLLGGGGPHREALLKAVLQRLRPSGIVVIPLATLEAVATLRPLMEQSGLTVQLNQLQAWRGQPLSDGTRLAPMNPILSLKGT

SEQ ID NO: 8901 - DNA, 1230 bp, Gloeobacter violaceus PCC 7421
  CDS (1)..(1230): transl_table=11
atgcacctgctttccatcgtgggcatcggagcggacggtccccgcggactgtcggcggacacccaggccctcatcgcccagagcccggtgatcgccggaagtgccgagcagttgcgctggtggccggggcgcagtgggcggatcgaaatgggcgccgatctggccgctttttttgcgcaactggagcaggcgctcaccgaggcaccggtggtgttggtggcgaccggcgacccgctctacttcgggattggacggctggtgctcgaacggttcggccgggagcaggtgcgctttatgccgcacctcagctcggtgcaactggcctgcagccgggcgaagctcccctggcaggaggcagcggtggtgagcgcccacggccgctccctcgaaaagctcggcgaggccctgcgcccgcttcccgaactggtcgcggtactcaccgacccggtcaacaccccggcgcgcatcgcccgcttcgtgctggatctcgccccggtgaccccgtaccggctgtgggtgtgcgcccggctcggcgccgaggacgagcaggtcgaatgcctgggctgcgagcaagcctgcgagcgggattttggcgagccgaacgtggtgctgctggagcgcgcccccgcccgcaccccggccagtctgcccgccgtgggcatcttcgacgatcacttcgtcactttttcggacaaacccggcctgatgaccaagtacgaagtgcgggttctggcgattgcttatctgcaactggagcgtgggcaggtctgctgggatatcggcagcggcaccggctcggtggcgatcgaaatggcccgcctgatcggcggcggcagcgtctacgcgattgaaaagaccgaggcgggctgtctgctcatcgaggccaactgtgcccgcctcggggtgtgcaacgtgcgggtgcgccgcgcccgcgccccggaggtgctcgctgaactgcccgccccggatcggatctttttgggcggcggcggacgccaattggtggccatcctcgaagcctgcaccgccgggctgcgcccgggcgggatcctggtggccagtttcgccgggctcgagcaactggtgagcgcccaggcttacttgctcaagcagggctggtccgtgcagtacacccatctgcagattgcccgctcggcgagccttgcgagcggttcgcggctggtgcccctcaatccggtctttttgttgcgctccacccggcccctgtga

SEQ ID NO: 8902 - protein, 409 aa, Gloeobacter violaceus PCC 7421
MHLLSIVGIGADGPRGLSADTQALIAQSPVIAGSAEQLRWWPGRSGRIEMGADLAAFFAQLEQALTEAPVVLVATGDPLYFGIGRLVLERFGREQVRFMPHLSSVQLACSRAKLPWQEAAVVSAHGRSLEKLGEALRPLPELVAVLTDPVNTPARIARFVLDLAPVTPYRLWVCARLGAEDEQVECLGCEQACERDFGEPNVVLLERAPARTPASLPAVGIFDDHFVTFSDKPGLMTKYEVRVLAIAYLQLERGQVCWDIGSGTGSVAIEMARLIGGGSVYAIEKTEAGCLLIEANCARLGVCNVRVRRARAPEVLAELPAPDRIFLGGGGRQLVAILEACTAGLRPGGILVASFAGLEQLVSAQAYLLKQGWSVQYTHLQIARSASLASGSRLVPLNPVFLLRSTRPL

SEQ ID NO: 8903 - DNA, 1248 bp, Corynebacterium diphtheriae NCTC 13129
  CDS (1)..(1248): transl_table=11
ttgggacgctccaaaaacgacgatggccaagcacacaccggtagcattaccgtcgtcggaattggagctggcggtgtagaagaactcggtgcacaagctcgcaccgcactacgccaagccacaatcatcatcggatccaaacgccaactcggactgctccccgaagatttccaaggcgaccgaatcgcatggccatctccgcttgttccagcaatcccagcactcttcgctgaattcatcgacaaagaagtcgtagtccttggatccggtgaccccatgtttcacggtatcggcagcacactccaccgactgcttccaaatcacagcatgaccgtgattccgcagccatcatcggcatcgctagcatgtgctcgactcggttgggcactagatacaacaagcgtctacagcctcgtcacccatcccatcgcacatctcacattagcaatcgaacaaggtgaccgtttcctagtattaggacgcaaccatgagtctccacacgagatctgtgaacaccttatttctttaggtcaaagcaccgcagaagtaaccgttctgagcgatatcggcagcgttagcgaaacaattacttcaggagcagctactgactacccgtcgaacgattcagcattgaacgttatcgcgatacgcccactcgccgccacccgaagtagagtaccgggactaccagactccgagtacgtcaccgatggtcagctcacaaaacaacacgtccgagcactcgcgatatcagctttggctcctaaacctcatgaaactctgtgggatatcggaggcggatccggttccatcgctatcgaatggctgcgttcaacaccacaaacgacagctgtctgcttcgaaatatcggaagaacgtcgcgaacgaatcctcagcaatgcaatcaacctcggggtatccgataggatagcagtgcagcaaggcgcccccagagcatttgacgatgttccagacaaccccgacgtcatcttcatcggcggtggacttaccgcgccgggcgtgttcgcggccgcatggaaacgcctaccagtagggggtcgattagtagccaacgcagtgacagtagaaagcgaacaaatgctttgggcactgcgtaaacaatttggtggaactatcagttcgtttgctatttcgcatgagcacacagtgggctcattcatcaccatgaaacctgcattaccggtacaccaatggaccgtagtaaaagcattgacaaaggaactctga

SEQ ID NO: 8904 - protein, 415 aa, Corynebacterium diphtheriae NCTC 13129
MGRSKNDDGQAHTGSITVVGIGAGGVEELGAQARTALRQATIIIGSKRQLGLLPEDFQGDRIAWPSPLVPAIPALFAEFIDKEVVVLGSGDPMFHGIGSTLHRLLPNHSMTVIPQPSSASLACARLGWALDTTSVYSLVTHPIAHLTLAIEQGDRFLVLGRNHESPHEICEHLISLGQSTAEVTVLSDIGSVSETITSGAATDYPSNDSALNVIAIRPLAATRSRVPGLPDSEYVTDGQLTKQHVRALAISALAPKPHETLWDIGGGSGSIAIEWLRSTPQTTAVCFEISEERRERILSNAINLGVSDRIAVQQGAPRAFDDVPDNPDVIFIGGGLTAPGVFAAAWKRLPVGGRLVANAVTVESEQMLWALRKQFGGTISSFAISHEHTVGSFITMKPALPVHQWTVVKALTKEL

SEQ ID NO: 8905 - DNA, 1218 bp, Geobacter sulfurreducens PCA
  CDS (1)..(1218): transl_table=11
atgcctcatcagaaaatttatctcgtcggcgccggcatcgaagggtgggaggggttcggctccaaggccctcgaagtcatcaacgaggccgaggttctcatcggccaccggcgtcatctggacacctttcccgagttcaaggggaagaagcaggaactgggcgatctctccatcctcctggagcagctgaagaacaccgacaagcggaccgttgtccttggctccggggaccccaactttttcggcatcgcccgcttcctgctccgcaatctctccaaggaccggatcgagatctttcccaacgtgacgagcgtgcagtacgcctttgcccggatcaaggaaccctgggacgacgccatcttcgtctcggtgcacggccgggggctcaagcccgccgtggaccggatcgtggccgccgagaaggtggcggttcttaccgacaagatcaatacccccgcagccatcgcccgcgaactgatcgagcgcggcgccgaggggtacgaggcgtggctctgcgaggacatggggacgccggccgagaagttcacccgcaccgatgtgaaggggctgctggacattgccgcctcggaactcaacatcctcatcctcgtgaaggcatgggaaccccagctggcccagtacccggtcatgggcatcgcggacgacgagttcgccacggccaagaagctgatcaccaagcaggaagtgcgggccgtcaccctggccaagctccggctccaggacgacctggtcatgtgggacatcggcgcgggcagcggctcggtatccatcgaggcgtccaacctcatgcccaatggccggctcttcgccctggagcgcaatccccagtacgtgaccttcctgcgggagaacctgaagaaattcgtggcccgcaacgtcgtgctggtggaggcgttcgcccccgaggggctcgatgagctgcccgaccccgaccgggttttcatcggcggttccggcggcatgctggaggagatcatcgaggccgtggaccgccggctcaagcccgagggggtcatcgtcctcaacgccgtgaccctggataccctcaccaaggcggtggagttcctggaagaccacggctacctggtggaggtggcgtgcgtcaacgtggccaagacccgagggctcaccgagtacaagatgttcgaggcccagaatccggtctacatcatctcggcatggaaaggcgaagagtga

SEQ ID NO: 8906 - protein, 405 aa, Geobacter sulfurreducens PCA
MPHQKIYLVGAGIEGWEGFGSKALEVINEAEVLIGHRRHLDTFPEFKGKKQELGDLSILLEQLKNTDKRTVVLGSGDPNFFGIARFLLRNLSKDRIEIFPNVTSVQYAFARIKEPWDDAIFVSVHGRGLKPAVDRIVAAEKVAVLTDKINTPAAIARELIERGAEGYEAWLCEDMGTPAEKFTRTDVKGLLDIAASELNILILVKAWEPQLAQYPVMGIADDEFATAKKLITKQEVRAVTLAKLRLQDDLVMWDIGAGSGSVSIEASNLMPNGRLFALERNPQYVTFLRENLKKFVARNVVLVEAFAPEGLDELPDPDRVFIGGSGGMLEEIIEAVDRRLKPEGVIVLNAVTLDTLTKAVEFLEDHGYLVEVACVNVAKTRGLTEYKMFEAQNPVYIISAWKGEE

SEQ ID NO: 8907 - DNA, 1275 bp, Prochlorococcus marinus str. AS9601
  CDS (1)..(1275): transl_table=11
atgactgaaaaaaaaagaaaaattcatgtagtaggaattaattcttataaatttgaggatctatctttcaaattacaaaatctatttttagaaacagaaaatattgcagttccaaattcatattttgaaaaaataaaatcatggagcgaaaatggtttagaaaaaaataaattatttttttcgagcaacagtaatcaggaacttgttaactggcttagatcacaaaaaactgatgttattttaatttcaagaggagatcctctctggtttggaattgggagaatactactagaaaatttttcaaaagatgaattaagtttctaccctgcaaatacttgcattcaattagcatttagtaagttaaagttcccatggcaagatactgttaatgtgagtattcacggaagagattcgactaagttaattgaagctcttaaagcaagaccgtcaaatttggctgtcattacagattcaaataacaaaagtctagaaataatcaaaaaaaatttatcagaacttgatctgattgacatctatgatttttggctctgtgaagaaataggcttcgaaaatgaaaaaatcaggaaattaaatcttaaagagtcattgccctcagatatatcaaatttgaatattgctattctttcaaaaaaaaaggaaaattattcgaacaacaatcttcctctattcggaatcaatgacaatgtttttaagacttttgatgatagaccaaatttattaactaagagagaagttcgcattcaaatattagctgctttagagctcccaagaaatggtgtcatttgggatataggagcaggttgtggatcaattggtttagaggcattaaagctaaggcctaatttggatttgttttgtttcgataaaaggattggctcaaaagaattaatactagaaaactcaaaaaggcttgacgtcaacccaaaatttatttttgaggaagacataaatcacaccttgaatgcgagaaatttaagttcttttgaaaaccctaatagattaataattggaggatgtgataaaaaaactaaactccagattattaataaaattgcacaagatatggatattggagacattatcgttatcccaataataaatattcaaactattaaagaattgaaagaggaattagaagataaaaatttcaaaacaaatttaaatttaattcagacctataaaagcttaagtattgcggagggaatgagactagaaccaaataatcctgtttttctattaacagggaaaaaataa

SEQ ID NO: 8908 - protein, 424 aa, Prochlorococcus marinus str. AS9601
MTEKKRKIHVVGINSYKFEDLSFKLQNLFLETENIAVPNSYFEKIKSWSENGLEKNKLFFSSNSNQELVNWLRSQKTDVILISRGDPLWFGIGRILLENFSKDELSFYPANTCIQLAFSKLKFPWQDTVNVSIHGRDSTKLIEALKARPSNLAVITDSNNKSLEIIKKNLSELDLIDIYDFWLCEEIGFENEKIRKLNLKESLPSDISNLNIAILSKKKENYSNNNLPLFGINDNVFKTFDDRPNLLTKREVRIQILAALELPRNGVIWDIGAGCGSIGLEALKLRPNLDLFCFDKRIGSKELILENSKRLDVNPKFIFEEDINHTLNARNLSSFENPNRLIIGGCDKKTKLQIINKIAQDMDIGDIIVIPIINIQTIKELKEELEDKNFKTNLNLIQTYKSLSIAEGMRLEPNNPVFLLTGKK

SEQ ID NO: 8909 - DNA, 1284 bp, Prochlorococcus marinus str. MIT 9515
  CDS (1)..(1284): transl_table=11
atgagtcggataaaaagaaaaattcacgtaataggaattaattcttttgaatttttagagctgccccttaaattacaaaaattatttaaaaagacagctaatattgcagttccaaatacatatataggagaaataaaattatgggcaaaaaataataccaataataaagaaaaattatttttcgaaagcaaaagtgacaacaaactaattgattggcttaaatctcaaaaaactgatgtaattttattttctaggggtgatcctctttggtttggtattgggagaatacttctagaaaatttttcgaaagaagaattaagtttctatccgtcaaatacatgtgctcaattagcatttagtaaactcaaaatatcttggcaaggggcagcatatgtaagtatccatggaagagattcaaccaaattcattaaggctatgaaatcaaagccttcaagtatagcggtcattacagattcaaataactgcggtttagaaacaattcagcataatttattagaattaaatttagaaaattattatgacttttggatttgtgaggaaataggttttaaaaatgaaaggatcagaaaatttagcctaaaagaaaagttaccatttgacatttctaatttaaatattgctgttctcctgaaaagagaaaaagatcttcaaagagaagcaactcctttatttggattaaaagatgatacttttaaaacttttgaagatagaccaaatttattaaccaaaagggagattcgaattcaaattttagctgatttagagttaccagaaaatggcgcaatttgggatattggagcaggttgcggctcaattggtttagaagcattaaaattaaggcccaatttaaaattattttgtattgacaaaagaattggatcaaaagaattgatattagaaaatgcaaaaagattaggcgttagacctaaggatatttttgaagaagatataaataatttaattgatactaataacattaaatcttttaaaaaagctaggagaataattattggtggctgtgacaaaaatactaaacttcgaattattaatgaattatctaaagatatgaatcatggagatattgtttctattcctttaattgatattcaaaccattaaagatttaagagagactttaaaagtaaataatttcgaagtaactctaaatcttattcagacttataaaagtttaagtatttcagggggaattagaatggatccgaacaatcctgtatttttgcttaaagggagaaaactaatttaa

SEQ ID NO: 8910 - protein, 427 aa, Prochlorococcus marinus str. MIT 9515
MSRIKRKIHVIGINSFEFLELPLKLQKLFKKTANIAVPNTYIGEIKLWAKNNTNNKEKLFFESKSDNKLIDWLKSQKTDVILFSRGDPLWFGIGRILLENFSKEELSFYPSNTCAQLAFSKLKISWQGAAYVSIHGRDSTKFIKAMKSKPSSIAVITDSNNCGLETIQHNLLELNLENYYDFWICEEIGFKNERIRKFSLKEKLPFDISNLNIAVLLKREKDLQREATPLFGLKDDTFKTFEDRPNLLTKREIRIQILADLELPENGAIWDIGAGCGSIGLEALKLRPNLKLFCIDKRIGSKELILENAKRLGVRPKDIFEEDINNLIDTNNIKSFKKARRIIIGGCDKNTKLRIINELSKDMNHGDIVSIPLIDIQTIKDLRETLKVNNFEVTLNLIQTYKSLSISGGIRMDPNNPVFLLKGRKLI

SEQ ID NO: 8911 - DNA, 1287 bp, Prochlorococcus marinus str. NATL1A
  CDS (1)..(1287): transl_table=11
atgcctgatgagtcaaagcagatacacgtaataggaattgatacttcaagtgttgaaagtttttttgaagctaaaaaaaaaccaatttttgaagctgagataatcactggtccacaaagaattttagattctttcaaaacttggttaaaggataaaaatataaaaaatcataagttcgagttcattgctactgacaaactaaacgactttatagatctattaaaaaagggcaagaaaaaaacaattgtattttctggtggtgatcctctttggtttgggattggtagattattaattcaaaactttcctttatcaaaactttattttgagccagccgcgacctctttccaactcgctttttcaagacttggcaaaccttggcaaaatacaaaatggatcagtcttcatggaagagacccgcttcaatttgaaaaagcaattaaaaagcttccttcttcacttgtggttttaactgactcaaatagaggaggagctaaggaggtttatcaattaatggattccttggaacttcagaaaaaatatgaattttggactttcgaaaggcttggatatatcaatgaaagaattctaaaaatatcttctgttgatgatttcccaattgatcttgatccattgcatcttgtgattcttttaaaaaaagaagagcctctaatacaatcaaaagatttacctttatttggaattgttgattcagtttttcttcaaaatgcagactgccctgggttaatgacaaaaaaagaagttagggttcaaattcttgccgaacttaatctcccaaagcgaggaataatttgggacataggaagtggagttgggagtattggtttagaagcattaaggatatctccaaatctaaaattagtatccattgataaaagagttggaagtacaaatataatcaaggaaaacgccagaaggcttggcgttaagccatcattgataattgaggatgaagcattaaatatatttaaacaaaataaaataacatcaagtctttcaaaaccagaaagagttattatcggaggcgggggctcaaactcacatttaattcttgaagaagttttgaagcttataaatagtacttgtataattgttatcccactaatatcattaaaatctatatcaaaattagagtcgattttaaagcctaaagcacacaagttatctattagtcaacatcaatcgtatagaggtgtaagtattggagaagatataagattatctcctttaaatcctgtttttattttgaaaggtgaaattaaataa

SEQ ID NO: 8912 - protein, 428 aa, Prochlorococcus marinus str. NATL1A
MPDESKQIHVIGIDTSSVESFFEAKKKPIFEAEIITGPQRILDSFKTWLKDKNIKNHKFEFIATDKLNDFIDLLKKGKKKTIVFSGGDPLWFGIGRLLIQNFPLSKLYFEPAATSFQLAFSRLGKPWQNTKWISLHGRDPLQFEKAIKKLPSSLVVLTDSNRGGAKEVYQLMDSLELQKKYEFWTFERLGYINERILKISSVDDFPIDLDPLHLVILLKKEEPLIQSKDLPLFGIVDSVFLQNADCPGLMTKKEVRVQILAELNLPKRGIIWDIGSGVGSIGLEALRISPNLKLVSIDKRVGSTNIIKENARRLGVKPSLIIEDEALNIFKQNKITSSLSKPERVIIGGGGSNSHLILEEVLKLINSTCIIVIPLISLKSISKLESILKPKAHKLSISQHQSYRGVSIGEDIRLSPLNPVFILKGEIK

SEQ ID NO: 8913 - DNA, 1296 bp, Prochlorococcus marinus str. MIT 9303
  CDS (1)..(1296): transl_table=11
atgcccgcctcaatcagctccgcagcgatccacgtcatcggcaccgatgccgcaggcttagatcaccttgccactccattgcaagagctggtgctctcagcccaagggctggctgcaccccgtcgccttttgccgcaattgccgagctggtggcagcagcagcaaacggatcagcctttgccagaactgatcgccagcgatcaaccagaggctctaatcgcctggttgcgccagcggcagggcacagccgtcgtgctagctagcggcgacccgctctggttcggcatcggcaggcgactactcgaagcatgttctgctgatcagctgcactttcatcccgcaccttcttcgctgcaacttgcctttgcccggcttgggcggccttggcaggatgccgcctggatcagcctgcatggccgtgacccagcccccttagctcaaaagctgcaacaacgccccgcagctctagctgtactcaccgatcccaaccgcggtggagccgaagaggtgcgtacgattttgcgctcttctggcctggaaactgcctatgcagtgtggctttgcgaacagctcggacacgccaatgaacgggtgcaacggctgacgccacaggatgccttgccatcggatcttcatcccctacacatggttgtgctgcttgcagaacaagctgctccaccaggagatccagccaagcttccattgttcggtcttgacgatggcttgttcctgcaacacgacgatcgccctggcctgatgagcaaacgggagcttcgtgttcagctcctcgcagagttagagctgccagaacagggcttactctgggatttaggtgccggagttggcagcgttggcttagaggccttacgcctgcgtccacaactgcaattactagctgttgaaaagcgtggcggcggtgcagcgctgatcaaggccaatgctgcccggcttgccgttcagcctgctgcagtacttgaagccgaggccctcagcctgctgaatggaacagatttgccaccaaccttgagccgccccgatcgggtgctgctagggggtggcggccgccagcgagttgctctcctcaaggccgtattgcaaaagcttcaaccacatggagtcgtcgtgattccactagtaaccattgaggccatggcagaactcaaacccttacttcaagattgcggttgcgccgtgaaggtgagtcaacaccagtcctggaggggcataccgctggcagacggcacccgcatggcgccgatgaacccggtgatgatcctcaaaggcacgatgccttaa

SEQ ID NO: 8914 - protein, 431 aa, Prochlorococcus marinus str. MIT 9303
MPASISSAAIHVIGTDAAGLDHLATPLQELVLSAQGLAAPRRLLPQLPSWWQQQQTDQPLPELIASDQPEALIAWLRQRQGTAVVLASGDPLWFGIGRRLLEACSADQLHFHPAPSSLQLAFARLGRPWQDAAWISLHGRDPAPLAQKLQQRPAALAVLTDPNRGGAEEVRTILRSSGLETAYAVWLCEQLGHANERVQRLTPQDALPSDLHPLHMVVLLAEQAAPPGDPAKLPLFGLDDGLFLQHDDRPGLMSKRELRVQLLAELELPEQGLLWDLGAGVGSVGLEALRLRPQLQLLAVEKRGGGAALIKANAARLAVQPAAVLEAEALSLLNGTDLPPTLSRPDRVLLGGGGRQRVALLKAVLQKLQPHGVVVIPLVTIEAMAELKPLLQDCGCAVKVSQHQSWRGIPLADGTRMAPMNPVMILKGTMP

SEQ ID NO: 8915 - DNA, 1275 bp, Prochlorococcus marinus str. MIT 9301
  CDS (1)..(1275): transl_table=11
atgactgaagttaatagaaaaatttatgtaattggtattaattcttataaatttgaggatctatctttcaaattacaaaatttatttttagaaacagaaaatattgcagttccaaattcatattttgaagaaattaaatcatggagcgaaaatggtttattaaataagaaatcatttttttcaagcaaaagcaataacgaacttgttaactggcttaggtctcaaaaaaatgatgtaattttaatttcgaggggagatcctctttggtttggaattggaagaatactattagaaaatttttcaaaagatgaattaagtttttacccttcaaatacttgtattcaattggcatttagtaagttaaagattccatggcaagatactgttaatgtaagtattcacggcagagattcgactaaattaattgaggctcttaaagtaagaccttcaagtctggctatcattacagaagcaaataacaaaagcttagaattaatcaaaaaaaacctatcacaattaaatctgattgattattatgatttttggctttgtgaagagataggcttcgataatgaaaatataagaaaattaaatcttaaagagtcattgccttctgacatatcaagtttgaatattgttgttcttacaaaaacaaaaaaaaattactcaaatagtaatcttcccctttttggaatcagtgaccacatatttaagacttttgatgatagaccaaacttattaactaaaagggagattcgtgttcaaatcttagctgatctagagctcccaaaaaatggcgtaatatgggatataggagcaggttgtgggtcaattgggttagaggcattaaaattaaggcccaacttagatttgttttgtatcgataaaaggtttggctcaaaagcattaatacttgaaaactcaaaaaggcttggcgttaaaccaaaatttatttttgaggaagacataaataatatctttaaaaagagaattttaagttcttttgaaaaacctaatagattaataattggaggatgcgataaaaaaactaaactccagattattagtaaactagctcaagggatggataatggagacattgtcgttatcccaataattgatattcaaactattaaagaattgaaagaggaattagaggacaaaaatttcaaaacaaatttaaatttaattcagacctataaaagcttaagtattgcagagggaatgagactagaaccaaataatcctgtttttctattaaaagggaaaaaataa

SEQ ID NO: 8916 - protein, 424 aa, Prochlorococcus marinus str. MIT 9301
MTEVNRKIYVIGINSYKFEDLSFKLQNLFLETENIAVPNSYFEEIKSWSENGLLNKKSFFSSKSNNELVNWLRSQKNDVILISRGDPLWFGIGRILLENFSKDELSFYPSNTCIQLAFSKLKIPWQDTVNVSIHGRDSTKLIEALKVRPSSLAIITEANNKSLELIKKNLSQLNLIDYYDFWLCEEIGFDNENIRKLNLKESLPSDISSLNIVVLTKTKKNYSNSNLPLFGISDHIFKTFDDRPNLLTKREIRVQILADLELPKNGVIWDIGAGCGSIGLEALKLRPNLDLFCIDKRFGSKALILENSKRLGVKPKFIFEEDINNIFKKRILSSFEKPNRLIIGGCDKKTKLQIISKLAQGMDNGDIVVIPIIDIQTIKELKEELEDKNFKTNLNLIQTYKSLSIAEGMRLEPNNPVFLLKGKK

SEQ ID NO: 8917 - DNA, 1218 bp, Burkholderia vietnamiensis G4
  CDS (1)..(1218): transl_table=11
atgacggcgtggctgacggtagtgggcatcggcgacgacggctacgcggggctcgggcgcagcgcgcggcgcgcgctgctcgacgcgacgcggatcgtcggcgcgcggcggcacctcgacatgctgccggcgcggctgacggccgcgcgcgaagcgtggccgtcgccgttcgatctgtcgggcctgctcgcgacgcgcggcgcgcccgtctgcgtgctcgcgagcggcgacccgatgctgttcggcgtcggcgcgacgctcgcgcgtgagctgggcgccgacgaatggcgcgtgctgcccgcgccgtcgtcgctgtcgcttgcggccgcgcgcctcggctgggcgttgcaggacgtcggcgccgtgtcgctcgtcggccggccgctcgcgacactcgcgcgccacctgctgccgggccggcgcctgttcgtgttgagcgcggacggccgcacaccggccacggtcgccgccgaactgacggcgcgcggcttcgggccgacccgcatcagcgtgttcgagcacctcggcggcccgctggagcggcgcatcgacggcctcgcgcacgactggcggatcgacgaaaccgcggcgctcaatctcgtcgcgctcgactgcgtggccggcgccgatgcgccgcgccgcgcgctcacgccgggcctgcccgacgacgcataccggcacgacggccagctcaccaagcgcgacatgcgcgcgctgacgctcgggcgtctcgcgcccgcgccgggcgagctgctgtgggacgtgggcgcgggcagcggctcgatcggcatcgaatggatgcgggcgcatccgtcgtgtcacgccatcgcgatcgagtcgcacgcggaacggcagcgttacatcgaacacaaccgcgacgcgctcggcgtgccgggcctgcaactcgtcgccgggcgcgcgcccgctgcgctcatggggctggcgccgcccgacgcgatcttcatcggcggcggcgcgaccggggccggcgtgctcgacgcgtgctgggccgcgctgaagccgggcgggcggctcgtcgcgaacgcggtgacgctgcagggcgagctcgcgctcgccgcgtggcgcgacgcacacggcggcacgctcacgcgcgtgtcgctcgcgcatgccgagccgctcggccgcttcgacacgtggcggcagccgctgccggtcacgctgtacgacgtgcgcaagcccgacgcgggcgctgcatga

SEQ ID NO: 8918 - protein, 405 aa, Burkholderia vietnamiensis G4
MTAWLTVVGIGDDGYAGLGRSARRALLDATRIVGARRHLDMLPARLTAAREAWPSPFDLSGLLATRGAPVCVLASGDPMLFGVGATLARELGADEWRVLPAPSSLSLAAARLGWALQDVGAVSLVGRPLATLARHLLPGRRLFVLSADGRTPATVAAELTARGFGPTRISVFEHLGGPLERRIDGLAHDWRIDETAALNLVALDCVAGADAPRRALTPGLPDDAYRHDGQLTKRDMRALTLGRLAPAPGELLWDVGAGSGSIGIEWMRAHPSCHAIAIESHAERQRYIEHNRDALGVPGLQLVAGRAPAALMGLAPPDAIFIGGGATGAGVLDACWAALKPGGRLVANAVTLQGELALAAWRDAHGGTLTRVSLAHAEPLGRFDTWRQPLPVTLYDVRKPDAGAA

SEQ ID NO: 8919 - DNA, 1236 bp, Bradyrhizobium sp. ORS278
  CDS (1)..(1236): transl_table=11
atggtgagtccaaacgcaacctgcaacgcgccgcgctggctgtccatcatcgggatcggtgaggacggcgttgacggtctctctacgcccgcgcgtgacctgattgccagcgcgaccttcgtggtcggcggcgcgcgtcatcttgagctcgctgcgccgctcatcaggtcggagcggctcgcatggccgagcccgctgcacctggcgttcgagcagatcgcagcacgccaggggcagcccgtcgtggtgctggccagcggtgatcccttcaactacggcgtcggcaagcagctgatgcaacgctttgcacccgcggagatgctgtgcctgccgcatgcttcggccttcagtctcgccgcggcacggctcggctggccgctgcaggatgtcgcccaggtgacgctgcatggccgcgcgctcgaaggcatcattcgccatctcgcgccgggcgcacgcatcctcgcgctggcttgggacggatctacggccgcaaaactcgccggactgctgaccgcgcgccgcatgggccgttcgcggttgaccgcgctcgaagccatgggcgggacgcaggagcgtgtgcgcagcgtgagggccgacgagttcgacctgtccgatatccatccgctcacgacgctggcgctggagattgatgtccaacccggtgcgccggtgatcccgctgacgtcgggcctcgctgatgacctgttcgagcatgacggccagctcacaaaacgtgacgtccgcgccgcgacgctgtcggcactcgcgccgacgcccggcgagctgctgtgggatgtcggtctcggctccggctcggttgcgatcgaatggctgttgcgtcatggctcgctgcgcgcattcggcatcgaggcgcggcaggaccgtgcggatcgggccatgcggaacgcgcttgcgctcggtgcgcccgacctccaggtggtggtcggccgcgcgccgacggcgctggctgatctcgaaccgccggatgcgatcttcatcggcggcggcatttcggaagctggggtgttcgaggcggcctggtcgcgcctgaagccgggcgggcggctggtcgccaatgtcatctcgctcgaaggcgaggcgcggttgatcgatctgttcggccgtcacggcggcgaactgatgcgcatcgcggtgtcgcgcatcgagcccgtcggccgcatgcacggctggcggcaggccatgccggtgacccaatggcgggtgagcaagccatga

SEQ ID NO: 8920 - protein, 411 aa, Bradyrhizobium sp. ORS278
MVSPNATCNAPRWLSIIGIGEDGVDGLSTPARDLIASATFVVGGARHLELAAPLIRSERLAWPSPLHLAFEQIAARQGQPVVVLASGDPFNYGVGKQLMQRFAPAEMLCLPHASAFSLAAARLGWPLQDVAQVTLHGRALEGIIRHLAPGARILALAWDGSTAAKLAGLLTARRMGRSRLTALEAMGGTQERVRSVRADEFDLSDIHPLTTLALEIDVQPGAPVIPLTSGLADDLFEHDGQLTKRDVRAATLSALAPTPGELLWDVGLGSGSVAIEWLLRHGSLRAFGIEARQDRADRAMRNALALGAPDLQVVVGRAPTALADLEPPDAIFIGGGISEAGVFEAAWSRLKPGGRLVANVISLEGEARLIDLFGRHGGELMRIAVSRIEPVGRMHGWRQAMPVTQWRVSKP

SEQ ID NO: 8921 - DNA, 1254 bp, Synechococcus sp. WH 7803
  CDS (1)..(1254): transl_table=11
atgatcgatgtgatcgggaccgacgccggcgctccggcgtctttaccaccgatgcaccaacacctggtgcagaacgctgacctggtggcagcgccaaaacgcttgctgccccagcttgtggattggctcggcagtcgcgccgacgaccagcagcgcttggtcagcgatgacccgattgccctcagtgacgccctcgcccccctggcgcccaccctgcggattgtggtgctggccagtggcgatccgctctggttcgggattggtcgtgtgttgattgagcggctgggcagcgagcggctgcgtttccacccagccccctcctccatgcagctggccttcgcccgcctgggcaaaccctggcagggagccgaatggatcagcttgcacggccgtgatcccagccccctggcccagcggttgcagaaacggccagctgccctggcggtgctcaccgatccaggccgaggaggcgtggaagaggtgcgcgcgattctgcgcggcagcgggctcgaatccagctacagcctctggctgtgtgaagccctcggtcaccacgacgaacgcgtgcagcgcctcgaagcgaccaggccctgcccggacgacctgcaccccctgcatctggttgtgctgctggcccaacctcccgccgcatccgctgcggaggctcttccgctgtttgggattgccgatggcgactacctgcagcacgacgaccgccccgggctgatgaccaaacgggaggtgcgcattcagctgctcgcggatctcgagctgccggagcaaggcgtgctctgggatctgggggctggcacagggagtgtgggcctggaggctctgcgcctgcgcccgcagctgcagctgatggcgatcgaacgccgaagcggcggcggggcgttgatccaggccaatgcccaacgacttggcgttgctccggcttccgtactggagggggatgctcgaacgcttctgcctcagcttccggatccggatcgcgtgctggtgggaggaggcgggcgccaacgcgcaaccctgctcaaggcagtgatcgatcgcctcaggcctggcggtgtggtggtgatccccctggcgaccctggaagcgctggccgaactgcggcctgtgctcgagcaggctgaactgcagttgcagatcagccagcaacaggcctggcgcggtcagcctctggccgaaggcacccgcctggcgccgatgaatcccgttctgatcctcaaaggcacgaaagcgcagccctga

SEQ ID NO: 8922 - protein, 417 aa, Synechococcus sp. WH 7803
MIDVIGTDAGAPASLPPMHQHLVQNADLVAAPKRLLPQLVDWLGSRADDQQRLVSDDPIALSDALAPLAPTLRIVVLASGDPLWFGIGRVLIERLGSERLRFHPAPSSMQLAFARLGKPWQGAEWISLHGRDPSPLAQRLQKRPAALAVLTDPGRGGVEEVRAILRGSGLESSYSLWLCEALGHHDERVQRLEATRPCPDDLHPLHLVVLLAQPPAASAAEALPLFGIADGDYLQHDDRPGLMTKREVRIQLLADLELPEQGVLWDLGAGTGSVGLEALRLRPQLQLMAIERRSGGGALIQANAQRLGVAPASVLEGDARTLLPQLPDPDRVLVGGGGRQRATLLKAVIDRLRPGGVVVIPLATLEALAELRPVLEQAELQLQISQQQAWRGQPLAEGTRLAPMNPVLILKGTKAQP

SEQ ID NO: 8923 - DNA, 1263 bp, Xanthobacter autotrophicus Py2
  CDS (1)..(1263): transl_table=11
atggcgggcataagtgccccagcggggcgctggctgtccatcgtcggcatcggcgaggatggggcggacggtctctcccccgccgcgcgcgccgccatttcctccgccgaaatcgtgtttggcggggcgcgccaccttgcgctcgcgggcgggctcgtcaccggagaagcgcaggtgtggccgagccccttcagccttgtcggcgttctcgccgcgcgcgggcgggcggtgtgcgtcctcgcctcgggcgatcccttcctttacggcgtgggcgcgagcctcgcccgccatgtgccggccgacgagatgcgcgccttccccgcgccttccgccttcgcgctggccgccgcgcgccttggctggccgttgcaggaggcggacctcgtatccctccacggccggccgctggcccggctgcggcccttcctgcaggacggcgcgcggctgatcctcctcacctcggacggcgacgggccgcgacaggtggcggatttcgtcaccgcccacggctgcggtgcttcgcgccttatggtgctggaggcgctgggcggcccctccgagcgggtgcgcgagacgcgggccgaggccttcgcctttaccgacgtgaccgcgctgaacgtggtggcgctgcaggtggcggcggaggcaaacgcccccctcctgcctctcgccagcggccttgccgacgacttgttcgagcatgatggccagatcaccaagcgcgagatccgcgccctcaccctctcctccctcgcgccacgacggggggagctgttgtgggatatcggcgcgggggctgggtccatcgccatcgaatggctgctggcgcatccctccctcagtgccgtcgccatcgaggggcatgcggagcgcgccgcccgcgtcggccgcaatgccgggcgcctcggcgtgccgcatctgaaagtcgtagagggtgcggcacccggcgcccttgccggactgcccccgccggatgtcatctttctcggcggcggcgcctcggagccgggcgtgttcgaggcggcgatggcggcgctgaagccgggcgggcggctggtggccaacgcggtgacgctggagacggaagcggtgctcctcgctgcccatgcaaggctcggcggcgatctcgtacgcatcgcgctggcgcgctccgtggcggtgaagggcatgaccggctggcggcccgccatgccggtcacccaatggcgctatggcaagccgcccgaaggcaagccacctgagaccgagggaggcggggcatga

SEQ ID NO: 8924 - protein, 420 aa, Xanthobacter autotrophicus Py2
MAGISAPAGRWLSIVGIGEDGADGLSPAARAAISSAEIVFGGARHLALAGGLVTGEAQVWPSPFSLVGVLAARGRAVCVLASGDPFLYGVGASLARHVPADEMRAFPAPSAFALAAARLGWPLQEADLVSLHGRPLARLRPFLQDGARLILLTSDGDGPRQVADFVTAHGCGASRLMVLEALGGPSERVRETRAEAFAFTDVTALNVVALQVAAEANAPLLPLASGLADDLFEHDGQITKREIRALTLSSLAPRRGELLWDIGAGAGSIAIEWLLAHPSLSAVAIEGHAERAARVGRNAGRLGVPHLKVVEGAAPGALAGLPPPDVIFLGGGASEPGVFEAAMAALKPGGRLVANAVTLETEAVLLAAHARLGGDLVRIALARSVAVKGMTGWRPAMPVTQWRYGKPPEGKPPETEGGGA

SEQ ID NO: 8925 - DNA, 1275 bp, Prochlorococcus marinus str. MIT 9215
  CDS (1)..(1275): transl_table=11
atgactgaaaaaaaaagaaaaattcatgtagtgggaattaattcttataaatttgaagatctatctttcaaattacaaaatctatttcaagaaacagtttctattgccgttccaaattcatattttgaagaaattaaatcatggaacgaaaatggtttagaaaaaaagaaattatttttttctagcaacagtaataaggaacttgttaattggcttaaatcacaaataactgatgctattttaatttcgagaggagatccactttggtttggcattgggagaatactactagaaaatttttcaaaagatgaattaagtttctacccttcaaatacttgcattcaattagcatttagtaagttaaagatcccatggcaagatactgttaacgtgagtattcacggcagagattcgaataggttagtagaggctcttaaaacaaggccttcaagtttagctattattacggattcaaataacaaaagtttagaagtaatcaaaaaaaacttatcagaattaaatcttattgacttttatgatttttggctctgtgaagagattggcttcgagaatgaaaaaataagaaaattaaatcttaaagagtcattaccatctgatatatcaagtttgaacgttgttgttcttgaaaaaacaaagaaaaattactcaaataatgatctccctcttttcggaatcagtgatcatatttttaagacttttgatgatagaccaaacttattaactaaaagggaggttcgcatacaaatattagctgctttagagctcccaagaaatggtgtcatctgggatataggagcaggttgtgggtcaattggtttagaggcactaaggttaaggcctaatttggatttgttatgtattgataaaaggattggctcaaaagaattaatattagaaaactcgaagaggcttaacgtcaagccaaaatttatttttgaagaagacataaattgcaccttgaatatgaataatttgagttctcttgaaaaacctagtagattaataattggaggatgtgataaaaaaactaaactcaagattattaggaaactagctcaaaatatgaatattggggacattatcgttatccctataattgatattcaaactattaaagaattggaagaggaattagaagataaaaatttcaaaacaaatttaaatttaattcagacctataaaaggttaagtattgcggagggaatgagactagaaccaaataatcctgtttttctattaaaagggaaaaaataa

SEQ ID NO: 8926 - protein, 424 aa, Prochlorococcus marinus str. MIT 9215
MTEKKRKIHVVGINSYKFEDLSFKLQNLFQETVSIAVPNSYFEEIKSWNENGLEKKKLFFSSNSNKELVNWLKSQITDAILISRGDPLWFGIGRILLENFSKDELSFYPSNTCIQLAFSKLKIPWQDTVNVSIHGRDSNRLVEALKTRPSSLAIITDSNNKSLEVIKKNLSELNLIDFYDFWLCEEIGFENEKIRKLNLKESLPSDISSLNVVVLEKTKKNYSNNDLPLFGISDHIFKTFDDRPNLLTKREVRIQILAALELPRNGVIWDIGAGCGSIGLEALRLRPNLDLLCIDKRIGSKELILENSKRLNVKPKFIFEEDINCTLNMNNLSSLEKPSRLIIGGCDKKTKLKIIRKLAQNMNIGDIIVIPIIDIQTIKELEEELEDKNFKTNLNLIQTYKRLSIAEGMRLEPNNPVFLLKGKK

SEQ ID NO: 8927 - DNA, 1281 bp, Prochlorococcus marinus str. MIT 9211
  CDS (1)..(1281): transl_table=11
atgaacagatcttcaaagccaatctatgtgataggaatttgcgctgggggggttgaaaagcttccattgtcacttcaagagctaattgtctcagccgagagaattgcttgtcctgcaaggatcttgacgcccttgactaattggtggcataaaacagaagtcggcaaaaagttaccagaattatttgatagcacaaatacaaatgagctaattcactggctcaaaagccaaaatcaaaaaactatcttattagccagtggcgatccactttggtttggtataggaagagtattaattgaaaacttaccaaatcgtgaaattgtttttcacccctcaacaacatctttgcagcttgcttttgctagaataggtagaccttggcaagatgcctcttggattagtcttcacgggagggatccaagccctcttataaaccttctaaagaaaaggccgaatgcaatagcaatactaaccgatcctaaattaggtagcccaaagcaaattaaacatattcttgaatcagctgaactagataaaatctacactttttggatatttgaaaggcttggtcattctgaagagcggatctataagatcatgccttctcaaaaactgcccgaatcaatagatcctttaaatatagttgtcctaataaaagaaagtatccctatacatcaaaagactgacttacccctatttggtattgaggatggtctatttattcaacatgatgatcgtccaggtcttatgactaaaagagaagttagggtccaaattcttgcagatattgagttacctgaagaaggagtaatttgggatatcggtgctggtgtagggagcataggactagaagccctgagaataagaccaaaactaaaactacttctagtagataaaagagttggtagccaaaagctaattaatgaaaatgcagtaaggctttctgttaaaccttcagtaattattgaatctgatatagaaagattattagagcaaggaactattccaaaaaatgtatctaaagctgacagaataatactaggaggaggagaaaaaagagatctgattgggcaattactcgaaaggctaaatcccaagggaattattgtaatccctttaacaactttacaatcaattgatcaaatagaaaaaatatttaatgactggggttgcatattaaaaattagtcagcatcaaaattacagaggaattaaaataggcaaagcaacaagactttcacctatgaacccagtatttattttaaaagccaagttaatctag

SEQ ID NO: 8928 - protein, 426 aa, Prochlorococcus marinus str. MIT 9211
MNRSSKPIYVIGICAGGVEKLPLSLQELIVSAERIACPARILTPLTNWWHKTEVGKKLPELFDSTNTNELIHWLKSQNQKTILLASGDPLWFGIGRVLIENLPNREIVFHPSTTSLQLAFARIGRPWQDASWISLHGRDPSPLINLLKKRPNAIAILTDPKLGSPKQIKHILESAELDKIYTFWIFERLGHSEERIYKIMPSQKLPESIDPLNIVVLIKESIPIHQKTDLPLFGIEDGLFIQHDDRPGLMTKREVRVQILADIELPEEGVIWDIGAGVGSIGLEALRIRPKLKLLLVDKRVGSQKLINENAVRLSVKPSVIIESDIERLLEQGTIPKNVSKADRIILGGGEKRDLIGQLLERLNPKGIIVIPLTTLQSIDQIEKIFNDWGCILKISQHQNYRGIKIGKATRLSPMNPVFILKAKLI

SEQ ID NO: 8929 - DNA, 1236 bp, Leptospira interrogans serovar Copenhageni str. Fiocruz L1-130
  CDS (1)..(1236): transl_table=11
atgaaagcggttactgttgtcggtatgggcgatgaaggttgtccagggctatcaagtatcgctgccaatgcggtcgcaaaagctcaaatactcgctggcggaaaaaggcatttagatttttttcctcaattctccggagaaaaaatagtattcaaagatgatttgacccaaaccatcaaaaggatcgcggaactttctttggaacatacaatatgtgttcttgcgtccggagatcctttgtttttcggaatcggaaatttaattcgtaaaaaagtaggtcctgaatacgtagattttattccagcccccagttccgttcaacacgcgtttgcaaaaattggaattccttgggacgacgccgaagtcttatccttacacggaagatcttcgaaaggactgattaccaaattacaatttcttaataaggttgcattgttcacggacaaaatcaatcacccgaaagaaatcgcttcttatctattgtctttcaacgaatctgaatggactgcatttgtatgcgaaaatctaggaggagaaaaagaaagaatccgtaaattcgacttaaaatcgttaagcgaagaagaagaaattgaccctctaaacgttttggttctcattagaaactcagtaaattggaaaccacctacagttgtgcctaacgtttcagaagaaaattattcaaaacgagttcccaaaaaagggctaattactaaaaaagaagttcgaattctttccatcgcgtttttaaatatcagagaagatagtgtaatctgggacattggagcaggctctggttctatagccatcgaagccgcacagatcgctaaaaacggcaagtcctatgcaattgaaattgatcctgaaggaattgaaatttgtaaacagaacattcttctccaaaagacggataatgtacatgtgatttcaggaaaagctccagaagttctagaaaaacttccagatccagactgtatctttgtaggtggttctaatggagatatttatgagattattagaatatcattaaataagctttcgcctctcggaagtttggtaataaatgcagtaaccatagacaacgtttctcaaatctatcagagttttaaaaaattaaaacttgtacctgaagtaactcttttgaacgtttctagaggacgagtcctaaaggattatcttcggtacgaagctctcaatccgattcacatttttaagattaaaaaaccggagaaaatgtga

SEQ ID NO: 8930 - protein, 411 aa, Leptospira interrogans serovar Copenhageni str. Fiocruz L1-130
MKAVTVVGMGDEGCPGLSSIAANAVAKAQILAGGKRHLDFFPQFSGEKIVFKDDLTQTIKRIAELSLEHTICVLASGDPLFFGIGNLIRKKVGPEYVDFIPAPSSVQHAFAKIGIPWDDAEVLSLHGRSSKGLITKLQFLNKVALFTDKINHPKEIASYLLSFNESEWTAFVCENLGGEKERIRKFDLKSLSEEEEIDPLNVLVLIRNSVNWKPPTVVPNVSEENYSKRVPKKGLITKKEVRILSIAFLNIREDSVIWDIGAGSGSIAIEAAQIAKNGKSYAIEIDPEGIEICKQNILLQKTDNVHVISGKAPEVLEKLPDPDCIFVGGSNGDIYEIIRISLNKLSPLGSLVINAVTIDNVSQIYQSFKKLKLVPEVTLLNVSRGRVLKDYLRYEALNPIHIFKIKKPEKM

SEQ ID NO: 8931 - DNA, 1461 bp, Desulfovibrio vulgaris subsp. vulgaris str. Hildenborough
  CDS (1)..(1461): transl_table=11
ttggaagacgccagcccggcgactgccgcggctgatatcggtgccgctcatgtcgccgtccccgaatgcggtgcagcaccggatgccctagctggacgtgatggtgccgaggcggtctccctcgacgcaggactctccggtggcagtgcctccgatggtcacgccaaggtttctgaatctgcgttctgcgcctctcctgaagtcggtgatgccgggtgctgtctgcctccgctgacggtactcggtctcggcacgggggatacggcgctctctcctgtccatgagtcgctcttgcgtgatgcggaggtgctggtgggcggcaggcggcagcttgccgccttccgcgggcaccccgcgcgacaggtggtcatcgcctcgcccgtgacggacgcccttgaagccgtcgcccgcttgcgtgaagaagggcggcgtgtggtggtgcttgccgatggcgacccgctcttcttcggcataggcacccgtgtggcccgtgatttcgggcccgatgccgtccgggtggtgccgtccgtaagctgtctgcaggcggctgcggcgcggcttggcatggcgtggcacgacaccgtgaccgtctccatgcacggacgcgacgactggcggcctctcgcggcggcggtactcggcgggcaccccgtctgcgtgctcaccgacggcgtgaacacgcccgaccgcatcgcccgccatcttctcgaccgcggtgtggactggttccgtgcgcatgtcttcgaggacatgggtacggtggaggaacaggctcacgacctttcgcttgccgcatgtgccgccctcgacttcgggccgtgctgcaccgtgcttctggtgccgcagggcgaggtgcgcggcccccgcaccgggatgcccgacaccttctttgccgccgaggcggggctgctcaccaaatggcccgtgcgggcggtggcccttgccgcgttgcgcgtgaaccctgcggataccgtgtgggacgtgggtgccggtagcggtgccatgtcggtggagtgtgccgccgtcgcatcgcggggtagcgtatgggccgtcgaacgcgacgctgcccgcgtggtctgcgtggaggagaatcggcgtcgtatgggggcggccaacatcgaggtcgtgcacggcgacgccccggcgtgtctcgccagcctgcccacacccgaccgggtgttcatgggcggcggtctcggtggcatcagtgccgatgcctcctgtccggtgctgcataccgtctgcgagagactcgcccccggcgggcgcgtggtcgtggcgtgcgtgctgctgggcagcctcgaaagggcactgggggtgttccgcaacctcgggtggcccgccgaggtcgtctgcgtacaggcttcggtctcgtcgcctcttgccggtgacatgcgccttgcggcgttcaaccccgtgcatcttgtctctgccgcacggccacagacgggagggcagtga

SEQ ID NO: 8932 - protein, 486 aa, Desulfovibrio vulgaris subsp. vulgaris str. Hildenborough
MEDASPATAAADIGAAHVAVPECGAAPDALAGRDGAEAVSLDAGLSGGSASDGHAKVSESAFCASPEVGDAGCCLPPLTVLGLGTGDTALSPVHESLLRDAEVLVGGRRQLAAFRGHPARQVVIASPVTDALEAVARLREEGRRVVVLADGDPLFFGIGTRVARDFGPDAVRVVPSVSCLQAAAARLGMAWHDTVTVSMHGRDDWRPLAAAVLGGHPVCVLTDGVNTPDRIARHLLDRGVDWFRAHVFEDMGTVEEQAHDLSLAACAALDFGPCCTVLLVPQGEVRGPRTGMPDTFFAAEAGLLTKWPVRAVALAALRVNPADTVWDVGAGSGAMSVECAAVASRGSVWAVERDAARVVCVEENRRRMGAANIEVVHGDAPACLASLPTPDRVFMGGGLGGISADASCPVLHTVCERLAPGGRVVVACVLLGSLERALGVFRNLGWPAEVVCVQASVSSPLAGDMRLAAFNPVHLVSAARPQTGGQ

SEQ ID NO: 8933 - DNA, 1161 bp, Picrophilus torridus DSM 9790
  CDS (1)..(1161): transl_table=11
ttgataaatgtaataggtataaatccatgcagggagctaagcaggagggcatttgaaataatagagggctctgatttaataatatccggtgagaggaattcacacattataaataaaaagattgatttttacataaaagatttaaagagcacggttgaatttatagataaaaatataaacaaaaatatatgcattatagcctcgggagaccctttattttttggtattggtgcatctctttcatccagatacaaaatgaatattttaactgaaacaagctctatcgccattgcaatgtccaggataaatgaggattaccatgatgcagtttttatttcacttcatggcaggagcatcaatggtctggcacagagaatagagaagaacaggaagattattatattaacagatgatgagaacaatccttcaaggatagcaaagtatcttatggaattcaatctaaactatgaaatgtacgtctttgagaacctctgctatgacaatgaaaaaatatataaattgaatcctgaagaggcctcaaaaatgagcttttccaggcttaacattgtttatttaaaatcgaataaggataactacatttatcctgatgatgatgacctttataaaatcaattcaaatattacaaaatcagagataagggatataacattgagattattaaatataaaagataacgatgttttctgggacataggtgccggctctggatttatatcaataagcgcctcaaaggctgcaccgggatcattaatctattccatagaaaagaataaaaatgcactgagaaatatatatctaaattcaaggagataccattccgatataaatattatagatggtgaggcgccatactgccttgatgatctgcctgatccggatgcggtattcataggcggcagctcaggtttaatcgacgatattatagaatattcatataaaagattaaggcctggaggcaggcttgttcttaacatagcaacgctgaacagccttgccagggcagtgaacaaaatggaaaaactattttcaaacttttcatttgaggaggtatctgtttttaaatcttcaaggatattaagcacttttagatttgagcctgttaatccggtgtttatacttcacggtgagaaagatgcttaa

SEQ ID NO: 8934 - protein, 386 aa, Picrophilus torridus DSM 9790
MINVIGINPCRELSRRAFEIIEGSDLIISGERNSHIINKKIDFYIKDLKSTVEFIDKNINKNICIIASGDPLFFGIGASLSSRYKMNILTETSSIAIAMSRINEDYHDAVFISLHGRSINGLAQRIEKNRKIIILTDDENNPSRIAKYLMEFNLNYEMYVFENLCYDNEKIYKLNPEEASKMSFSRLNIVYLKSNKDNYIYPDDDDLYKINSNITKSEIRDITLRLLNIKDNDVFWDIGAGSGFISISASKAAPGSLIYSIEKNKNALRNIYLNSRRYHSDINIIDGEAPYCLDDLPDPDAVFIGGSSGLIDDIIEYSYKRLRPGGRLVLNIATLNSLARAVNKMEKLFSNFSFEEVSVFKSSRILSTFRFEPVNPVFILHGEKDA

SEQ ID NO: 8935 - DNA, 1209 bp, Desulfotalea psychrophila LSv54
  CDS (1)..(1209): transl_table=11
atgaataagatccatgtaatcggtgtcggtgcagaccttgccgaactgcaaaaccttgccccaaccctaaagaatatccagctctttgtggccagccccaagcaccacccactcctggcaggatatggagtgaagtgccgggcaatcactcccttagacgaatgtctggaagagatcagagcgacggagggtgaggtggccgtccttgccagtggcgaccccctcttctacggcataggagcaagcctgctccgccacttcggggaagaggatctcctcttttatcccggcctctcctccatacaaagggcctgtgccctgttcaagatcccttggcacgatgcccagcttatcagcctgcacggccgagaggccaatcatattccgggaatgatcctaccccataggaagagcctgattctcaccgatggcagaaattcacccaactccattgccagagagatactcaactacctcctccttattgaagataaagagctgacaaagagaattgagctcagggttggagaaaacctcggtacagaggaagagtggctcttcacgggtagcctgcaagaggcggcggagacaagctttgcccctctcaatgtcctctgcgtcctcattgccgagcagaaaaagctcccatccctaggactcatcgaggaggagatctgtcatagtcgaggcctgatcaccaagaatgaggtgcgagcggcctctctgcatcgcctccagctccctacgagtggggtactgtgggatatcggagcgggcagcggctctgtctccattgaagcggcccgactctcccccggtttgaccatctactccgtcgagcataaggaggaggagattgctaatatcaaggccaatatccgcaagtttgccacctataacgtcatccccatcctgggacgggcagcagcccttatggaaaagctccccctgccggacagaatctttgtcggtggcagtggcggcgagttggggaagatcattgaaacagccaaggagcggctacctgtagagggccgcattgtcatcaatgccgtcctgaaaaaaaccgctctggaggcaatgttttatctccgcgccctggaccttacctgtagtagcagcaaagtcagcgtcagtcgcattgagaccgacggcaatattaatgactttaatcccataaccatcatcgctgggcaaaaaatatcatga

SEQ ID NO: 8936 - protein, 402 aa, Desulfotalea psychrophila LSv54
MNKIHVIGVGADLAELQNLAPTLKNIQLFVASPKHHPLLAGYGVKCRAITPLDECLEEIRATEGEVAVLASGDPLFYGIGASLLRHFGEEDLLFYPGLSSIQRACALFKIPWHDAQLISLHGREANHIPGMILPHRKSLILTDGRNSPNSIAREILNYLLLIEDKELTKRIELRVGENLGTEEEWLFTGSLQEAAETSFAPLNVLCVLIAEQKKLPSLGLIEEEICHSRGLITKNEVRAASLHRLQLPTSGVLWDIGAGSGSVSIEAARLSPGLTIYSVEHKEEEIANIKANIRKFATYNVIPILGRAAALMEKLPLPDRIFVGGSGGELGKIIETAKERLPVEGRIVINAVLKKTALEAMFYLRALDLTCSSSKVSVSRIETDGNINDFNPITIIAGQKIS

SEQ ID NO: 8937 - DNA, 1284 bp, Methylococcus capsulatus str. Bath
  CDS (1)..(1284): transl_table=11
atgactgaaccctgccgcatcatcggcgtactggacaacggcgccgagggattgactccacaggcgctggcgtaccttcacgccgccgacctggtgatcggcgccgggcgcaccctcgcactgttcgaagctcacctggccgaaggcgccgaatgccgcgacctgggcggtcgccttgcgcaagtgccggactggatcgccgaggcgcgccggaatggaaagcgggtggcggtgctggcgaccggcgatccgctgtgccacggcatcgccggctatctgggcaacaagctcggccgcgaggccttggagatcctccccaacgtctccacgatccagctcgcctgtgcccggctggggctgccctggcaggacatggccatcggctcggtgcatagccgcgatgccggcgactggacaccgggcgccggccccgggcacggcctgtacgggctgctgcaaaagctgcggcaggccgatctcatgggcgtcttcaccagcccggaaaacggcccggaccgcatcgcccgcatgttgcgggccgaagggctggacgaggaattcgagatggccatcgcggaacggctgttgcaggcggacgagcgtatacatggctggctgggcatcgccgaggccgccggccaatgcttcgccgatcccaacgtggtgctgctgcgccgccggccctgcgagcgggaggcgctgttcgggctccccgacacccgtttccggcagcgcgccccggacaagggtctcatcaccaagcgcgaggtgcgcgccgtgtccctggcccggctggcgctgcgcccggacagcatcgtctgggacatcggcgcgggttccggcgcggtcggcctggaagcggcgcgcctgtgccccctgggccacgtctacgccatcgagaagaatgtggaagacttcgccattgccttgagcaaccgcgagagcctccgcgtcagcaactacacgctggtccaggccaaggctccccgggaactggacggctggcccgacccccacggcgtcttcatcggcggctccggcggcgaactgcgcgagctgatccagatctgcctgcgacggctgcgcaccggcggctggctggtgatgaacttcgccaccctggaaaacctggcggcggcggtggatgccctgaaggcgtccggggcaagctgggatgtcacccagttgcaggcggcgcgcagccgtcccatcctggacatgcaccgcctgcaggcggaaaacccggtctggatcgtttgcgcccagcgagagaacaatgagtga

SEQ ID NO: 8938 - protein, 427 aa, Methylococcus capsulatus str. Bath
MTEPCRIIGVLDNGAEGLTPQALAYLHAADLVIGAGRTLALFEAHLAEGAECRDLGGRLAQVPDWIAEARRNGKRVAVLATGDPLCHGIAGYLGNKLGREALEILPNVSTIQLACARLGLPWQDMAIGSVHSRDAGDWTPGAGPGHGLYGLLQKLRQADLMGVFTSPENGPDRIARMLRAEGLDEEFEMAIAERLLQADERIHGWLGIAEAAGQCFADPNVVLLRRRPCEREALFGLPDTRFRQRAPDKGLITKREVRAVSLARLALRPDSIVWDIGAGSGAVGLEAARLCPLGHVYAIEKNVEDFAIALSNRESLRVSNYTLVQAKAPRELDGWPDPHGVFIGGSGGELRELIQICLRRLRTGGWLVMNFATLENLAAAVDALKASGASWDVTQLQAARSRPILDMHRLQAENPVWIVCAQRENNE

SEQ ID NO: 8939 - DNA, 1200 bp, Silicibacter pomeroyi DSS-3
  CDS (1)..(1200): transl_table=11
atgtctgatgctccgtggctgagcgtgatcggcatgggcgaggatggactggatggcctgccgcccgcaagccgtcaagccctggacgcggccgaggtgatcatggcgccgccccggcacctgtcgctgctgcccgaggggccgcaggagcgcatcgcatggccggtcccgtattccgacggcttggagattctctccgggctgcgcgggcgccacgtggcagtgctcgcctcgggcgatccgttctggtttggcgcgggttcggtcattgcccgccattttgatgcgggcgaatggcgcgcgttgcccggagtctcgaccttttcgctggcagcggcgcggctgggctggccgctggagaagaccctcaccctgggtctgcatgccgcaccgctgacccggctgcggccctatctggcatccggcctgcgcgcgctgatcttgctgcgcgacggtgcggcggtatccgaactgtcgcgctacttggatcagaccggctttgccgccacccgcctgcatgtgatggaggcgctggggggcccgcgcgagcgcctgcaaaccctgtcgctggccgaggcgcaagcgggcgatttcgcccaccccgtctgtgtcggggtcgaagtggcgggcgaaggtcgggcgattcccaaggcaagcggcaggcccgacgcgatcttcgagaccgacgggcagatcaccaagcgcccggtgcgggcgctgacgctttcggcgctggcgccgcagcggggcgagcacctgtgggacatcggcggcggcaccggctcgatcgggatcgaatggttgatgagcgattcgacgctgcgcgccaccaccgtcgaaccccgcgccgaccgcgccgcgcgcatccgcgccaatgccgacgccctggggcaagaccacctgcgcgtggtcgagggcagcgcgcccgaggttctgggcagtcttgcgcggcccgatgcggtgttcatcggcggcggtctcagcacggcgctgctggaatggctttttgccgaactgcccgccggcacccggcttgtcgccaatgcggtgacgctggaaagcgaggcgttgctggccctctggcaggccgacaagggcggcgagctgctgcggatcgaactggcgcaatctgccccgctggggccgcgccggggctggaaatcggcctatccggtggtgcagtggagcgtgacgctatga

SEQ ID NO: 8940 - protein, 399 aa, Silicibacter pomeroyi DSS-3
MSDAPWLSVIGMGEDGLDGLPPASRQALDAAEVIMAPPRHLSLLPEGPQERIAWPVPYSDGLEILSGLRGRHVAVLASGDPFWFGAGSVIARHFDAGEWRALPGVSTFSLAAARLGWPLEKTLTLGLHAAPLTRLRPYLASGLRALILLRDGAAVSELSRYLDQTGFAATRLHVMEALGGPRERLQTLSLAEAQAGDFAHPVCVGVEVAGEGRAIPKASGRPDAIFETDGQITKRPVRALTLSALAPQRGEHLWDIGGGTGSIGIEWLMSDSTLRATTVEPRADRAARIRANADALGQDHLRVVEGSAPEVLGSLARPDAVFIGGGLSTALLEWLFAELPAGTRLVANAVTLESEALLALWQADKGGELLRIELAQSAPLGPRRGWKSAYPVVQWSVTL

SEQ ID NO: 8941 - DNA, 1230 bp, Synechococcus elongatus PCC 6301
  CDS (1)..(1230): transl_table=11
atggatactccttccttaactccgtggctatcgatcgttgggattagcgaagaaggatggctggccctaaccccgatcgcacagcaatgtatcctgcaagccgacattctcgtgggcagcgatcgccattttgatcttctgccttccctgccaggtgcggaacaatggcgctggggatccccgttttccgccacgatcacccaaatcctcgagcggcgcggccaatctatttgcatcctcgccagtggcgacccaatgtgctacggcgttgggagtttgctggcacaacgcttgccgctgactgaactccagattctgcctgcaccctcggcctttagtttggcctgctctcgcttgggctgggctttgccggaagtggaaaccctgagcctttgcggtcgcgatccagcgttacttaacgcgctactttatcctggcgccaagattttggccctcagtgccgatcgctcgactccagccacgatcgcagagcaactctgtcagcagggctgggggtcaagtcggctcacggttttagaacatctgggcggccctaaggagcgaaaaattagtgaaatagccgagcactggtctcagcccacgatcgcctctctcaacaccgtggcgattgaatgccatgcccgcgatcgcgacttgattgtgccgccccgcctgactggactgcctgatgcggcctaccaccatgatgggcaactgaccaaacgggaagtgcgagcgatcacgctagctgcgctagctcccctgcccggccaactgctctgggatgtgggtgccggctgtgggtcgatcggcattgaatggatgcgtagcgatcgccgctgtcgagcgatcgccattgagcagcatccgcagcggctgcaaatcattacacagaatgcgatcgccctcggggttccgaacctgcaagtggttgccggttcagcaccggctacgctgagtggcttgccccaaccggatgccatcttcatcggtggcggtgtcactgctccaggtgtgctcgatcaatgctggcaagcgctgccgatgggtgggcggctagttgttaacgccgttaccctcgaaagcgagcaagtcgttttggctggacagcagcgctgggggggagatttaatccgtgtggcggtgcagcgagcggaaccgatcggccgctttctcggctggaaatcgctggcaccgatcacgcaatggacggtcaaaaaaacagcctag

SEQ ID NO: 8942 - protein, 409 aa, Synechococcus elongatus PCC 6301
MDTPSLTPWLSIVGISEEGWLALTPIAQQCILQADILVGSDRHFDLLPSLPGAEQWRWGSPFSATITQILERRGQSICILASGDPMCYGVGSLLAQRLPLTELQILPAPSAFSLACSRLGWALPEVETLSLCGRDPALLNALLYPGAKILALSADRSTPATIAEQLCQQGWGSSRLTVLEHLGGPKERKISEIAEHWSQPTIASLNTVAIECHARDRDLIVPPRLTGLPDAAYHHDGQLTKREVRAITLAALAPLPGQLLWDVGAGCGSIGIEWMRSDRRCRAIAIEQHPQRLQIITQNAIALGVPNLQVVAGSAPATLSGLPQPDAIFIGGGVTAPGVLDQCWQALPMGGRLVVNAVTLESEQVVLAGQQRWGGDLIRVAVQRAEPIGRFLGWKSLAPITQWTVKKTA

SEQ ID NO: 8943 - DNA, 1305 bp, Bacteroides fragilis NCTC 9343
  CDS (1)..(1305): transl_table=11
atgaagacctcagaaacaacccgacctactctttcttctctccctgtcgggaagagagcggaagagggtacaccccataaccttttcaccgttataggtctcgacgacagtccttcgccttacctttcaccttccgtcaaggcattgatagaccaaggatgtgtcttttcaggaggagtgcgccatcacgacattgttgccccactgctccctgccggagcaaagtggatcgacatcaccgttcctctcgaccaggtattcgcccgttatgcaggacatccccatatcattgtctttgcttcgggtgaccctatctttttcggctttgccaacacgatccgccgacgtctgcccgatgcggagattcggctctatccctcttttaactctttgcaaacgctggcacaccgattagtgatgccctacgatgatatgcgcaccatctcccttaccggacgtccatggcatggatttgatcgtgcattgatagaacgtactcccaagatgggaatcctcaccgatcgcgaacatacgcctgctaccattgcaagccggatgctggactatggttacaacgattataccatgtacataggtgaacatctgggacatccgacaaaagaactgattcgccggatgacgcttgaagaggcagccgcagaaacatttgaatatcccaattgcctgattttaactacaggtgacggactgcaatctgtaaacggaggaatactctcccctcgtttcttcggcatccccgacgaagcattcgaactgcttgacggacgtgcccggatgatcaccaaagcccctatccgcctgctcaccttgagtgccttggaactaaaccgacggacttctttctgggatatcggcttctgcaccggctccgtctctatcgaagcccgattacaatttccccatctgcatgtcacatcttttgagatccgccccgaaggcaagcgactgatggaaatcaacagccggcgtttcggtactccgggcattaccaccgtcatcggtgactttcttgaaacagataccgccatttatccctgtcccgatgcagtttttatcggcggacatggcggacggctgaaagaaatcatatcccgggtccggcataagcttcttcccggagcacgcatcgttttcaactccgtatccgaagaaagtaaaacgcatttcatcgaagccgccaacgaatccggactctgttttctcggcggaacaagagtcgcaataaatgaatataatccaatagagatcctggtggcttcagctccggactctccttatctataa

SEQ ID NO: 8944 - protein, 434 aa, Bacteroides fragilis NCTC 9343
MKTSETTRPTLSSLPVGKRAEEGTPHNLFTVIGLDDSPSPYLSPSVKALIDQGCVFSGGVRHHDIVAPLLPAGAKWIDITVPLDQVFARYAGHPHIIVFASGDPIFFGFANTIRRRLPDAEIRLYPSFNSLQTLAHRLVMPYDDMRTISLTGRPWHGFDRALIERTPKMGILTDREHTPATIASRMLDYGYNDYTMYIGEHLGHPTKELIRRMTLEEAAAETFEYPNCLILTTGDGLQSVNGGILSPRFFGIPDEAFELLDGRARMITKAPIRLLTLSALELNRRTSFWDIGFCTGSVSIEARLQFPHLHVTSFEIRPEGKRLMEINSRRFGTPGITTVIGDFLETDTAIYPCPDAVFIGGHGGRLKEIISRVRHKLLPGARIVFNSVSEESKTHFIEAANESGLCFLGGTRVAINEYNPIEILVASAPDSPYL

SEQ ID NO: 8945 - DNA, 1203 bp, Pseudomonas syringae pv. syringae B728a
  CDS (1)..(1203): transl_table=11
atgtcgccgtggctgacagtcgtgggaatcggggaagacggttacaaggggctcggcaagaacgccagacacgcgctgctgcacgctgatcaggtgttcggcggcccgcgccaactggcgttgctgccgccgtgcattcgcgccgagcgacgtgcgtggcccagccctttctcgttgagccctgtgctcgagcagcggggtgccgagatctgcgtgctggccagtggcgacccgatgatgttcggcgtcggcgccagtcttgcacgcgtggtcagcatagacgaaatgcgcattctgcccgcgccctcctcttactctctggccgccgcccgcctcggctggcccctgcaggacgtcgtcaccctgtcggtggttgcccggccggtggccgcgctgaacgcgcatttccaccatggcatgcgcctgctggtgttgagcaacgacggcagcagccccgccgtgattgccggcttgttgcgcgagcgcggctttggtccaagccgcatgaccgttctggagcatctgggtggcgaagccgaacggcgcgtcgaagggctggccagcgagtggggcaaccccgagatcgccgcgctgaacctggttgccatcgattgtcgcgccgacgccagcgccatccgtctgagccccgtttcaggtctgccggacagcgccttcgaacatgacggacagctcaccaagcgcgacgtacgcgccatcaccctcgcccgccttgcaccgctgccgggcgaactgttgtgggatgtcggcgcgggctgcggctccatcggcatcgaatggatgcgcgcgcacccgacctgccgggcgatggccatcgaagccgatgaaggccgccagcaactgatcgaattcaaccgcgacgcactcggcgtgcccggcctgcaactggtgcggggcagtgcgcctcaggcattgagcggtctggagcgcccggatgcgattttcatcggcggtggcgtgacgcgtatcggcgtgctggaaacctgctgggaacaactgcgtccgggtggccgactggtcgccaatgcggtcaccctgcaaagcgaaacggccttgatggcctggcgcgaacggcatggcggcgagctgacccgtatccacgtcgcccacgcgcagccccttggcgaattcgacacgtggcgtcaggcgttgccgatcactctgctggacgtagtcaaaccctga

SEQ ID NO: 8946 - protein, 400 aa, Pseudomonas syringae pv. syringae B728a
MSPWLTVVGIGEDGYKGLGKNARHALLHADQVFGGPRQLALLPPCIRAERRAWPSPFSLSPVLEQRGAEICVLASGDPMMFGVGASLARVVSIDEMRILPAPSSYSLAAARLGWPLQDVVTLSVVARPVAALNAHFHHGMRLLVLSNDGSSPAVIAGLLRERGFGPSRMTVLEHLGGEAERRVEGLASEWGNPEIAALNLVAIDCRADASAIRLSPVSGLPDSAFEHDGQLTKRDVRAITLARLAPLPGELLWDVGAGCGSIGIEWMRAHPTCRAMAIEADEGRQQLIEFNRDALGVPGLQLVRGSAPQALSGLERPDAIFIGGGVTRIGVLETCWEQLRPGGRLVANAVTLQSETALMAWRERHGGELTRIHVAHAQPLGEFDTWRQALPITLLDVVKP

SEQ ID NO: 8947 - DNA, 1215 bp, Pseudomonas fluorescens Pf-5
  CDS (1)..(1215): transl_table=11
atgtcgccctggctgacagtagtgggaatcggtgaagacggcttcaagggccttggcagaaatgcccggcacgccctgctgggcgcatcaaagatcgtcggcgcccaacgccagctggacctgctgccaccctgcatccgtggccagcgccagctgtggcccagcccgttttccctggagccggtgctgagccagcgtggtgctgcagtctgcgtcctggccagcggtgaccccatgctgttcggcgtcggcgccagcctggcgcggcagctgcccgcagaggaaatccaggtactgtcctttccttcgtcctattccctggcggctgcgcgcctgggctggcctttgcaggaggtgatcacgctctctgtggtcgcgcggccgatcagcgcactcagcgcccaactgtccggcggggtacgcctgctggtgctgagcaatgacggccacagcccggccgccatcgccggcctgctgcgcgagcgcggtttcggcccgagccggatcagcgtgctggaacacctgggcggccccctggagcggcgcatcgacggcaccgccaatgactgggccgacccggcaatcgccgacctcaacctgctggccatcgaatgcctggccgaagccagcaccccgcgcctgtcgcggctcgccggcctgccggactcggcctttcgccacgatggccagttgaccaagcgcgacgtgcgggccatgaccctggcgcgcctggcaccggtgcccggcgagctgctctgggacgtgggtgccggcagcggctccatcggcatcgagtggatgcgtacccaccccagctgccgcgccctggccatcgaggccgacgacggccgccagcaattgatcgaacacaaccgcgaggtactcggcgtgcccgggctgcaactgatacgcggccgcgcgccccaggcactggccgggctggaacgcccggatgcgatcttcatcggtggcggcgtgacccgcgaaggagtgctgcaggcctgctgggaacaactcaagcccggcgggcgcctggtggccaatgccgtgaccctgcaaagcgaaatgaccctgatggactggcgagaacgccacggcggcgagctgacccgcattcacatcgcccaggcccagccactgggagagttcgacacctggcgccaggccctgccgatcaccctgctggacctgcacaagccccgggacctgccatga

SEQ ID NO: 8948 - protein, 404 aa, Pseudomonas fluorescens Pf-5
MSPWLTVVGIGEDGFKGLGRNARHALLGASKIVGAQRQLDLLPPCIRGQRQLWPSPFSLEPVLSQRGAAVCVLASGDPMLFGVGASLARQLPAEEIQVLSFPSSYSLAAARLGWPLQEVITLSVVARPISALSAQLSGGVRLLVLSNDGHSPAAIAGLLRERGFGPSRISVLEHLGGPLERRIDGTANDWADPAIADLNLLAIECLAEASTPRLSRLAGLPDSAFRHDGQLTKRDVRAMTLARLAPVPGELLWDVGAGSGSIGIEWMRTHPSCRALAIEADDGRQQLIEHNREVLGVPGLQLIRGRAPQALAGLERPDAIFIGGGVTREGVLQACWEQLKPGGRLVANAVTLQSEMTLMDWRERHGGELTRIHIAQAQPLGEFDTWRQALPITLLDLHKPRDLP

SEQ ID NO: 8949 - DNA, 1203 bp, Pseudomonas syringae pv. phaseolicola 1448A
  CDS (1)..(1203): transl_table=11
atgtcgccgtggctgacagtcgtgggaatcggagaagacggttacaagggcctgggcaagaacgcccggcacgctctgctgcacgctgatcaggtgttcggcggtccgcgccagctggcattgctgccgccgtgcattcgcgccgagcggcgtgcatggccgagtccattttcgctgaacccggtgctggaacagcggggtgccgaaatctgcgtactggccagtggcgatccgatgctgttcggcgtcggcgccagcctggcacgcgtagtctccatcgacgaaatgcgtattctgcccgccccttcttcttactctctggccgccgctcgtctgggctggccgttgcaggaagtcgttaccttgtcagtggttgcccgtccggtagccgcattgaacgctcatttccatcatggcgtacgtctgctggtgctgagcaatgatggcagcagccccgcagtgattgccggtttgctgcgcgaacgaggctttggccctagccgcatgacggtcctggagcacctgggaggtgaagccgaacggcgcgtcgaggggctggccagtgaatggggtaatcccgagatcgctgcgctgaacctggttgccgtcgattgtcgcgccgacgccagcgccattcgcctgagtacagtggccggtttgccagacagcgctttcgagcatgacggccagttgaccaaacgcgacgtgcgggccatcacccttgcccgccttgctccggtgccgggtgaactgctttgggacgtcggcgcgggctgcggttccatcggcatcgaatggatgcgcgcgcacccaacctgccgggcgatggccatagaagcggacgaaggccgtcagcaactgatcgaattcaatcgcgatgcgctgggcgtgccgggcctgcaattggtccgtggcagcgcgccacaggcgctgagcggtctggagcgtccggatgcgattttcatcggcggtggcgtgacccgtatcggcgtgctggaaacctgctgggagcagctgcgctccggcgggcggctggtcgccaatgcagtaaccctgcaaagcgaggctgcactcatggcctggcgcgagcggcatggcggcgaactgacgcgtattcacgtcgcccatgctcagcctcttggcgagttcgatacgtggcgtcaggccttgccgatcactctgctggatgtagtcaaaccctga

SEQ ID NO: 8950 - protein, 400 aa, Pseudomonas syringae pv. phaseolicola 1448A
MSPWLTVVGIGEDGYKGLGKNARHALLHADQVFGGPRQLALLPPCIRAERRAWPSPFSLNPVLEQRGAEICVLASGDPMLFGVGASLARVVSIDEMRILPAPSSYSLAAARLGWPLQEVVTLSVVARPVAALNAHFHHGVRLLVLSNDGSSPAVIAGLLRERGFGPSRMTVLEHLGGEAERRVEGLASEWGNPEIAALNLVAVDCRADASAIRLSTVAGLPDSAFEHDGQLTKRDVRAITLARLAPVPGELLWDVGAGCGSIGIEWMRAHPTCRAMAIEADEGRQQLIEFNRDALGVPGLQLVRGSAPQALSGLERPDAIFIGGGVTRIGVLETCWEQLRSGGRLVANAVTLQSEAALMAWRERHGGELTRIHVAHAQPLGEFDTWRQALPITLLDVVKP

SEQ ID NO: 8951 - DNA, 1287 bp, Dechloromonas aromatica RCB
  CDS (1)..(1287): transl_table=11
atgaagcgctctgatcaatgtgccttgattggcattctcgatgacggctgggcgggtttgtccgaaaccgcccgccagcgtctggcggcagccgatatcgtgatcggtgccgggcggacgctggaactggttcgcccgcacttgtccgccggcgcaacgctgaaggacatggacggcgcgctcggccaggttagcggctggatactggctgcccgcgacgccggccaaacggtggccgcgctggccaccggcgacccgctctgccacggcatcgcctcgtggctgaccggcaagctggggcgcgacggattcgatatcctgccggcggtatcgaccttgcagctggcctttgcccgtttcaaaacaccgtggcaggacatcaagattgccacctgccatagcgccgatgccggcgaatggtttgtcggcgccactccggcccacggcctctacaagctgatgcggaccatcgcccggcatccgcgcgtcgcgctctttaccggcccggaaaacacgccggcccggctggcccgggcgctgatcaccgccggttacggcgatgacgccaagctgtcgatcgcctgtcgtctcttgctggccgatgagcagatcttcgctggcctaagccccgccgaggccgcgaccatggagttcccgcagccgaacgtcgtgctggtcgaccgtgcagcggaggcgccccgcccgagctttggcctggaagatctcgaatacatccagcgctcgccggaaaaaggcctgatcaccaagcaggaagcccgcgcgctgtcactggccaagctgcgcctcgcacccgatgccatcgtctgggacatcggtgccggctccggctcggtcggcctcgaatgcgcccggctggccccgttcggccacgtctgggcgatcgagaaaaacgaaggcgatgccgccaatgccagggccaatgccgaacgtttccgcatcggcaactacacgctgtgcgaaggcaaggccccggcgcagctcgatagctggccagacccggatgccgtcttcatcggcggctccggcggcgaactggccgagttgatcaagctgatcctcggccgcctgaagccgggtggccggctggtcatgaatttcgtcaccctggaaaacctcgccacggccacggcaacgctcaaggaatgcggcgccacctgggatgtcgtccagcttcaggccagccgcagccagcccattctcgacatgcaccggatggccgcgcagaacccggtgtggattgttagcgcaagcaaggaaaatctatga

SEQ ID NO: 8952 - protein, 428 aa, Dechloromonas aromatica RCB
MKRSDQCALIGILDDGWAGLSETARQRLAAADIVIGAGRTLELVRPHLSAGATLKDMDGALGQVSGWILAARDAGQTVAALATGDPLCHGIASWLTGKLGRDGFDILPAVSTLQLAFARFKTPWQDIKIATCHSADAGEWFVGATPAHGLYKLMRTIARHPRVALFTGPENTPARLARALITAGYGDDAKLSIACRLLLADEQIFAGLSPAEAATMEFPQPNVVLVDRAAEAPRPSFGLEDLEYIQRSPEKGLITKQEARALSLAKLRLAPDAIVWDIGAGSGSVGLECARLAPFGHVWAIEKNEGDAANARANAERFRIGNYTLCEGKAPAQLDSWPDPDAVFIGGSGGELAELIKLILGRLKPGGRLVMNFVTLENLATATATLKECGATWDVVQLQASRSQPILDMHRMAAQNPVWIVSASKENL

SEQ ID NO: 8953 - DNA, 1218 bp, Thermobifida fusca YX
  CDS (1)..(1218): transl_table=11
atgaagacaccggtcactgtcgtcggcataggcgctgatggctgggaagggttgccgccggcgtcccgcgacgctatccgcgaagcccaggtactcctcggcggtactcgacatttggctttggtgcccgacacgggagcggtacgcgaaccgtggccgtccccgttgctgagcggtcttccaatgctcctggaccggtaccgtgaccgccgtgtcgtcgtgctggcttccggggaccccctcctgtcggggatcggcaccaccctggtgcgactgctcggcgcagaccgggtgcgggtgctgcccgcggtgagctcggtcgccctggcccgggcacggatggggtggagcgcggagtctgtggatgtggtgacgctcgtgggacgcgacgtcgacgcggtgcgccgctacctcacccccgggcggcggctggtggtgctctcctcggatgggacgacgcctgccgcggtcgcagcccggctggtcgaacacggccttggcgatagccgcatgacggtcctgtccgacctggggagcagcagagaggaacggatcgaagccaccgcggccgagtggcggggccgggacgcgccgccgttgaacgtggtgtgcgtggcggtcaccggaaacggtgggtacccgcttacccccgggctgccggatgaggcgttcgaccacgacgggcagctcaccaaacgagagatacggattgccgcggtctgtgcgctccgcccccaaccccaggccctgctgtgggatgtgggagcgggagcagggtcggtggccgtggaatggctgcgcgccgacccgcggtgccgggctgttgcgattgagcggcaccccgaacgggtgcaccggatcacgcgtaacgctgcccggcttggtgtgccctccctgcgcgtggtccacggtagtgcgcctgacgcgctgagcggactggagccacccgatgcggtgttcgtcggtggtggggctaccgacccgtccgtgctggaccggtgctgggcggccctgcggcccgggggccgcatcgtagtgcacgccgtgactttggagacggaagcagtcttggtggaacggtggcggcgccacggcggagagttgacacgcctctcggtggaacgggctgcccccctggggtcgttcacgggatggcgtccggcccgtccggttgtccagtgggccgcgaccaaaacagatcagggaagagagacatga

SEQ ID NO: 8954 - protein, 405 aa, Thermobifida fusca YX
MKTPVTVVGIGADGWEGLPPASRDAIREAQVLLGGTRHLALVPDTGAVREPWPSPLLSGLPMLLDRYRDRRVVVLASGDPLLSGIGTTLVRLLGADRVRVLPAVSSVALARARMGWSAESVDVVTLVGRDVDAVRRYLTPGRRLVVLSSDGTTPAAVAARLVEHGLGDSRMTVLSDLGSSREERIEATAAEWRGRDAPPLNVVCVAVTGNGGYPLTPGLPDEAFDHDGQLTKREIRIAAVCALRPQPQALLWDVGAGAGSVAVEWLRADPRCRAVAIERHPERVHRITRNAARLGVPSLRVVHGSAPDALSGLEPPDAVFVGGGATDPSVLDRCWAALRPGGRIVVHAVTLETEAVLVERWRRHGGELTRLSVERAAPLGSFTGWRPARPVVQWAATKTDQGRET

SEQ ID NO: 8955 - DNA, 1287 bp, Prochlorococcus marinus str. NATL2A
  CDS (1)..(1287): transl_table=11
atgcctgatgagtcaaaacagatacacgtaatcggaattgatacttcaagtgttgaaagtttttttgaagctaaaaaaaaaccaatttttaaagctgaaagaatcactggtcctcaaagaattttagattcattcaaaacttggttaaaggataaaaatataaaaaacaataagttcgagttcttttcaactgacaaactaaatgactttatagatctattaaaaaaggacaagaaaaaaacaattgtgttttctggtggtgatcctctttggtttgggattggtagattattaattcaaaactttcctttatcaaatctttattttgagccagccgcgacctctttccaactcgctttttccaaacttggcaaaccttggcaagatacacaatggatcagtcttcatggaagagacccgcttcaattagaaaaagcaattaaaaagcttccttcttcacttgtggttttaactgactcaaatagaggaggagctaaggaggtttatcaattaatggattccttggaacttcagaaaaaatatgaattttggactttcgaaaggcttggatatatcaatgaaagaattctaaaaatatcttctgttgatgatttcccaattgatcttgatccattgcatcttgtgattcttttaaaaaaagaagagcctctaatacaatcaatagatttacctttatttggaattgttgattcagtttttcttcaaaatgcagactgccctgggttaatgacaaaaaaagaagttagggttcaaattcttgccgaacttaatctcccaaagcaaggaataatttgggacataggaagtggagttgggagtattggtttagaagcattaaggatatctccaaatctaaaattagtatccattgataaaagagttggaagtacaaatataatcaaggaaaacgccagaaggcttggtgttaagccatcattgataattgaggatgaagcattaaatatatttaaacaaaataaaattacatctagtctttcaaaaccagaaagagttattatcggaggcggtggctcaaactcacatttaattcttgaagaagttttgaagctgataaatagtacttgtataatagttataccactaatatcattaaaatctatatcaaaattagagtcgattttaaagcctaaagcccacaagttatctattagtcaacatcaatcgtatagaggtgtaagtattggagaagatataagattatctcctttaaatcctgtttttattttgaagggtgaaattaaataa

SEQ ID NO: 8956 - protein, 428 aa, Prochlorococcus marinus str. NATL2A
MPDESKQIHVIGIDTSSVESFFEAKKKPIFKAERITGPQRILDSFKTWLKDKNIKNNKFEFFSTDKLNDFIDLLKKDKKKTIVFSGGDPLWFGIGRLLIQNFPLSNLYFEPAATSFQLAFSKLGKPWQDTQWISLHGRDPLQLEKAIKKLPSSLVVLTDSNRGGAKEVYQLMDSLELQKKYEFWTFERLGYINERILKISSVDDFPIDLDPLHLVILLKKEEPLIQSIDLPLFGIVDSVFLQNADCPGLMTKKEVRVQILAELNLPKQGIIWDIGSGVGSIGLEALRISPNLKLVSIDKRVGSTNIIKENARRLGVKPSLIIEDEALNIFKQNKITSSLSKPERVIIGGGGSNSHLILEEVLKLINSTCIIVIPLISLKSISKLESILKPKAHKLSISQHQSYRGVSIGEDIRLSPLNPVFILKGEIK

SEQ ID NO: 8957 - DNA, 1212 bp, Anabaena variabilis ATCC 29413
  CDS (1)..(1212): transl_table=11
atgacgcagaaatggctatctattatcggtattggtgaagatggactatcggggttaagtgcgatcgctctttctctactcaatcaagcagaaatcgttgtaggaggcgatcgccatttagcaatgttacctccaaacgacccacgcgaaaaaattctttggacttctcctattactaccgcagtagcagaaattatccagcgtcggggtaaatctgtatgtgtgttagctagtggtgaccccatgtattacggtattggtgtcaccttggcgcgacaagttcccatatcggaaatgacgattatccctgcaccttcatctttcagcctcgcttgcgcccgattaggatggtctttaacagaggtagaaaccttaagtttatgcggtcgtccctctgctttgctgcaatcttatatatatcctggtgcgcggttattaattttaagtgaggggaaaaatacaccgagcattgttgccgaaattcttacacagggaggttttgggaatagccaactcacagtcttggaacggatgggtggcattcatgaaaggatattaacagggacagccgcaacctggcaggaaacgaaactggcagacttaaatgcgatcgccctacattgtatcgctgatgctggtgttgttaccttacccagattaccaggattgccagataacgcctatcaccacgatggacaacttaccaaacgggaagttagagctgttaccctatcaactttagcacctacaccaggacagttactttgggatgtgggggcgggttgtggttccatatcgatagaatggatgcggactaatcccagatgtcaggcgatcgctattgaacaaaactcatctagactacaatacattgcagataatgcggctgctttaggtactcccaacctgaaaatcattgcgggaaaagcacctcatgtcctccaagatttacccacacccgatgccatttttatcggtggtggagttacagccccaggattatttgatatttgttggcaagcattacgcccaggcggcaggttaattgctaatgtagtcaccatagaaggcgagcagaccttatttcaatggtacgaaaaagtgggtggcagttttacccgtattgccattcaacgagccgaaccaattggtaaatttttgggttggcgagcaatggctcctgtaacacaatgggtaggggtgaaagattaa

SEQ ID NO: 8958 - protein, 403 aa, Anabaena variabilis ATCC 29413
MTQKWLSIIGIGEDGLSGLSAIALSLLNQAEIVVGGDRHLAMLPPNDPREKILWTSPITTAVAEIIQRRGKSVCVLASGDPMYYGIGVTLARQVPISEMTIIPAPSSFSLACARLGWSLTEVETLSLCGRPSALLQSYIYPGARLLILSEGKNTPSIVAEILTQGGFGNSQLTVLERMGGIHERILTGTAATWQETKLADLNAIALHCIADAGVVTLPRLPGLPDNAYHHDGQLTKREVRAVTLSTLAPTPGQLLWDVGAGCGSISIEWMRTNPRCQAIAIEQNSSRLQYIADNAAALGTPNLKIIAGKAPHVLQDLPTPDAIFIGGGVTAPGLFDICWQALRPGGRLIANVVTIEGEQTLFQWYEKVGGSFTRIAIQRAEPIGKFLGWRAMAPVTQWVGVKD

SEQ ID NO: 8959 - DNA, 1212 bp, Pseudomonas fluorescens PfO-1
  CDS (1)..(1212): transl_table=11
atgtcaccctggctgacagtagtaggaatcggtgaagacggcttcaaaggcctgggcaagaatgcccggcgcgccttgatggacgcttcgcggatcatcggcggtcagcgtcagctggatctgttgccggtgtgcatccgtggcgagcgccagttgtggccgagcccgttttccctggccccggtgctcgagcgtcgcggtgaagccgtgtgtgtgctggccagtggtgatccgatgttctacggcgttggcgcgagtctggcgcgtcaggttccggaggccgagatgctggtcctgccggccccgtcgtcctgctcgctggcggcggcccgactgggctggccgttgcaggacgtcagcgtgctgtcgctggtggctcgcccgctggcggctctcaatgcacaactgtttggcggcgtgcgcctgttgctgctgagcaatgacggccagagcccggcggcggttgccacgttgctgcgtgaacgcggattcggcgccagtcgcctgagcgtgctggaacatctgggcggcagcgccgaacgccggatcgacggcagcgccaacgactggaacgatccgctcattgccgacctcaacgtgatcgccctcgagtgcctcgccgatccgcagacaccgcgcctgtcgcgcctcgccggcctgccggactcggccttccggcacgacggccaactgaccaagcgcgacgtgcgcgcgatcaccctcgcccgcctcgccccgacaccgggcgaattgctctgggacgtcggcgcgggcagcggctcgatcggcatcgagtggatgcgcgcgcacccgagctgtcgcgcactggccatcgaggctgacgatggtcgccagcagctgatcgaacacaaccgcgatgcgctgggtgtgcccggcctgcaactgattcgtggcagcgccccgcaagctctcgccgggctggagcgaccggacgcgattttcatcggcggcggcgtgacccgcgaaggcgtgctggaaacctgctgggcacaactcaaacccggtggccgactggtcgccaacgctgtgaccctgcaaagcgaaatgaccttgatgagctggcgcgaacgccacggcggcgaactgacccgcatccacatcgcccaggcacagccgctgggcgaattcgacacctggcgccaggcgttgccgatcaccctgctcgatctggtcaaacccctcgatgcgtga

SEQ ID NO: 8960 - protein, 403 aa, Pseudomonas fluorescens PfO-1
MSPWLTVVGIGEDGFKGLGKNARRALMDASRIIGGQRQLDLLPVCIRGERQLWPSPFSLAPVLERRGEAVCVLASGDPMFYGVGASLARQVPEAEMLVLPAPSSCSLAAARLGWPLQDVSVLSLVARPLAALNAQLFGGVRLLLLSNDGQSPAAVATLLRERGFGASRLSVLEHLGGSAERRIDGSANDWNDPLIADLNVIALECLADPQTPRLSRLAGLPDSAFRHDGQLTKRDVRAITLARLAPTPGELLWDVGAGSGSIGIEWMRAHPSCRALAIEADDGRQQLIEHNRDALGVPGLQLIRGSAPQALAGLERPDAIFIGGGVTREGVLETCWAQLKPGGRLVANAVTLQSEMTLMSWRERHGGELTRIHIAQAQPLGEFDTWRQALPITLLDLVKPLDA

SEQ ID NO: 8961 - DNA, 1254 bp, Burkholderia sp. 383
  CDS (1)..(1254): transl_table=11
atgacggcgtggctgacagtagtaggcatcggcgacgacggttacgcggggctcggacgcagcgcgcggcgcgcgctgctcgacgcgacgctcgtcgtcggcgcgaagcggcatctcgacatgctgcccgcgcggctgccggccgcgcgcgaaacctggccgtcgccgttcgatctcgcgggcgtgctggcccgacgcgcatcgcccgtctgcgtgctcgccagtggcgacccgatgctgttcggcgtcggcgccacgctcgcgcgccagctttcccccgacgaatggcgcgtgctgcccgcaccgtcgtcgctgtcgctggcagccgcgcgcctcggctgggcgctgcaggatgtcggcgcggtctcgctcgtcggccgtccgcttgcgacgctcgcgcgtcacctgctgcccggccgccgcctgttcgtgctgagcgccgacggccgcacgccggccgccgtcgcggccgaactcgtcgcacgcggcttcgggccgacgcgcatcagcgtgttcgaacatctcggcggcccgctcgagcggcgtctcgacgggctcgcacagggctggcgcatcgacgaaacggccgcgctcaatctggtggcgctcgactgccaggcctgccccgacgcgccgcgccgcgcgctcacgcccggcctgcccgacgacgcgtaccgtcacgacggccagctcaccaagcgcgacctgcgcgccatgacgctcggccgcctcgcgcccgtgcccggcgagctgctgtgggacgtcggcgccggcagcggctcgatcggcatcgagtggatgcgcgcgcatccgtcatgccaggcaatcgcgatcgaagcgcatgcggagcggcaacgcttcatcgaacacaaccgtgatgcgctcggcgtgccgggcctgcaactcgtcgcgggccgcgcccccgatgcgctcgcggggctcgccgcgcccgacgcgatcttcatcggcggcggggcgaccgcacccggtgtgctcgacgcgtgctgggcagcgctgaaaccgggcggccggctggtcgcgaacgcggtcacgctgcagggcgagatggcgctcgccgcgtggcgcgatgcgcatggcggcacacttacgcgtgtgtcgctcgcacacgccgagccgctcggccgtttcgacacgtggcggcaaccgttgccggtcacgctgtacgacgtgcgcaagcccgacaccgccgacacgcccgcaccgtcgaccgcgacgaacgcaacggacgcgtga

SEQ ID NO: 8962 - protein, 417 aa, Burkholderia sp. 383
MTAWLTVVGIGDDGYAGLGRSARRALLDATLVVGAKRHLDMLPARLPAARETWPSPFDLAGVLARRASPVCVLASGDPMLFGVGATLARQLSPDEWRVLPAPSSLSLAAARLGWALQDVGAVSLVGRPLATLARHLLPGRRLFVLSADGRTPAAVAAELVARGFGPTRISVFEHLGGPLERRLDGLAQGWRIDETAALNLVALDCQACPDAPRRALTPGLPDDAYRHDGQLTKRDLRAMTLGRLAPVPGELLWDVGAGSGSIGIEWMRAHPSCQAIAIEAHAERQRFIEHNRDALGVPGLQLVAGRAPDALAGLAAPDAIFIGGGATAPGVLDACWAALKPGGRLVANAVTLQGEMALAAWRDAHGGTLTRVSLAHAEPLGRFDTWRQPLPVTLYDVRKPDTADTPAPSTATNATDA

SEQ ID NO: 8963 - DNA, 1260 bp, Synechococcus sp. CC9605
  CDS (1)..(1260): transl_table=11
atgatcgatgtgatcggcaccgacgccggggcgcccccctcgttgcccgctccacagcagacgttgctgcgggcggccgccgtgattgcagcaccgcagcggttgcaagctgccctgcaggactggctgggggacgccaaacctgagctgatcagcagcgatgacccgcgggctctggtggacaacctgcaatcgaaagctgctgatcaatctgtggtggtgctggccagcggcgatccgctctggttcggcctggggcgcatcctttgcgaccgcatcggcgcagagcggctgcggtttcatccggcccccacatcgctgcagctggccttcgcccgcatcgggcgcccctggcaggacgccgactgggtgagcctgcacggacgggaccccaaaatcctgaccagcgccttgcagaaacgaccgacggccctggcggtgctgacggacccgaaccaggggggcgccggcagcgtgcagcagatgttgcgcagcagcggcctggaggccagcacggacctgtggctctgcgaaaaacttggccaccccgatgaacgggttcagctgatcgccccaaacgccgcgctaccaacagatctgcatccgctgctgattgcactgctgatcgcccgcgaacccgccgcgccggatccgcatcagctgccgttgttcgggctcgatgacgggctctaccttcagcacagcgatcaccccggactgatgaccaagcgggaggtgcgcatccaacttctggccgaactcgccctgccgcagctgggcgtgctctgggatctgggggccggcaccggcagcgtcggtctggaggcgctgcgactgcggcctggcctgcaactgctggcagtggaacgccgcgccggtggcgcgcaactgatccagcgcaatgcgcaacggctcggtgtcagccccgcagcggtgctggagaccgacgctacaactgtgctgaacggagggctccccgatggcctcagccagcccgatcgggttctgctcggaggcggtggcgcccagcgggagcgcctgctgcagaacgtactgacgcggctgcggcctggtggcgttgtggtgattcccctggcaagcatcgaggcgttggccagcgttcggccgctactcgagaacgctgggttgttggtgcgagtgcagcaactgcaggcctggaggggacaaccgctgggggatggcacccgcctggctccgatgaaccccacgttgatcgtgacgggaacgaagccggcttaa

SEQ ID NO: 8964 - protein, 419 aa, Synechococcus sp. CC9605
MIDVIGTDAGAPPSLPAPQQTLLRAAAVIAAPQRLQAALQDWLGDAKPELISSDDPRALVDNLQSKAADQSVVVLASGDPLWFGLGRILCDRIGAERLRFHPAPTSLQLAFARIGRPWQDADWVSLHGRDPKILTSALQKRPTALAVLTDPNQGGAGSVQQMLRSSGLEASTDLWLCEKLGHPDERVQLIAPNAALPTDLHPLLIALLIAREPAAPDPHQLPLFGLDDGLYLQHSDHPGLMTKREVRIQLLAELALPQLGVLWDLGAGTGSVGLEALRLRPGLQLLAVERRAGGAQLIQRNAQRLGVSPAAVLETDATTVLNGGLPDGLSQPDRVLLGGGGAQRERLLQNVLTRLRPGGVVVIPLASIEALASVRPLLENAGLLVRVQQLQAWRGQPLGDGTRLAPMNPTLIVTGTKPA

SEQ ID NO: 8965 - DNA, 1218 bp, Geobacter metallireducens GS-15
  CDS (1)..(1218): transl_table=11
atgcctcaccagaaaatctaccttgtcggcgcaggcatcgaagggtgggaagggttcggcgccaaggccctggaggtcatcggcaaggctgaggttctcgtcggccacaagcggcacctggatatcttctccgacttcaccgggaagaagcaggagctgggtgacctctccatcctcctggagcagctcaggagcaccgacaagcggaccgtggtcctcggttccggcgacccgaactttttcggcatcgcccggttcctgctccgcaaccttcccaaggagcggatcgagatcttccccaacgtgacgagcgtccagtacgcctttgcccagatcaaggagccgtgggacgacgccatcttcgtctcggtccacggccgggggctcaagggggccgtggaccggatcgtggccgccgagaaggtggcggtcctcaccgacaagaccaactccccggcggccatcgcccgggagctcatcgcccggggtgccgaggggtacgaggcgtggctctgcgagaacctggggctccccggcgagaagttcaccaggaccgacgtgaaggggctcctggagctgccggcggcggaactgaacatcctcatcctcatcaaggcctgggaaccccagctggcccagtacccggtcatcggcatcgacgacgacgagttcgccaccgccaagaagctcatcaccaagcaggaggtacgggccgtgaccctgtcgaagcttcggctccaggatgacctcgttatgtgggacatcggcgccgggagcgcttccgtctccatcgaagcatcgaatctcatgcccaacggccgcatcttcgccctggagaggaatccccagtacctcggcttcatccgcgataacctgaaaaagttcgtggcccgcaacgtgaccctcgtggaggccttcgcccccgaggggctcgacgatctcccggacccggaccgggtcttcatcggcggttccggcggcatgctggaagagatcatcgatgccgtggaccggcgcctcaagtccgagggggtcatcgtcctcaacgccgtgaccctcgacaccctcaccaaggcggtggagtttctggaggaccacggctacatggtggaggtggcctgcgtgaacgtggccaagaccaaggggctcaccgagtacaagatgttcgagtcccacaatcctgtctatatcatcaccgcctggaagagtgacgaatga

SEQ ID NO: 8966 - protein, 405 aa, Geobacter metallireducens GS-15
MPHQKIYLVGAGIEGWEGFGAKALEVIGKAEVLVGHKRHLDIFSDFTGKKQELGDLSILLEQLRSTDKRTVVLGSGDPNFFGIARFLLRNLPKERIEIFPNVTSVQYAFAQIKEPWDDAIFVSVHGRGLKGAVDRIVAAEKVAVLTDKTNSPAAIARELIARGAEGYEAWLCENLGLPGEKFTRTDVKGLLELPAAELNILILIKAWEPQLAQYPVIGIDDDEFATAKKLITKQEVRAVTLSKLRLQDDLVMWDIGAGSASVSIEASNLMPNGRIFALERNPQYLGFIRDNLKKFVARNVTLVEAFAPEGLDDLPDPDRVFIGGSGGMLEEIIDAVDRRLKSEGVIVLNAVTLDTLTKAVEFLEDHGYMVEVACVNVAKTKGLTEYKMFESHNPVYIITAWKSDE

SEQ ID NO: 8967 - DNA, 1212 bp, Desulfovibrio desulfuricans G20
  CDS (1)..(1212): transl_table=11
atgaccattgatgtggttggtctcggcatggatgccgactcgctgccggaatatcataccgatgttgtcgaaagcgctcaggttctggtgggcggcaagcgtcagctggccctttttgacgatcatccggcagaaaagctgctcatcacggcgccgctgggcgatatgctggaaaacatagccagactggaaagtcagggtaaatccgtggtggtgctggccgacggcgacccgctgtttttcggcataggtgcgcgccttgtggatgaattcggaccggaaggcgtgcgcatatggcccaatatcacatcgctgcaggctgctgccgcacgcgccaaagtgccgtggcagggcatcagggtggtatcgctgcacggacgcgacgacatgcgtccgctcatgcaggccctgctgcaaagcccgtgggtctgcgtgctcacagacggccgcagcattccttcggccattgcccagtggctgctggacagaggcgccgactggttttttgtctgggtgtttgaaaacatgggacagcccaacgagcatttcgaccgctactctctgcaggatgccgtcaaacgcagtttttcgtcactgaacaccgttctcatagaacgcagaggcggccccgagcgtgtgctcgcccccggcatacccgacgacgaactgctgagcgacggcggactggtgaccaaatggcccatacgcgccgcgggcattgccgcgctgcgtccttcgcacggcatgacggtgtgggatctgggagcaggcagcggtgccatgggcatggaagcctcatgtctggtgggtgagggcgtggtgtggtgcgtggaacgcaaggcggcccgcgttgagcacatccgcgccaacagacgccgcttcggggcgctgcaggttgaagtggtgcacggcaccatgcctgcctgtctcgacgatctgcccgcccctgacagaatttttctgggcggcggactcggctccggcgacgaagtgctgcatcaggcatgctcacggctcaatcccggcggccgcattgtggcccactgcgtgctgctggggtctttgaaccgtgctcgggaagcattcaccgcaatgggctggccgtacgaaatcacacaggtgcagtctgcatgcgccgtgccgctggccggtgacctgcggctggacgccaacaatcccgtctttatcatagccgcccagcgtccggagtaa

SEQ ID NO: 8968 - protein, 403 aa, Desulfovibrio desulfuricans G20
MTIDVVGLGMDADSLPEYHTDVVESAQVLVGGKRQLALFDDHPAEKLLITAPLGDMLENIARLESQGKSVVVLADGDPLFFGIGARLVDEFGPEGVRIWPNITSLQAAAARAKVPWQGIRVVSLHGRDDMRPLMQALLQSPWVCVLTDGRSIPSAIAQWLLDRGADWFFVWVFENMGQPNEHFDRYSLQDAVKRSFSSLNTVLIERRGGPERVLAPGIPDDELLSDGGLVTKWPIRAAGIAALRPSHGMTVWDLGAGSGAMGMEASCLVGEGVVWCVERKAARVEHIRANRRRFGALQVEVVHGTMPACLDDLPAPDRIFLGGGLGSGDEVLHQACSRLNPGGRIVAHCVLLGSLNRAREAFTAMGWPYEITQVQSACAVPLAGDLRLDANNPVFIIAAQRPE

SEQ ID NO: 8969 - DNA, 1275 bp, Prochlorococcus marinus str. MIT 9312
  CDS (1)..(1275): transl_table=11
atgactgaaataaatagaaaaatttatattgtagggattaattcttttaaatttgaagatttaccttttaaattacaaaatctatttaatgagacagtaaatattgcagtgcctaattcatatcttgaaaaaattaaatcatggagcgaaaacgatttaaaacaaaaaaaattattttatgcaagcaaaagtaataacgaactcattaactggcttcggtctcaaaaaaatgatgttattttaatttcaagaggcgatcctctttggtttggaattggaagaatactcctagaaaatttttcaaaagatgaattaaatttctacccttcaaatacttgtattcaattagcatttagtaagttaaaaattccttggcaggatactattaatgtaagtattcatgggagagattccactaagttagttgaggcacttaaaaccaagccttcaagtttggctattattacagattcaaacaacaaaagtttagaaattatccaaaaaaacttatcagaattaaatctgattgacttttatgatttttggctttgtgaagaaataggtttcgacaatgaaaatataagaaaattaaatcttaaagagtcattgccctccgatatctcgagtttgaacattgctgttctaacaaaagcaaggaaaattttttcgaataatgatttacctcttttcggaatcagtgacattatttttaaaacttttgaagacagaccaaatttattaactaaaagggaggttcgtattcaaatcttagctgatttagaactcccaaaaaaaggtgtaatttgggatataggagcaggttgtggatcaattggtttagaggcattaaaactaaggcctaatttagatttattttgtatcgataaaagaattggctcaaaaggcttaatattagaaaactcaaaaaggctgggagttaaaccaaaatctatttttgaggaagacataaataataccttcaacaagataaattttatttcttttgaaaaacctaatagattagtaattggaggatgcgataaaaagactaaacttcaaatcattaataaactgggccaagatatgagtagtggagatattatcttaatcccaataatagatattcaaactatagaagaattaaaagaggaattagaaaataaaaattttaatacaaatttaaatttaatacagacttacaaaagtttaagtatcgcagaaggaatgagattagaaccaaataatcctgtatttttattaaaagggaaaaaataa

SEQ ID NO: 8970 - protein, 424 aa, Prochlorococcus marinus str. MIT 9312
MTEINRKIYIVGINSFKFEDLPFKLQNLFNETVNIAVPNSYLEKIKSWSENDLKQKKLFYASKSNNELINWLRSQKNDVILISRGDPLWFGIGRILLENFSKDELNFYPSNTCIQLAFSKLKIPWQDTINVSIHGRDSTKLVEALKTKPSSLAIITDSNNKSLEIIQKNLSELNLIDFYDFWLCEEIGFDNENIRKLNLKESLPSDISSLNIAVLTKARKIFSNNDLPLFGISDIIFKTFEDRPNLLTKREVRIQILADLELPKKGVIWDIGAGCGSIGLEALKLRPNLDLFCIDKRIGSKGLILENSKRLGVKPKSIFEEDINNTFNKINFISFEKPNRLVIGGCDKKTKLQIINKLGQDMSSGDIILIPIIDIQTIEELKEELENKNFNTNLNLIQTYKSLSIAEGMRLEPNNPVFLLKGKK

SEQ ID NO: 8971 - DNA, 1227 bp, Rhodospirillum rubrum ATCC 11170
  CDS (1)..(1227): transl_table=11
atgacagcgtggctgacggtggtgggcatcggcgaggacggtttggccggcctgggcgagggagcgcgcgacgccatcgccaaggcctcgctgctgctgggcggccagcgccaccttgatctggttccggtggtcgcagggcaggagcgccaagcttggcccagcccgttttccctggcctatgatctggtgctggcccgccgaggaacgccggtctgcgtgctggctagcggcgatcccatgcattacggcatcggcgcctcgctggccgcgaggctcgagccgggcgaaatgcgggtgctgcccgcgccctcgtcgttctcgctggctgccgcccgtctgtgctggccgctgcaggactgccaactgctgaccgtccatggccgcccgctcgagagcgtcagggtggctctttatcccgaggcccggctgctgatcttgtcggaagacggccagaccccggccgccctggccgccttgctggtggaacgcggctttggcgagagcccgttcatcgtgctcgaacacctgggcggcccgactgagcgcatccgccacgccacggcgcgcggctggctggcggccgagtccgcgccttgcgccgatctcaatctggtggccgtcgactgccgggccgaggcgggcgcccagtcctggccccggctggccggcctgcccgacagcgcctatcgccacgacggccaattgaccaaacgcgccgtccgcgccgtgacgctggcccacctcgcccccttgcccggccaggtgctgtgggacgtgggggcgggctgcggctcgatcggcatcgaatggatgcgcagcgcgcccagctgccgggccttcgccatcgaagccgatgccgaacgcgccgatgtcatcgcccataatcgcgccgccctgggcgttcccggcctggaactggtggaaggccgcgccccggcggtgcttgaaggcctgcccgatcccgacgccatcttcatcggcggcggcctgaccgccaatggcgtgttcgaacgctgctggatcgccctgaaaccgggcggccggctggtcgccaacgccgtcaccctcgaaagcgaggcccgcctcgcccattggcacggcgtgctaggcggcgagctgacccgcctctcggtcgcccacgccgaccccgtcggccgcttccacggctggcgctcggcgatgccggtgacgctctatgaggtggtcaagcccaagcaggggtga

SEQ ID NO: 8972 - protein, 408 aa, Rhodospirillum rubrum ATCC 11170
MTAWLTVVGIGEDGLAGLGEGARDAIAKASLLLGGQRHLDLVPVVAGQERQAWPSPFSLAYDLVLARRGTPVCVLASGDPMHYGIGASLAARLEPGEMRVLPAPSSFSLAAARLCWPLQDCQLLTVHGRPLESVRVALYPEARLLILSEDGQTPAALAALLVERGFGESPFIVLEHLGGPTERIRHATARGWLAAESAPCADLNLVAVDCRAEAGAQSWPRLAGLPDSAYRHDGQLTKRAVRAVTLAHLAPLPGQVLWDVGAGCGSIGIEWMRSAPSCRAFAIEADAERADVIAHNRAALGVPGLELVEGRAPAVLEGLPDPDAIFIGGGLTANGVFERCWIALKPGGRLVANAVTLESEARLAHWHGVLGGELTRLSVAHADPVGRFHGWRSAMPVTLYEVVKPKQG

SEQ ID NO: 8973 - DNA, 1521 bp, Burkholderia thailandensis E264
  CDS (1)..(1521): transl_table=11
atgaaggctggcacgaacgaaacgtcccggcaggtctcctggctggcaggtcgtcatccgcagcgggccttcccggcagccgcgaaaagggcggcgtggccagtggcgtggatcggatgcggactcgctgctcacagttgcgggggcagccgcagcggcgcggcgcgccctgcgttccctcttgggccccgtggggcgccggtcgacggacgctgtattatgccttttttcgcgacgcccgagcgcgcagatgcgcgatgcgggcgtcgctttcaggatcgacgggaacacgatggagtacgacggatgaccgcgtggctgacggtggttggcatcggcgacgacggctacgcggggctcggccggccggcgcggcgcgcgctcgccgacgcggcggtggtgatgggcggcgagcggcatctcgcgatgctgcccgcgcggcacggcgccgagcgcgtgccgtggccgaagccgttcgatctcgcgccgctcttcgcgcgggctccggcgcgcgtgtgcgtgctggcgagcggcgatccgatgctgttcggcgtcggcgcgacgctcgccagcacgctcgcgccgaacgagtggcgcgtgctgcccgcgccgtcgtcgctgtcgctcgcggccgcgcgcatcggctggccgttgcaggacgtcgatgcggtgtcgctcgtcggccgcccgctcgcgtcgcttcaccggcatctgtatccgggccggcgcctgttcgtgctgagcgcggacggcgcgacgcccgccgcgatcgccggcgcgctcgccgcgcgcggcttcgggccgagcgcgatgacggtgttcgagcatctcggcggcccgctcgagcggcgcgccgacgcgcgcgccgacgcgtggggcgacgcgcgtgcggcggcgctgaacgtcgtcgcgatcgaatgccgcgcgagcgccgatgcgccgcgcctggcgctcacgcccggcttgccggacgatgcgtaccgccacgacggccagctgacgaagcgcgatctgcgcgcgctcgcgctcgggcggctcgcgcccgcgccgggcgaattgctgtgggacgtcggcgcgggctccggctcgatcggcatcgaatggatgcgcgcgcatccgagttgccggacgatcgcgatcgaagcgcatccggcgcggcagcgcatcatcgagcacaaccgagatgcgctcggtgtgcccgcgctcgagctcgtcgcgggccgcgcgcccgaagcgctcgcgggcctgcccgctcccgacgcggtgttcgtcggcggcggcgtgagccgtgagggcgtgctcgacgcgtgctgggccgggctgaagccgggcggccgcctcgtcgcgcacgcggtcacgctgcagggcgaggcggcgctcgtcgcatggcgcgagcggcacggcggcgcgctcgcgcgcgtgtcggtcgcgcacgcgcagccgctcggcggcttcgacgcgtggcggcaggcgctgcccgtcatgctgtacgacgcccgcaagccgcaggagcacgaatga

SEQ ID NO: 8974 - protein, 506 aa, Burkholderia thailandensis E264
MKAGTNETSRQVSWLAGRHPQRAFPAAAKRAAWPVAWIGCGLAAHSCGGSRSGAARPAFPLGPRGAPVDGRCIMPFFATPERADARCGRRFQDRREHDGVRRMTAWLTVVGIGDDGYAGLGRPARRALADAAVVMGGERHLAMLPARHGAERVPWPKPFDLAPLFARAPARVCVLASGDPMLFGVGATLASTLAPNEWRVLPAPSSLSLAAARIGWPLQDVDAVSLVGRPLASLHRHLYPGRRLFVLSADGATPAAIAGALAARGFGPSAMTVFEHLGGPLERRADARADAWGDARAAALNVVAIECRASADAPRLALTPGLPDDAYRHDGQLTKRDLRALALGRLAPAPGELLWDVGAGSGSIGIEWMRAHPSCRTIAIEAHPARQRIIEHNRDALGVPALELVAGRAPEALAGLPAPDAVFVGGGVSREGVLDACWAGLKPGGRLVAHAVTLQGEAALVAWRERHGGALARVSVAHAQPLGGFDAWRQALPVMLYDARKPQEHE

SEQ ID NO: 8975 - DNA, 1437 bp, Frankia sp. CcI3
  CDS (1)..(1437): transl_table=11
gtgagttccgccgactccagcttcgccgactccatcccctccgctgtgcgcgtcaccgtggtaggtatcggggccgacggctgggcggggctggcgccgacggcacgtgaggtggtgcgcggggccgccgtgctgttcggcgccgatcgccagcttgccctcgtgcccgaaaggatcgacggccagcccgttggaggccggcgggtgtcgtggccgtccccgctgctgccggccctgccccgcctgctggccgggcacgccggcaccggcgctcaggcggggcagggtgagctctgtgttctcgcgagtggtgatccgatgttcttcgggatcggcaccactctggtccggctgctgggagcgcaccgggtgcgggtcctgccccatccttcgtcgctctccctggcctgcgcgcggctcgggtgggccgtggacgacgtcgacgtggtgagcgcggtcggacgtcccctcgcgcaggtgcaggccgcactggcgccgcgtcgacggctgctcgtcctcagctccgaccgggccacgcccgtcgagttcgccaccttgctcgtcgggcgcgggtacggcgagagcctgctgacggttctcgaccggctcggggggccggacgaggcgtaccagagcgcccccgcctccgcctgggtcgaggccggtgcccgggcctgggttcgggcaccggccgccgtggagcacccgggcggggccgcctcggccgtgccgccggggtcagctgtgtcgcaagggtcggtcgtgccgcaggtgccgttgcgcgagccggcggacctcaacgtcgtcgccgtcgagccggtgcccacgccgtccgccccgcaccgctcgcggacgccgggcttgcctgatgacgcgttcgagcacgacggtcagatcaccaggcgggagatccgggcggtgaccctggcccggctcggaccggtcccgggcgaactgctgtgggacgtcggatcgggctcgggcagcatcgcgatcgagtggatgcgcacccatggcacctgtcgcgcgatcgcgatcgagccgcgggcggagcgcgccgaccggatccggcgcaatgccacggctctcggcgtgccggcgctgcggatcgtgcccggccgggcgcccgaggccctggccgggctgccggcgccggatgcggtcttcatcgggggcggcctcacgacccccgggctgctcgacgcctgctgggcggcgctgggcggacgtggccggctcgtcgccaacgccgtcaccctcgaatccgaggcgctcctcgtctcctggcatgcccgcctgggcggtgatctggtccggttgtcagtgagtcgggcggccccgatcggtggcttcaccggatggcgcccggcgaggccggtgacccagtggacggtgtggcccgccgcccaccgatccgtcgatccgtcgaaaatgtag

SEQ ID NO: 8976 - protein, 478 aa, Frankia sp. CcI3
MSSADSSFADSIPSAVRVTVVGIGADGWAGLAPTAREVVRGAAVLFGADRQLALVPERIDGQPVGGRRVSWPSPLLPALPRLLAGHAGTGAQAGQGELCVLASGDPMFFGIGTTLVRLLGAHRVRVLPHPSSLSLACARLGWAVDDVDVVSAVGRPLAQVQAALAPRRRLLVLSSDRATPVEFATLLVGRGYGESLLTVLDRLGGPDEAYQSAPASAWVEAGARAWVRAPAAVEHPGGAASAVPPGSAVSQGSVVPQVPLREPADLNVVAVEPVPTPSAPHRSRTPGLPDDAFEHDGQITRREIRAVTLARLGPVPGELLWDVGSGSGSIAIEWMRTHGTCRAIAIEPRAERADRIRRNATALGVPALRIVPGRAPEALAGLPAPDAVFIGGGLTTPGLLDACWAALGGRGRLVANAVTLESEALLVSWHARLGGDLVRLSVSRAAPIGGFTGWRPARPVTQWTVWPAAHRSVDPSKM

SEQ ID NO: 8977 - DNA, 1224 bp, Desulfitobacterium hafniense Y51
  CDS (1)..(1224): transl_table=11
atgattcaaatagtggggataggccctggtacgagagcatgggttccccaggctgttgaagcaatggtcgctcagagcgatgttttggtaggagggatacgagccctggagttgttcccggatttccaaggagagtcataccgggtcactggaaatctggcggaaactcggcaaaccttgcagaaagtattgcagcagggcaaaaaagccagtgtcctggtttccggtgatccaggtttttatagtctgcttccttggctgaaaagggagtttcctcaagaagaaattcaagtattgccgggcctcagctccattcagctggcctttgcccgggcagggataccctggcaggatgcagagctgcttagtgtccatggccgtccgctgaactgcttgcctttacatctcagccggccagtgggagttcttactggcggtgaaaactcaccccggaagatcgctgagtattatcacacctatggctgcaatccgcggatttcacttggcaacgccttaacctatgcggaagagcgttggctgaatacagatgctgatcagctcatgaattcagaagaagatttcgccaatgcggtgatgatcctctatccggaagaagcggagcataagccggaacaatctgtcctctccctgcccaggagctttggcatcaaggatgaggagtttatacgcggtgatgtccccatgaccaagacggagattcgcgttcaagttctggctaaggcgggaattatccccgcgagccgagtcttggatgtgggagccgggacgggaagtataagcattgaagctgctcttctggctcatcgcggctgcgtttatgcggtggaggaaaatccggaggcacaagagctgatcctgaagaatcaggagaaattccgggtaagcaacctgcgcttgattcgtggctccgcaccgctggctctgcaggaaatccctcctgtggatgtctgcattattggcggaagccatggacagattcgggagattttacaccaggcccctctggtacctgggggacgggcagtggtgactgccgtaactttagagacattggctcatggtatggaggccctgaaaagcttgcaatacgaagatgttgatgtggtttcgatccaagctgtgcgctggaagggcattaaggatattcatcttgcccaggcccaaaatcctgtatttatactctcaggaaggaaaggaagctaa

SEQ ID NO: 8978 - protein, 407 aa, Desulfitobacterium hafniense Y51
MIQIVGIGPGTRAWVPQAVEAMVAQSDVLVGGIRALELFPDFQGESYRVTGNLAETRQTLQKVLQQGKKASVLVSGDPGFYSLLPWLKREFPQEEIQVLPGLSSIQLAFARAGIPWQDAELLSVHGRPLNCLPLHLSRPVGVLTGGENSPRKIAEYYHTYGCNPRISLGNALTYAEERWLNTDADQLMNSEEDFANAVMILYPEEAEHKPEQSVLSLPRSFGIKDEEFIRGDVPMTKTEIRVQVLAKAGIIPASRVLDVGAGTGSISIEAALLAHRGCVYAVEENPEAQELILKNQEKFRVSNLRLIRGSAPLALQEIPPVDVCIIGGSHGQIREILHQAPLVPGGRAVVTAVTLETLAHGMEALKSLQYEDVDVVSIQAVRWKGIKDIHLAQAQNPVFILSGRKGS

SEQ ID NO: 8979 - DNA, 1398 bp, Burkholderia xenovorans LB400
  CDS (1)..(1398): transl_table=11
atgccggcctggctgacggtggtgggcattggcgacgacggcttcgccggtttggggcgtgccgcgcggcgtgctttgctggaagcgtcggtggtctacggcggcgaacgccatctggccatgttgcccgcgcggctcgccgcgcgccgtgccgcgtggccgcgtccgttcgatcttgcgcctttgctggccgagcgcagcggcgcggtgtgcgtgctggcgagcggcgacccgatgctgttcggcgtgggcgcgacgctcgcgcggcagttgccggcgggcgagttgcgggtgctgcccgcgccgtcgtcgttgtcgctggcggccgcgcgcctcggctggccgttgcaggacgtcgcgacggtgtcgctggtgggccgcccgttgcccacgctgaacgcgcatctgcacgacggcgcgcgcgtcttcgtgctgagcgcggacgggcgcacgcccgcggcgctcgcggaattgctgaacgcacgcggattcggggcgacccgcatgagcgtgctggaacatctgggcggcgagttggagcggcgcatcgacggccgcgcggatcagtggtccgggggtgaggtggccgcgctgaatctggtcgcgctcgattgccgcgccaccgaaggcgcgccacgtctgccgctgacctgcggtttgcccgacgacgcgtttcgccacgacggccagctgaccaaacgcgatgtgcgcgccatcacgctcgcgcgcctcgcgccggcgcccggcgaactgctgtgggacgtgggcgcgggcagcggctcgatcggcatcgaatggatgcgcgcgcatccaacctgccgtgcgatcgctattgaaggacatgccgagcgtcagcgtttcatcgaacacaatcgcgatgcgttgggtgtgccgggcctgcaactcgtcgcgggccgcgcgccggctgcgctgcgggggttgccggtgccggatgccgtgttcatcggcggcggcgcgacggtgccgggcgtgctggaggcgtgctgggcgagtctgcgcgaaggcgggcgactggttgccaacgcggtcacgctgcagggcgaagcggcgctggccgcatggcgcgaacggcacggcggtacgttgacgcggatcgcgctcgccgatgcacaaccgctcggcggtttcgacacgtggcggcaggcgttgccgatcacgctgctggatgtgacgaagccggccggcgggggtgccatgaacgccgctaacatcattgacacgatcgacggcacgaacagcgtgagcagcacgaaccccgcgaacgccacgaacgccaccaacgccaccaacgccaccaacgccacgagtgtcaggaatcccgcgaacgccgccagtgtcacgaaccccgccgttgccgactcacagcacgaaccctga

SEQ ID NO: 8980 - protein, 465 aa, Burkholderia xenovorans LB400
MPAWLTVVGIGDDGFAGLGRAARRALLEASVVYGGERHLAMLPARLAARRAAWPRPFDLAPLLAERSGAVCVLASGDPMLFGVGATLARQLPAGELRVLPAPSSLSLAAARLGWPLQDVATVSLVGRPLPTLNAHLHDGARVFVLSADGRTPAALAELLNARGFGATRMSVLEHLGGELERRIDGRADQWSGGEVAALNLVALDCRATEGAPRLPLTCGLPDDAFRHDGQLTKRDVRAITLARLAPAPGELLWDVGAGSGSIGIEWMRAHPTCRAIAIEGHAERQRFIEHNRDALGVPGLQLVAGRAPAALRGLPVPDAVFIGGGATVPGVLEACWASLREGGRLVANAVTLQGEAALAAWRERHGGTLTRIALADAQPLGGFDTWRQALPITLLDVTKPAGGGAMNAANIIDTIDGTNSVSSTNPANATNATNATNATNATSVRNPANAASVTNPAVADSQHEP

SEQ ID NO: 8981 - DNA, 1212 bp, Rubrobacter xylanophilus DSM 9941
  CDS (1)..(1212): transl_table=11
atggaggggatgaggaggatctcggttataggcctcgacgggaggcccctccccccggaggcgagggagcttctggcgggggccgcgctggtggcgggggggcggcggcacctgagggagctcggcctggagggggggcgctcggtggcgctggagggcgacctctccggggcgctcgagcggatctcggccgagcgcggccccgtggcggtgctggcctccggggacccggggttcttcgggatcgtgcggctcctggccgggcgcttcgggcgggaggcgctcagggtgctgcccgccgcctcctccgccgcgcgcgccttcgcccgggcctcgctcccctgggacgacgccctggtggtgagcgcccacggccgcgacccccgccgggcggtgaacgcctgccgggcccaccccaaggtggcggtcctcacctccccgggcttcggcccggcggagctggcccgggagctcgcggggtgggggagggagctgttcgtggccgagcggctcggggagcccgacgagcgctgcttctccgggggcccggaggaggtcgccgggcggcgctggcgcgagcccaacgtggtgctctccctgcgggaggggcgcgcggtgggggcgaagggctgggcctcctgcgggcttgggagcccggggcggtgggcgctgccggagggggagttcgagcaccgctccggcatgatctccgggcccgagacccgcgccctcgccctcgcccgcctcggccccggccccggggacctggtctgggacgtgggggccgggagcggctcggtcgccatcgagtgcgcccggctgggggccgccgcggcggccgtggagcgcgaccccgagagctgcgggcgcatccggcgcaacgcggagcgccacggcgtgtgcgtccgggtggtggagggggaggcgccggaggcgctgcgcggcctccccgacccggacgcggtcttcgtgggcggctcgggtggtggccttagggagatcctgcgcctgtgcgccgcccgcgcccgccgctgcgtggtggccagcctcgtggggctggagcgggtggtcccggcggcggagctgctcgagggctgcgggctggaggtggaggcggtcatgctgcaggcctcgcgggtgaagggggtggggaggctgcaccggctggccccggagaacccggtcttcctggtctcgggggcgaggccgtga

SEQ ID NO: 8982 - protein, 403 aa, Rubrobacter xylanophilus DSM 9941
MEGMRRISVIGLDGRPLPPEARELLAGAALVAGGRRHLRELGLEGGRSVALEGDLSGALERISAERGPVAVLASGDPGFFGIVRLLAGRFGREALRVLPAASSAARAFARASLPWDDALVVSAHGRDPRRAVNACRAHPKVAVLTSPGFGPAELARELAGWGRELFVAERLGEPDERCFSGGPEEVAGRRWREPNVVLSLREGRAVGAKGWASCGLGSPGRWALPEGEFEHRSGMISGPETRALALARLGPGPGDLVWDVGAGSGSVAIECARLGAAAAAVERDPESCGRIRRNAERHGVCVRVVEGEAPEALRGLPDPDAVFVGGSGGGLREILRLCAARARRCVVASLVGLERVVPAAELLEGCGLEVEAVMLQASRVKGVGRLHRLAPENPVFLVSGARP

SEQ ID NO: 8983 - DNA, 1236 bp, Rhodococcus sp. RHA1
  CDS (1)..(1236): transl_table=11
atgaccgacccgatcgtcgtcgtcgggatcggggccgacgggtgggacggtctgtcgccgtccgcgcgacgcgcggtcgagcacgccgacgtggtgatgggctcggggcgtcagctcggcctgctcccggagtcgccggcactgcgagtggcctggccgtcgccgctcgttcccgcgctgccgggcctgttcgaacaacaccacgaccggcgggtgtgcgtcctggccagcggagacccgatgttccacggcatcggcgtcaccctcgtcgacctgctcggcgcggatcgggtgcgggtgatcccgcacccgtcctcggccaccctggcgtgcgcccggctgggctgggcggcgcacgagacgcccgtggtcagtctggtgaaccggcacgtggacttgctcctgcctgcactcggcgatcacacgcgactgctcgtgctgagccgcgacgaacacacccccgccgccgtggccgaactcctgacggaacacgggttcgggccgtcgcggctcagtgtgctcggcgaactgggcgggcccgacgagtcgaggctcgacggaacggcgtcggcatggtcgcacgaaccgggggcccggctgaacgtgatcgcgatcgactgccgggccgactccggcaccctccggttgacccggatgcccggactgcccgacatcgcgttcacgggcgacgggcagatgaccaaacacgagatccgtgccctgacgctgtgcgccctcgccccggcggcgggggagttgctgtgggacgtgggaggcgggtccggcacggtcgcgatcgaatggatgcgtacccaccccctctgtcgggccgtgactttcgagcgcagcgcggcacgcgtcgaccagatcgagtcgaacgcggccgcgctcggggtgccgtccctcgccgtgttcggcgacgcgcccgcagcgttcgaggacgtaccacccgaactgtccacaccggacgcgatcttcgtcggcggtggcgtcacgcaggacggcctgctcgacgagtgctggtcgcggctccgggtcggcggccggatggtggtcaacgcggtgacggcggaatcggaagcgcttctgctgcagtggttctcgaattgcggcgggcagctccgcaagttccaggtgtatcgcggtgagccactcggcgggttcaccgcgtggcggccgcaactgccggtggcgcagtggtcggtgacgaagcagtcgaaaggtgatgcggcatga

SEQ ID NO: 8984 - protein, 411 aa, Rhodococcus sp. RHA1
MTDPIVVVGIGADGWDGLSPSARRAVEHADVVMGSGRQLGLLPESPALRVAWPSPLVPALPGLFEQHHDRRVCVLASGDPMFHGIGVTLVDLLGADRVRVIPHPSSATLACARLGWAAHETPVVSLVNRHVDLLLPALGDHTRLLVLSRDEHTPAAVAELLTEHGFGPSRLSVLGELGGPDESRLDGTASAWSHEPGARLNVIAIDCRADSGTLRLTRMPGLPDIAFTGDGQMTKHEIRALTLCALAPAAGELLWDVGGGSGTVAIEWMRTHPLCRAVTFERSAARVDQIESNAAALGVPSLAVFGDAPAAFEDVPPELSTPDAIFVGGGVTQDGLLDECWSRLRVGGRMVVNAVTAESEALLLQWFSNCGGQLRKFQVYRGEPLGGFTAWRPQLPVAQWSVTKQSKGDAA

SEQ ID NO: 8985 - DNA, 1314 bp, Trichodesmium erythraeum IMS101
  CDS (1)..(1314): transl_table=11
gtgaaaaaactagctccagaactcagggaaaagcagggaaaaaacataattattgtgactataaatgttattggtataggtttagatggagtagttggactaaatcagttagtacgagaaattgttaaaagagcgactttgttggtaggaagcgatcgccatctcagttatttttctgataataacgctgaaagtattgtaattaaagatctacttgaggcaattttagaaatacgacagcatttagagactcctaatagttgtatagtggttttagcttcaggagatcccctattttttggtttagggaggttattagtagcacattttcctgcagaaaaattaaggttttacccccatctgagttcggtacaattagcttttagccggatcaaagttccttggcaagatactaaaataattagtgttcatggtcgtcctatggatgagctgattaaagcattacagcaaggagctgagaaggttgctgtactcacagacccgaccaatacaccacaagcgatcgctaatttgctactatctttacatctgccagctacatatcaattttgggtatgtgaaaatcttggtgctgaggatgaacgagtccaacaatggtctatagatgaaatacaaaaagaaacatttgcaccattgaatttggtggtattgttgcgtaaagctagaatggctaatcaacctgtagatttagttgatttacctcttttggggataccagataattattttttaagttatgatgaccatccaggcttgatgagtaagcgggaagtccgggtgttaattttagctgagttgagtttgcaaccaggacaaataatatgggatattggtgctggtaccggttctgttgcagtggaaattgctcgcctttgcagtagttctatagtatatgcaattgaaaaaactgctataggaacaagtttaattgaagaaaattgtcgtcgctttcaactaaaaaatgtcgtttctcttcatggtaatgctccggaaattttgcatcatctacgtcctccccacagagtttttatagggggtagtagtggtaaactcagaaatattctgggagtttgtggaattagaatgttgcctgaaggggtaatagttttagcatttacaactttggaaaatttgcatactgctataagttgggtagaagagagaagaaggagcgatcgctcttggagttatcgtcttttgcaagtgcagttatctcgttctatacctgtagctaatttaactcgatttaatcctcttaatcctgtcacaattatgatcgttaaacgggattaa

SEQ ID NO: 8986 - protein, 437 aa, Trichodesmium erythraeum IMS101
MKKLAPELREKQGKNIIIVTINVIGIGLDGVVGLNQLVREIVKRATLLVGSDRHLSYFSDNNAESIVIKDLLEAILEIRQHLETPNSCIVVLASGDPLFFGLGRLLVAHFPAEKLRFYPHLSSVQLAFSRIKVPWQDTKIISVHGRPMDELIKALQQGAEKVAVLTDPTNTPQAIANLLLSLHLPATYQFWVCENLGAEDERVQQWSIDEIQKETFAPLNLVVLLRKARMANQPVDLVDLPLLGIPDNYFLSYDDHPGLMSKREVRVLILAELSLQPGQIIWDIGAGTGSVAVEIARLCSSSIVYAIEKTAIGTSLIEENCRRFQLKNVVSLHGNAPEILHHLRPPHRVFIGGSSGKLRNILGVCGIRMLPEGVIVLAFTTLENLHTAISWVEERRRSDRSWSYRLLQVQLSRSIPVANLTRFNPLNPVTIMIVKRD

SEQ ID NO: 8987 - DNA, 1266 bp, Synechococcus sp. CC9311
  CDS (1)..(1266): transl_table=11
atgatcgatgtgatcggcaccgacgccggtgctcccggctcgctcccacccggagctcagctcttggtggagcaggcccacctgttggcagccccaaaacggttgctacctgcactgcagcaatggtctgcgtgcccagcagacctgcgttgcatcgccagtgataatccaatcgctctgagcgaggagttgcttgcccttgggagcgatcagcgcgcggtggtgctggccagcggtgatccgttgtggttcggcatcggccggatcttgatcgagcgcctgggacgcgaacgcctgcgctttcatccaggcccctcctcgttgcaactggcatttgcccgactgggcaggccatggcaggacgcccaatggatcagcttgcatggccgcgatcctgctcccctggctcagcgattgcagcaacgcccaagcgccttggccgtgctcaccgatcccagtcgcggtggcgtagacgaggtccgccaaagcttgcacagcagcgggctggaatcggcctatgccctctggctatgcgaatcgctaggccacagcagtgagcgggtgcaaaagctcgacccatcccaagcaacgcctagcgatttgcacccactccatctggtggtgttgctcgcggaagctcaagcgactccaccagccgatcaacttccactctttggcctggaggatggtgtgtttcttcaacacgccgaccgacctggcttgatgaccaaacgggaggtgaggatccaattgctcgctgagctcaaccttcctgcacatggcgtgctctgggatctgggtgctggcactggcagcgttggcctcgaagcgctgcggctgcggcctcaattgcgcttgctttgcattgaacagcgcagcggcgggtcctcactgatcaccgcgaatgcagcacgcctcggcgttcaacccgccgcggtgatggaaggcgatgcgatggaagaactcaacaatgtgcctgcagtcttagcggctcccgatcgcgtgctcattggtggcggtggccgcaaacgtcgatccctgctggagcacgtgatccagtgcatggcccccaagggtgaagtggtgatccccctggccaccctggaagccatggcggagctgcgtcccgtgctcgaagctgccaagtactccgtgaaagtcagtcagcagcaagcctggcgaggccaaccccttgccgatggcacgcggcttgctcccatgaatccggtgttgatcctcaagggaagcgctcccccacaggactga

SEQ ID NO: 8988 - protein, 421 aa, Synechococcus sp. CC9311
MIDVIGTDAGAPGSLPPGAQLLVEQAHLLAAPKRLLPALQQWSACPADLRCIASDNPIALSEELLALGSDQRAVVLASGDPLWFGIGRILIERLGRERLRFHPGPSSLQLAFARLGRPWQDAQWISLHGRDPAPLAQRLQQRPSALAVLTDPSRGGVDEVRQSLHSSGLESAYALWLCESLGHSSERVQKLDPSQATPSDLHPLHLVVLLAEAQATPPADQLPLFGLEDGVFLQHADRPGLMTKREVRIQLLAELNLPAHGVLWDLGAGTGSVGLEALRLRPQLRLLCIEQRSGGSSLITANAARLGVQPAAVMEGDAMEELNNVPAVLAAPDRVLIGGGGRKRRSLLEHVIQCMAPKGEVVIPLATLEAMAELRPVLEAAKYSVKVSQQQAWRGQPLADGTRLAPMNPVLILKGSAPPQD

SEQ ID NO: 8989 - DNA, 1233 bp, Rhizobium leguminosarum bv. viciae 3841
  CDS (1)..(1233): transl_table=11
atgtctgatgtcgctcctgcgtccggtcagcgctggctgactattatcggcatcggcgaagatggtccagaagggttgggcgaggaggcgaaaaggctgatcgcgaccgcacccgccgtcttcggcggcgtgcggcaccacgcgcttgctgcctcgctgatcacaggcgaaaagctttcctggcagagcccgttcgagcgctcggtcgaggctatcctagaaaggcgtggcacgcctgtcgtcgtgctcgcctctggcgatcccttcctctatggcgtcggcgcaacgctctcccgccatgtggcggcggaagagatgtgcaccatccccgcgccctcggccttcagccttgccgcgtcccgccttggctggccgctgcaggaggtcgcgacgatctcgctgcatggaagaccgatcgacctgatccggccgcatctgcatcccggacggcgcatcatcgcgctgacctcggatgagaaggggtctggcgatctggctgcgctgctgactgctgctggcttcggtcagtcgcaacttacggtgctcgaggcgcttggcggcgctcgggaacgacagagaagcgtcctggcggcggatttcgacctgctggacatcgatcccctgaatgtctgcgcactcgaaatcgcggcaggggagggggcacgcattctgccgtttaccgccgggctcgaggacgagttgttcgagcatgatgggcagatcaccaaacgtgaaatccgggcgatgacgctttcggcgctcgcgccgcgtcacggcgaactgctctgggatatcggcgccggctcgggatcgatcggcatcgaatggatgttggccgatcccagcctcaaggcaatcgccctcgaacagtcgccggagcgggccgcacgtgttgctcgcaatgcatccgccttcggcgtgccgcatctcgccgtcgtcgaaggtgcggcacccctcgcactgaagggcctgccggagccggatgtgatcttcctcggcggtggcggcagcgagccgggtgttatcgatactgcgattgccgcgctgaagcggggagggcggctcgttgccaatgccgtgacgctggaaatggaagcggtgctgctcgccgaacatgcaaaacgcggcggtttcctcacgcggatcgaaatatcgcgtgcccagcctgtgggcggcatgagcggctggcggccggcaatgccggtaacgcagtggcgctggacgaaaggatga

SEQ ID NO: 8990 - protein, 410 aa, Rhizobium leguminosarum bv. viciae 3841
MSDVAPASGQRWLTIIGIGEDGPEGLGEEAKRLIATAPAVFGGVRHHALAASLITGEKLSWQSPFERSVEAILERRGTPVVVLASGDPFLYGVGATLSRHVAAEEMCTIPAPSAFSLAASRLGWPLQEVATISLHGRPIDLIRPHLHPGRRIIALTSDEKGSGDLAALLTAAGFGQSQLTVLEALGGARERQRSVLAADFDLLDIDPLNVCALEIAAGEGARILPFTAGLEDELFEHDGQITKREIRAMTLSALAPRHGELLWDIGAGSGSIGIEWMLADPSLKAIALEQSPERAARVARNASAFGVPHLAVVEGAAPLALKGLPEPDVIFLGGGGSEPGVIDTAIAALKRGGRLVANAVTLEMEAVLLAEHAKRGGFLTRIEISRAQPVGGMSGWRPAMPVTQWRWTKG

SEQ ID NO: 8991 - DNA, 1248 bp, Pseudomonas aeruginosa UCBPP-PA14
  CDS (1)..(1248): transl_table=11
gtgtcatcggcagactcgacgccgccctggctgaccctggtgggcatcggcgaggacggttatcccggcctcggcaagcaggcccggcgtgccctgctgcaagccagccggatcgtcggcgcggcgcgccagctggaactgctgccgccgtgcatcggcgccgcccgcgaaacctggccgacgccgttctccctggaaccattgctggcccggcgcggccagccgacctgcgtgctggccagcggcgacccgatgctgttcggcgtcggcgccagtctcgcccggcaactgccggcgaccgaactgcgagtcctgccggcgccctcctccctctcgctggccgccgcccgcctcggctgggccctccaggaggtcgcctgcctgtcgctggtggcgcgtccgctggcggcgctgcaggcacaggtccacgacggccggcgcctgctggtcctcagcaatgacggcgacagcccggccgccatcgcccgcctgttgagcgcccgtggcttcggcgccagtcgcctgagcgtgctggaacacctcggcgggccgctcgagcgccgtctcgacggcctcgccggcgactggtcgctgccacgcgccgccgatctcaacctggtggcggtggaatgccgcgccggcgccggcgccgtgcgcctgccgctgaccccgggcctggccgacgaggcctatcgccacgacggccagttgaccaagcgcgacgtccgcgccgtgaccctggcgcgcctggcgccctgccccggcgagctgctctgggacgtcggcgccggctgcggctccatcggcatcgaatggatgcgcgcgcaccccagttgccgggcgatcgccatcgaagccaacgacgagcgccaggaacatatccgccacaaccgcgacgccctcggcgtaccgtccctgcacctggtcgccggcagcgccccggaggcgctgctggaactgcccgagccggacgccatcttcatcggcggcggggtcaccgccgagggcgtgctggaaacctgctgggagcgcctgcggcccggcggccgcctgctcgccaacgcggtcaccctgcagagcgaacgggtgctgctcgactggcagcaacgcctggggggcgacctcacccgcctcggcgtcgcccacgcgcgaccgctgggcggtttcgacacctggcgccaggccttgccgatcaccctgctggaattgcgcaaacccgccgccaggaagcctccccgcgatgcgtga

SEQ ID NO: 8992 - protein, 415 aa, Pseudomonas aeruginosa UCBPP-PA14
MSSADSTPPWLTLVGIGEDGYPGLGKQARRALLQASRIVGAARQLELLPPCIGAARETWPTPFSLEPLLARRGQPTCVLASGDPMLFGVGASLARQLPATELRVLPAPSSLSLAAARLGWALQEVACLSLVARPLAALQAQVHDGRRLLVLSNDGDSPAAIARLLSARGFGASRLSVLEHLGGPLERRLDGLAGDWSLPRAADLNLVAVECRAGAGAVRLPLTPGLADEAYRHDGQLTKRDVRAVTLARLAPCPGELLWDVGAGCGSIGIEWMRAHPSCRAIAIEANDERQEHIRHNRDALGVPSLHLVAGSAPEALLELPEPDAIFIGGGVTAEGVLETCWERLRPGGRLLANAVTLQSERVLLDWQQRLGGDLTRLGVAHARPLGGFDTWRQALPITLLELRKPAARKPPRDA

SEQ ID NO: 8993 - DNA, 1272 bp, Magnetococcus sp. MC-1
  CDS (1)..(1272): transl_table=11
atggctgagccctgccatatcatcggcgtattggataatggccccgaggggttgcatgggcagagcgtgggattaatgcgccgggctcaggtggtgattggggtgccgcgtaccttcgccctgtttgaggatctgttgccggaagaggcgcagcgcctggatctgaccggccatttggataaagtgccccagtgggtgcaacgcggcttgcaagcggaagagacggtgttggtgctggcgacgggggatcccctgtgccatggcattggcagttatctggtgaaaaaattgggcctggatgcctgccagatccaccccaacacctcggtgatgcagtgggccttcgcccgtttggggctgccttggcaaaaggcgcaaattttatcggcccacaccgccgattgtggcgcttggcagccggggctggggccggaacaccccctgaccggggtgatgcagagcatccagcagcagcccctattgggtatctttaccagcccggagaatgatcctgcccgcatcgcgcaggcgatccaagcggcgggtatgggggagcatgtgctcttgcatgtggcccagcagttgttgctggatgatgagcgggtggagcgggatcttagcccggctaccgtggccgcaggccactatgcccagcccaatgtgatgattgtcgagaataccgccccccagcggctgcccctgtttgggttggaggatgccagctaccagcagcgtaagcccgataaggggctgattaccaaaaaagaggtgcgggtggtgacgctggcgcagctgcgtctgcatcgtgagagcatcgtgtgggatattggggcgggttcaggctccattgggttagaggccgcccgcatggccggccatgtctatgccatagagaaaaatgggccagatcgtgagattatggaggccaaccggcagcagatgggctgtttaaactacagcgcctatctgggcgaagcccctgcggggctggagaactggccggacccggatgcggtggtgattgggggctctggcggccatttggccccgctgctggcgttggtggcccagcgtctgttgcccgaggggcgcttggtgatgaactttgttaccctggagaatctaaccacggcccttgaccagttacaacggctgggtatggtgtgggagctgatccagatgcagatttcccgcagtcagcctattttagagatgcaccgtatgcaggcagaaaacccggtgtggatccttaccgccagacatggaacctga

SEQ ID NO: 8994 - protein, 423 aa, Magnetococcus sp. MC-1
MAEPCHIIGVLDNGPEGLHGQSVGLMRRAQVVIGVPRTFALFEDLLPEEAQRLDLTGHLDKVPQWVQRGLQAEETVLVLATGDPLCHGIGSYLVKKLGLDACQIHPNTSVMQWAFARLGLPWQKAQILSAHTADCGAWQPGLGPEHPLTGVMQSIQQQPLLGIFTSPENDPARIAQAIQAAGMGEHVLLHVAQQLLLDDERVERDLSPATVAAGHYAQPNVMIVENTAPQRLPLFGLEDASYQQRKPDKGLITKKEVRVVTLAQLRLHRESIVWDIGAGSGSIGLEAARMAGHVYAIEKNGPDREIMEANRQQMGCLNYSAYLGEAPAGLENWPDPDAVVIGGSGGHLAPLLALVAQRLLPEGRLVMNFVTLENLTTALDQLQRLGMVWELIQMQISRSQPILEMHRMQAENPVWILTARHGT

SEQ ID NO: 8995 - DNA, 1197 bp, Nocardioides sp. JS614
  CDS (1)..(1197): transl_table=11
gtgatcatagtcgtgggtatcggcgccgacggctgggacgggctcccggggccggtccgggagcaggtcgagagggctgcggtcgtgctcgggggacgccgccaggtcgacctcgtgccggccatcgagggtcagcggcgcgagacctggccctcgccgctgcgcagggggctggctgcgctcctcgccacgctcgaggggcaggacgtcgtcgccctcgcgtcgggtgacccgctcgtctccggcatcgcgacgacgttgatcgacgccgtcggcgcggatcaggtcagggtcatccccgccgtgtcctcggtcgcactcgcacgcgcggcgatgggctggcccgccgagtcgcacgccaccgtcagcgtcgtgggtcgcgacgtctcgctcgtacgccgcgagctcgcgccgggtcgccggatcctcgtgctctcctccgacgagaccactcccgacgcggtcgccgatctcctgtgccgggacgggtacggcgactcgatcgtgaccgttctcggcgacctcggctcgcccgacgagacgagcagcgcctcggcggcgaccgagcggcgagggccgtactcgcgactcaacatcgtggcgatcgaagcgaccggcccggcggcctacgcctcgtggaccgcgggcctgcccgatgactccttcgagcacgacgggcagctgacgaagcgtgacctgcgcgcctccgcgctggcccgtctggcccccgtgcccggcgagcacctgtgggacgtcggtgcaggagccggctcgatcgggatcgaatggatgcgggcccaccccacctgcacggccacggcagtcgaggcagaccccgagcgcactgagcggatcggacgcaacgccgccagactcggcgtgcccgggctcgaggtcgtcgaaggccgcgctcccgaagtgctggccgcactgcccacaccggacgcgatcttcgtcggcggcggcgcgacgcgacccggcgtcatcgagacctgcctcgacgcgctcggtgcacagggtcggatcgtcgtccacggcgtcaccctggagaccgagcaggtgctcgctcggctctacgaggagcagggtggcgagctgacccggatctccgtcgagtcggccggcccggtcgggaccttcaccggttggacgcccgcacgtgccgtcacccagtgggcgtacgcgaagggctcgtga

SEQ ID NO: 8996 - protein, 398 aa, Nocardioides sp. JS614
MIIVVGIGADGWDGLPGPVREQVERAAVVLGGRRQVDLVPAIEGQRRETWPSPLRRGLAALLATLEGQDVVALASGDPLVSGIATTLIDAVGADQVRVIPAVSSVALARAAMGWPAESHATVSVVGRDVSLVRRELAPGRRILVLSSDETTPDAVADLLCRDGYGDSIVTVLGDLGSPDETSSASAATERRGPYSRLNIVAIEATGPAAYASWTAGLPDDSFEHDGQLTKRDLRASALARLAPVPGEHLWDVGAGAGSIGIEWMRAHPTCTATAVEADPERTERIGRNAARLGVPGLEVVEGRAPEVLAALPTPDAIFVGGGATRPGVIETCLDALGAQGRIVVHGVTLETEQVLARLYEEQGGELTRISVESAGPVGTFTGWTPARAVTQWAYAKGS

SEQ ID NO: 8997 - DNA, 1311 bp, Azoarcus sp. BH72
  CDS (1)..(1311): transl_table=11
atgcagactgacaccctccacatcatcggcatcctcgacgacggctgggccggcctcaccgacgccgcccgccaacgccttgccggctgcggcctggtgatcggcgccgcgcgcacgctggcgcgggtcgcgcccttcctgcccgaaaccaccgtgctgcgcgagatggacggcgcgctatcgaaggtgcccggctgggtgcgcgacgcccaggcggacggcctcgccgtcgcggtgctcgccaccggtgacccgctctgccacggcatcgccggcttcctgatcggcaagctcggggcggcgaacgtcgcagtacatccggcgccatcgacgatgcagctcgcctgcgcgcggctgaaaaagccgtggcaggacatcgcgattgcctcctgccacagcgccgacgccggcgagtggacgcccggcgccccgccggaccacggcctctacaagctggtgcgcgcggtggcggaacacccccgcgtcgccgccttcaccggccccgacaacagccccgaccgcatcgcccgcgcgctgctcgccgccggttacggcgaggacgtgcgcctctcggtcgccgcccgcctgtgtctggccgacgaggcggtgttcgccgatctcccgctcgcggacgcggccgcgatgcgctttcccgatcccaatatcctcgtcattgaacgcacgccggccgagcgccgcgcgctgttcggtttcgacgacggcgactacgtccagcgtcagccggagaaaggcctgatcaccaagctggaagcgcgcgcggtgtcgctcgccaagctcgggctcgccgccgacagcatcgtctgggacatcggcgccggctccggctcggtcgggctggaagccagccgcatcgcccgccacggccacgtgtgggcgatcgagaagaacgccgccgatgccgccaacgcgctcgaaaacgcccgccgcctgcgcgccagcaactacaccctgattcaggccaaggcaccggacgggctggacgcctggcccgaccccgatgccatcttcatcggcggctccggcggcgagctggccgaactcatcctgctggcgctggcgcggctgcgcccgggcgggcggctggtgatgaacttcgtcaccctcgaaaacctgaccaccgcaaccacggtgctggcagtggcgggcgccgcctgggacgtgaccatgctgtcggccgcgcgcagccagcccatcctcgacatgcaccgcctcgccgcgcagaacccggtgtggatcgtctgcgcgcgcaaggctgcactccaagcggaaatccctcgcgatgaaaattga

SEQ ID NO: 8998 - protein, 436 aa, Azoarcus sp. BH72
MQTDTLHIIGILDDGWAGLTDAARQRLAGCGLVIGAARTLARVAPFLPETTVLREMDGALSKVPGWVRDAQADGLAVAVLATGDPLCHGIAGFLIGKLGAANVAVHPAPSTMQLACARLKKPWQDIAIASCHSADAGEWTPGAPPDHGLYKLVRAVAEHPRVAAFTGPDNSPDRIARALLAAGYGEDVRLSVAARLCLADEAVFADLPLADAAAMRFPDPNILVIERTPAERRALFGFDDGDYVQRQPEKGLITKLEARAVSLAKLGLAADSIVWDIGAGSGSVGLEASRIARHGHVWAIEKNAADAANALENARRLRASNYTLIQAKAPDGLDAWPDPDAIFIGGSGGELAELILLALARLRPGGRLVMNFVTLENLTTATTVLAVAGAAWDVTMLSAARSQPILDMHRLAAQNPVWIVCARKAALQAEIPRDEN

SEQ ID NO: 8999 - DNA, 1173 bp, Mycobacterium sp. KMS
  CDS (1)..(1173): transl_table=11
gtggtggtcgggatcggcgccgacgggatggccgggctcgcccgggcgtctgctgacgaattacgccgggcgacaacagtttacgggtcgcgacgccaactcgacctgctcgacgacaccgtgaccgccgaacgccacgaatggccgtcgccgctgatgcccgcgctgcaggccatccgcgacgacccggcgggtgacgtccacatcgtggccagcggcgatccgatgctgtacggcatcggcggctcggcggtgcggatcttcggacccggccgcgtcaccgtcctaccgcatgtgtcgtcggtgacgctggcctgcgcccgcctcggctggccggtgcaggacaccgaggtcatcagcctggtcaccgccgcgccgcggaccgcggtacgccgtggcggccatgcggtcgtcctgtcccgcgacgagtcctcgcccgccgcgctggcccggttgttgaccgacaccgggcggggagagtcggagatgacgctgctcgagcaactcggcggaccggaagagcgcaggcgtaccggcacggcccggtcctggtcggccgacccgcccggggacgtggacgccctcaacgtcgtcgccgtccgctatctgcccgacgaccggcagttgcaggtgctgcccgacggggccttcgcccacgacgggcagatcaccaaacagtcgatgcgcgcggtcaccctggccgcgctggcaccgcgcccgggcgggttgttgtgggatgtgggcgccgggtcgggcagcatcggcatcgagtggtgccgcagcggaccgggatgccgggcgatcgcgttcgagcgggacgagacgcgccgggagcgcatcgcggccaacgcggacgcccacggtgtcgacgtcgaggtgcggggtgcggcgccggagtcgctcgacggggttccgcagccgtcggcggtgttcatcggcgggggtctgacccgtcccggcctgctcgacggctgtgtggatgcgctgccaccgggtggccggctggtcgccaacgccgtcaccgcggagtccgaagtcgttctcgtgcagtggtattcgaagatgggtggggagttgcgccgctaccagcactaccgtggtgagccggtcgggacgttcaccggctggcgccccgccatgccggtgacgcagtgggtggtggtcaaaccgtga

SEQ ID NO: 9000 - protein, 390 aa, Mycobacterium sp. KMS
MVVGIGADGMAGLARASADELRRATTVYGSRRQLDLLDDTVTAERHEWPSPLMPALQAIRDDPAGDVHIVASGDPMLYGIGGSAVRIFGPGRVTVLPHVSSVTLACARLGWPVQDTEVISLVTAAPRTAVRRGGHAVVLSRDESSPAALARLLTDTGRGESEMTLLEQLGGPEERRRTGTARSWSADPPGDVDALNVVAVRYLPDDRQLQVLPDGAFAHDGQITKQSMRAVTLAALAPRPGGLLWDVGAGSGSIGIEWCRSGPGCRAIAFERDETRRERIAANADAHGVDVEVRGAAPESLDGVPQPSAVFIGGGLTRPGLLDGCVDALPPGGRLVANAVTAESEVVLVQWYSKMGGELRRYQHYRGEPVGTFTGWRPAMPVTQWVVVKP

SEQ ID NO: 9001 - DNA, 1209 bp, Nostoc punctiforme PCC 73102
  CDS (1)..(1209): transl_table=11
atgacagagaaatggctttctatcgtgggcattggggaagatggattacaggggttaagtgctatcgctcgttctctagtcgatcgagctaaagtaattgtcggaggcgatcgccatttagcaatgctccctacagacgatcaacgtgaaaaaatagtctggacatcccccattagcatttctgtagacgaaatcattcagcgtcgcggtcagtcaatctgcgtactcgcaagcggcgatccgatgtgttacggcattggtgtcaccttaatgcggcgaattcccgtttctgaaatgacgattatccccgcaccttcagctttcagcctcgcctgtgccaggatgggatggtctttaactgaggtggaaaccttgagtttgaatggtcgtccatcctccctactccagtcttacatttacccaaaagcacggttgttgattttgagtggagggaaggacacacccgccattgttgcgaaaattttgacaaatcgcggctatggtggcagcgaaattaccgtcttggagcgtatgggcggtactcatgaaagaattgtggaaggtacggctgcatcttggagtgaaactgaagttgcggctttgaatgcgatcgcagtttattgtattgctgatgctggggttatcccattaccaagattaccagggctaccagataacgcttatcaccacgatggacagttaacgaagcgtgaggttagggcaatcaccctagcagctttagcacccacaccgggacaattgttgtgggatgttggcgcgggttgcggttcaatttctatcgaatggatgcggagtaatgctcgatgtcgagcgatcgcgatcgaacaaaattcttctagactactttatattgccgataatgccgccactctcggtactccaaatgtgcaaatcattgaaggtaaagcgccccatgcactgaaagatttgccagcaccagatgctatttttattggtggtggggtgacagcaacaggactttttgatgtttgctgggaagcactgcgtccgggtgggcgtttggtagcaaatgtggtgacggtagagggcgagcaaactttatttcaatggcatgaacgagtcggtggcgatttaactcgtgttgccattcaacggacggaacctattggtaaatttttgggctggcgggcaatggcacctgtaacgcaatgggtagttgtaaaataa

SEQ ID NO: 9002 - protein, 402 aa, Nostoc punctiforme PCC 73102
MTEKWLSIVGIGEDGLQGLSAIARSLVDRAKVIVGGDRHLAMLPTDDQREKIVWTSPISISVDEIIQRRGQSICVLASGDPMCYGIGVTLMRRIPVSEMTIIPAPSAFSLACARMGWSLTEVETLSLNGRPSSLLQSYIYPKARLLILSGGKDTPAIVAKILTNRGYGGSEITVLERMGGTHERIVEGTAASWSETEVAALNAIAVYCIADAGVIPLPRLPGLPDNAYHHDGQLTKREVRAITLAALAPTPGQLLWDVGAGCGSISIEWMRSNARCRAIAIEQNSSRLLYIADNAATLGTPNVQIIEGKAPHALKDLPAPDAIFIGGGVTATGLFDVCWEALRPGGRLVANVVTVEGEQTLFQWHERVGGDLTRVAIQRTEPIGKFLGWRAMAPVTQWVVVK

SEQ ID NO: 9003 - DNA, 1176 bp, Magnetospirillum magnetotacticum MS-1
  CDS (1)..(1176): transl_table=11
atgatcaccgtcatcggcattggcgaggacggtctggacgggctgtcgcccgccgcccggacattgctcgataccgccgaggtgctggtgggcggtgcccgccatctggccatggtcccgtccaatggggccgaacggctggaatgggcttcgcccttcgctgacagccgtgccctgttggaggcccgcacgactaaccgcgttgtcgtcctggccagcggcgagcccctgtggttcggtgccgccgccactctgataagctggttcggtgccgataaggtgagcgtggttccccatcccggcgccttctccctggcttgcgcccgtctgggctgggccatgcaggattgcctgttcctcaccattcacgggcggcccattgacgccctggccctgcatctggcgccggggcgccgcctgctgatcctggccgaggatcgcaccagtccggcccatgtggcggctttgctgcgttcccacggatatggcgccagcacgattacagtgctggagaatttgggcggagcgaaagagcgcatcaccgatcccgagggctgcgcctcggatctcaatgtcgtggcggtggagtgtcgtctggaccggggtgttcgccctctctccacggtgcccggcctgcccgacgaagccttcgagcatgatgggcagttgaccaagcgcgacatccgcgccgccaccctggccgcccttgcgccgttgcccggtcaggtgctgtgggacgtgggggcgggctgcggctccatcgccatcgagtggatgcgggcgggcggccgggccatcgccctggaaagccgcccggaacgcctggagcgcatcgcccgcaacgcggcgcgcctgggggttcccggacttgagatcatcgcgggccgtgttcccgataccctgccgctcgaccgcgagccccccgacgccatcttcgtgggcggcggcgtctccgaggccgggctgctggatatctgctggtcggcgctggggcgcggcgggcggctggtggccaatgctgtgaccctggaaggcgaggcggccctggtcgccctgttcggcctgcatggcggcgagatgacccggctgtcggtggcccatctcgaccgggtgggcggcttccacgcctggcatcccgccatgccggtgacccgttatgtggggtggaagaagtga

SEQ ID NO: 9004 - protein, 391 aa, Magnetospirillum magnetotacticum MS-1
MITVIGIGEDGLDGLSPAARTLLDTAEVLVGGARHLAMVPSNGAERLEWASPFADSRALLEARTTNRVVVLASGEPLWFGAAATLISWFGADKVSVVPHPGAFSLACARLGWAMQDCLFLTIHGRPIDALALHLAPGRRLLILAEDRTSPAHVAALLRSHGYGASTITVLENLGGAKERITDPEGCASDLNVVAVECRLDRGVRPLSTVPGLPDEAFEHDGQLTKRDIRAATLAALAPLPGQVLWDVGAGCGSIAIEWMRAGGRAIALESRPERLERIARNAARLGVPGLEIIAGRVPDTLPLDREPPDAIFVGGGVSEAGLLDICWSALGRGGRLVANAVTLEGEAALVALFGLHGGEMTRLSVAHLDRVGGFHAWHPAMPVTRYVGWKK

SEQ ID NO: 9005 - DNA, 1326 bp, Crocosphaera watsonii WH 8501
  CDS (1)..(1326): transl_table=11
atgttcaaacaattacaaaatctcaacaatatttctaatatttattctaataaatttatgattaaagttgtaggaattggtttaaatggaaaagaaagcttggcaacaaagactaagacaattgttgaacaagctactttattaatagggagcgatcgccatttaacttattttcctaatcattctggtaataaaatggttattaagaacttttttgaggatattaaaaaccttcaggaaatcaaaaataatcatgaatatattgttattttagtaagcggtgatcctctatttttcggtttaggaagattattattagaacagtttgatatagaagaattagaattttatccccatttgagttccatacaattgggttttagtagggttaagataccttggcatgatgctataattattagtggccacggtcgtcatttagatgaactaatttctagcttacggcagggtcaagaaaaaattgctattcttacagatagcaaaaataatccccaggcgatcgccgaacttttcttgagtttaaaaatccccattaattatgatatttgggtctgtgaaaatttaggagatatcgatgaaaaagttaattgttttaccccgcaaatattagcaagtcttactaattatcagttttctgccttaaatattgttattctcttgcgtaagaaggatcttaatttaagtcaaaaagagcttgaaaatttacctatttttggtgttgaagataattattttttaagttttaaagatcgtcctgggttgatgacaaaaaaagaagttagaatgattattttaggggaactgggtttaaaatcacaacaaattatctgggatattggtgcaggaactggctcagtttctattgaaattgctcgtttatgtcctaactctcagatttatgctattgaaaaaacagcaatgggtattaatttaattaataaaaacagtaagagatttaaagttaataatataacatcaattcaagcacaagctcctaataagttacaaacattacccaatcctaatagaatttttcttggagggagtgggggaaatttgattgatattttagatatttgtcaagataaattagcaaaaaatggcataattattattgctttagcaactatagaaaatttaggaatcagtttgaattggattaagaaaaatagctggaattatcaactattaaatattaatatatctggctctctttcggttggtaacttaacccgtttagctcctttaaatcctatattcttagttaagatttttaagaaaaataagaagattcctcgtacctag

SEQ ID NO: 9006 - protein, 441 aa, Crocosphaera watsonii WH 8501
MFKQLQNLNNISNIYSNKFMIKVVGIGLNGKESLATKTKTIVEQATLLIGSDRHLTYFPNHSGNKMVIKNFFEDIKNLQEIKNNHEYIVILVSGDPLFFGLGRLLLEQFDIEELEFYPHLSSIQLGFSRVKIPWHDAIIISGHGRHLDELISSLRQGQEKIAILTDSKNNPQAIAELFLSLKIPINYDIWVCENLGDIDEKVNCFTPQILASLTNYQFSALNIVILLRKKDLNLSQKELENLPIFGVEDNYFLSFKDRPGLMTKKEVRMIILGELGLKSQQIIWDIGAGTGSVSIEIARLCPNSQIYAIEKTAMGINLINKNSKRFKVNNITSIQAQAPNKLQTLPNPNRIFLGGSGGNLIDILDICQDKLAKNGIIIIALATIENLGISLNWIKKNSWNYQLLNINISGSLSVGNLTRLAPLNPIFLVKIFKKNKKIPRT

SEQ ID NO: 9007 - DNA, 1203 bp, Prosthecochloris aestuarii DSM 271
  CDS (1)..(1203): transl_table=11
atgtctgagaagtttcttgtgatcggcctcagtgacagccgttccccggttttcgatcctcaaaccctgcgagagatcgccgcatgcagggtgtttgccggaggtgagcggcatcgcgccatcgtcgggcatctgctgccgcacgccagccgatggattaccatcgcacctcctatgagtgacgtgatgcgacagctggatgaagccggaggccgggtcgtggtgtttgcctccggagatccgctcttttacggcttcggagcgaccctgcagaaacactttccggatgcatcctgccgttttgttccggcgttttcctcgctgcagacacttgcgcaccggcttcagctgccgtatcagtcaatgcgtttcgcctccctgaccgggaggagctggcaggaactcgatcgtctgctcatcgaaggagccggtcttatcggcgtgctgactgacaggcgcaaaacgcctgcagcgattgcgcgccgtcttctcgaatacggctacggggggtattcgctgctcgtcggcgaggctctcggggggcctgaagaacgggtgacggagctttcgccggcagacgcatcggacgcgctctttgacgatctcaactgcgtcattctccggggcggcccttcccgggagcgattctacggtattgccgattcgctgttcgaagggcttccgggccggccggatatgatcacgaagatgccgcttcgcctggcaacgctttcacgactcaacctggtgaactgttcgcacttctgggatatcggcttctgcaccggatcggtatccatcgaggcccggctgcagtttcccgggctggagatcagcgcatttgaaaagcgccccgaatgcgaagggatcttcgatcgcaatgccaggcggttcggggctccgggagttcgggtggtgatgggtgacgtgctgaagcaggagtttgacgaacataccgggccggacggcagggtaggagccgtgttcatcggcgggcacggggggcagctcgaggcgatcttcgatatcgcagccgagcggctttcgcccggcggacggattgtggtcaacgctgtcaggacagacaccctcgaacgctttcatgcgcgggcccggcaccatgcgcttcgcctgcccgatgaccttgtgatcactcccgggaggcataattcaataaccatcgctgccgcagtgcaggaataa

SEQ ID NO: 9008 - protein, 400 aa, Prosthecochloris aestuarii DSM 271
MSEKFLVIGLSDSRSPVFDPQTLREIAACRVFAGGERHRAIVGHLLPHASRWITIAPPMSDVMRQLDEAGGRVVVFASGDPLFYGFGATLQKHFPDASCRFVPAFSSLQTLAHRLQLPYQSMRFASLTGRSWQELDRLLIEGAGLIGVLTDRRKTPAAIARRLLEYGYGGYSLLVGEALGGPEERVTELSPADASDALFDDLNCVILRGGPSRERFYGIADSLFEGLPGRPDMITKMPLRLATLSRLNLVNCSHFWDIGFCTGSVSIEARLQFPGLEISAFEKRPECEGIFDRNARRFGAPGVRVVMGDVLKQEFDEHTGPDGRVGAVFIGGHGGQLEAIFDIAAERLSPGGRIVVNAVRTDTLERFHARARHHALRLPDDLVITPGRHNSITIAAAVQE

SEQ ID NO: 9009 - DNA, 1197 bp, Sulfitobacter sp. EE-36
  CDS (1)..(1197): transl_table=11
atggctgatcctgttgctgcctgggtgaccctgattggtctgggcgaagatggccttggcgggctgaccgatgcaagccgaaaggcgctggcagaggccgacgtgatctttggcggggcgcggcatctggcgctttgtgccgcgggcgcgcgggggcgcgaatggccgttgccgttcagtgtagcgccggtgttggaacatcgcgggcgtgcggttgtggtgctcgcctcgggtgatcctttctggcacggcgtgggcggttcgctggcgcaggtgctggacgcgtcggaatggcgctgctttcccgcgccgtcctgcatgacgctcgccgctgcgcggcttggctggcggttggaggaggtcacgacccttggcctgcatgctgccccgttcgaggtgttgctgccccatctggcggcaggtgcgcggctgatctgcacattgcgcgatggtgcggcccctgcgacgctggcaggctatctgaccgcgcagggtttcggcgcgtcccgcctgacggtgatggaggcgcttggcggtccgcgtgaaatcgcgcgcacggccgatgctgcgacttttgacctggacggcgtcgccgcccctgtggtggtggcgattgcggtgtcgggtagcgcgggtatcagccacgcgcccggacggccagaggcgctttttgcccatgacagccagatcaccaaatcacccatgcgcgcgttgacgctggctgcgttggccccccgcgcgggggagctgctgtgggatgtggggggcggatcgggctctgtctctgttgaatggtgtctggccgcgccgcacgcgcagtccattgcaatcgagccgcgcgaaagccgctgcgataatatcaccgagaacgcccgccgctttggtctggcgggccggatgcgctgcgtgcagggcacggcccccgatgcgctggccgatctgcccctgcccgctgcggtctttctggggggtggcgcgtcagaggatgtcttgcaggcgatctgggacaggatcacgccgggcacgcggcttgtggcgaatgcggtggcgcttgaaacccaagccttgctgatccgctggcatgggatgcacggcgggcagctactgcggattgatctggcgcaggcggcccccttggggaccatgcagggctggcaccccagccgcccgcaactgcaatggagcgtgacccgatga

SEQ ID NO: 9010 - protein, 398 aa, Sulfitobacter sp. EE-36
MADPVAAWVTLIGLGEDGLGGLTDASRKALAEADVIFGGARHLALCAAGARGREWPLPFSVAPVLEHRGRAVVVLASGDPFWHGVGGSLAQVLDASEWRCFPAPSCMTLAAARLGWRLEEVTTLGLHAAPFEVLLPHLAAGARLICTLRDGAAPATLAGYLTAQGFGASRLTVMEALGGPREIARTADAATFDLDGVAAPVVVAIAVSGSAGISHAPGRPEALFAHDSQITKSPMRALTLAALAPRAGELLWDVGGGSGSVSVEWCLAAPHAQSIAIEPRESRCDNITENARRFGLAGRMRCVQGTAPDALADLPLPAAVFLGGGASEDVLQAIWDRITPGTRLVANAVALETQALLIRWHGMHGGQLLRIDLAQAAPLGTMQGWHPSRPQLQWSVTR

SEQ ID NO: 9011 - DNA, 1203 bp, Oceanicola batsensis HTCC2597
  CDS (1)..(1203): transl_table=11
atgagcgcggcatggctgcatgtcgtcgggatcggcgaggacgggatggcggggctgctgccggccacccgcgccgttgtcgaggcggccgaggtgatcgtcggcggcgaccggcatcacaggctgtcggacgcggtcacggccgagcgtgtcgcctggccgcatccgttcgacgcgctgatcgacacgcttcgggggttgcgcgggcggcgggtggtcgtgctggcgaccggcgatccgctctggttctcggtcggcgcccggatcggccggtcgatcccgcccgatcagatcgtctatcacccgcagctttccgcgttccagctggcctcggcccggatgggctggtcgatggccgacctcgagacgctgacggtgcatggccgtccggtcgaacagatgatcgccttcatccagcccgacgcacggctgctgatcctgacgaccggcggggatacgccgggccggattgcccgtttcctgaccgaacgggggttcggcagatccacgatgaccgttctcgccaacatgggcggagaggcggagctgagggtcgaggggctggcggaaagctggtctcacgaggtgcctgccttcaacacgctggcggtggactgcgtcgccgcccccgacgcggcgctgctgccgcgcgtgccggggctggcggacgatctgttccagtccgacggaacgatgaccaagcgcgaggtgcgtgcggtgacgctggccaagctgatgccgatgcgcggggcgcttctgtgggacatcggtaccggctgcgggtcggtcgcggtcgaatggatgcgggcggcgcggtatgccagggcggtcgggatcgagccgcgcgccgaccggcgggcgatggcggccgagaatgcgctggcgctcggcgtgccgggactgcagctgatcgagggcgaggcgcccgcggcgctggccgggctggaccggccagatgcggtgttcatcggtggcgggctgagcgaggcggcattcgccaccgcctgggaccggctgaaaccgctcggccgtctcgtggcgaatgccgtcacgatcgagagcgaacaggtgatgctggccctgcaggcccggcacggcggagaactggccaagcttcaggtcgcgcgggccgaggcggtcggacggctttcgggctggcggccagcaatgccggtgacccagtggagcctggtgaaacgatga

SEQ ID NO: 9012 - protein, 400 aa, Oceanicola batsensis HTCC2597
MSAAWLHVVGIGEDGMAGLLPATRAVVEAAEVIVGGDRHHRLSDAVTAERVAWPHPFDALIDTLRGLRGRRVVVLATGDPLWFSVGARIGRSIPPDQIVYHPQLSAFQLASARMGWSMADLETLTVHGRPVEQMIAFIQPDARLLILTTGGDTPGRIARFLTERGFGRSTMTVLANMGGEAELRVEGLAESWSHEVPAFNTLAVDCVAAPDAALLPRVPGLADDLFQSDGTMTKREVRAVTLAKLMPMRGALLWDIGTGCGSVAVEWMRAARYARAVGIEPRADRRAMAAENALALGVPGLQLIEGEAPAALAGLDRPDAVFIGGGLSEAAFATAWDRLKPLGRLVANAVTIESEQVMLALQARHGGELAKLQVARAEAVGRLSGWRPAMPVTQWSLVKR

SEQ ID NO: 9013 - DNA, 1251 bp, Synechococcus sp. RS9917
  CDS (1)..(1251): transl_table=11
atgatcgaggtgatcggcaccgacgccggcgcacccgccagcctggcggagccgcaacagcgtctgctgcgagaggcgcactggatcgcggcgccgcggcgtctgcattcggcactcacactctggcttggcgatcaccacccggcgacgctgctcgcgagcgattcccctcttcagctctgcaaccaactccaggccctgccgtccagcacgcgggcggtggtgctcgccagcggtgaccccctctggttcggcatcggccgcaccctggtggagcgcctgggcgctgatcggctccgctttcaaccggcaccgagctccctgcagctggccttctcccggctcggccgcccctggcaggacgcccaatggctgagcctgcatgggcgcgatcccctggcgctggcgcaacaactgcagcaacggcccagagccctggcggtgctcaccgaccccagccgcggcggcgtggaggaggtgagaacgatcctgcgcagcagtgggctggacaccgcctatgcgctctggctgttcgaagccctggggcacgcggacgagcgggtgcagcagctgcaccccccggatccctcccccagcacactccatcccctgcatctggtggtgctcctggcggagctgcccagcgccccgccaccggaacgcctgccccttttcggcctcgaggacggcctcttcctgcagcacgacgaccgcccggggctgatgaccaaacgggaggtgcgcatccagctgctcgccgatctggagctgccggatcgcggcgtgctctgggacctgggggccggcaccggcagtgtgggcctggaagccctgcgcctcaggccagacctgcagctcctggcgattgaacgacggggcggcggggcgcccttgatcgaagccaatgccgagcggctgggggtgcggccagcggctgtgctggaaggcgatgcccttgccctgctaccggacttgcccggccccgaccgcgtgctgcttggtgggggagggcgcgatcgggccgccctgctgcaggccgtgctcacgcgtctgcggcccggtggtgtggtggtgatccccctggccacgctcgaagccctggccgagctccgaccgctcctggaaacggccgactgccgagtgaccctcagtcagctgcaatcctggcggggtcaacccctcgccgggggcacccgcctggcaccgatgaatcccgtgctgatcctcaaaggcaccaagcccccaacctga

SEQ ID NO: 9014 - protein, 416 aa, Synechococcus sp. RS9917
MIEVIGTDAGAPASLAEPQQRLLREAHWIAAPRRLHSALTLWLGDHHPATLLASDSPLQLCNQLQALPSSTRAVVLASGDPLWFGIGRTLVERLGADRLRFQPAPSSLQLAFSRLGRPWQDAQWLSLHGRDPLALAQQLQQRPRALAVLTDPSRGGVEEVRTILRSSGLDTAYALWLFEALGHADERVQQLHPPDPSPSTLHPLHLVVLLAELPSAPPPERLPLFGLEDGLFLQHDDRPGLMTKREVRIQLLADLELPDRGVLWDLGAGTGSVGLEALRLRPDLQLLAIERRGGGAPLIEANAERLGVRPAAVLEGDALALLPDLPGPDRVLLGGGGRDRAALLQAVLTRLRPGGVVVIPLATLEALAELRPLLETADCRVTLSQLQSWRGQPLAGGTRLAPMNPVLILKGTKPPT

SEQ ID NO: 9015 - DNA, 1284 bp, Synechococcus sp. WH 5701
  CDS (1)..(1284): transl_table=11
gtgcacccaccgcaccagccgcactgccttgaggtgatcggcaccgacgccgctgggctggcctcgctgccagcgccggcggcggccctggtgcgccaggccgagctggtggcggcaccggcccgcctcctgccggagctgcgccaggccctggcggatgcggctcagccgccggcgctgattgccagtgatcgccccgagcagctctttccccagctggagcaagctctggctgctggttgggcggtggtgctgctggccagtggcgatccgctctggttcggcatcagccggctgctgctggatcgctttccccgcgagtgcctgcgctttcaccccgccccctccagcctgcagctggccttcgcccgcctcggtcgcccctggcaggacgccagctggatcagcctgcatggccgcgaccccgaacccctggcggcggccctccagaggcgacccgccgccctggcggtgctcaccgatcccggccgcggcggtgccgaggaggtgcgacggatcctggctgcctccggcctggaggcggcctatgcgctctggctgtgcgagcggctcggccacccccaggagcgggtgcagcggctggcgccccaggcggcgctgccggccgatctcgatcccctgcatctggtgctgctgatcgccgagccgccggtccctcccgatcccgccggcctgccactgttcggcctcgaggatggcctctggctgcagcacaccgatcgccccggcctgatgaccaagcgggaggtgcgcatccagttgctcgccgacctggagctgcccgccagcggtgttctctgggatgtgggggccggggtgggctcggtgggcctggaggccctgcgcctgcgcccggccctggagctctgggccctggagcggcgaggcggttcagcggccctgatccgggccaatgccgaacgtctcggtgtggcgccggcgggggtgctcgaaggcgacgctctcagtgtgctggagcagggcggcccccccgatcccgaccgggtgctgctcggaggtggcggtcgccagcgtctggcgctgctggagatcgtgctgcggcgcctgcggcccctcggccaggtggtgattcccctggccaccctcgaagccctcgcccagttgcggccgccgctggagcgggccgggctgcgggtgcaggtgagtcagctgcaggcctggcggggttcccccctggcggagggcacacgtctggcgccactcaatccggtgctggtgctcaaggggcgccgggtcgattga

SEQ ID NO: 9016 - protein, 427 aa, Synechococcus sp. WH 5701
MHPPHQPHCLEVIGTDAAGLASLPAPAAALVRQAELVAAPARLLPELRQALADAAQPPALIASDRPEQLFPQLEQALAAGWAVVLLASGDPLWFGISRLLLDRFPRECLRFHPAPSSLQLAFARLGRPWQDASWISLHGRDPEPLAAALQRRPAALAVLTDPGRGGAEEVRRILAASGLEAAYALWLCERLGHPQERVQRLAPQAALPADLDPLHLVLLIAEPPVPPDPAGLPLFGLEDGLWLQHTDRPGLMTKREVRIQLLADLELPASGVLWDVGAGVGSVGLEALRLRPALELWALERRGGSAALIRANAERLGVAPAGVLEGDALSVLEQGGPPDPDRVLLGGGGRQRLALLEIVLRRLRPLGQVVIPLATLEALAQLRPPLERAGLRVQVSQLQAWRGSPLAEGTRLAPLNPVLVLKGRRVD

SEQ ID NO: 9017 - DNA, 1254 bp, Synechococcus sp. WH 7805
  CDS (1)..(1254): transl_table=11
atgatcgatgtgatcggaaccgacgctggcgcacctgcgtccctacctccgatgcaccaaagcctggtgcaagacgctgacctggtggcagctccaaagcgcatgctgccccaacttgtggattggctgggcagtcgcgccaccgaacagcagcgcttggccagtgatgatccgattgccctcagtgaagcccttcgcccgcttgcgcagaccctgcggattgtggtgctggccagtggagatcccctgtggttcggcattggtcgcgtgttgatcgagcggctggggagcaagcggctgcgtttccacccagcaccctcctccatgcagctggccttcgcccgcctgggcagaccctggcaggaagccgaatggatcagcctgcacggccgtgatcccagccccctggcccagcggttgcagaaacggccggccgccctggcggtgctcaccgatccaggccgagggggcgtcgaagaggtccgcgcgactctgcgcggcagcggactcgaatcgagctactgcctctggctgtgtgaagccctcggtcaccacgacgaacgcgtgcagtgcatcgaagcgaacaagccttgcccggatgaccttcatcctctgcacctggttgtactgctggcccaacctcccgtcccatccgcgccagaggctcttccattgtttgggattgaggatggcgactacctgcagcacgacgaccgccctgggctgatgaccaaacgggaggtgcgcatccagctgctctcggatctcgacctgccggaacaaggcgtactttgggatctgggggctggaacagggagtgtgggcctggaggccctacgcctgcgcccgcggctgcagctgatggcgatcgaacgacgaagcggtggcggggctttgatccaggccaatgcccgacgcctcggcgttgcaccgagctccgtacttgaaggggatgctctgacgctgctgcctcagcttccggatccagatcgcgtgctggtgggaggaggcgggcgccaacgaacagccctgctgaagggagtgattgatcgcctcagacccggcggcatcgtggtcatccccctggccaccctggaagctcttgccgaactgcggcctgtgctcgagctggccgggctgcagctgcggatcagccagcaacaatcctggcgcggtcagcctcttgccgagggcactcgcctggcgccgatgaatcccgttctgatcctcaagggcacaaaaccggggtcctga

SEQ ID NO: 9018 - protein, 417 aa, Synechococcus sp. WH 7805
MIDVIGTDAGAPASLPPMHQSLVQDADLVAAPKRMLPQLVDWLGSRATEQQRLASDDPIALSEALRPLAQTLRIVVLASGDPLWFGIGRVLIERLGSKRLRFHPAPSSMQLAFARLGRPWQEAEWISLHGRDPSPLAQRLQKRPAALAVLTDPGRGGVEEVRATLRGSGLESSYCLWLCEALGHHDERVQCIEANKPCPDDLHPLHLVVLLAQPPVPSAPEALPLFGIEDGDYLQHDDRPGLMTKREVRIQLLSDLDLPEQGVLWDLGAGTGSVGLEALRLRPRLQLMAIERRSGGGALIQANARRLGVAPSSVLEGDALTLLPQLPDPDRVLVGGGGRQRTALLKGVIDRLRPGGIVVIPLATLEALAELRPVLELAGLQLRISQQQSWRGQPLAEGTRLAPMNPVLILKGTKPGS

SEQ ID NO: 9019 - DNA, 1263 bp, Oceanospirillum sp. MED92
  CDS (1)..(1263): transl_table=11
atgatccatgtggttggtttgggcgtttcgcatacggcagaactgtcggcagaggcgcagcgctcgttgcagcaggttgatctggtagttggttctgcgcggcagttggcaaccattgaagatctgctatccatcggcaaagcgaccgctgagctaccaaagctggctgagttgagacccttggttgatggggccttggctgagcagaagtcggtaatgattctggcttctggtgatccgttgttttatggcatcggtcgttggtttagccgtaactttgcgcaaactgatctgaagttttatccggcggtatccagcttacaaaccgcttgtcaccgtttaggtatcgcgttgcaggatctcgaagtcttgagcctgcatggacggcctttgggcaagttgaaaacacgtttacgccagaatcagccactgctgatcctgaccgatagccaaagtcacccacaggcgattgcgaaaagttgcatcgattgcggttttccacaagcacaactgacggtgttagaaacgctgggttatcccgaggagcagatcagggcgttttccgctgcggaattagtggcggctcaaaatgactttgatccgctacacctgaccttggtggagccggggagcaatgaggggtatctacccgagtttccgggtatccccgaccggtactttattaccgatactgataagcccggtaaagggatgatcagtaagcgggaggtcagactgacgatactctcgctgatgcaactgagccgtggtgatcaggtctgggatattggtgcaggttgcggtggtgttgcggttgaattggcttactggcaacccttagcgactgtgaatgcgatagagcaccacccagaacgtttgcaatgtctgcaagcaaaccgcacacgatttggtgtcgtcagtaatttgcaggttattgaggggcgagcgcctgaagtcctgcaagggctgacgactccgaacaaagtatttattggcggcaatgatggcgaattgccacaactgctagcccaggtatgggaactgttgccgcctgatggcgtactcgtggccagtgcggtaactgaaaataccaaacagctgctgatgcagttctggcaacagcgaactgaagctgcggatagccaggtggaaaccacacaagttgctgtgagccgcggtgaaaccctggcggggcagttaatgtatcgaccgaatctaccggttaatttgtttaagtttgtaaaacacggagctgcggtatga

SEQ ID NO: 9020 - protein, 420 aa, Oceanospirillum sp. MED92
MIHVVGLGVSHTAELSAEAQRSLQQVDLVVGSARQLATIEDLLSIGKATAELPKLAELRPLVDGALAEQKSVMILASGDPLFYGIGRWFSRNFAQTDLKFYPAVSSLQTACHRLGIALQDLEVLSLHGRPLGKLKTRLRQNQPLLILTDSQSHPQAIAKSCIDCGFPQAQLTVLETLGYPEEQIRAFSAAELVAAQNDFDPLHLTLVEPGSNEGYLPEFPGIPDRYFITDTDKPGKGMISKREVRLTILSLMQLSRGDQVWDIGAGCGGVAVELAYWQPLATVNAIEHHPERLQCLQANRTRFGVVSNLQVIEGRAPEVLQGLTTPNKVFIGGNDGELPQLLAQVWELLPPDGVLVASAVTENTKQLLMQFWQQRTEAADSQVETTQVAVSRGETLAGQLMYRPNLPVNLFKFVKHGAAV

SEQ ID NO: 9021 - DNA, 1443 bp, delta proteobacterium MLMS-1
  CDS (1)..(1443): transl_table=11
atgagccaaccggtaagcacggacgtaactacccagccctgctcggaggtaactgttcagcagtgccccaggctggggcaagcggaccggcgccgcgtactgttgggtacgcaagccgggccgatcgccccaggatggggtgctgctggacagttacgcacgggcaaaattgtggtggccggcctagggccggaggggcttggcgcggcgcagcgccaagccctggccgcctgccgttgcctgtttgccgccgagcgccaccgtgccctggccgcttccctggcggctgataacacctcggagatccggccgttgaccccgctgccggcggccctggccgatatcgccgcccgactgcccggcggtgatgtgggggtgctggtgggcggcgatcccctctttttcgggatcggccgccggctgctggcccactttgccccggagcaactggagttccagccggctttgagttcagtgcaactggcctgcgcccgtttccggctgccctgggatgatgcccggctggtcagtctgcatggccgcaaccgggggcaccatacagcctccgataccaatattgccaacgctatcgccggggcgcgcttggccggccgcttgctgaccgctcccaaaagcgtggtgctgaccgatcagcgccattcgccggcttatatcgccaccgccctgcggcactacctggccctgatcggagattggacgacggcggcggcggtacgagtcatggtgggggaaaacctgggcagcgccgaggagcgcctgttcagtggcgatctggcggagaccgccggcgaggctttcgcgcctctgaatatcatgatcatcctcaaccccatggccggagccagcctggcctgcggcgagccggtctccctggggctgcgggagcgcgattttgtccaccagcgggggatgatcaccaaggatgaagtgcgggcgataaccctgcacaagctggctctgcccgcccacggagtactctgggatatcggcgcggccagcggttcaatcagcctggaggcggcccgcctggcccccagcctgctggcctgcgccatcgagcaggaggagtcacggctggccgatctcaaggccaatattgccagcttgggcgccttcgcggtgctgccggtggcgggggccgcaccggcggttttaaacgagttgcccgacccggatcggatctttatcggcggctccggcggccggttgcccgccattatcgccgccggcgccgagcgcctggccgccggcggccgcctggtgatcaacggggtcaccgccgccacccaggaacaggcccctgccctgctgcgggcggcgggcctggaggtggaaagcagcgaagtggcgatccggcggttacccgccgccggccgggcgctgaactttaatccaatcaccattatcacgggaagcagatga

SEQ ID NO: 9022 - protein, 480 aa, delta proteobacterium MLMS-1
MSQPVSTDVTTQPCSEVTVQQCPRLGQADRRRVLLGTQAGPIAPGWGAAGQLRTGKIVVAGLGPEGLGAAQRQALAACRCLFAAERHRALAASLAADNTSEIRPLTPLPAALADIAARLPGGDVGVLVGGDPLFFGIGRRLLAHFAPEQLEFQPALSSVQLACARFRLPWDDARLVSLHGRNRGHHTASDTNIANAIAGARLAGRLLTAPKSVVLTDQRHSPAYIATALRHYLALIGDWTTAAAVRVMVGENLGSAEERLFSGDLAETAGEAFAPLNIMIILNPMAGASLACGEPVSLGLRERDFVHQRGMITKDEVRAITLHKLALPAHGVLWDIGAASGSISLEAARLAPSLLACAIEQEESRLADLKANIASLGAFAVLPVAGAAPAVLNELPDPDRIFIGGSGGRLPAIIAAGAERLAAGGRLVINGVTAATQEQAPALLRAAGLEVESSEVAIRRLPAAGRALNFNPITIITGSR

SEQ ID NO: 9023 - DNA, 1443 bp, delta proteobacterium MLMS-1
  CDS (1)..(1443): transl_table=11
atgagccaaccggtaagcacggacgtaactacccagccctgcccggaggtaactgttcagcagtgccccaggctggggcaagcggaccggcgccgcgtactgttgggtacgcaagccgggccgatcgccccaggatggggtgctgctggacagttacgcacgggcaaaattgtggtggtcggcctgggtccggaggggcttggcgcggcgcagcgccaagccctggccgcctgccgttgcctgtttgccgccgagcgccaccgtgccctggccgcttccctggcggctgataacacctcggagatccggccgttgaccccgctgccggcggccctggccgatatcgccgcccgactgcccggcggtgatgtgggggtgctggtgggcggcgatcccctctttttcgggatcggccgccggctgctggcccactttgccccggagcaactggagttccagccggctttaagttcagtgcaactggtctgcgcccgtttccggctgccctgggatgatgcccggctggtcagtctgcatggccgcaaccgggggcaccataccgcagtcgataccaatattgccaccgctatcgccggggcacgcttggccggccgcttgctgaccgctcccaaaagcgtggtgctgaccgatcagcgccattcgccggcttatatcgccaccgccctgcggcactacctggccctgatcggagatggggcgacggcggcggcggtgcgggtcatggtgggggaaaacctgggcagcgccgaggagcgcctgttcagtggcgatctggcggcgaccgccggcgaggctttcgcgcctctgaatatcatgatcatcctcaaccccatggccggagccagcctggccagtggcgagccggtctccctggggctgcgggagcgcgattttgtccaccagcgggggatgatcaccaaggatgaagtgcgggcgataaccctgcacaagctggctctgcccgcccacggagtactctgggatatcggcgcggccagcggttcaatcagcctggaggcggcccgcctggcccccggcctgctggcctgcgccatcgagcaaaaggagtcacggctggccgatctcaaggccaatatcgccagcttgggcgctttcgcggtgctgccggtggcgggggccgcaccggcggttttaaacgaactgcccgacccggatcggatctttatcggcggctccggcggccggttgcccgccattatcgccgccggcgccgagcgcctgaccaccggcggccgcctggtgatcaacggggtcaccgccgccaccaaggaacaggcccctgccctgctgcgggcggcgggcctggaggtggaaagcagcgaagtggcgatccggcggttacccgccgccggccgggcgctgaactttaatccaatcaccattatcacgggaagcagatga

SEQ ID NO: 9024 - protein, 480 aa, delta proteobacterium MLMS-1
MSQPVSTDVTTQPCPEVTVQQCPRLGQADRRRVLLGTQAGPIAPGWGAAGQLRTGKIVVVGLGPEGLGAAQRQALAACRCLFAAERHRALAASLAADNTSEIRPLTPLPAALADIAARLPGGDVGVLVGGDPLFFGIGRRLLAHFAPEQLEFQPALSSVQLVCARFRLPWDDARLVSLHGRNRGHHTAVDTNIATAIAGARLAGRLLTAPKSVVLTDQRHSPAYIATALRHYLALIGDGATAAAVRVMVGENLGSAEERLFSGDLAATAGEAFAPLNIMIILNPMAGASLASGEPVSLGLRERDFVHQRGMITKDEVRAITLHKLALPAHGVLWDIGAASGSISLEAARLAPGLLACAIEQKESRLADLKANIASLGAFAVLPVAGAAPAVLNELPDPDRIFIGGSGGRLPAIIAAGAERLTTGGRLVINGVTAATKEQAPALLRAAGLEVESSEVAIRRLPAAGRALNFNPITIITGSR

SEQ ID NO: 9025 - DNA, 1224 bp, Desulfitobacterium hafniense DCB-2
  CDS (1)..(1224): transl_table=11
atgattcaaatagtggggataggccctggtacgagagcatgggttccccaggctgttgaagcaatggtcgctcagagcgatgttttggtaggagggatacgagccctggagctgttcccggatttccagggagagtcataccgggtcactggaaatctggcggaaactcggcaaaccttgcagaaagtattgcagcagggcaaaaaagccagtgtcctggtttccggtgatccaggtttctatagtctgcttccttggctgaaaagggagtttcctcaagaagaaattcaagtattgccgggcctcagctccattcagctggcctttgcccgggcagggataccctggcaggatgcagagctgcttagtgtccatggacgtccgctgaactgcttgcctttacatctcagccggccagtgggggttcttactggcggtgaaaactcaccccggaagatcgctgagtattatcgcacctatggctgcaatccgcggatttcacttggcaacgccttaacctatgcggaagagcgttggctgaatacagatgctgatcagctcatgaattcagaagaagatttcgccaatgcggtgatgatcctctatccggaagaagcggagcataagccggaacaatctgtcctctccctgcccaggagctttggcatcaaggatgaggagtttatacgcggtgatgtccccatgaccaagacggagattcgcgttcaagttctggctaaggcgggaattatccccgcgagccgggtcttggatgtgggagccgggacgggaagtataagcattgaagctgctcttctggctcatcgcggctgcgtttatgcggtggaggaaaatccggaggcacaagagctgatcctgaagaatcaggagaaattccgggtaagcaacctgcgcttgattcgtggctccgcaccgctggctctgcaggaaatcccgcctgtggatgtctgcattattggcggaagccatggacagattcgggagattttacaccaagcccctctggtacctgggggacgggcagtggtgactgccgtaactttagagacattggctcatggtatggaggccctgaaaagcttgcaatacgaagatgttgatgtggtttcgatccaagctgtgcgctggaagggcattaaggatattcatcttgcccaggcccaaaatcctgtatttatactctcaggaaggaaaggaagctaa

SEQ ID NO: 9026 - protein, 407 aa, Desulfitobacterium hafniense DCB-2
MIQIVGIGPGTRAWVPQAVEAMVAQSDVLVGGIRALELFPDFQGESYRVTGNLAETRQTLQKVLQQGKKASVLVSGDPGFYSLLPWLKREFPQEEIQVLPGLSSIQLAFARAGIPWQDAELLSVHGRPLNCLPLHLSRPVGVLTGGENSPRKIAEYYRTYGCNPRISLGNALTYAEERWLNTDADQLMNSEEDFANAVMILYPEEAEHKPEQSVLSLPRSFGIKDEEFIRGDVPMTKTEIRVQVLAKAGIIPASRVLDVGAGTGSISIEAALLAHRGCVYAVEENPEAQELILKNQEKFRVSNLRLIRGSAPLALQEIPPVDVCIIGGSHGQIREILHQAPLVPGGRAVVTAVTLETLAHGMEALKSLQYEDVDVVSIQAVRWKGIKDIHLAQAQNPVFILSGRKGS

SEQ ID NO: 9027 - DNA, 1335 bp, Synechococcus sp. RS9916
  CDS (1)..(1335): transl_table=11
atgatcgacgtgatcggcaccgacgctggcgcccctggcacgcttccaccagcgggtcagctgctggtggaacaggcccagcttgtggctgctcccaaacggatgctcagtgcgctgcagcagtggccaggcgtcccagccaagctgcgcctgatcgccagcgacgacccgattgccctcagcgaggcactgctggccctggagcccgatcagtcagcagtggtcttggccagcggtgatccgctttggtttggcatcggcaggatcctgatcgaacgggtcggtcgcagccgcctgcgcttccatccagggcccagttccctgcagctggccttcgcacgcctgggccagccctggcagaacgccgagtggatcagcctccacggccgcgatcccctcgcgctcaaccgctgcctgcaacaacgcccccgatcgctggcggtgctcaccgaccccagcaggggaggggtgaatgaggtgcgtcagatcttgcgctccagcggattggaagccgcctacgccctatggctttgcgaagccctcggccacacggatgagcgcgtgcagcaactgcagcccactgatcccacgccaagcgatctcaacgccctgcatttggtggtgctgctcgcgcaacccgcgcctgatcccacacccgactctttgcccctgtttggcctcgatgacggcctgtttctgcaacacgacgaccggcccggcctgatgaccaaacgggagatgcgcatccagctcctggccgaactgaacctgccggcccgtggcgtgttgtgggatctgggggccggcaccggcagcgttgggctggaggcccttcgcctgagaccagaactgcaactgctcgcggttgaaaagcggggtggaggtgcccgcttgatcacagccaatgcgcaacgcctgggggtgcaacctgccgccgtgctggagggcgatgcgctcaagctgcttgaggccgatgctcatccaaccgctgacccttccattccagccgctcttgcgcgggccgaccgggtgctgatcgggggtggcggcaagcagcgcgctgccctgctcaaggcagtgctgcaacggctgaacccaggcggcgtggtggtgatccccctggccaccgtcgaggccttggccgagctgcgccccctgctggagcactgcggctgtgccgtgagtgtcagccaacaccaggcctggcgcggacaacccctcagtgatggcacccgcctggccccgatgaacccggtgcttctgctcaaaggcaccgcccgctgcagtgagccgtcagactcaggccaacccaaccctgaacagccatgcccctga

SEQ ID NO: 9028 - protein, 444 aa, Synechococcus sp. RS9916
MIDVIGTDAGAPGTLPPAGQLLVEQAQLVAAPKRMLSALQQWPGVPAKLRLIASDDPIALSEALLALEPDQSAVVLASGDPLWFGIGRILIERVGRSRLRFHPGPSSLQLAFARLGQPWQNAEWISLHGRDPLALNRCLQQRPRSLAVLTDPSRGGVNEVRQILRSSGLEAAYALWLCEALGHTDERVQQLQPTDPTPSDLNALHLVVLLAQPAPDPTPDSLPLFGLDDGLFLQHDDRPGLMTKREMRIQLLAELNLPARGVLWDLGAGTGSVGLEALRLRPELQLLAVEKRGGGARLITANAQRLGVQPAAVLEGDALKLLEADAHPTADPSIPAALARADRVLIGGGGKQRAALLKAVLQRLNPGGVVVIPLATVEALAELRPLLEHCGCAVSVSQHQAWRGQPLSDGTRLAPMNPVLLLKGTARCSEPSDSGQPNPEQPCP

SEQ ID NO: 9029 - DNA, 1338 bp, Moritella sp. PE36
  CDS (1)..(1338): transl_table=11
atgatgcaagatagcgataaggacattaataagaaaggtcgccgaacctgtattgatgtgattggcttgggtgttgcagaacacgcattgttaacacctgctgcgcagcaagccatacagcaagctgaggtgataattggttctgaccgtcagttagccgtgattagccaattgttgacgggtaatattgacgagcatcaggctcaagcgaaacctgaaccaaagcaagtgatcttgccgtctctatctcagttacttgcgttattagcgacgcatcagcaacagcgtgtggtgatattagcgtcgggcgatccgttacattatggtattggtcgttggttgctgactaaatttggcaaagataatttacagtttcatgcgggtatttcgagtattcaagcggcttgccatgcattaggtttggcactgcaagatgttgaagtattaagtttgcatggccgacccctagccaaaattcgtacccgtcttaaaattaaacaaaccttagtaatactgactgataaacacagtcagcctcagcatttagcccaagaatgtattaatgccggatttgatcaatcgattatttgggtgtgtgaattattgggttatgcccagcagcgtatacgtgcatttacagctacgcaattaatcgcgacaccggaattaagctttgacccattgcacgtatctgtggttgagccacttggtactggcggcatattgccaaactttccgggcattgaagaccaatactttgtcaccgaccgtgaagcgggtaaaggcatgatcaccaaacgtgaagtgcgtctgcagatcttgtcactgatgcagcctgctaaaggcgatgtaatctgggacattggtgcaggttgtggtggtgtggcggttgagttggcctattggcagcaagacgcacaaatatatgccattgaacatcatcctgaccggttaagttgtttagccgcaaatcaacaacgctttggtgtggtggctaacttagcgattattgcgggccgtgcgcctgctgaattagcgacattaccagtagcgaataaagtatttattggtggcagtgatggtgagttagcgtcggtgctagccctaagttggcagcaattacctgctggtggggtattagttgcgagtgcggtaacggaaaccaccaagtaccaattacagcattttgcccagtcgttgtccgatctacaaacggaaaccttgcaagtcgcgattagcaaaggcactaaattagcgggtcagttaatgtataaaccgaacctgccggtgaccttatttaaatttaccaaatatgaagaagtcgataatgaagtataa

SEQ ID NO: 9030 - protein, 445 aa, Moritella sp. PE36
MMQDSDKDINKKGRRTCIDVIGLGVAEHALLTPAAQQAIQQAEVIIGSDRQLAVISQLLTGNIDEHQAQAKPEPKQVILPSLSQLLALLATHQQQRVVILASGDPLHYGIGRWLLTKFGKDNLQFHAGISSIQAACHALGLALQDVEVLSLHGRPLAKIRTRLKIKQTLVILTDKHSQPQHLAQECINAGFDQSIIWVCELLGYAQQRIRAFTATQLIATPELSFDPLHVSVVEPLGTGGILPNFPGIEDQYFVTDREAGKGMITKREVRLQILSLMQPAKGDVIWDIGAGCGGVAVELAYWQQDAQIYAIEHHPDRLSCLAANQQRFGVVANLAIIAGRAPAELATLPVANKVFIGGSDGELASVLALSWQQLPAGGVLVASAVTETTKYQLQHFAQSLSDLQTETLQVAISKGTKLAGQLMYKPNLPVTLFKFTKYEEVDNEV

SEQ ID NO: 9031 - DNA, 1179 bp, Magnetospirillum gryphiswaldense
  CDS (1)..(1179): transl_table=11
atgatcaccgtcatcggtatcggcgaggatgggctggacggcatcagcgccgccgcccgcgccctgatcgcgggcgccgaggtgatcgtcggcggcgagcgtcatctggccatggtggaagccgccgacaagcgcccgtggcccagcccgtttgccgatggcaaggatctgctgagttcgttgcgtcataaaaacgtcgtcgtcctcgcctcgggcgatcccatgcattacggcatcggcgccacccttgcccgctggttccccggcgaagagcagctggtgttgccccatcccggcgccttttccctggccgccgccgccttgggttggccgctgcaggattgcctgaccctgaccgtgcatggccgcccactggaggccttgcatctgcatctggcgccggggcgcaagctgctggtgctgtccgaagacggccaaagtccggcggcggtggcgcgtttgctggaaaaagccggtttcggcccctcggacatggtggtgctggaacatctgggcgggccgcgccagaacatccgccgtgccagcgctggcacttgggtgggcgaagccgccgatctcaacatcatcgccatcgcctgccgggcggaaacgggcgcccaaatcctgtccacactccccggcctgcccgatgatgccttcacccatgacggccagttgaccaagcgggaaatccgggcgctgaccctgtcgaccttggccccgttgccgggcgagatgctttgggatgtgggtgccggctgcggctccatcgccatcgagtggatgcgggccggcggcatcgccaccgccatcgaatcccatgcggggcgggttggcttcatcgccgccaacgcggcgcggctgggggttcccggcctgaaagtggtgcgcggccatgcccccgatgccctgccctatagcgatcccgacgccattttcgtcggcggcggcgtctccgcccccggtctgcttgatgcctgctgggccggcttacgtccaggcgggcggctggtggtcaacgccgtcaccgccgagggtgaggcggcgttgctggcctttcacgcccgccacggcggcgccatgacccggctgtcggtggcgcgattagccccggtcggcggcttccacacctggcatgcggccatgccggtgacccaatacaagggggtcaaggcatga

SEQ ID NO: 9032 - protein, 392 aa, Magnetospirillum gryphiswaldense
MITVIGIGEDGLDGISAAARALIAGAEVIVGGERHLAMVEAADKRPWPSPFADGKDLLSSLRHKNVVVLASGDPMHYGIGATLARWFPGEEQLVLPHPGAFSLAAAALGWPLQDCLTLTVHGRPLEALHLHLAPGRKLLVLSEDGQSPAAVARLLEKAGFGPSDMVVLEHLGGPRQNIRRASAGTWVGEAADLNIIAIACRAETGAQILSTLPGLPDDAFTHDGQLTKREIRALTLSTLAPLPGEMLWDVGAGCGSIAIEWMRAGGIATAIESHAGRVGFIAANAARLGVPGLKVVRGHAPDALPYSDPDAIFVGGGVSAPGLLDACWAGLRPGGRLVVNAVTAEGEAALLAFHARHGGAMTRLSVARLAPVGGFHTWHAAMPVTQYKGVKA

SEQ ID NO: 9033 - DNA, 1233 bp, Microcystis aeruginosa PCC 7806
  CDS (1)..(1233): transl_table=11
atggcggatcgcaattgtcagtcgaaatggctatcgatcataggaattggtgaagatggcttagaagggttaagttcagtggggcgaagtctgctttctttagcatcagttattgtcggtggtgaacgtcatctggcaatgttacccccagaggatcaacggcaaaaactgctctggacttctcccattcaagactccattaacgagattatccgccgtcgtggtcaatctgtctgtgttttggccagtggtgatcccatgtgctacgggattggtgtcaccctcacccgtcagattcccccggaggaaatgacgattattccctctccttctagctttagtcttgcctgtagtcgtttgggttggtccctgagtgaagtggaaactttgagtttgtgcggtcggcctccggcttggttgaatggggtgctttatcccggcgctaaactgctggtactgagcgctgatgctcagactcccgcaatcgctgctcggctgctcagggagggaggttttggcgaaagttccatcaccgttttagaacatctagggggaacccgagaacgccacattcaaggcatcgccaacgattgggagtttacatatctggcagatttaaatgtcatcgccattagctgcatttcctcccatccccccacccgggcgccgcgccttccaggactgccggattctgcctaccatcatgacggacagttgacaaaaagagaagttcgtgctatcacgctgagtagattggttcccctgcctgggcaattgctctgggatgtgggggcgggttgtggttccattgccattgagtggctgcggagcgatcgccgttgccaggctattgcgatcgaacatcatcccaccagattacaatacattgccgataatgccgccgccctgggaacgccccacctgcaaatcgtcgccggaatcgcaccgagcgccctggaagatttaccgcaaccggacgctatttttattggtggcggtatcaccacaccccacctattggaaacctgttggttagccctgcgccccgggggtcgtcttgttgccaatactgttacaattgaaagcgaattagttctcttgcaatggcatagtaaattaggaggggaactgctgcgaattggcattgaaaaagccgaaccggtcggcaagtttttaggttggaaagcaatggcccccgtgacccagtggactgttctgaaaccgagattgtaa

SEQ ID NO: 9034 - protein, 410 aa, Microcystis aeruginosa PCC 7806
MADRNCQSKWLSIIGIGEDGLEGLSSVGRSLLSLASVIVGGERHLAMLPPEDQRQKLLWTSPIQDSINEIIRRRGQSVCVLASGDPMCYGIGVTLTRQIPPEEMTIIPSPSSFSLACSRLGWSLSEVETLSLCGRPPAWLNGVLYPGAKLLVLSADAQTPAIAARLLREGGFGESSITVLEHLGGTRERHIQGIANDWEFTYLADLNVIAISCISSHPPTRAPRLPGLPDSAYHHDGQLTKREVRAITLSRLVPLPGQLLWDVGAGCGSIAIEWLRSDRRCQAIAIEHHPTRLQYIADNAAALGTPHLQIVAGIAPSALEDLPQPDAIFIGGGITTPHLLETCWLALRPGGRLVANTVTIESELVLLQWHSKLGGELLRIGIEKAEPVGKFLGWKAMAPVTQWTVLKPRL

SEQ ID NO: 9035 - DNA, 1197 bp, Bacillus megaterium
  CDS (1)..(1197): transl_table=11
atggcaattaaaattattggaattggtgacgacgggaagttaagtctgcttcctatgtatgaacagtggatttacgaaagcgatgtgctcattggagggaagcgtcaccttgacttttttcaagatttccaaggagaaaaagtagccattgaaggaggtctttcttcccttgttgaacgtttaaaaaacgaagaaggaaatgcggttgtgttagcatcaggcgacccgttattttacggaattggaagctatctttctacgaagctagacgttgaaatatacccttatttaagttctattcagcttgcattctcacgtttaaaagaaagatggcaagacgcttattttacaagtgtgcacgggagaagcataaagggtcttgctcagcgcattgacggctataaaaaagtagcgattttaaccgatgagcaaaattctcctactgctctggcaaactacttattgtcatttggcatgacagaatacaagatgtttgtggcagagaacttaggaggagaaacggagcgctgtcagctgctttcgttggaagaggcggcgaatcaattcttttctccgcttaatgtcgtgatattaaagcaggtagaagaaagtccagtctggcctcttggaatagaggacgatgaatttattcaacgtaaaccggataagggacttatcaccaaaaaagaaattcgtacacttagtattagcgccctgcagctaaagagagacagcgtcgtatgggatatcggaacatgtacgggttcagttgcgattgaagcggctaaaatagcgcgtgaaggacaaatttttgccgtggaaaaaaatgaagcagacttagaaaactgcagggaaaatctagcgaaatttcgagtagatgcccacactgtgcacggaaaagcaccagaagggctaaatgagtttgctgatcctgatgcggtgtttattggaggtacagcaggaggcatggaaacaattttagatgtttgctgcagccgattaaattcaggaggtcgcatcgtattaaatgccgtaacgattgaaaatttagcagaagcgatgaaagcttttaaagaacgagggtttgagactgctgttacccttgcacaaatttcaagaagcaagccaattttacatttaacacgatttgacgctttaaaccccatttatattattacagccaaaagaggagaatga

SEQ ID NO: 9036 - protein, 398 aa, Bacillus megaterium
MAIKIIGIGDDGKLSLLPMYEQWIYESDVLIGGKRHLDFFQDFQGEKVAIEGGLSSLVERLKNEEGNAVVLASGDPLFYGIGSYLSTKLDVEIYPYLSSIQLAFSRLKERWQDAYFTSVHGRSIKGLAQRIDGYKKVAILTDEQNSPTALANYLLSFGMTEYKMFVAENLGGETERCQLLSLEEAANQFFSPLNVVILKQVEESPVWPLGIEDDEFIQRKPDKGLITKKEIRTLSISALQLKRDSVVWDIGTCTGSVAIEAAKIAREGQIFAVEKNEADLENCRENLAKFRVDAHTVHGKAPEGLNEFADPDAVFIGGTAGGMETILDVCCSRLNSGGRIVLNAVTIENLAEAMKAFKERGFETAVTLAQISRSKPILHLTRFDALNPIYIITAKRGE

SEQ ID NO: 9037 - DNA, 1248 bp, Pseudomonas aeruginosa
  CDS (1)..(1248): transl_table=11
gtgtcatcggcagactcgacgccgccctggctgaccctggtgggcatcggcgaggacggttatcccggcctcggcaagcaggcccggcgtgccctgctgcaagccagccggatcgtcggcgcggcgcgccagctggaactgctgccgccgtgcatcggcgccgcccgcgaaacctggccgacgccgttctccctggaaccattgctggcccggcgcggccagccgacctgcgtgctggccagcggcgacccgatgctgttcggcgtcggcgccagtctcgcccggcaactgccggcgaccgaactgcgggtcctgccggcgccttcctccctctcgctggccgccgcccgcctcggctgggccctgcaggaggtcgcctgcctgtcgctggtggcgcgcccgctggcagcgctgcaggcacaggtccacgacggccggcgcctgctggtcctcagcaacgacggcgacagcccggccgccatcgcccgcctgttgaacgcccgtggcttcggcgccagtcgcctgagcgtgctggaacacctcggcgggccgctcgagcgccgtctcgacggcctcgctggcgactggtcgctgccgcgcgccgccgatctcaacctggtggcggtggaatgccgcgccggcgccggcgccgtgcgcctgccgctgaccccgggcctggccgacgaggcctatcgccacgacggccagttgaccaagcgcgacgtccgcgccgtgaccctggcgcgcctggcgccctgccccggcgagctgctctgggacgtcggcgccggttgcggctccatcggcatcgaatggatgcgcgcgcaccccagttgccgggcgatcgccatcgaagccaacgacgagcgccaggaacatatccgccacaaccgcgacgccctcggcgtaccgaccctacacctggtcgccggcagcgccccggaggccctgctggaactgcccgagccggacgccatcttcatcggcggcggggtcaccgccgagggcgtgctggaaacctgctgggagcgcctgcggcccggcggccgcctgctcgccaacgcggtcaccctgcagagcgaacgggtgctgctcgactggcagcaacgcctgggtggcgacctcacccgcctcggcgtcgcccacgcgcgaccactgggcggtttcgacacctggcgccaggccttgccgatcaccctgctggaattgcgcaagcccgccgccaggaagcctccccgcgatgcgtga

SEQ ID NO: 9038 - protein, 415 aa, Pseudomonas aeruginosa
MSSADSTPPWLTLVGIGEDGYPGLGKQARRALLQASRIVGAARQLELLPPCIGAARETWPTPFSLEPLLARRGQPTCVLASGDPMLFGVGASLARQLPATELRVLPAPSSLSLAAARLGWALQEVACLSLVARPLAALQAQVHDGRRLLVLSNDGDSPAAIARLLNARGFGASRLSVLEHLGGPLERRLDGLAGDWSLPRAADLNLVAVECRAGAGAVRLPLTPGLADEAYRHDGQLTKRDVRAVTLARLAPCPGELLWDVGAGCGSIGIEWMRAHPSCRAIAIEANDERQEHIRHNRDALGVPTLHLVAGSAPEALLELPEPDAIFIGGGVTAEGVLETCWERLRPGGRLLANAVTLQSERVLLDWQQRLGGDLTRLGVAHARPLGGFDTWRQALPITLLELRKPAARKPPRDA

SEQ ID NO: 9039 - DNA, 1242 bp, Pseudomonas denitrificans
  CDS (1)..(1242): transl_table=11
atggctgacgtgtcgaacagcgaacccgccatagtctccccctggctgaccgtcatcggtatcggtgaggatggtgtagcgggtctcggcgacgaggccaagcggctgatcgccgaagcgccggtcgtctacggcggccatcgtcatctggagctcgccgcctccctcatcaccggcgaagcgcacaattggctaagccccctcgaacgctcggtcgtcgagatcgtcgcgcgtcgcggcagcccggtggtggtgcttgcctcgggcgacccgttcttcttcggcgtcggcgtgacgctggcgcgccgcatcgcctcggccgaaatacgcacgcttccggcgccgtcgtcgatcagtcttgccgcctcgcgcctcggctgggcgctgcaggatgcgacgctcgtctccgtacatgggcggccgctggatctggtgcgaccgcatttgcatccgggggcgcgtgtgcttacgctcacgtcggacggtgcgggtccgcgagaccttgccgagcttctggtttcaagcggcttcggtcagtcgcgactgaccgtgctcgaagcgctgggcggcgccggcgaacgggtgacgacgcagatcgccgcgcgcttcatgctcggcctcgtgcatcctttgaacgtctgcgccattgaggtggcggccgacgagggcgcgcgcatcctgccgcttgccgccggccgcgacgatgcgctgttcgaacatgacgggcagatcaccaagcgcgaggtgcgggcgctgacgctgtcggcactcgcaccgcgcaagggcgaactgctatgggacatcggcggcggctccggctcgatcggcatcgaatggatgctcgccgatccgaccatgcaggcgatcaccatcgaggttgagccggagcgggcagcgcgcatcggccgcaacgcgacgatgttcggcgtgcccgggctgacggttgtcgaaggcgaggcgccggcggcgcttgccggcctgccacaaccggacgcgatcttcatcggcggcggcggcagcgaagacggcgtcatggaagcagcgatcgaggcgctcaagtcaggcggacggctggttgccaacgcggtgacgacggacatggaagcggtgctgctcgatcatcacgcgcggctcggcggttcgctgatccgcatcgatatcgcgcgtgcaggacccatcggcggcatgaccggctggaagccggccatgccggtcacccaatggtcgtggacgaagggctaa

SEQ ID NO: 9040 - protein, 413 aa, Pseudomonas denitrificans
MADVSNSEPAIVSPWLTVIGIGEDGVAGLGDEAKRLIAEAPVVYGGHRHLELAASLITGEAHNWLSPLERSVVEIVARRGSPVVVLASGDPFFFGVGVTLARRIASAEIRTLPAPSSISLAASRLGWALQDATLVSVHGRPLDLVRPHLHPGARVLTLTSDGAGPRDLAELLVSSGFGQSRLTVLEALGGAGERVTTQIAARFMLGLVHPLNVCAIEVAADEGARILPLAAGRDDALFEHDGQITKREVRALTLSALAPRKGELLWDIGGGSGSIGIEWMLADPTMQAITIEVEPERAARIGRNATMFGVPGLTVVEGEAPAALAGLPQPDAIFIGGGGSEDGVMEAAIEALKSGGRLVANAVTTDMEAVLLDHHARLGGSLIRIDIARAGPIGGMTGWKPAMPVTQWSWTKG

SEQ ID NO: 9041 - DNA, 22 bp, Artificial sequence
  primer
atgatccatgtggtgggcattg

SEQ ID NO: 9042 - DNA, 20 bp, Artificial sequence
  primer
ttaaccaaggtcgtcgtttc

SEQ ID NO: 9043 - protein, 496 aa, Artificial sequence
  consensus sequence
  Variant (2)..(7): Xaa in position 2 to 7 is any amino acid
  Variant (8)..(9): Xaa in position 8 to 9 is any or no amino acid
  Variant (11)..(24): Xaa in position 11 to 24 is any amino acid
  Variant (25)..(28): Xaa in position 25 to 28 is any or no amino acid
  Variant (30)..(62): Xaa in position 30 to 62 is any amino acid
  Variant (63)..(79): Xaa in position 63 to 79 is any or no amino acid
  Variant (86)..(88): Xaa in position 86 to 88 is any amino acid
  Variant (90)..(90): Xaa in position 90 is any amino acid
  Variant (92)..(93): Xaa in position 92 to 93 is any amino acid
  Variant (95)..(103): Xaa in position 95 to 103 is any amino acid
  Variant (104)..(106): Xaa in position 104 to 106 is any or no amino acid
  Variant (108)..(113): Xaa in position 108 to 113 is any amino acid
  Variant (116)..(117): Xaa in position 116 to 117 is any amino acid
  Variant (119)..(129): Xaa in position 119 to 129 is any amino acid
  Variant (131)..(133): Xaa in position 131 to 133 is any amino acid
  Variant (135)..(149): Xaa in position 135 to 149 is any amino acid
  Variant (150)..(167): Xaa in position 150 to 167 is any or no amino acid
  Variant (169)..(193): Xaa in position 169 to 193 is any amino acid
  Variant (194)..(203): Xaa in position 194 to 203 is any or no amino acid
  Variant (205)..(205): Xaa in position 205 is any amino acid
  Variant (208)..(209): Xaa in position 208 to 209 is any amino acid
  Variant (210)..(210): Xaa in position 210 is any or no amino acid
  Variant (212)..(243): Xaa in position 212 to 243 is any amino acid
  Variant (244)..(289): Xaa in position 244 to 289 is any or no amino acid
  Variant (291)..(302): Xaa in position 291 to 302 is any amino acid
  Variant (303)..(308): Xaa in position 303 to 308 is any or no amino acid
  Variant (311)..(313): Xaa in position 311 to 313 is any amino acid
  Variant (315)..(317): Xaa in position 315 to 317 is any amino acid
  Variant (319)..(320): Xaa in position 319 to 320 is any amino acid
  Variant (322)..(329): Xaa in position 322 to 329 is any amino acid
  Variant (330)..(330): Xaa in position 330 is any or no amino acid
  Variant (333)..(333): Xaa in position 333 is any amino acid
  Variant (337)..(337): Xaa in position 337 is any amino acid
  Variant (340)..(342): Xaa in position 340 to 342 is any amino acid
  Variant (344)..(354): Xaa in position 344 to 354 is any amino acid
  Variant (355)..(356): Xaa in position 355 to 356 is any or no amino acid
  Variant (358)..(368): Xaa in position 358 to 368 is any amino acid
  Variant (370)..(382): Xaa in position 370 to 382 is any amino acid
  Variant (383)..(385): Xaa in position 383 to 385 is any or no amino acid
  Variant (387)..(389): Xaa in position 387 to 389 is any amino acid
  Variant (391)..(394): Xaa in position 391 to 394 is any amino acid
  Variant (395)..(408): Xaa in position 395 to 408 is any or no amino acid
  Variant (410)..(413): Xaa in position 410 to 413 is any amino acid
  Variant (414)..(414): Xaa in position 414 is any or no amino acid
  Variant (417)..(429): Xaa in position 417 to 429 is any amino acid
  Variant (430)..(436): Xaa in position 430 to 436 is any or no amino acid
  Variant (438)..(440): Xaa in position 438 to 440 is any amino acid
  Variant (442)..(443): Xaa in position 442 to 443 is any amino acid
  Variant (445)..(485): Xaa in position 445 to 485 is any amino acid
  Variant (486)..(495): Xaa in position 486 to 495 is any or no amino acid
GXXXXXXXXLXXXXXXXXXXXXXXXXXXRXXXXXXXXXXXXXXXXXXXXXXXXXXXXXXXXXXXXXXXXXXXXXXXXXXLASGDPXXXGXGXXLXXXXXXXXXXXXPXXXXXXLAXXRXXXXXXXXXXXSXXXRXXXXXXXXXXXXXXXXXXXXXXXXXXXXXXXXXLXXXXXXXXXXXXXXXXXXXXXXXXXXXXXXXXXXXEXLGXXXEXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXTKXXXRXXXLXXLXXXXXXXXXWDXGAGXGSXXXEXXXXXXXXXXXXXEXXXXXXXXXXXNXXXXXXXXXXXXXXXXAXXXLXXXXXXXXXXXXXXXXXXPXXXXXGGXXXXXXXXXXXXXXXXXXXXLXXXGXXVXXXXXXXXXXXXXXXXXXXXXXXXXXXXXXXXXXXXXXXXXXXXXXXXXXXP

SEQ ID NO: 9044 - protein, 13 aa, Artificial sequence
  protein pattern
  Variant (3)..(3): Xaa in position 3 is Ile, Leu or Val
  Variant (5)..(5): Xaa in position 5 is Ala, Gly, Ser or Thr
  Variant (7)..(7): Xaa in position 7 is Ala, Cys, Ser, Thr or Val
  Variant (10)..(10): Xaa in position 10 is Ile or Val
  Variant (11)..(11): Xaa in position 11 is Ala, Gly or Ser
  Variant (12)..(12): Xaa in position 12 is Ile, Leu or Val
WDXGXGXGSXXXE

SEQ ID NO: 9045 - protein, 17 aa, Artificial sequence
  protein pattern
  Variant (2)..(2): Xaa in position 2 is any or no amino acid
  Variant (4)..(4): Xaa in position 4 is Ala, Gly, Thr or Val
  Variant (5)..(5): Xaa in position 5 is Asp, Gly, Ser or Thr
  Variant (7)..(7): Xaa in position 7 is Asp or Glu
  Variant (9)..(11): Xaa in position 9 to 11 is any amino acid
  Variant (12)..(12): Xaa in position 12 is Gly or Ser
  Variant (13)..(13): Xaa in position 13 is Ala, Ile, Leu or Val
  Variant (14)..(16): Xaa in position 14 to 16 is any amino acid
  Variant (17)..(17): Xaa in position 17 is Ile, Leu or Val
VXLXXGXPXXXXXXXXX

SEQ ID NO: 9046 - DNA, 645 bp, SYNECHOCYSTIS SP.
  CDS (1)..(645): transl_table=11
atgcacattcccgatggtctattgccaccccagatcgtggccgggggctatgcagtgacggggttagccacttggtactgtctgcggcaaattaatcgtcaaggccatgcccaggaaaatattcccaaagcatctttgctgaccgcagctttttttgttgcttcctctatctatattcccctgccgccggtgagtgtccacctaattctcaacggtctgttgggggtaatgctgggctattttgctctgccagccattttaattggcctctttttccaagctttgatggtgggccatggggggctgaccaccttgggtattaatggtgttttgatgggtttgccaacgttggcggcctatcatatttttcaactgcgccatgggctagaaaagtttctgccggagcgctgggccatgggcattgctgcttttttggggggtagcagtggtttagccttaacggtgctaattttcattgccctcactgtcaccagtttaccgacgggtttggatgccaccgctgagcgccgagcgattatggtgctggcgttgggccatgtacctctgattgtgctagaaggcatattcactgccctggtggttttgtttctgcaacggactaaaccggaattactggagagttaa

SEQ ID NO: 9047 - protein, 214 aa, SYNECHOCYSTIS SP.
MHIPDGLLPPQIVAGGYAVTGLATWYCLRQINRQGHAQENIPKASLLTAAFFVASSIYIPLPPVSVHLILNGLLGVMLGYFALPAILIGLFFQALMVGHGGLTTLGINGVLMGLPTLAAYHIFQLRHGLEKFLPERWAMGIAAFLGGSSGLALTVLIFIALTVTSLPTGLDATAERRAIMVLALGHVPLIVLEGIFTALVVLFLQRTKPELLES

SEQ ID NO: 9048 - DNA, 654 bp, Archaeoglobus fulgidus DSM 4304
  CDS (1)..(654): transl_table=11
atgcacataatggagggttacctgccacctgagtgggctgcattctggtatgtttttgccataccatttctggtctacggagctcttcgagttaagaggattatagaggaaaagccatcgatgaagtccttaattgctgtttctgcaggcttcatcttcgtcctctcagccctcaagcttccatctgtgactggaagctgctcacatccgactgggactggcatagcagtggtgtttttcgggcctgcggtgacagccctgctttcggcaatagtgctgctctaccaagccttgctgctggctcatggagggataacaacgctcggagcaaacactgcttccatgggcgttataggcccctttgttgggtggattgctttcaagctgctgaagaatgtcaatttcagagtggctgtttttgctgctgcgatgctctcggatctggtaacttatgtggtcacctcactgcagctcgcccttgcctttcccagctcagctggagttgcaggcataatcaaatccgctgcgaccttcatgggcatattcgccgtaactcaggttccgctctccatcattgagggcgtggtggctgtgatgctcgtctcctacatctttgaagttagaagcgacgttctggaggtggtaaaggcatga

SEQ ID NO: 9049 - protein, 217 aa, Archaeoglobus fulgidus DSM 4304
MHIMEGYLPPEWAAFWYVFAIPFLVYGALRVKRIIEEKPSMKSLIAVSAGFIFVLSALKLPSVTGSCSHPTGTGIAVVFFGPAVTALLSAIVLLYQALLLAHGGITTLGANTASMGVIGPFVGWIAFKLLKNVNFRVAVFAAAMLSDLVTYVVTSLQLALAFPSSAGVAGIIKSAATFMGIFAVTQVPLSIIEGVVAVMLVSYIFEVRSDVLEVVKA

SEQ ID NO: 9050 - DNA, 669 bp, Methanothermobacter thermautotrophicus str. Delta H
  CDS (1)..(669): transl_table=11
ttgcatatcatggaaggatttctcccctggcagtggtgcctcctctggtatctgctctcagccccggtcatagtctatggcctcatcaggataataaggattgcagatgagaaacccgaggcaaaaccactccttgcagttagcggtgcattcatgttcgttctctcatcccttaaactgccatctgtaaccggcagctgctcacaccccacgggtaatggtcttggcgctgtactcttcggaccggcagttacctcggtgatggcactgattgttctgatcttccaggcgatacttctggcccatggaggactcacaacccttggagccaacgttttctcaatgggtatagtgggacccttctgtgcctggggaatctacaggctcaccaggtcctcactttccacatcagtttcagttttccttgcagccttcctcggggacctgatgacctacgtgacaacctcggtgcagctggccctggcgttcccgattcccggattttcagaggccctgatgaagttcatgatcatattcgcctacacccagctaccccttgcagtggcagagggcctcctgacggtggtgatatttgagaacatactcaaactcaaacctgacataatggaaaagcttcagataatcagtaaaaaggctacggaggcctga

SEQ ID NO: 9051 - protein, 222 aa, Methanothermobacter thermautotrophicus str. Delta H
MHIMEGFLPWQWCLLWYLLSAPVIVYGLIRIIRIADEKPEAKPLLAVSGAFMFVLSSLKLPSVTGSCSHPTGNGLGAVLFGPAVTSVMALIVLIFQAILLAHGGLTTLGANVFSMGIVGPFCAWGIYRLTRSSLSTSVSVFLAAFLGDLMTYVTTSVQLALAFPIPGFSEALMKFMIIFAYTQLPLAVAEGLLTVVIFENILKLKPDIMEKLQIISKKATEA

SEQ ID NO: 9052 - DNA, 624 bp, Methanothermobacter thermautotrophicus str. Delta H
  CDS (1)..(624): transl_table=11
gtgcatatacccgacggaatcataccattatggcagtgcgcagtctactgggctgtggcgctcataaacataggaatattcttctacatattctcaaagaaaccccagaaggaaaggagaatcgttggaacgggcctttttgctgcggctgcagcggctgtatcctccatatccgtaccatcacccttcggtgtcccggtacacttcttcctcatacccctcgcagccatactgctgggacccctcacagccgtcatcgttgcaaccctctgcctggtaatccagttcttcatactgggtatgggtggcctgacaagtatgggtgccaacatactcacaatgggtataggcctcggtgtcggtacatacgcggtctacagtgttgtgagtgaacttgacaggagcctcgcagtcttcaccgccaccttcttcggtataatggttgccacggtgttccacatcatgatactccttgcagcgggtgttgctggtcctgaaatgctgatggcgacacttataccgttctacatctttgtgggggtcatagagggtgctgcgaacatattcattgtatccttccttgagaggatgaaaccagaattaaccatgatggagagggtgtaa

SEQ ID NO: 9053 - protein, 207 aa, Methanothermobacter thermautotrophicus str. Delta H
MHIPDGIIPLWQCAVYWAVALINIGIFFYIFSKKPQKERRIVGTGLFAAAAAAVSSISVPSPFGVPVHFFLIPLAAILLGPLTAVIVATLCLVIQFFILGMGGLTSMGANILTMGIGLGVGTYAVYSVVSELDRSLAVFTATFFGIMVATVFHIMILLAAGVAGPEMLMATLIPFYIFVGVIEGAANIFIVSFLERMKPELTMMERV

SEQ ID NO: 9054 - DNA, 654 bp, Methanothermobacter thermautotrophicus str. Delta H
  CDS (1)..(654): transl_table=11
ttgcatattccagatggtttcataccattcccacagtaccttgtgtactggcttattgcccttgtagccctctacttcagcatgcagtgggctggaagggatcttaaagaaaggcagataccactgtttgctgttcttgcagcgggaatatttgcaatacaggcgatgaacataccgataccctggggtaccagcggtcacatggttggagcggcccttgttgcaataatatttgcaagtccctatgcggctgtcctgcttctctcaattgtactgatactgcagggactcatcttcggtgacggaggaataacggcactgggtgcaaacatcttcaacatgggtgtgattggaggtttcaccggttactacctcttcagggcactgagatctgcaggtgaaatacctgcagtgattgtggcatcatgggcatcaatattccttgcagccattgcctgtgcagtggagatgtggatagcaggaacattccccctcgtacagggactctggatgatgggactctaccacgcagtcataggcctcatagaggctgcaataaccgtcgtggttgttcttgcaattcagagcagccgccctgatcttttctccctgagggactggggaaagaaaggtgccgaggtgttatcaaaatga

SEQ ID NO: 9055 - protein, 217 aa, Methanothermobacter thermautotrophicus str. Delta H
MHIPDGFIPFPQYLVYWLIALVALYFSMQWAGRDLKERQIPLFAVLAAGIFAIQAMNIPIPWGTSGHMVGAALVAIIFASPYAAVLLLSIVLILQGLIFGDGGITALGANIFNMGVIGGFTGYYLFRALRSAGEIPAVIVASWASIFLAAIACAVEMWIAGTFPLVQGLWMMGLYHAVIGLIEAAITVVVVLAIQSSRPDLFSLRDWGKKGAEVLSK

SEQ ID NO: 9056 - DNA, 663 bp, Halobacterium sp. NRC-1
  CDS (1)..(663): transl_table=11
atgcacatcatggaaggattcctccccggaatctgggcgctcgtgtggttcgtcgtcgccatccccgtcatcagctacggcgcgctgaaaaccgcacgcctcgcgcgcaacgacgaactaaacaaatcacacatcgccgtcgccgccgcgttcatcttcgtgctgtccgccctcaagatcccgtcggtcacgggcagcacatcacatcccaccgggaccggcatcgcggtcgtgctgttcgggcccgcagtcacggcgtttctctctgcgatcgtgttgctctaccaagccctcctgttgggtcacggcggactcacgacgctcggtgcgaacgtcgtctcgatgggcgtcgtcggcccggtggccggctgggtcgtcttccgcgcgctgaacccctatctcgacctccagaaagcaacgtttgcggccgcggtcatcgccgactggacgacgtatctcgtgacctccatccaactcggcgtcgcgttcccgtccgggcccggtgtcgccggcgttgtcgactccatcgtccggttcgccagcgtgttctcgatcacccagatccccatcggcatcgttgagggcgcgctcgccgccggtctcatcggctacatcgccatgtcgcgccagtccatcaagacgcgactgggggtgacagcatga

SEQ ID NO: 9057 - protein, 220 aa, Halobacterium sp. NRC-1
MHIMEGFLPGIWALVWFVVAIPVISYGALKTARLARNDELNKSHIAVAAAFIFVLSALKIPSVTGSTSHPTGTGIAVVLFGPAVTAFLSAIVLLYQALLLGHGGLTTLGANVVSMGVVGPVAGWVVFRALNPYLDLQKATFAAAVIADWTTYLVTSIQLGVAFPSGPGVAGVVDSIVRFASVFSITQIPIGIVEGALAAGLIGYIAMSRQSIKTRLGVTA

SEQ ID NO: 9058 - DNA, 969 bp, Clostridium acetobutylicum ATCC 824
  CDS (1)..(969): transl_table=11
atgcatatacctgataattatttgagtccttcaacctgtgctgtttttggggcatttatgttgcctgtatggagaaatgcaataataaaagtaaaaggtgagatttcaaggaagaaaatgcccctacttggagtagccgccgctttttcatttttagttatgatgtttaatgtcccattaccaggaggaactactggccatgctataggaggggcgcttgtggctattttacttggaccatatgctgcagtgcttgcagttacagtagcacttgtaatacaagcgttatttttcggcgatggtggtattttggcaataggtgtaaactgttttaatatggcgtttataataccttttgtatcatttaatttatttaagatgataaaaagattttcaaagagtaaaaaaggtgagtatttcggagcgtttttttctggatatatagctgtaaacctagctgccttatttgcagcaattgagtttggtattcaaccactgctttttaaggatgctttaggaaagccactatatagtccttatggtttaacagtatctattccatctatgttaataccacatttgttggtggttggatttttagaaggaattataacagttggagcgtacagctatgtaaagaaagcttctcctgaaataatatacaaggaaaacaatagtaaaaatagatttttgtacgttatactggggctacttattttggctaccccattaggacttttgtcgagcggtacagcatggggagaatggaatgtaaagcaaattaaaaatcttataggttttacacctaagggaatgaaaaatggttttaagtttaattcactatttcagggatataatgtaggtaatttaaaggactatattggatatatattggcagcagtggttggagtagtaataatactaatgatatttaaaattttagagaaggtaaaaaaggagaaagtatga

SEQ ID NO: 9059 - protein, 322 aa, Clostridium acetobutylicum ATCC 824
MHIPDNYLSPSTCAVFGAFMLPVWRNAIIKVKGEISRKKMPLLGVAAAFSFLVMMFNVPLPGGTTGHAIGGALVAILLGPYAAVLAVTVALVIQALFFGDGGILAIGVNCFNMAFIIPFVSFNLFKMIKRFSKSKKGEYFGAFFSGYIAVNLAALFAAIEFGIQPLLFKDALGKPLYSPYGLTVSIPSMLIPHLLVVGFLEGIITVGAYSYVKKASPEIIYKENNSKNRFLYVILGLLILATPLGLLSSGTAWGEWNVKQIKNLIGFTPKGMKNGFKFNSLFQGYNVGNLKDYIGYILAAVVGVVIILMIFKILEKVKKEKV

SEQ ID NO: 9060 - DNA, 672 bp, Clostridium acetobutylicum ATCC 824
  CDS (1)..(672): transl_table=11
atgcatatagaagatggaatattatcaccaacggcatgggggacgttatatgctgcatctgctttatttgtagttccaggtgttagagaaataaagaatagatctaaagaaaacttatattataagccttttttatcaatggtaggagtaggggtttttgtaatatcctgcatgcacatacctgttcctgtaactggttcatgttcgcatccatgtggaacacctcttgcagcgatactcataggtccactagcaacttcagttataacggcaatagctttgttttttcaagcgctgtttttaggacatggtggtattacaactataggggcaaataatatttcaatgggtatagctggagcaatatcaggatacgccttttttaagctttttagaaaatttggcagctcagtatggttagcagctggggtagcaggttttgtaggtgatatggttacctatatggtaagtgccttagaattggctgtaagcttacatggacatacgtcaatattgaaacaatggttaatattttttatgggatatggaccaacacaagttccattagcgatcgcggagggtatatttacagcagtaattattaaagtgatgcttaagagaagaccagatcttttaaaaatagataacttaaagagtaataaggagggttaa

SEQ ID NO: 9061 - protein, 223 aa, Clostridium acetobutylicum ATCC 824
MHIEDGILSPTAWGTLYAASALFVVPGVREIKNRSKENLYYKPFLSMVGVGVFVISCMHIPVPVTGSCSHPCGTPLAAILIGPLATSVITAIALFFQALFLGHGGITTIGANNISMGIAGAISGYAFFKLFRKFGSSVWLAAGVAGFVGDMVTYMVSALELAVSLHGHTSILKQWLIFFMGYGPTQVPLAIAEGIFTAVIIKVMLKRRPDLLKIDNLKSNKEG

SEQ ID NO: 9062 - DNA, 648 bp, Salmonella typhimurium LT2
  CDS (1)..(648): transl_table=11
atgcatatcatggagggctttttaccgccagtgtgggcgctggcctggtggctactgtttttaccctgcttgtggtatggactggtgcgcttacggcgtattgtgcaggaggataatcatcagaaggtactgctggcgctgtgcggcgcgtttatttttgtcctgtccgcgctcaaaattccgtcggtaacggggagttgttcacatccgaccggcgttggtctggcggttatcttgttcgggcccggggtggtggcgattctcggcgcggttgtgctgttgtttcaggcgctattgctggcgcacggtggcctgacgacgcttggcgcaaatggaatgtcgatggcggtgattggcccggttgtcggttatctggtgtggaaaatggcctgccgtgccggactgcgccgtgatgtcgccgtttttctgtgcgcgatgctggcggatttggcgacctattttgtgacttcagtccagcttggcgttgcgtttcccgatccccatgccggagcgacagggtctgttgtgaagtttatggggattttctgcctcacacagattcctgtcgccattgctgaaggtttattaaccgtcatgatttatgaccagttaaccaaacggcaagtgattaccgtacaaggacattaa

SEQ ID NO: 9063 - protein, 215 aa, Salmonella typhimurium LT2
MHIMEGFLPPVWALAWWLLFLPCLWYGLVRLRRIVQEDNHQKVLLALCGAFIFVLSALKIPSVTGSCSHPTGVGLAVILFGPGVVAILGAVVLLFQALLLAHGGLTTLGANGMSMAVIGPVVGYLVWKMACRAGLRRDVAVFLCAMLADLATYFVTSVQLGVAFPDPHAGATGSVVKFMGIFCLTQIPVAIAEGLLTVMIYDQLTKRQVITVQGH

SEQ ID NO: 9064 - DNA, 651 bp, Listeria monocytogenes EGD-e
  CDS (1)..(651): transl_table=11
atgcatattatggaggggtttttaccagttaaatgggctgtcttttggttaattgtatttattccatttcttgtgcttggtttaattcgcattcgtaaattaattgccctagacaaaaataacaaattactattagcattgtgtgcggcctttatcttcgttctttctgcacttaaaatcccgtccgttacaggttcttgttctcacccgactggggttggccttgcaacggttatgtttggtccgctcgttgttagtgtgctcggtgtcattgtcttgctttttcaagcgttactacttgcgcacggcggtattactacacttggcgcgaacgcaatgtcgatggcggttatcggtccaatggttggttttgtggtatacaaacttgctcgtaaattaaactgtaatagaagtgtatcgattttcttatgcgcgatgacagctgacttagcaacatacttaaccaccagcgttcagctcggagtcgttttcccagatccagcgtccggcatgatggcttccattctgaagttcatggcgattttctgtgtgacacaagttccaattgcgattgcagaaggattgctaacggtagtcatgtacaatcttattagcaaaaatttaccagaaaaggtggcacaattacgatga

SEQ ID NO: 9065 - protein, 216 aa, Listeria monocytogenes EGD-e
MHIMEGFLPVKWAVFWLIVFIPFLVLGLIRIRKLIALDKNNKLLLALCAAFIFVLSALKIPSVTGSCSHPTGVGLATVMFGPLVVSVLGVIVLLFQALLLAHGGITTLGANAMSMAVIGPMVGFVVYKLARKLNCNRSVSIFLCAMTADLATYLTTSVQLGVVFPDPASGMMASILKFMAIFCVTQVPIAIAEGLLTVVMYNLISKNLPEKVAQLR

SEQ ID NO: 9066 - DNA, 735 bp, Listeria innocua Clip11262
  CDS (85)..(735): transl_table=11
atgaaaaaattatggaagtttctaccatttgttttaatcggcgttatttattttactttaacgaacccagaatccgcacatgcaatgcatatcatggagggctttttacccgttaaatgggcagtcttttggctaattgtctttatcccattccttgtacttggtttaattcgtattcgtaaattaatcgctttagataaaaataataaattactgttggcattatgtgcagcctttatctttgttctttctgcacttaaaatcccgtccgttacaggatcttgttctcatccgacaggtgttggacttgcaacggttatgttcggaccgctcgttgtcagtgttcttggcgtgattgtcttacttttccaagcgctacttcttgcacacggcggtattactactcttggtgcaaacgcaatgtcgatggctgttatcggtccaatggttggttttgtcgtctataaactagctcgtaaactaaactgtaataaaagtgtttcgattttcttatgtgcaatgacagctgacctggcaacctacttaaccaccagcgtccagctcggagtcgttttcccagatccagcatcaggcatgatggcttctattctaaaattcatggcaattttctgtgtcactcaagttccaatcgcgattgcagaaggcttactcactgtagttatgtacaatcttattagcaaaaatttaccagaaaaggtggcacaattacgatga

SEQ ID NO: 9067 - protein, 216 aa, Listeria innocua Clip11262
MHIMEGFLPVKWAVFWLIVFIPFLVLGLIRIRKLIALDKNNKLLLALCAAFIFVLSALKIPSVTGSCSHPTGVGLATVMFGPLVVSVLGVIVLLFQALLLAHGGITTLGANAMSMAVIGPMVGFVVYKLARKLNCNKSVSIFLCAMTADLATYLTTSVQLGVVFPDPASGMMASILKFMAIFCVTQVPIAIAEGLLTVVMYNLISKNLPEKVAQLR

SEQ ID NO: 9068 - DNA, 786 bp, Nostoc sp. PCC 7120
  CDS (100)..(786): transl_table=11
gtgctgagaagggttctcgcatcgaaacgtgcctccctaattctcatggggatgctgagcttttatataattgttagtgcatctgcgccagcttatgccatgcacattatggagggctatctaccagcagggtgggcagctttttggtggttagtagctttgccgtttatgcttctaggagtgcgatcgctcacccgcatcaccaaagccaacccagaactaaaattattgttagcattggcaggggcttttactttcgtattatcggccttgaaattgccctcagtaacgggtagttgttctcacccgacaggtacaggcttagggtccgtgctattcgggcctttggcgatgtctgtgttgggtagtttagtattgttgtttcaagcattgctactggcgcatggtggtttaacaactttgggtgcaaatgctttttcaatggcgatcgcggggccatttgcagcctattggatatatcatctgacaatcaagttaactggcaagcaaagaattgccatctttttagcagccaccttagcagatttgctaacctacattattacttccgtccaactagccttagcttttcccgcaccagtcggcggatttatcgcctcattcgccaaatttgctggtattttcgccattacccaaatccctttagccattagtgaaggattattaactgtcttggtatggaactggctacaatcctactcaccgcaagaactccaattattgaaattaatccaaggggaatctcaaagccatgaatcaatctaa

SEQ ID NO: 9069 - protein, 228 aa, Nostoc sp. PCC 7120
MHIMEGYLPAGWAAFWWLVALPFMLLGVRSLTRITKANPELKLLLALAGAFTFVLSALKLPSVTGSCSHPTGTGLGSVLFGPLAMSVLGSLVLLFQALLLAHGGLTTLGANAFSMAIAGPFAAYWIYHLTIKLTGKQRIAIFLAATLADLLTYIITSVQLALAFPAPVGGFIASFAKFAGIFAITQIPLAISEGLLTVLVWNWLQSYSPQELQLLKLIQGESQSHESI

SEQ ID NO: 9070 - DNA, 921 bp, Nostoc sp. PCC 7120
  CDS (1)..(921): transl_table=11
atgcatattcctgatggatttgtgtctgtgccggtggcaggcgcaacgagtttggtaagtttggcaggactattggttgctagtgggcgatcgcaaacagcttttggtattcgtcgcgcccccatcctgggcttaaccaccgcctttatttttgcggcgcaaatgattaatttcccggtagcagggggaaccagtggtcacttgctcggaggtactttagctgcgatcgttttaggtagcccctgggctggctctttgtgcatcgccacagtcttaattatccaggcggtgctgttcgctgacggtgggatcactgccttgggagcaaatatattaaacatgggattcattggcgtttgggtaggctggatgttaacccaaaccttgcaaaggctatttggcggctctaaagcacgtttacccttagcggctggtatagcggcggccgtgagtgtcgtagtagcagcgatcgcctgtgctattgagttagtcatttctgggactgcatccatagctgtgttacctgctatgactggtgttcatattttgattggtattggtgaaggcctaattactggcggtgtattaacttatctagccaaagccaggccagatttgttaccaggagaacaagaagaatttcgcggttggttagtgcctgttgttagcatagtcttagtagctggtgcattgtcattgctagcctcagcttggcctgatggcttagaaagagtggcagaagacttgggatttatcaaactaagtgaagaagtcagaatatctgtaccgacaccgttagcagactatggtattgagggtttaggagcaattgggacgagtattgctggacttctgggggctgcggtttgctttgctgttgcttttggaattgccaaagtagtgagaccaaagaatgcttaa

SEQ ID NO: 9071 - protein, 306 aa, Nostoc sp. PCC 7120
MHIPDGFVSVPVAGATSLVSLAGLLVASGRSQTAFGIRRAPILGLTTAFIFAAQMINFPVAGGTSGHLLGGTLAAIVLGSPWAGSLCIATVLIIQAVLFADGGITALGANILNMGFIGVWVGWMLTQTLQRLFGGSKARLPLAAGIAAAVSVVVAAIACAIELVISGTASIAVLPAMTGVHILIGIGEGLITGGVLTYLAKARPDLLPGEQEEFRGWLVPVVSIVLVAGALSLLASAWPDGLERVAEDLGFIKLSEEVRISVPTPLADYGIEGLGAIGTSIAGLLGAAVCFAVAFGIAKVVRPKNA

SEQ ID NO: 9072 - DNA, 672 bp, Clostridium perfringens str. 13
  CDS (1)..(672): transl_table=11
atgcatatcatggaaggatttttacaacctaaatggtgtatagcatggggagttataactataccatttatagtattaggattattctctattaaaaacaaggttggaaataatccaagactaaagattttgttagctatggcaggagcttatgcttttgttctttcagcattaaagcttccatcagttacaggtagttgctcacatcctacaggagttggtcttgcggcaatattatttggacctacagcagcatcagttttaggacttatcgtacttttattccaagcattacttttagctcatggtggtcttactactcttggagctaatactttttcaatggctgtagttgggcctttagtatcatacggactttataaattagtaaaaaaacttaatggaccaacatggttaggtgtatttttagcatctgctcttggagatttagcaacttacatggttacttcagttcaattaggactagccttcccagcagaggttggaggagttatggcatcagttatgaaattcatgggtatatttgctgttactcaagttcctctagctataagtgaaggaatattaacagtcataatctttaatacaatagaaaattatgcaaaagaagatttaatggaacttaacattttttcaaagggggtaaaataa

SEQ ID NO: 9073 - protein, 223 aa, Clostridium perfringens str. 13
MHIMEGFLQPKWCIAWGVITIPFIVLGLFSIKNKVGNNPRLKILLAMAGAYAFVLSALKLPSVTGSCSHPTGVGLAAILFGPTAASVLGLIVLLFQALLLAHGGLTTLGANTFSMAVVGPLVSYGLYKLVKKLNGPTWLGVFLASALGDLATYMVTSVQLGLAFPAEVGGVMASVMKFMGIFAVTQVPLAISEGILTVIIFNTIENYAKEDLMELNIFSKGVK

SEQ ID NO: 9074 - DNA, 615 bp, Pyrococcus furiosus DSM 3638
  CDS (1)..(615): transl_table=11
gtgcatatcccagacggcctattgagccctccagtgatagccgctacatatttgggttttattgccgttctagcgtactcacttagaaatctaaaggagttcccagaagagaagataccactattaggactttttgcagcaggaatcttcgcagcacaaatggtcaacttccccataattggaggagttagtgggcacttactgggaggagctttggtggcggtaattttaggcccacatgccgccttcattgtaatgacaacggttttactaatccaaacattcttctttggggacggaggaataacggcacttggagccaacatattgaacatgggagctgtgggagcgtatcttggctactatatctaccagaaaattagcaaagtcaaagaagagctcggaattgcacttgcagcctggctatcagtagtgataggagcagcactaacagcaattgaaataggagttagtggaaatgtgccatttacaaaagtgttctcccttatggttgcttatcattcgataattggaattggagaagcactgataaccctggccgttataaaagcagtgaaaggtaaagtagcaagtattggaggtgttccaacatga

SEQ ID NO: 9075 - protein, 204 aa, Pyrococcus furiosus DSM 3638
MHIPDGLLSPPVIAATYLGFIAVLAYSLRNLKEFPEEKIPLLGLFAAGIFAAQMVNFPIIGGVSGHLLGGALVAVILGPHAAFIVMTTVLLIQTFFFGDGGITALGANILNMGAVGAYLGYYIYQKISKVKEELGIALAAWLSVVIGAALTAIEIGVSGNVPFTKVFSLMVAYHSIIGIGEALITLAVIKAVKGKVASIGGVPT

SEQ ID NO: 9076 - DNA, 708 bp, Methanosarcina acetivorans C2A
  CDS (1)..(708): transl_table=11
atgcacataatggaaggatttttgccgaccccctggtggcaactatggtttgtagtatcaataccagtgatcgcgtttggtatttataaaatgaacaagcttattaatgaaaaacgagaggtattgcctctccttgctgttgcaggtgcgtttatttttgtgttatcttcccttaaattgccttcagtagtcggaagctgttctcaccccacaggcacgggggttgcagcaattatgttcgggccggcaattaccgcagttctcggaaccatcgtacttatctaccaggcaattttccttgcacacggaggacttacaacccttggagcaaatgtcttttctatgggcattctgggccctgtggtggcatacctggtctataaggcaggaatgaaagcaaatctcaatttctatcttgtagttttccttgcaacggccctcggggactgggcaacttatgtaactacctctgtgcaacttgcccttgcatatcctgcaggagatgtgcttacctttgcaggctttatgagttcgttcgttaaatttgccggagtctttgcagttactcaggtgcctcttgcaatcatggaaggagctgtcagtgccctgctcttcaagtatgtggtcaacgttaagagcgatatcctggttgaaatgaacgtccttgaagattcggtcgtaagaaaactgagagggaatcccgcatga

SEQ ID NO: 9077 - protein, 235 aa, Methanosarcina acetivorans C2A
MHIMEGFLPTPWWQLWFVVSIPVIAFGIYKMNKLINEKREVLPLLAVAGAFIFVLSSLKLPSVVGSCSHPTGTGVAAIMFGPAITAVLGTIVLIYQAIFLAHGGLTTLGANVFSMGILGPVVAYLVYKAGMKANLNFYLVVFLATALGDWATYVTTSVQLALAYPAGDVLTFAGFMSSFVKFAGVFAVTQVPLAIMEGAVSALLFKYVVNVKSDILVEMNVLEDSVVRKLRGNPA

SEQ ID NO: 9078 - DNA, 996 bp, Methanosarcina acetivorans C2A
  CDS (1)..(996): transl_table=11
atgcatattccagatggttatttagggccaagtacgtttatctcgttctggatcatcatgattccgatttgggcttacgcgggaaggaaaatgaggaatcttggatcgagaagagttccactgcttgctctagcgtctgcattcacctttgtaattatgatgttcaatatacctgtacctggtggaagcagtggccatgcggtagggggaactgtaattgccgtcgttatagggccgtgggctgcagttatagccatatctatagccctggcgctgcaagcgctgatgttcggagatggggggctcaccgcttatgctgcaaactgtttcttcatggcagttcttatgccttttatcggttactatacctacaaatttattagcggatccacagacatcaaatcctcacgaagagtaatagccatagccatcggggcctggttagctatcactgtctcagctacactgatcggacttgttcttggattacagcctattttatataaaaacgaaagcggtttacctctttatatgccatatccactgagtgtgaccgttccagcgatgtttttggaacatgcatttctattcagtattcttgaggcattggtttcggcattgatattcgcctatatccagagagcagatccatccatattttatgcagaaaaaactaagcctcaagaaatatcgaagaaaggcaagcttttgagaaacttgactgttggcctgatattgttgataatcctgacgcctttaggtctgcttgtggcaggcactgcatatggcgaatgggcgccagaagagctcaaagctaggattggctttgtgccaccgggcctggaaaaactttcaggtatctggaatgcgccatttttagactacagcctttccagtctccatccggctatcggatacgtcatagcagccatagtaggggtactgttatgcatgggcatcttgtacttcattggcaggaggatagtcaaggactaa

SEQ ID NO: 9079 - protein, 331 aa, Methanosarcina acetivorans C2A
MHIPDGYLGPSTFISFWIIMIPIWAYAGRKMRNLGSRRVPLLALASAFTFVIMMFNIPVPGGSSGHAVGGTVIAVVIGPWAAVIAISIALALQALMFGDGGLTAYAANCFFMAVLMPFIGYYTYKFISGSTDIKSSRRVIAIAIGAWLAITVSATLIGLVLGLQPILYKNESGLPLYMPYPLSVTVPAMFLEHAFLFSILEALVSALIFAYIQRADPSIFYAEKTKPQEISKKGKLLRNLTVGLILLIILTPLGLLVAGTAYGEWAPEELKARIGFVPPGLEKLSGIWNAPFLDYSLSSLHPAIGYVIAAIVGVLLCMGILYFIGRRIVKD

SEQ ID NO: 9080 - DNA, 693 bp, Thermoanaerobacter tengcongensis MB4
  CDS (1)..(693): transl_table=11
atgcatatacctgacgggtacttgagccctcagacatgcgctgtaatgggggccgccatggttcctgttctctataaatccgtaaaagaagtaaataaagagcttgataagaaggacataccaacgatggcaataggttcggctttttctttcacagtcatgatgttcaacgtcccaataccgggcggtacaacagcccatgccatcggctccacccttctggcaatagtattgggcccctgggctgcggtcatttctgttacggtagcccttataatacaggccctcctctttggcgatggaggggtactggctttaggagcaaatactttcaatatggcttttctagcccccttcgttggatacggagtttacaagcttatgatgcgccttaaattaaagaaagttttatcctccgcaataggtgcatatgctggaataaatgcagcagcttttgcaacagcagtagagcttggcatacagccaatgcttttccacacagctacaggaaaagccctttatttcccttatggacttaacatatctatccctgctatgatgtttgctcatctcactgttgcaggtttcgtagaagctattgtaacagctttagttatatactacctagaaaaagtaggagaagataatatactctaccagtactcctacaggctaaggggtgaaaaaagatga

SEQ ID NO: 9081 - protein, 230 aa, Thermoanaerobacter tengcongensis MB4
MHIPDGYLSPQTCAVMGAAMVPVLYKSVKEVNKELDKKDIPTMAIGSAFSFTVMMFNVPIPGGTTAHAIGSTLLAIVLGPWAAVISVTVALIIQALLFGDGGVLALGANTFNMAFLAPFVGYGVYKLMMRLKLKKVLSSAIGAYAGINAAAFATAVELGIQPMLFHTATGKALYFPYGLNISIPAMMFAHLTVAGFVEAIVTALVIYYLEKVGEDNILYQYSYRLRGEKR

SEQ ID NO: 9082 - DNA, 693 bp, Thermoanaerobacter tengcongensis MB4
  CDS (1)..(693): transl_table=11
atgcacataccagaaggatatttaagtcctcaaacctgcgccgttatgggtgctgctatggtaccagtgttgacagttgcagcaaaaaaagtcaacaaaagttttgacaaaaaggacgttcctgctatggcgatagggtcagcttttgcttttaccataatgatgtttaacgtgccaataccagggggtacaactgcccacgcaattggcgccacactgcttgcaacaactttagggccttgggcggcaagtatatctcttacgctagccttatttattcaagcattgctttttggcgatggaggaattttagctcttggagcaaacagctttaatatggcatttatagctccttttgtgggatatggaatttacaggctcatgttatctctcaaactaaataaggttttatcatctgctatagggggatatgtaggaataaatgctgcagctcttgctacagcaatagaacttggacttcagccattgctttttcatacagcaaatggaacacctctatatttcccttatggattaaacgtagcaatacctgcaatgatgtttgctcatcttactgtagctggtattgtagaagctgttataacaggccttgtagtatattatttacaaaaagtagacgaagaaaatatattacataaattctcatataggcttagaggtgataatagatga

SEQ ID NO: 9083 - protein, 230 aa, Thermoanaerobacter tengcongensis MB4
MHIPEGYLSPQTCAVMGAAMVPVLTVAAKKVNKSFDKKDVPAMAIGSAFAFTIMMFNVPIPGGTTAHAIGATLLATTLGPWAASISLTLALFIQALLFGDGGILALGANSFNMAFIAPFVGYGIYRLMLSLKLNKVLSSAIGGYVGINAAALATAIELGLQPLLFHTANGTPLYFPYGLNVAIPAMMFAHLTVAGIVEAVITGLVVYYLQKVDEENILHKFSYRLRGDNR

SEQ ID NO: 9084 - DNA, 1062 bp, Streptomyces coelicolor A3(2)
  CDS (1)..(1062): transl_table=11
gtgcatgtacctgacggattcatcaacgccccgacctccgccgtgaccggagtcgtcgccgcgggcgccatcgcggtcagcctgcgcggcgcgcgccgtgagctggacgagcggacggcgccgctggccgggctggtcgcggcgttcatcttcgccgtgcagatgctgaacttcccggtcgcggccgggaccagcgggcatctgctcggcggcgcgctggccgccatcctcgtcgggccctgtacgggtgtgctgtgtgtctccgtcgtgctgctgatgcagggcatcctcttcgccgacggcggtctgaccgcgctcggcgtcaacatcaccgacatggcgatcgtcaccacggtcgtcgcctacgccctgttccggggcctggtgaaggtgctgccgcgcacccgccgctcggtcaccgtcgcctccttcgtcgccgcgctcgtctccgtcccggccgccgcgctcgccttcacgctcctgtactggatcggcggcaccaccgacgtctccatcggcaaggtcgccaccgcgatgatcggcgtgcacctgctgatcggcatcggcgaggccgcgatcaccgcgctgaccgtcggcgccgtcatcgccgtacgcccggacctggtgtacggggcgcgcgggctccagcagcggctcaagctgcgggtgaacggcgagctggtcgacgcccccggcgccggacccgctccggtccccgcccccgtcgccgcccgctcccaccgcaaggtgtggatcaccggcctggtcgcctccctggtcctggccggcttcgtcagcttctacgcctccgccgaccccgacggcctggagaaggtcgcctccgacaagggcatcgacgagaaggcgaaggagcacgccaacgccgactcgccgctcgccgactacggcgtcgaggacatcaccaacgcccgcgtctcgggcggcctcgcgggcgtgatcggcgtcggcgtcacggtcgtcgcgggcagcgccgtgttctgggcggtgcgcaggcgccgcagcgaggacgcctccccgaccagcacggaaacgaccgtctga

SEQ ID NO: 9085 - protein, 353 aa, Streptomyces coelicolor A3(2)
MHVPDGFINAPTSAVTGVVAAGAIAVSLRGARRELDERTAPLAGLVAAFIFAVQMLNFPVAAGTSGHLLGGALAAILVGPCTGVLCVSVVLLMQGILFADGGLTALGVNITDMAIVTTVVAYALFRGLVKVLPRTRRSVTVASFVAALVSVPAAALAFTLLYWIGGTTDVSIGKVATAMIGVHLLIGIGEAAITALTVGAVIAVRPDLVYGARGLQQRLKLRVNGELVDAPGAGPAPVPAPVAARSHRKVWITGLVASLVLAGFVSFYASADPDGLEKVASDKGIDEKAKEHANADSPLADYGVEDITNARVSGGLAGVIGVGVTVVAGSAVFWAVRRRRSEDASPTSTETTV

SEQ ID NO: 9086 - DNA, 774 bp, Streptomyces coelicolor A3(2)
  CDS (76)..(774): transl_table=11
gtggtacccgtaagccaggagaccggccaaggcgcgtcgtccatccacgaggtgctggagagggtctgccgagtcatgcacatagccgagggctttctgccaccggcgcacgcgatcgcctggggtgtcgcgtccgcgccgttcgtcgtccacggagtccggtcactcacccgtgaggtcagggagcacccggagagcacactgctcctcggtgcctccggagccttcacgttcgtcctgtcggccctgaagctgccgtcggtcaccgggagttgctcccacccgaccggcaccggtctgggcgcgatcctgttccggccgccgatcatggcggtccttggcaccatcacgctgctcttccaggcgctgctgctcgcccacggcgggctcaccacgctcggcgccaacgtcttctcgatggcgatcgtcggcccctgggccggatacggcgtctaccggctgctgcgccgctgggacgtgccgttgatggtcaccgtgttcttcggcgcgttcgtcgccgacctgtccacgtactgcgtcaccagcgtgcagctggcgctggccttcccggatccgagcagcgggttcctgggcgcgctcggcaagttcgggtccatcttcgcggtgacgcagattccactcgcggtgagcgagggcctgctcacggtgatcgtgatgcggctgctcgtgcagtccagcaagggcgaactgacccggctgggcgtgctgctgacccggaccggcgagcggaagcaggaggcggtggcgcgatga

SEQ ID NO: 9087 - protein, 232 aa, Streptomyces coelicolor A3(2)
MHIAEGFLPPAHAIAWGVASAPFVVHGVRSLTREVREHPESTLLLGASGAFTFVLSALKLPSVTGSCSHPTGTGLGAILFRPPIMAVLGTITLLFQALLLAHGGLTTLGANVFSMAIVGPWAGYGVYRLLRRWDVPLMVTVFFGAFVADLSTYCVTSVQLALAFPDPSSGFLGALGKFGSIFAVTQIPLAVSEGLLTVIVMRLLVQSSKGELTRLGVLLTRTGERKQEAVAR

SEQ ID NO: 9088 - DNA, 708 bp, Methanosarcina mazei Go1
  CDS (1)..(708): transl_table=11
atgcatataatggaaggttttttacctactccctggtggcagttatggtttgcagtatcaattcccgtgatactgtacggcatttacaaaatgaacaatctggtcaaagaaaaacgcgaaatattgcctctccttgctgtcgcaggtgcgtttatttttgtgttatcctccctgaaattgccttcggtaaccggaagctgttcccaccctacaggaaccggagttgcagcaattatattcggtccggcaatatccgcagtgctcgggacgatcgtgcttctctatcaggcacttttccttgcgcacgggggactcacaactcttggagcaaatgtcttttccatgggcatcgtagggcctgtggtagcataccttgtttataaagcaggtatgaaagctaatatcaacttctttgtcgtggtcttccttgctacggcttttggggactgggcaacctatctaactacatccgtgcaactttctctggcgtatcctgcaggtggagcgcttactattgcaggtttcatgagttcattcggcaaattcgccacagtctttgcagttactcaggtgccccttgcgatcatggagggagctatcagtgccctgctcttcaagtacgttgtcaacgtcaagagcgacatcctggttgaaatgaaagtcattgaagatgctgttgtaagaaaactgagaggtatttccgcatga

SEQ ID NO: 9089 - protein, 235 aa, Methanosarcina mazei Go1
MHIMEGFLPTPWWQLWFAVSIPVILYGIYKMNNLVKEKREILPLLAVAGAFIFVLSSLKLPSVTGSCSHPTGTGVAAIIFGPAISAVLGTIVLLYQALFLAHGGLTTLGANVFSMGIVGPVVAYLVYKAGMKANINFFVVVFLATAFGDWATYLTTSVQLSLAYPAGGALTIAGFMSSFGKFATVFAVTQVPLAIMEGAISALLFKYVVNVKSDILVEMKVIEDAVVRKLRGISA

SEQ ID NO: 9090 - DNA, 666 bp, Methanosarcina mazei Go1
  CDS (1)..(666): transl_table=11
atgcatatacctgattcttttataccgctaagccaggcaatagtttactgggtaattagcattccttttatttttatgtcaatgaaatgggcaaaaagtgagcttgaagagatgaaagtgcccatccttgctgcccttgcagcaggaatatttgctattcaggccatgaacatccctatagggatgggaacaagcgggcacatggtaggagcaactcttgttgccattgttttcggaagcccctgggctggagtactggttctcacactcgtgttgcttgtacagggtttcgcattcggagacggtggaatcaccaccatgggagcaaatatccttaacatgggcattatttccggctttgcaggatactatacatatctagctctccgcaagagtgcaggaacaagcattgcagccttcggaggcgcatggttaggacttttcgtttcatcaattgtttgcgccgtgcagatgtggcttgcaggcactttccctctggtacccgggcttatcgctatgggaactttccacctgataattggctttatcggggaagggctgatcacttcggtcgtgatcacggcgattgcaaaatcccgtcctgacctgcttgaaggcgggtacactgccagacctgagaaatccaagacggaggctcatgcatga

SEQ ID NO: 9091 - protein, 221 aa, Methanosarcina mazei Go1
MHIPDSFIPLSQAIVYWVISIPFIFMSMKWAKSELEEMKVPILAALAAGIFAIQAMNIPIGMGTSGHMVGATLVAIVFGSPWAGVLVLTLVLLVQGFAFGDGGITTMGANILNMGIISGFAGYYTYLALRKSAGTSIAAFGGAWLGLFVSSIVCAVQMWLAGTFPLVPGLIAMGTFHLIIGFIGEGLITSVVITAIAKSRPDLLEGGYTARPEKSKTEAHA

SEQ ID NO: 9092 - DNA, 672 bp, Chlorobium tepidum TLS
  CDS (1)..(672): transl_table=11
atgcacatcatggagggcttcctgccgccgggctggagcctgttctggtggctggtgtcgctgccgtttttcgtgctcggcttcatctccctgcgccggatcgtggcgagcaatccgcgcatgaagctgctgctggccatggcgggggcgttcgccttcgtgctctcatcgctcaagattccctccgtgaccgggagttgctcgcacccgaccggcgtcgggcttggggcgatcatgttcgggccgtcggtgatgagcgtgctcggcgcgatcgtgctgctcttccaggcgctgctgctggcgcatggtggcttgaccacgctcggcgcgaacgcattttcgatggcgattaccgggccgttcgtgtcatggggtttgtacaaacttttcgacagtttgcgctcgccgcgctggctgtcggtctttgtcgctgcttcgattggcgatctggcaacttacgtggtcacctcttttcagctcgccttcgcgttcccttccatcaccggcggcgttgtcgcttcggcggtcaagttcctcggtattttcgccatcacccaggttccgctcgccgtgagcgagggcatcctgacggtgatggtctataacgccatcatggcctacacgggtcaatcattctttggcgcgcagtcgctttccagggaggtgaagtga

SEQ ID NO: 9093 - protein, 223 aa, Chlorobium tepidum TLS
MHIMEGFLPPGWSLFWWLVSLPFFVLGFISLRRIVASNPRMKLLLAMAGAFAFVLSSLKIPSVTGSCSHPTGVGLGAIMFGPSVMSVLGAIVLLFQALLLAHGGLTTLGANAFSMAITGPFVSWGLYKLFDSLRSPRWLSVFVAASIGDLATYVVTSFQLAFAFPSITGGVVASAVKFLGIFAITQVPLAVSEGILTVMVYNAIMAYTGQSFFGAQSLSREVK

SEQ ID NO: 9094 - DNA, 717 bp, Thermosynechococcus elongatus BP-1
  CDS (1)..(717): transl_table=11
gtggtcacgacggcgagtagaggtggagtaatgcacattcccgatggtttagttccgcctctgtggtgcggactgggctacgccgctagcggtggcctcctctggtggtcttgccgccgtttacagcgggcgacggtggatacgctggcgatcgtcccccgtttagccttgttaacaggtgcttttttcactgcttccgctgtctatattccggtgccccccgccagtgtccatctcctattcctgggcagcttgggggtgcttttgggggaaggggcgatgatcgccgtggtggttgggttatttctacaggcagtcatgtttgggcatgggggcctgaccacccttggcctcaatgctctgatcatgggcataccagcactggtggcggcggctgtgtttcggggggtgtggcatcgctggccacccagggggcgatcgctcctggggttgcttctaggcagcggggcagtgttgttggcggttttcctctttagcgcagttgttatcctaagcttgccagccaccttagatcaacagcgggagtggttagcgattactgccatcgtgattgcccatctgccccttgctatcttggagggagtggttacggcttcactgctggtctttttggccaaagtcaagccagaattcctctcccaaggcctatcgttttccggtgaaaattctccttaccctactgccaaccctcgctga

SEQ ID NO: 9095 - protein, 238 aa, Thermosynechococcus elongatus BP-1
MVTTASRGGVMHIPDGLVPPLWCGLGYAASGGLLWWSCRRLQRATVDTLAIVPRLALLTGAFFTASAVYIPVPPASVHLLFLGSLGVLLGEGAMIAVVVGLFLQAVMFGHGGLTTLGLNALIMGIPALVAAAVFRGVWHRWPPRGRSLLGLLLGSGAVLLAVFLFSAVVILSLPATLDQQREWLAITAIVIAHLPLAILEGVVTASLLVFLAKVKPEFLSQGLSFSGENSPYPTANPR

SEQ ID NO: 9096 - DNA, 675 bp, Thermosynechococcus elongatus BP-1
  CDS (1)..(675): transl_table=11
atgcacatcagcgagggctttttgcccctgggttgggccgtgggttggtggctggcctttctcccctttttggcatggggactgtggtcattgcaacaacagatcaaacaacactccgaatccgtcctactggttgccttggcaggcgcctatgcctttgttgtttcttctttgaagattccctcggttacaggcagctgttcccatcctattgggattgccctgggggctattctttttcggccccccttaatggcagtattggggacactggtgttgctctttcagagcctcctcattgcccatggcggattgacgacactgggagccaacgccttctcaatggcggtcgtaggaccgtggttggcttggctcacctactgcggtgtgtctcgtttgagagtgaagccggcgatcgctctgtttgccgctagcttcatcagcaatgtgggtacttacaccttgacctctttgcaattggccttggcctttcccgacagcgtgggtggcctggccacttcctttgccaaatttggcaccctctttgcagtcacacagattcccctcgccatcagtgaagggctgctgacggtcttggtgtggaactggttgacgacctactgcgttgcagaactgcaggccttaagactcttgcctcaggaagagttgccctag

SEQ ID NO: 9097 - protein, 224 aa, Thermosynechococcus elongatus BP-1
MHISEGFLPLGWAVGWWLAFLPFLAWGLWSLQQQIKQHSESVLLVALAGAYAFVVSSLKIPSVTGSCSHPIGIALGAILFRPPLMAVLGTLVLLFQSLLIAHGGLTTLGANAFSMAVVGPWLAWLTYCGVSRLRVKPAIALFAASFISNVGTYTLTSLQLALAFPDSVGGLATSFAKFGTLFAVTQIPLAISEGLLTVLVWNWLTTYCVAELQALRLLPQEELP

SEQ ID NO: 9098 - DNA, 657 bp, Clostridium tetani E88
  CDS (1)..(657): transl_table=11
atgcatatagcggaaggatttttaccacctatgtggagtggagtatactttgtaatttccgcaccatttataattataggtcttaaacaaataagagaaagggcaaaggataataaagatattaaaatgcttttaggattagtggcagcatatgcatttatactttctgctatgaaaattccatcagtaactggaagttgttctcacccgacaggtacaggtctttcagcaataatttttgggccttttatatcagcaattgtaggacttatagtattaatttttcaagctatcttactagctcatggtggaataacaaccttaggtgctaatacattatcaatgggaattatgggacctatagtatcatatttaatttacagaggatttaaaaataaaaatcaaaaggttgcagtatttttagcagcaactttaggggacttatttacgtattttattacctcagtacaacttgctttagcattcccagctcaacaaggaggaatagcagcatcctttgcaaaatttttctcaatattttctataacacaaattcctttagctataatggaaggaatattaacggttataatatttgaatttgtaatgaaatacgcatcaaaggaaatagaagtattaggtggtgttagaaaatga

SEQ ID NO: 9099 - protein, 218 aa, Clostridium tetani E88
MHIAEGFLPPMWSGVYFVISAPFIIIGLKQIRERAKDNKDIKMLLGLVAAYAFILSAMKIPSVTGSCSHPTGTGLSAIIFGPFISAIVGLIVLIFQAILLAHGGITTLGANTLSMGIMGPIVSYLIYRGFKNKNQKVAVFLAATLGDLFTYFITSVQLALAFPAQQGGIAASFAKFFSIFSITQIPLAIMEGILTVIIFEFVMKYASKEIEVLGGVRK

SEQ ID NO: 9100 - DNA, 987 bp, Lactobacillus plantarum WCFS1
  CDS (1)..(987): transl_table=11
gtgcatattccggataattatttaagtcccgcaacttgcggaacgttggtcaccgcgatggctcccgtctggaccgtcgccgttttaaaagttaaagttcaaatcaaaaaacatcatgaaaccctgccaatgctcggcatcgccgcttcattggcttttttaattatgatgttcaacttgccgattccaggtgggaccacggctcacgctgtcgggggaaccctgttagctgtcttgattggcccatgggcggcgtgtcttgcgctgaccgtgacgttactactacaagccttattattcggtgatggcggtatcctagcctttggcgctaacgcgttgaatatggcggtcattatgccgtttgtcggctacgcctgctatcgcctaggtcaaaaatggcaccatgaaaagttggggctcgcaattggtgcttacttaggcattaatatggcggcgctagttgctggtatcgagctcgggttacaacccatactggctcatacggcaagtggtgcgccgctctactgcccatacggcctcaacattacgatacccgcaatgttgacggctcacttattagtcgccggctgggtcgaagtcgtcttcacactgcttgtctttcaatttgtaaaacgagtcgcaccgactaacctctatcagacacccactcggcgcaatcagcggccgtggatcgcactgctactcggattagcggtgttatcaccattaggcttgttggctagcaatacggcttggggcgaatggagcccccaagaattacagcaacggctagcgcaacaacatatcagtactcacgcgcctcaaggaatggtccacgggttccattttcaggccctgttcagtgattacgccatcgcgggcttaccggttagtgtaggttatattttatcggccattaccgctgttttgattttcttacttttgattcgaggtcttcaacatgaaaccgacacgtcccaacactga

SEQ ID NO: 9101 - protein, 328 aa, Lactobacillus plantarum WCFS1
MHIPDNYLSPATCGTLVTAMAPVWTVAVLKVKVQIKKHHETLPMLGIAASLAFLIMMFNLPIPGGTTAHAVGGTLLAVLIGPWAACLALTVTLLLQALLFGDGGILAFGANALNMAVIMPFVGYACYRLGQKWHHEKLGLAIGAYLGINMAALVAGIELGLQPILAHTASGAPLYCPYGLNITIPAMLTAHLLVAGWVEVVFTLLVFQFVKRVAPTNLYQTPTRRNQRPWIALLLGLAVLSPLGLLASNTAWGEWSPQELQQRLAQQHISTHAPQGMVHGFHFQALFSDYAIAGLPVSVGYILSAITAVLIFLLLIRGLQHETDTSQH

SEQ ID NO: 9102 - DNA, 1056 bp, Streptomyces avermitilis MA-4680
  CDS (1)..(1056): transl_table=11
atgcatgtgcctgacggattcatcaacgccccggtctccgcggtctccggagtggtcgccgccggcgccatcgccgtgagcctgcgcggtgcccgccgtgaactggacgagcggaccgccccgctcgccggtctggtcgccgcgttcatcttcgccgtacagatgctgaacttcccggtcgcggccgggaccagcggacatctgctcggcggtgcgctcgccgcgatactcgtcggccccttcaccggggtgctgtgcgtgtcggtcgtcctgctgatgcaggggatcctgttcgccgacggcggtctcaccgcgctcggcgtcaacatcaccgacatggcgatcgtcacgaccgtcgtgtcctacgccgtcttccgcggcctcgtgaaggtgctcccccgcaagcgacgctccgtcacggtcgccgccttcgtctccgcgctgctgtcggtgccggccgccgccgtcgccttcaccctcttctacgcggtcggcggcaccacagacatcgcgatcggcaaggtcgccaccgccatgatcggcgtgcatgtgctcatcggcatcggcgaggccgcgatcaccgccctcaccgtcggcgccgtcatcgccgtacggccggatctcgtccacggggcccgcgggctccagcagcgtctgaagctgcgggtcggcggcgatctggtggacgcgcccgccgcgcccgccgcccccgcgacccccgtcgccgcccgcacctcgcaccgcaaggtgtggatcaccggcctcgtcacctccctcgtcctcgccgggttcgtcagcttctacgcctccgccagccccgacggcctggagaaggtcgccaaggaccagggcatcgacgccaaggccaagaagcaccacaccgaggactccccgctcgccggctacggcgtcaaggacgtctccgacgcccggatctccggcggtctcgcgggcgtgatcggcgtcggcatcaccgtcgtcgcgggcaccggcgtcttctgggccgtccgcaggcggcgcaccgtcgacgcctcccccgtgaacacgagcgtctga

SEQ ID NO: 9103 - protein, 351 aa, Streptomyces avermitilis MA-4680
MHVPDGFINAPVSAVSGVVAAGAIAVSLRGARRELDERTAPLAGLVAAFIFAVQMLNFPVAAGTSGHLLGGALAAILVGPFTGVLCVSVVLLMQGILFADGGLTALGVNITDMAIVTTVVSYAVFRGLVKVLPRKRRSVTVAAFVSALLSVPAAAVAFTLFYAVGGTTDIAIGKVATAMIGVHVLIGIGEAAITALTVGAVIAVRPDLVHGARGLQQRLKLRVGGDLVDAPAAPAAPATPVAARTSHRKVWITGLVTSLVLAGFVSFYASASPDGLEKVAKDQGIDAKAKKHHTEDSPLAGYGVKDVSDARISGGLAGVIGVGITVVAGTGVFWAVRRRRTVDASPVNTSV

SEQ ID NO: 9104 - DNA, 600 bp, Wolinella succinogenes DSM 1740
  CDS (1)..(600): transl_table=11
gtgcatatctccgaaggtgtcctcagcgcccccttactagtggggggctgggcgcttagcgccccttttgtggtttacgctctcaaaacgcttgaagcccaaaagattcctctagtggcttctatgtcggccctcttttttgtcggctcctttattcatatcccctttggcgtgaccaatattcatctggtgctcagcggaatcattggtgcaatgattggactagaggcttttttggcgcttttggtggcgctctttttgcaggcgattctctttggctatggaggcttgggggttcttggggtgaatctctccattatggcgcttcccgctcttttggctagaactatttttctctacactaggctctatacaaggcgaagcttgggctattttttagttgggtttacttcgattctcctctcttcgattcttctctccttggtgctttatatcgagggtgaagggtttaaaagtgcggctttggcagtgtttgctctcaatattcctttaatgggcatagaggggttcatcacctacttggccctctcctttttggagcgctaccgccccacacttttagagaggatggcgcgatga

SEQ ID NO: 9105 - protein, 199 aa, Wolinella succinogenes DSM 1740
MHISEGVLSAPLLVGGWALSAPFVVYALKTLEAQKIPLVASMSALFFVGSFIHIPFGVTNIHLVLSGIIGAMIGLEAFLALLVALFLQAILFGYGGLGVLGVNLSIMALPALLARTIFLYTRLYTRRSLGYFLVGFTSILLSSILLSLVLYIEGEGFKSAALAVFALNIPLMGIEGFITYLALSFLERYRPTLLERMAR

SEQ ID NO: 9106 - DNA, 693 bp, Gloeobacter violaceus PCC 7421
  CDS (1)..(693): transl_table=11
atgcacattccggatgggtttttgagcctgcccgtctgcctggccatgggtctggtgtctctggtgatcttgggcatcgccctgcgccaggtcgagcgccagttcgccgaccggctggtgcctttgatgggcgtgagcgccgcctttatcttcgcggcccagatgatcaattttccggtgctcgggggcaccagcggtcacctgttgggcggcacgctggccggggtgctgctcggtccctgggccggtacgctcgcggtgatggtcgtcttcggagtgcaggcgctgctgtttcaagatggcggcatcgtcgccttgggcgccaatctattcaacatgggcttcgtgggaacgtttttgggctactacctttaccggggtctgcgcacgctgcttggaggaacaagctggctggccacagccaccggcacggccgtggccagttgggtgagcgtggtgacggcctcggccctggtggctgtgcagctggccctctccggcaccgtgaacctagctgttgtgctgcccacgatggtcggggtgcacgcgctgatcggcatcggcgaagccatcctcaccgtcggcgtcgtgagcttcctgtggcgcacgcggcccgatttaatcttcgagccccccgcgcccccactcctcgaagcggttcaacccgtcaaggaatcgatccgtgggcgctag

SEQ ID NO: 9107 - protein, 230 aa, Gloeobacter violaceus PCC 7421
MHIPDGFLSLPVCLAMGLVSLVILGIALRQVERQFADRLVPLMGVSAAFIFAAQMINFPVLGGTSGHLLGGTLAGVLLGPWAGTLAVMVVFGVQALLFQDGGIVALGANLFNMGFVGTFLGYYLYRGLRTLLGGTSWLATATGTAVASWVSVVTASALVAVQLALSGTVNLAVVLPTMVGVHALIGIGEAILTVGVVSFLWRTRPDLIFEPPAPPLLEAVQPVKESIRGR

SEQ ID NO: 9108 - DNA, 1032 bp, Geobacter sulfurreducens PCA
  CDS (1)..(1032): transl_table=11
atgcacatggcggatgcgcttatttcaccggcggtcgggggagtcctgtgggcggccacggccggtaccgttgcctggagttgccgcagggtgcggcaggagctcgatgagcggaaggtgccgctcatgggtgtcctcggcgcattcgtatttgcagcgcagatgatcaacttcaccattccgggaaccggatccagcgggcaccttgggggggcattgctgctggctgtgctgctgggaccccatgccgcgtttctgaccattgcatcggtgctggtggtccaagccctgttctttgcggatggcgggctgttggcgctcggatgcaatattttcaatctcggcttctttcccgcgttcattgcctatcccttcatctaccgcgtgattgcgcctcccggctcgggccaggggcgagtcacggcggcatcgctggccgcagcggtcaccggcctgcagctcggcgcctttgctgtggtgctcgagacggttgcttccggcatttcggcgcttcccttcacctcctttgtgcttctcatgcaaccgatccatcttgccatcggcgcggtggaggggctcgtcaccgcggcggtgatcggtttcgtgagccgtgttcaccccgagatcaccggtttgcccacgttctttccggaacggggctccgcttccggcctccggggggtactgctgaccctgggggtaatggcactgctcactggcggtatcgtctcctggttcgcatcggagaatcctgacgggctcgaatgggccatcagccgggtgaccggttccgatgagctcgcagcaccccgcgatggtttccatggcacggcagcctcgatccaggagaaggttgcgttcctgcccgactattcctttcccgcccccgcagttcatgatgtctcccatgctgccgcctcagccggcagcggcaggctcggtacttcggtgtcaggggttgtagggggggcgctgacgctgggcgtcgcgttcctcattggcctgatcctgcgccaccgggcgtcttcgtaa

SEQ ID NO: 9109 - protein, 343 aa, Geobacter sulfurreducens PCA
MHMADALISPAVGGVLWAATAGTVAWSCRRVRQELDERKVPLMGVLGAFVFAAQMINFTIPGTGSSGHLGGALLLAVLLGPHAAFLTIASVLVVQALFFADGGLLALGCNIFNLGFFPAFIAYPFIYRVIAPPGSGQGRVTAASLAAAVTGLQLGAFAVVLETVASGISALPFTSFVLLMQPIHLAIGAVEGLVTAAVIGFVSRVHPEITGLPTFFPERGSASGLRGVLLTLGVMALLTGGIVSWFASENPDGLEWAISRVTGSDELAAPRDGFHGTAASIQEKVAFLPDYSFPAPAVHDVSHAAASAGSGRLGTSVSGVVGGALTLGVAFLIGLILRHRASS

SEQ ID NO: 9110 - DNA, 1041 bp, Geobacter sulfurreducens PCA
  CDS (76)..(1041): transl_table=11
atgaaacgaattaccttatatgctgccggttcggcaatcattggcgcaatgctgctggccgggcccgcccacgccatgcacatctccgagggaatcctccccctggggtgggcggcgctctggttcgccgtggcggcgccctttctggccctgggaattcggcgggtgaacgagctgtcccgccacgatctctccttcaagcccctggtgggactcatggcggcggtggtattcatcatctcctgcatgccgattccggtgcccaccgccggtacctgctcccatccctgcggcacggggatcgccgcgatcctggtggggcccctggtcagcgtggtcatcaccacggtagcgctcctcatccaggccctctttctggcccacggcgggctttcaacgctcggcgccgacgtggtgtccatgggggtggcgggctcctttgccggctggttcgtcttccggggcatgcgccggctgggcgcgggccttgcggtggccgcctttgtcgccgggctgctggcagactgggccacctacctgaccactgccctggagctgtcctcgggcgtgcgcgggagtgagccgttttacccgctgttcttgaagatcgttgccgcctttgtcccgacccagcttcctctcggcgtgctggaaggggccatgaccgccggtatggtggtcctgctccaccgcaagcgccccgatctgctggcgaaaatgggggtggtcgatgccggtggcccgggagccggtccccgccgggcaaccgtggtcatgctggcgctgttttgcctgctcgcctcgctccttgtggcgggaccgtcgcgcgcatcggaaaaatggcctggcgtggacgaaaccgttgtggaaaagattgccgcggaacacggccgtgaaccgcgggaccccctcatcaataccgaccagggtgacctgcttctcttcgtttttctgctggccggcacagtcgggggctttgcggcgggctatttctggcgtatgctggtggcggaacggagaacgtacgatgaccatacttga

SEQ ID NO: 9111 - protein, 321 aa, Geobacter sulfurreducens PCA
MHISEGILPLGWAALWFAVAAPFLALGIRRVNELSRHDLSFKPLVGLMAAVVFIISCMPIPVPTAGTCSHPCGTGIAAILVGPLVSVVITTVALLIQALFLAHGGLSTLGADVVSMGVAGSFAGWFVFRGMRRLGAGLAVAAFVAGLLADWATYLTTALELSSGVRGSEPFYPLFLKIVAAFVPTQLPLGVLEGAMTAGMVVLLHRKRPDLLAKMGVVDAGGPGAGPRRATVVMLALFCLLASLLVAGPSRASEKWPGVDETVVEKIAAEHGREPRDPLINTDQGDLLLFVFLLAGTVGGFAAGYFWRMLVAERRTYDDHT

SEQ ID NO: 9112 - DNA, 594 bp, Treponema denticola ATCC 35405
  CDS (1)..(594): transl_table=11
atgcatatatccgatggaggattatcgacggcggtttgtgccgtaggttatgcggcaagtgcggtaggaattgcctttgccgtcaaaggaacaaaagaagaggatatcccgaaaataagtcttatggcgggaactttttttgctatttcattgattatgattccgataccgccgagctcggttcatccgctcatgtgcggactgataggaattattgtagggcgtagggcgccccttgcattttttcccgcactgctgctgcaagcccttttatttcaacacggcgggattacaaccctcggagctaacactctgatgctttctatttcttcaatattatctgcaattattttttataattggaaaagcgataatgtgcttttaaagggaatggttgtaggagccttgtctgttatctttgttgttttggttttatcggttcttcttatgacgggcggaagttttgcaaaagaaacatttatagctatctttgtttctcattccgtagttatggcggtcgaggctgtaattaccggttttgccgtcaagcttatgatgaaggcgaggcccgattggtttaaacggaatttatag

SEQ ID NO: 9113 - protein, 197 aa, Treponema denticola ATCC 35405
MHISDGGLSTAVCAVGYAASAVGIAFAVKGTKEEDIPKISLMAGTFFAISLIMIPIPPSSVHPLMCGLIGIIVGRRAPLAFFPALLLQALLFQHGGITTLGANTLMLSISSILSAIIFYNWKSDNVLLKGMVVGALSVIFVVLVLSVLLMTGGSFAKETFIAIFVSHSVVMAVEAVITGFAVKLMMKARPDWFKRNL

SEQ ID NO: 9114 - DNA, 639 bp, Methanococcus maripaludis S2
  CDS (1)..(639): transl_table=11
atgcacataccagatggatttatcccattgtgggaaagcgggattttttgggtaatttccctgatatttttaagcatgtccttaaggtgggcgtcaaaggaaatgaatgaaaaaacagttccactatttactgcacttgcagcaggtatttttgcaattcaagcaatgaacatgccaataccttggggaaccagtggacacatggttggtgcagcactaaccgcgatagtatttgatagcccctgggctgctgtattaatgttagctcttgttttaattgttcaaggattattctttgcagacggtggtttaatcgtcatgggtacaaacatctttaacatgggggttgttggcggatttgtaggatactacttgttcaaagcactgaaaaaaacaaacttccacgcagcggtatttactgcaggatgggctgcaacatttttagcatcgattgcatgtgcggtagaacttgcaattgcaggaacattcccaattgaccttggaattcaatttatgggtctttaccacgcagttatcggtattatcgaaggattaattactgcaatagtagtaggctacctcgcatcagctcgaccggatcttgtaaagagcgtaaaaaaggtggtttcaaatgaataa

SEQ ID NO: 9115 - protein, 212 aa, Methanococcus maripaludis S2
MHIPDGFIPLWESGIFWVISLIFLSMSLRWASKEMNEKTVPLFTALAAGIFAIQAMNMPIPWGTSGHMVGAALTAIVFDSPWAAVLMLALVLIVQGLFFADGGLIVMGTNIFNMGVVGGFVGYYLFKALKKTNFHAAVFTAGWAATFLASIACAVELAIAGTFPIDLGIQFMGLYHAVIGIIEGLITAIVVGYLASARPDLVKSVKKVVSNE

SEQ ID NO: 9116 - DNA, 678 bp, Methanococcus maripaludis S2
  CDS (1)..(678): transl_table=11
atgcacattatggaaggttttttgcctccgatgtgggccgcattttggtttgtactctctggaattgttgttatatatggaataatccagttaaataaattaataaacaataaacctgaagttaaacctacattagccctcgcaggagcatttatgttcatattaagttcgctaaaacttccttcagttacaggaagctgttcacacccaacaggtggtggactaggcgcaatcatgtttggtcccgcaattacagcggtactcgcaacaattgtattattgttccaggcaatcttacttgcacacggtggattaaccacattaggagcaaatatattttcaatgggtattatgggcccagcaattggttttttagtgtttaaattgttaaaaggaaaattaaatatcacatgggttgttgtactcgctgcaatatttgcagactggggaacatacgctactacatcagtacagctcgcgttagcatacccactaccagattttggaacggctcttgcaaactttggaaccgtatttgcagtaacacaaattccacttgcaattatggaaggtctattaacaggacttatctgggattacattatgaaattaagacccgatctccttgcaaaacttggtcttattgaccttgaaaaagcaaaaggaggtgctgaataa

SEQ ID NO: 9117 - protein, 225 aa, Methanococcus maripaludis S2
MHIMEGFLPPMWAAFWFVLSGIVVIYGIIQLNKLINNKPEVKPTLALAGAFMFILSSLKLPSVTGSCSHPTGGGLGAIMFGPAITAVLATIVLLFQAILLAHGGLTTLGANIFSMGIMGPAIGFLVFKLLKGKLNITWVVVLAAIFADWGTYATTSVQLALAYPLPDFGTALANFGTVFAVTQIPLAIMEGLLTGLIWDYIMKLRPDLLAKLGLIDLEKAKGGAE

SEQ ID NO: 9118 - DNA, 1059 bp, Clostridium thermocellum ATCC 27405
  CDS (1)..(1059): transl_table=11
atgcatatggctgatgctctaatttcaccggctgtgggcggaaccatgatggctgttactgccggagttgcagcctactcagtcaataaaataaaacaagacatggacgaaaagaaaattccgttgatgggggtcatgggagcatttgtgtttgccgcccagatgattaacttttcaataccgggaacgggctccagcggtcatcttggagggggaatgcttcttgccgtgttgcttgggccatacgcgggatttttaaccatggcgtcgattttgctgattcaggcattgttcttcggggacggtggactgcttgcctacggctgcaatgtattcaatttgggctttttcacctgttttatatcctatccctgtgtctataaatggattacccgaaagggcataaattcaaaaagaatctttttggggtcgctgatatcatccataatcggacttcaaatgggttctttcagtgttgtaatcgagacgcttttgtcaggaaaaacggagctgcctttcggaagctttgtattgctgatgcagcctatacatcttgcaatcggagtagttgaaggtcttgtaacggcggcggttgtcattttcgtctggagaacaagacctgaattgtttgaaggagcggacgaaggaaaagtacaggacggtatatctgtaaaaaagcttttggctgtgttctcagttgccgccataattgtcgggggtgttctttcctggtttgcatcatcggctcctgacggtcttgaatggtctgttgaaaagacagcaggaacagctgaattggaagtccagggcgaaatttatgaaacattgtcgcagatacagcagaaaaccgcttttttaccggattatgattttaaagcaagatatagtgaaagccgggaagcttcagataatgaagatgccgggaaagcttggcctaatgcaaatttggggaccagtgtttcaggtattgtcggaggagtattgactcttgcgtttacggtattcattggttttgcaattaacatacttaaaagaatgaagaaaaatgcaactgcgtaa

SEQ ID NO: 9119 - protein, 352 aa, Clostridium thermocellum ATCC 27405
MHMADALISPAVGGTMMAVTAGVAAYSVNKIKQDMDEKKIPLMGVMGAFVFAAQMINFSIPGTGSSGHLGGGMLLAVLLGPYAGFLTMASILLIQALFFGDGGLLAYGCNVFNLGFFTCFISYPCVYKWITRKGINSKRIFLGSLISSIIGLQMGSFSVVIETLLSGKTELPFGSFVLLMQPIHLAIGVVEGLVTAAVVIFVWRTRPELFEGADEGKVQDGISVKKLLAVFSVAAIIVGGVLSWFASSAPDGLEWSVEKTAGTAELEVQGEIYETLSQIQQKTAFLPDYDFKARYSESREASDNEDAGKAWPNANLGTSVSGIVGGVLTLAFTVFIGFAINILKRMKKNATA

SEQ ID NO: 9120 - DNA, 753 bp, Clostridium difficile 630
  CDS (1)..(753): transl_table=11
atgaaacagaatattaaattaggggttatagctgcacttatgttaatcattttaactccagttacatcaaatgcaatgcatataatggaaggttacttaccagtaaaatggtctatagcatggggagttatatttataccatttttcttattcggattaaaatcaataggtaaaatagtaaagcaagaccctaaaaagaaagtattattagctttatgtggagcatttgtgtttgtattatcagcactaaaaataccttcagtaacaggaagttgttcacatcctactggtgtaggtcttggagcaataatgtttggaccaagcgtaatgtttgttcttggaactatagttttaatattccaagcattgttattagcacatggaggaataactactttaggagctaatgctttttcaatggcgataatagggccaatcgtatcattcctaatatttaaggctttaaagaaaaaagatggaaataatgctattccagtatttcttgcagcagcaataggagacttagccacatatacaataacttcaatacaattagcactggctttcccagacccatcaggtggggtaatggcttcagcaattaaatttttaggaattttctttatgactcaaataccaatagcaatagcagaaggtatacttactgtaattgtatataatttaattacagaaaacggagaaaaaagcatactagaaaataatgataaaggagttaaagctaatgagtgctaa

SEQ ID NO: 9121 - protein, 250 aa, Clostridium difficile 630
MKQNIKLGVIAALMLIILTPVTSNAMHIMEGYLPVKWSIAWGVIFIPFFLFGLKSIGKIVKQDPKKKVLLALCGAFVFVLSALKIPSVTGSCSHPTGVGLGAIMFGPSVMFVLGTIVLIFQALLLAHGGITTLGANAFSMAIIGPIVSFLIFKALKKKDGNNAIPVFLAAAIGDLATYTITSIQLALAFPDPSGGVMASAIKFLGIFFMTQIPIAIAEGILTVIVYNLITENGEKSILENNDKGVKANEC

SEQ ID NO: 9122 - DNA, 738 bp, Klebsiella pneumoniae subsp. pneumoniae MGH 78578
  CDS (1)..(738): transl_table=11
atgaatcaggtgaaatcgctgaagcagctttcgtatggggggctggcggccgctgttctgctgatcatcgtcccgcaggaggcgttcgccatgcatatcatggagggctttttgccgccgatgtgggcgctggcgtggtggctgctgtttttaccctgcctgtggtacggcctggtgcgcctgcggcgtatcgttcaggaagagagcaatcagaaggtgctgctggccctctgcggggcgtttatttttgttctttcggcgctgaagatcccgtcggtgaccggcagctgctcgcatccgaccggcgtcggtctggcggtgatcctcttcgggccgggcgtggtggcggtgctgggggcgatcgttctgctgttccaggcgctgctgctggcgcatggcggcctgaccacccttggcgccaacgggatgtcgatggcggtgatcggcccgatggtcggctatctggtgtggaagctggcctgtcgggcggggatccgtcgcgatgtcggggtctttctctgcgccatgctggcggatctgatgacctactttgtcacctccgtccagctcggggtggcttttcccgatccggcaaccggggcaggcggatcgatcgccaagtttatgggcatcttctgcctgacgcagatcccgatcgccatcgcggaaggcttgctcaccgtgatgatctacgatcagctaaccaaacggcgactgatcgccgcggagggacattaa

SEQ ID NO: 9123 - protein, 245 aa, Klebsiella pneumoniae subsp. pneumoniae MGH 78578
MNQVKSLKQLSYGGLAAAVLLIIVPQEAFAMHIMEGFLPPMWALAWWLLFLPCLWYGLVRLRRIVQEESNQKVLLALCGAFIFVLSALKIPSVTGSCSHPTGVGLAVILFGPGVVAVLGAIVLLFQALLLAHGGLTTLGANGMSMAVIGPMVGYLVWKLACRAGIRRDVGVFLCAMLADLMTYFVTSVQLGVAFPDPATGAGGSIAKFMGIFCLTQIPIAIAEGLLTVMIYDQLTKRRLIAAEGH

SEQ ID NO: 9124 - DNA, 594 bp, Desulfococcus oleovorans Hxd3
  CDS (1)..(594): transl_table=11
gtgcatatttctgaaggtattttatcgtggccggtgctggccgggtgcggggccgtggccctggccggcactgccgtgggaatccggaaactggaccctgaaaagattccccgcaccggcatgctgtcggcggcctttttcgtggcatcgctgatccatgtgccgctggggccttccagtgttcacctgatattaaatggcatggtcggtctgatcctggggtggagtgcctttcccgccatctttgtcgccattctgctgcaggcggtgctgtttcagtacgggggcatcaccacgctgggggtcaacacgatgatcatggcggttccggcgctgttgagctattatcttttccgtccctttgccggaagaggagattctctggtgtttgccggcgcctttttgtgcggcatggttgcggtgctgaccggcgggtttctggccgcggtggtgctgatctggtccgaggagcggttccttgaagtggccctgctgattgttaccgctcatctgccggttatggtggcggaaggcctgatcacagggtttgcggttctttttttgaaaaaggtcaagccggacctgcttgaataa

SEQ ID NO: 9125 - protein, 197 aa, Desulfococcus oleovorans Hxd3
MHISEGILSWPVLAGCGAVALAGTAVGIRKLDPEKIPRTGMLSAAFFVASLIHVPLGPSSVHLILNGMVGLILGWSAFPAIFVAILLQAVLFQYGGITTLGVNTMIMAVPALLSYYLFRPFAGRGDSLVFAGAFLCGMVAVLTGGFLAAVVLIWSEERFLEVALLIVTAHLPVMVAEGLITGFAVLFLKKVKPDLLE

SEQ ID NO: 9126 - DNA, 738 bp, Salmonella enterica subsp. arizonae serovar 62:z4,z23:--
  CDS (1)..(738): transl_table=11
atgaaacttgaacaacagctcagacagttgtctttcagtggactggctgcggcgctattgctgatggttgtccccgaacaggcgtttgcgatgcatatcatggagggatttttaccgccagtgtgggcgctggcctggtggttactgtttttaccctgcttgtggtatgggctggtgcgcttacggcgtattgtgcaggaggataatcatcagaaggtactgctggcgctgtgcggcgcgtttatttttgtcctgtccgcgctcaaaattccgtcggtaacggggagttgttcacatccgaccggcgttggtctggcggtcatcttgttcgggcccggggtggtggcgattctcggcgcggttgtgctgttgtttcaggcgctattgctggcgcacggcggcctgacgacgcttggcgcaaacggaatgtcgatggcggtgattggcccggttgtcggttatctggtgtggaaaatggcctgccgtgccggactgcgccgcgatgtcgccgtttttctgtgtgcgatgctggcggatttggcgacctattttgtgacttcagtccagcttggcgttgcgtttcccgatccccatgccggagcgacagggtctgttgtgaagtttatggggattttctgcctcacacagattgctgtcgccattgccgaaggtttattaaccgtcatgatttatgaccagttaaccaaacggcaagtgattaccgtacaaggacattaa

SEQ ID NO: 9127 - protein, 245 aa, Salmonella enterica subsp. arizonae serovar 62:z4,z23:--
MKLEQQLRQLSFSGLAAALLLMVVPEQAFAMHIMEGFLPPVWALAWWLLFLPCLWYGLVRLRRIVQEDNHQKVLLALCGAFIFVLSALKIPSVTGSCSHPTGVGLAVILFGPGVVAILGAVVLLFQALLLAHGGLTTLGANGMSMAVIGPVVGYLVWKMACRAGLRRDVAVFLCAMLADLATYFVTSVQLGVAFPDPHAGATGSVVKFMGIFCLTQIAVAIAEGLLTVMIYDQLTKRQVITVQGH

SEQ ID NO: 9128 - DNA, 615 bp, Desulfovibrio vulgaris subsp. vulgaris str. Hildenborough
  CDS (1)..(615): transl_table=11
atgcacatctccgaaggggttcttcccgcctccgtcctgctgggcggggcagcacttaccgcagccggcacggccctggggttgcggcgcatcgactgggacagggtgatgaccgtggcactgctcgccgccgcctttttcgtcgcctctctcatccatgtgcctgtcggccctgtgagcgcccatctcgtcctcaacgggctcatcggcgtgattctcggctgggcagccttccccgccattctcgtggccctgctgcttcaggccctgctcttccagttcggcggtctgctggtgcttggcgtgaacaccttcaacatggccctgccgcctgtcatctgccactatctcttccgcaaggcgctcacgggcacctccacgccgcgcacgggtgcggccttcgcctgcggcttcctctccgtgctcctttccgcatcgctcaccgccctgtccctcggtcttgccggtgagggcttcatcccggcggcgcagtcgctgctcatcgcccatcttcccgtcatggtcgtcgagggctgcatcaccgcccttgtcatcgggttcctctacaaggttcgtcccgaagtgctcgacttctcggcacaggcgacccgctag

SEQ ID NO: 9129 - protein, 204 aa, Desulfovibrio vulgaris subsp. vulgaris str. Hildenborough
MHISEGVLPASVLLGGAALTAAGTALGLRRIDWDRVMTVALLAAAFFVASLIHVPVGPVSAHLVLNGLIGVILGWAAFPAILVALLLQALLFQFGGLLVLGVNTFNMALPPVICHYLFRKALTGTSTPRTGAAFACGFLSVLLSASLTALSLGLAGEGFIPAAQSLLIAHLPVMVVEGCITALVIGFLYKVRPEVLDFSAQATR

SEQ ID NO: 9130 - DNA, 651 bp, Listeria monocytogenes str. 4b F2365
  CDS (1)..(651): transl_table=11
atgcatattatggagggctttttaccagttaaatgggctgtcttttggttcattgtatttatcccattccttgtacttggtttaattcgtattcgtaaattaattgccctagataaaaacaacaaattactgttggcactatgcgcagcctttatctttgttctttcagcgcttaaaattccgtccgttacaggatcttgttctcatccgactggtgttggccttgcaactgttatgttcggaccgctcgttgtcagtgtacttggtgtgattgtcttacttttccaagcgttactacttgcacacggcggtattacaactcttggcgcaaacgcaatgtcgatggcggttatcggtccaatggttggttttgtcgtatacaaactcgctcgtaaattaaactgtaataaaagtgtttcgattttcttatgtgcgatgacagctgacttagcaacctacttaactaccagcgtccagctcggagtcgttttcccagatccagcatccggcatgatggcatccattctgaagttcatggcgattttctgtgtgacacaagttccaattgcgattgcagaaggattgctaacggtagtcatgtacaatcttattagcaaaaatttaccagaaaaggtggcacaattacgatga

SEQ ID NO: 9131 - protein, 216 aa, Listeria monocytogenes str. 4b F2365
MHIMEGFLPVKWAVFWFIVFIPFLVLGLIRIRKLIALDKNNKLLLALCAAFIFVLSALKIPSVTGSCSHPTGVGLATVMFGPLVVSVLGVIVLLFQALLLAHGGITTLGANAMSMAVIGPMVGFVVYKLARKLNCNKSVSIFLCAMTADLATYLTTSVQLGVVFPDPASGMMASILKFMAIFCVTQVPIAIAEGLLTVVMYNLISKNLPEKVAQLR

SEQ ID NO: 9132 - DNA, 684 bp, Propionibacterium acnes KPA171202
  CDS (1)..(684): transl_table=11
atgcatatcgctgagggggttctctcgccggctcaatgtgcggtttggtatgccgcagctgcaccgttcgtcgttcatggcggataccgggtcgttaaagaggtcaaggagcaccctgaaaacaagcttctgctagctaccgcgggcgctttcacctttgtgctctcggctatcaaactgcccagcgttacgggatcgtcctcgcaccccaccggaacaggagttggggcggcactgttcaaaccgcctgtcatggccttcctggggatgatcgtgctcatcttccaggccctgctcctggcccacgggggaatttccaccctgggagccaatactttctcgatggctatcgcgggaccgtgggctgggtacgccttttacaagctcaccaagaaacttcgcgggcctgacgcgttagcgatcttcctgtgtatggtcttctccgacttcatcacctacgtcgtgactagcttccagctggcttttgccttcccggatgcaaccggtggcttctggggagctgtcggtaagttcctcggcatcttcgccataacccaagttccgctggctctcatagagggtctcgtcggcatcctgttgttccgtttccttgccaaggtcgccgccccgcagctcaaacagctcggcgtcctcgatgacaacccggaggtggctcatgcctga

SEQ ID NO: 9133 - protein, 227 aa, Propionibacterium acnes KPA171202
MHIAEGVLSPAQCAVWYAAAAPFVVHGGYRVVKEVKEHPENKLLLATAGAFTFVLSAIKLPSVTGSSSHPTGTGVGAALFKPPVMAFLGMIVLIFQALLLAHGGISTLGANTFSMAIAGPWAGYAFYKLTKKLRGPDALAIFLCMVFSDFITYVVTSFQLAFAFPDATGGFWGAVGKFLGIFAITQVPLALIEGLVGILLFRFLAKVAAPQLKQLGVLDDNPEVAHA

SEQ ID NO: 9134 - DNA, 630 bp, Desulfotalea psychrophila LSv54
  CDS (25)..(630): transl_table=11
gtgttactttcttggaggcattatatgcatatatctgaaggcgtcctcagcccaccggttttagccctgggtggagtaattaccgttgccggcacggccatgggtctaaaacatctcgacggtgaaaagatcatgaccaccgccctccttacttcaacattttttgttgccagcctgatccacgttcccgtcggccccgccaatgtccacctcattctctccggcctgatgggaattaccctgggctgggcctgctttcccgctatcctcaccgccctttttctccaggtcctcttttttcaatatggaggatttaccgtactcggggtcaacaccgccaatatggcagtaccggcaattatctgctacctcctctttcgccccctcctgacatcggggaaaaaggggcagaaagtagcagcctttgccagtggttttattgccgtactcctaggcaccctctttatggcgggctctctctttgccagcgatcagcaatttttcaatacagcaaagctggtctgcatagcccacattcctctaatgttcatcgagggaatcatcaccatgtttgccgtcacctttcttgccaaggtgcaacctgaatttctccaactcaagaccaaatga

SEQ ID NO: 9135 - protein, 201 aa, Desulfotalea psychrophila LSv54
MHISEGVLSPPVLALGGVITVAGTAMGLKHLDGEKIMTTALLTSTFFVASLIHVPVGPANVHLILSGLMGITLGWACFPAILTALFLQVLFFQYGGFTVLGVNTANMAVPAIICYLLFRPLLTSGKKGQKVAAFASGFIAVLLGTLFMAGSLFASDQQFFNTAKLVCIAHIPLMFIEGIITMFAVTFLAKVQPEFLQLKTK

SEQ ID NO: 9136 - DNA, 615 bp, Thermococcus kodakarensis KOD1
  CDS (1)..(615): transl_table=11
ttgcacattcctgacggactgttaagcacgcccgtgatagtggtgacgtacgcgataacgatactggctgttgcgtactcttccagaaagctgaaggaggttccagaagagaaaatccctctcctcgggctcttcgcggccggcatattcgcggcgcagatggttaacttcccgataatcggcggggtcagcggacatctgctcggtgcaacgctggtagcggttctcctcggctcctacgcggcagtgattgtcatgacatcagtcctcctcatccagactctcctcttcggcgacggcggaataaccgcgataggtgccaacatcctcaacatgggactcatcggggccttcatcggctactgggtttacagcaggctcaagagcatccacgagggctttgcgatgggactcgccgcctggctctccgttgtgctcggtgcggcgctggcttcagttgagataggcctcagccacagcctccccttcacgaaggttctttccttgatggtcggctaccacgccctcatcgggattggtgaggccgttctaacggttctgatagtttattcaatcaaggcgaggcttcccgagatagagggggtgcctgcatga

SEQ ID NO: 9137 - protein, 204 aa, Thermococcus kodakarensis KOD1
MHIPDGLLSTPVIVVTYAITILAVAYSSRKLKEVPEEKIPLLGLFAAGIFAAQMVNFPIIGGVSGHLLGATLVAVLLGSYAAVIVMTSVLLIQTLLFGDGGITAIGANILNMGLIGAFIGYWVYSRLKSIHEGFAMGLAAWLSVVLGAALASVEIGLSHSLPFTKVLSLMVGYHALIGIGEAVLTVLIVYSIKARLPEIEGVPA

SEQ ID NO: 9138 - DNA, 678 bp, Dechloromonas aromatica RCB
  CDS (1)..(678): transl_table=11
atgcacatcatggaaggctttttgcccttcgagcacgcggtcggctggacgatcgccgcggtgccattcgtcgccggaggcctgctggccatcaagaagcgcattcgggacaaaccggaacagcgcatgctgcttggcgttgccgcggccttcgcctttgttctctcggcgctgaaactgccttccgtcaccggcagctgttcacacccgaccggcaccggacttggcgccctactcttcggcccggtcgccatggcgcctatcggggcggtggtgctgcttttccaggccttgctacttgcccacggcggcctgaccaccctcggtgccaacattttctcgatggctgtcgttggtccgtttgctgccgccggcatttttcacctggcgcgcagcctgaaggcctcgtttgccgtcagcgtctttctcgcggccagtctggccgacctatcgacctacgtgacgacctcgctgcaactggcctgggccttccctgacccggccggtggttttgtcacgtcattcgccaagttcgccggcattttcgccgtcacacaaattcctctggcgatcagcgaggggtttctgactgtgctgattttcaatgccttggcccgtttcaacccgcaggagctgcaagaactgaagctgcttcctgccgataaggccagggcatga

SEQ ID NO: 9139 - protein, 225 aa, Dechloromonas aromatica RCB
MHIMEGFLPFEHAVGWTIAAVPFVAGGLLAIKKRIRDKPEQRMLLGVAAAFAFVLSALKLPSVTGSCSHPTGTGLGALLFGPVAMAPIGAVVLLFQALLLAHGGLTTLGANIFSMAVVGPFAAAGIFHLARSLKASFAVSVFLAASLADLSTYVTTSLQLAWAFPDPAGGFVTSFAKFAGIFAVTQIPLAISEGFLTVLIFNALARFNPQELQELKLLPADKARA

SEQ ID NO: 9140 - DNA, 993 bp, Methanosarcina barkeri str. Fusaro
  CDS (1)..(993): transl_table=11
atgcatattccggatggttatttaggcccaagtacatttatcgcattctggatcatcatgatcccgatttggctttatgcaggaaagaaaatgggaacccttgggtctaaaagagctccgctgcttgccctagcatcagcattcgcttttgttattatgatgttcaatttgcccgtgcccggtggaagcagcggccatgcagtgggtggggctataattgctgtcgttataggaccatgggctgcagttatagccatatctatagccctggcgctacaagcgctactgtttggggatggaggggtaaccgcttatgcggcaaactgtttcagtatggcagttattatgccttttattggttattacacttacaagtttattagcggaaacacagatatcaaatcctcacgaagggtaatcgctatagccatcggggcctggttatccctcaccgtagcagctacgttcataggatttattcttggattgcagcctattttatatagaggtgcaaatggtttacctctctatatgccatatccgctaagtgtaactgttccagctatgttcttggagcatgcatttgtattcagtatccttgaagcactagtttcagcattgatatttgtctatattcagagaacagatccatccatattctatgcagagaaagctgctcctcaagaagtatcaaagaaaaaaagcacaagagacctggctattggtattctgttgttgataattctaacacctctgggactgcttgcggcaggcactgcatatggtgaatgggccccggaggagcttaaagccagagtcggttatatgccaccgggcctggaaaagctttcagacctctggcatgccccaatctctgattacggcttttcaaatctccctccgattatgggatatattttagcagctgcgataggagtaatattgtgcgtgggcatcttgtacttcatgggcaaaaagattgctaaagattaa

SEQ ID NO: 9141 - protein, 330 aa, Methanosarcina barkeri str. Fusaro
MHIPDGYLGPSTFIAFWIIMIPIWLYAGKKMGTLGSKRAPLLALASAFAFVIMMFNLPVPGGSSGHAVGGAIIAVVIGPWAAVIAISIALALQALLFGDGGVTAYAANCFSMAVIMPFIGYYTYKFISGNTDIKSSRRVIAIAIGAWLSLTVAATFIGFILGLQPILYRGANGLPLYMPYPLSVTVPAMFLEHAFVFSILEALVSALIFVYIQRTDPSIFYAEKAAPQEVSKKKSTRDLAIGILLLIILTPLGLLAAGTAYGEWAPEELKARVGYMPPGLEKLSDLWHAPISDYGFSNLPPIMGYILAAAIGVILCVGILYFMGKKIAKD

SEQ ID NO: 9142 - DNA, 696 bp, Methanosarcina barkeri str. Fusaro
  CDS (1)..(696): transl_table=11
atgcacatattcgaaggtttccttccgggtccctggtggcagatctggtggatactctcaataccggtatttgcttatggaattttccggctgaacaagctggtgaaagaaaaacctgaagtgctgcctctgatcgctgtatcaggagctgttatttttgtgttatcatcgcttaagctgccttcggttaccggcagtacttctcatccaaccggaaccgggatggcagtcatacttttcgggcctgcaataacatcagtgctctctgcaattgtcctgctttaccaggctttgtttttggctcacggaggaattacgactttcggggcgaacctaatgtccatggggatcataggaccctttgttgcttatgccatatataaaaccatgatgcgtttgaacgttaatttttatgtgtcagcttttgtaacagcaaccctggcagattgggtcacgtacgttgtgacctcaacgcagcttgcactggcttttccggcgaaccccggaggtgttgaaggttcactcgtagcgttcctgagcgtttttgcgattacccagatcccacttgcgatcctcgaagcttcgctgatcactctgctcttcaagtacgtgctgcaggcaaagggcgatttgatggtcaggcttgacgtgcttaccgactcgcaagtaagaaaactaaaggagacgaaggcttaa

SEQ ID NO: 9143 - protein, 231 aa, Methanosarcina barkeri str. Fusaro
MHIFEGFLPGPWWQIWWILSIPVFAYGIFRLNKLVKEKPEVLPLIAVSGAVIFVLSSLKLPSVTGSTSHPTGTGMAVILFGPAITSVLSAIVLLYQALFLAHGGITTFGANLMSMGIIGPFVAYAIYKTMMRLNVNFYVSAFVTATLADWVTYVVTSTQLALAFPANPGGVEGSLVAFLSVFAITQIPLAILEASLITLLFKYVLQAKGDLMVRLDVLTDSQVRKLKETKA

SEQ ID NO: 9144 - DNA, 708 bp, Methanosarcina barkeri str. Fusaro
  CDS (1)..(708): transl_table=11
atgcatataatggaaggatatttaccagctatttggtgtatagtatggtttgtagtatcaataccagttgtagcatatggtgtttacaaactgaataagttagtgaaagaggagcgcggaattttacctgtacttgccgttgcaggtgcatttattttcgtcctttcatcactcaaaatgccttcagttaccggaagctgttcgcatccaacagggactggtataggtgcaatcatatttgggcctgctattactgccgttctctcgacaattgtacttatctatcaggctcttttccttgcacatggtggcctgaccacccttggagcaaatgtcttctccatgggcatcgtgggtccgatagtggcatacctgatctataagactgggatgaaagctaaacttaatttttatttaatcgtctttttggctgcaacccttggagattgggctacttacattgtgacttctacagaacttgctctggcatttcctgcaggagacatacttacctttggaggtttcttcagttcattcagcaaatttgttgcaattttcgcaattactcaggtaccgttggcgattgtagaaggcgctgtcagtgcactgcttttcaagtatatcatacaagctaaaagtgatttattagttgaaatgaaagttattggagaaccacttgtaagaaaacttagggggctccctgcatga

SEQ ID NO: 9145 - protein, 235 aa, Methanosarcina barkeri str. Fusaro
MHIMEGYLPAIWCIVWFVVSIPVVAYGVYKLNKLVKEERGILPVLAVAGAFIFVLSSLKMPSVTGSCSHPTGTGIGAIIFGPAITAVLSTIVLIYQALFLAHGGLTTLGANVFSMGIVGPIVAYLIYKTGMKAKLNFYLIVFLAATLGDWATYIVTSTELALAFPAGDILTFGGFFSSFSKFVAIFAITQVPLAIVEGAVSALLFKYIIQAKSDLLVEMKVIGEPLVRKLRGLPA

SEQ ID NO: 9146 - DNA, 720 bp, Methanosarcina barkeri str. Fusaro
  CDS (1)..(720): transl_table=11
atgcatattccagatggatatctagggccgtatacctatgtcgcgttttggatcattatgatcccgatatggtattacgctggaaaaaaactgaacacagaacttaagtccagacaggtccctctgctggcactatcagctgctttttcatttgtaataatgatgttcaatgtacctattccaggaggcagcacgggtcacgccgtgggaggtgcaattatcggcatagttctaggtccatgggcaggagttatatctatttctgtagctttggtattacaggcattgatgttcggtgatggaggaataacggccatagccgctaattgcttcaacatgggagttgtgatgccctttgtcggttactatatttacaagcttattagcggaaattctgatatcacctcctctaaaagagttattgcttcggctatagctggctggtgttctctgaccatagcagctttctttacaggtgttgaattcggaatacagcctatcttgcaacacacagctgccggaaccccactttatatgccttacccattgagtgtaactgttcctgccatggtagcggaacatgcttttggatttagcatcctggaagcactgataactgcacttatttttgcctatatccagagaacggatgcgtctctattttatagcgaaaaatctgaagtgcagaagaacaaaatgaagaaggcagtcacagcctga

SEQ ID NO: 9147 - protein, 239 aa, Methanosarcina barkeri str. Fusaro
MHIPDGYLGPYTYVAFWIIMIPIWYYAGKKLNTELKSRQVPLLALSAAFSFVIMMFNVPIPGGSTGHAVGGAIIGIVLGPWAGVISISVALVLQALMFGDGGITAIAANCFNMGVVMPFVGYYIYKLISGNSDITSSKRVIASAIAGWCSLTIAAFFTGVEFGIQPILQHTAAGTPLYMPYPLSVTVPAMVAEHAFGFSILEALITALIFAYIQRTDASLFYSEKSEVQKNKMKKAVTA

SEQ ID NO: 9148 - DNA, 921 bp, Anabaena variabilis ATCC 29413
  CDS (1)..(921): transl_table=11
atgcatattcctgatggatttgtgtctgtgccagtcgcaggcgcaacgggtttggtaagtttggcgggactgttgtttgctagtgggcgatcgcaaacagcttttggtattcgtcgcgcccccattctcggtttaacgactgcttttatttttgctgcccaaatgattaatttcccagtagcggggggaaccagtggtcacttgcttggcggtactttagccgcgattgttttaggtagcccttgggctggctcattgtgcattgccacagtcttaattatccaagccgtgctgtttgctgatggtgggatcacagccttgggagccaatattctgaacatggcattcattggcgtttgggtaggctggatgttaacccaaactttgcaaagattatttggcggctctaaagcacgtttacctttagcggctggtatagcggctgccgtgagtgtcgtagtagcagcgatcgcctgtgcgattgagttagtcctttctgggactgcatccatagctgttgtacctgctatgacaggtattcatattttaattggcattggtgaaggcttaattactggcggcgtattaacttatctagccaaagccagaccagatttgttaccaggagaacaacaagaatttcgcggttggttagtacctgttgttaccatagtcttagtcgctggtgcattgtcattgctcgcctcagcttggcctgatggcttagaaagagtggcagaagacttaggatttatcaaactaggtgaagaagtcagaatatctgtaccgacaccattagcagactatggtattgagggtttaggagcaattggaacaagtatcgccggacttttgggggctgcggtgtgctttgctgctgcctttggaattgccaaagtagtgagaccaaagaatgcttaa

SEQ ID NO: 9149 - protein, 306 aa, Anabaena variabilis ATCC 29413
MHIPDGFVSVPVAGATGLVSLAGLLFASGRSQTAFGIRRAPILGLTTAFIFAAQMINFPVAGGTSGHLLGGTLAAIVLGSPWAGSLCIATVLIIQAVLFADGGITALGANILNMAFIGVWVGWMLTQTLQRLFGGSKARLPLAAGIAAAVSVVVAAIACAIELVLSGTASIAVVPAMTGIHILIGIGEGLITGGVLTYLAKARPDLLPGEQQEFRGWLVPVVTIVLVAGALSLLASAWPDGLERVAEDLGFIKLGEEVRISVPTPLADYGIEGLGAIGTSIAGLLGAAVCFAAAFGIAKVVRPKNA

SEQ ID NO: 9150 - DNA, 687 bp, Anabaena variabilis ATCC 29413
  CDS (1)..(687): transl_table=11
atgcacattatggagggctacctaccagcaggatgggcagctttttggtggttagtagctttaccgtttatggttttaggagtgcgatcgctcacccgcatcaccaaagccaacccagaactaaaattattgttagcattggcgggggcttttactttcgtattatccgctttgaaattgccctctgtgacgggtagttgttctcacccgacaggtacaggcttaggggctgtgctgttcgggcctttggcgatgtctgttttgggtagtctagtattgttgtttcaagcattgttgctggcccacggtggtttaacaaccttgggtgcaaacgctttttcaatggcgatcgctggcccatttgccgcctattggatatatcatctgacaatccagttaactggtaagcaaagaatcgccatctttttagcagccaccttagcagatttgctaacctacattattacttccgtccaactagccttagcctttcccgcaccagtgggcggatttatcgcctcattcgccaaatttgctggtatttttgccattactcaaatccctctagccattagtgaaggattattgactgtcttagtatggaactggctacaatcctattcaccgcaagaactccaactgctgaaattaatccaaagggaacctcaaagccatgaatcaatctaa

SEQ ID NO: 9151 - protein, 228 aa, Anabaena variabilis ATCC 29413
MHIMEGYLPAGWAAFWWLVALPFMVLGVRSLTRITKANPELKLLLALAGAFTFVLSALKLPSVTGSCSHPTGTGLGAVLFGPLAMSVLGSLVLLFQALLLAHGGLTTLGANAFSMAIAGPFAAYWIYHLTIQLTGKQRIAIFLAATLADLLTYIITSVQLALAFPAPVGGFIASFAKFAGIFAITQIPLAISEGLLTVLVWNWLQSYSPQELQLLKLIQREPQSHESI

SEQ ID NO: 9152 - DNA, 618 bp, Rhodobacter sphaeroides 2.4.1
  CDS (1)..(618): transl_table=11
atgcacatccccgacggcatcctgacgctgcccgtccttgcggcgggcggtgcgctggcggtagtcggcgtgggcctaggtctccgcgggctggacgaccgggggatcccgcgggtggcgctcctgtcggcggttttcttcgcggcctcgctcgtgtcggtgccggtggggccgtcgagcgtgcatctgcttttgtccggattgatggggctggtgctgggcctcgggatcttcccggcggttctggtggcgctggccctgcaggcggtgctgttcggcttcggcgggctcacgacgctcggcgtcaacacggtgaacatcgccctgccgggcgcggcggcgggactcctgctcggcccgctcgtgcggcggcagacctctcccttagtcgcgggcgtgctcgccggggtaggctcggccctctgcatcttcgcctccggcggcggcgtggcgctgacgctctggctctcgtcgtcggatttcgtgccggtggcgcgggtgctgctcgtgacctgcctgccgctcgcgctggtcgaggcggccgtggcgggcatggtcgtggccttcctgatgcgcgtcgagccgcggatgctgcagccgtccgccggaggggcctga

SEQ ID NO: 9153 - protein, 205 aa, Rhodobacter sphaeroides 2.4.1
MHIPDGILTLPVLAAGGALAVVGVGLGLRGLDDRGIPRVALLSAVFFAASLVSVPVGPSSVHLLLSGLMGLVLGLGIFPAVLVALALQAVLFGFGGLTTLGVNTVNIALPGAAAGLLLGPLVRRQTSPLVAGVLAGVGSALCIFASGGGVALTLWLSSSDFVPVARVLLVTCLPLALVEAAVAGMVVAFLMRVEPRMLQPSAGGA

SEQ ID NO: 9154 - DNA, 654 bp, Carboxydothermus hydrogenoformans Z-2901
  CDS (1)..(654): transl_table=11
atgcatattatggaagggtttttaccggtaaaatgggtgattttctgggatcttgttactctaccttttataatggtaggttttatccgtttgcaaagggaagctacccaggggccgggagcgaaactaatgttagcttttgccggagcgtttatctttgttttatcggcgctaaaaatgccttcggtaacgggcagttgttcccatcctaccggaacggggttggctgcaattttatttgggccctttatcacaaccgtattaggttttattgttttgatttttcaggctcttcttttagcccacggtggccttaccacccttggtgctaatactttctccatggcagttgctggaccactggtagcttacggggtttataaagggttacagaaagccggaattaatagtaattttagcatttttttagcggccatgctgggagacctggtcacctatatcgttacttcggtccaactggcgttagcctttccgggaagttctctttttttaagtgctttaaaatttatgggaatctttgccttaacccaaattcctttagctataagtgaagggattttaacggttttaacctataatttcttgagccgttatgaagatgccaaaatatgggtagaaaagggtgagcattaa

SEQ ID NO: 9155 - protein, 217 aa, Carboxydothermus hydrogenoformans Z-2901
MHIMEGFLPVKWVIFWDLVTLPFIMVGFIRLQREATQGPGAKLMLAFAGAFIFVLSALKMPSVTGSCSHPTGTGLAAILFGPFITTVLGFIVLIFQALLLAHGGLTTLGANTFSMAVAGPLVAYGVYKGLQKAGINSNFSIFLAAMLGDLVTYIVTSVQLALAFPGSSLFLSALKFMGIFALTQIPLAISEGILTVLTYNFLSRYEDAKIWVEKGEH

SEQ ID NO: 9156 - DNA, 678 bp, Geobacter metallireducens GS-15
  CDS (1)..(678): transl_table=11
atgcacatctccgagggaatcctcccctttggctgggctgcgctctggttcgcggtggcggtgccattcctggcggtggggctcaggcggctcaacgagctttcccgggacgacctctccatgaagccgctggtggggctcatggcggcggtggtctttatcatctcctgcatgccgatcccggtccccagcgccggcacctgttcccacccctgcggtaccggtatctcggccatcctggtgggacccttcgtgtcggtggccatcgccgcggtggcactcctcattcaggcgctcctcctggcccacggggggctgtcgaccctgggggccgacatcgtttccatgggagtggtgggctcattcgcggggtggtttgtgttccaggggatgcgccgggtgagggcgagccttgccgtggcggggttcgcggcggggcttcttgccgactgggccacctatctggccacctccggggagctggccgccggtatccggggaagcgagccctttatccccctttttctgaagattgccgtggccttcatcccgacacagcttcccctggggattctcgaaggggccatgaccgccggtatggtggtgctcctctcccgcaagcggcccgacctgctggtgaagatgcgggtgctccgggccgaagaggtggcggcgtga

SEQ ID NO: 9157 - protein, 225 aa, Geobacter metallireducens GS-15
MHISEGILPFGWAALWFAVAVPFLAVGLRRLNELSRDDLSMKPLVGLMAAVVFIISCMPIPVPSAGTCSHPCGTGISAILVGPFVSVAIAAVALLIQALLLAHGGLSTLGADIVSMGVVGSFAGWFVFQGMRRVRASLAVAGFAAGLLADWATYLATSGELAAGIRGSEPFIPLFLKIAVAFIPTQLPLGILEGAMTAGMVVLLSRKRPDLLVKMRVLRAEEVAA

SEQ ID NO: 9158 - DNA, 1041 bp, Geobacter metallireducens GS-15
  CDS (1)..(1041): transl_table=11
atgcacatggcagacgctctcatttccccggcggtcggtggtaccctctgggtcgctgcgggcggcacgattgcctactgcgcacggaaggtgcgccaggatttggacgagaggaaagtgccgctcatgggggtgttgggggcctttgtctttgccgcccagatgatcaatttcaccattccggggaccggctccagcggccacctggggggcgggctcctgctggcggtgctcctggggccccacgcggcgtttctcaccatcgcctcggtcctcgtggtgcaggccctgttctttgccgacggcgggctcctggccctcggatgcaacatcgtcaacctgggatttttccccgcctttgtcgcctatcctctcatctaccgcgccattgccccagccggttccggtcaggggcgaagcaccgccgcagcggttgcggccgcggtcgtggggctgcagttcggggcattgtcggtggtgctggagacggtagcttcgggaatctcggcgcttcccttttcgtccttcgtgctcctgatgcagccgatacacctggccatcggcattgtggaagggcttgtcaccgcggcggtggtcggtttcgtggtcaaggcccatccggaagtcatcggtgcgacgcgccggtccgtgacgagcggttccggattcaggtgggtggcggtttcgctgctcgctctggcagtgatcaccggtggcgtagtctcccggtatgcctccgggaagcctgacggcctcgagtgggcgattgcgggtgtcaccggcaagggagagcttgcctctcccacaggcggggtccatggcgccctggcagcaatccagaaaaagagttcgtctctccccgcgtattcctttgccaagccaactgaagacggggccggggagccggcggcccggaaaaggggcgcggcgaagggggatgacaggctcggcacgtcggtctccgggattgccggcggcggtctgaccctggtgatggcctttgcggtcggcttcttgttgcgccgtcgcgccgcatcgtga

SEQ ID NO: 9159 - protein, 346 aa, Geobacter metallireducens GS-15
MHMADALISPAVGGTLWVAAGGTIAYCARKVRQDLDERKVPLMGVLGAFVFAAQMINFTIPGTGSSGHLGGGLLLAVLLGPHAAFLTIASVLVVQALFFADGGLLALGCNIVNLGFFPAFVAYPLIYRAIAPAGSGQGRSTAAAVAAAVVGLQFGALSVVLETVASGISALPFSSFVLLMQPIHLAIGIVEGLVTAAVVGFVVKAHPEVIGATRRSVTSGSGFRWVAVSLLALAVITGGVVSRYASGKPDGLEWAIAGVTGKGELASPTGGVHGALAAIQKKSSSLPAYSFAKPTEDGAGEPAARKRGAAKGDDRLGTSVSGIAGGGLTLVMAFAVGFLLRRRAAS

SEQ ID NO: 9160 - DNA, 615 bp, Desulfovibrio desulfuricans G20
  CDS (1)..(615): transl_table=11
atgcacatatcggaaggggtactttcggcaccggttttgctgtgcggtgccgccgtggcggcggcgggcatcgcggcgggactgcgcaggatggactatgaccgcctgatgaccgtggcgctgctttcggccgctttttttgtgggatcgcttatccatataccggtgggaccggccagcgcacatcttattcttaacgggctgctgggcgcagtgctcggttgggcggcctttccggccatattcaccgcactgctgctgcaggccgtgctttttcagtacggcgggctgaccattctgggcgtgaacacggcaaccatggcttctgccgcggtgctgtgcttctatcttttttctccgcttatgcgcaggcaggggcgctggcggctgctgggcggtttttgctgcggggcgtgcggcgtgctgtttgcagggctgttcacagcggcaagtcttgcgttttctgatgaaggcttccgccatgctgccggcatgattctggtggcgcatattcccgtcatggtggtggaaggcatcatcaccgctcttactgtttcgtttctggcccgcgcgcggcctgaagtgctgcatatgaatgccggaaaacagcgttga

SEQ ID NO: 9161 - protein, 204 aa, Desulfovibrio desulfuricans G20
MHISEGVLSAPVLLCGAAVAAAGIAAGLRRMDYDRLMTVALLSAAFFVGSLIHIPVGPASAHLILNGLLGAVLGWAAFPAIFTALLLQAVLFQYGGLTILGVNTATMASAAVLCFYLFSPLMRRQGRWRLLGGFCCGACGVLFAGLFTAASLAFSDEGFRHAAGMILVAHIPVMVVEGIITALTVSFLARARPEVLHMNAGKQR

SEQ ID NO: 9162 - DNA, 636 bp, Rhodospirillum rubrum ATCC 11170
  CDS (1)..(636): transl_table=11
atgcatatcgccgaggggatcgtcccgctctccgtggcggcgccgctgacggtcgtcgccgtcgccggcgtcgccaagggcctgcgcgccatcgatgccgagcgtctgccgacctgtggcctgttttcggcggtgttcttcgtcgccagtctgatccatgtgccgctgggaccgacaagcacccatctcgtgctcagcgggctgatcggcctgatgttgggttgggcggcctttccggccattctggtcggactggccctgcaggcggtgttcttcggcttcggcggccttctggtgcttggcgtcaacaccctgaccatggccgccccggcggtgctggcctgggcgctcttccgggggttggccgatcggctggcgccgtcgcgggcgccggtgctggcggcgatctgcggcgggctggcggtgctggtttccgccctgctggtcgccggagttttggccctgtccgatcaggccttcctgccggcggccgggttggtggtgctgggcaatctgccggtgatcggcctggaatcgctgattaccggcgccgccgtcgccctgctccaccgtgtccgtcccgagatgcttccgcgacagggaggtcgcccatggtcgggatccttcgtctcctga

SEQ ID NO: 9163 - protein, 211 aa, Rhodospirillum rubrum ATCC 11170
MHIAEGIVPLSVAAPLTVVAVAGVAKGLRAIDAERLPTCGLFSAVFFVASLIHVPLGPTSTHLVLSGLIGLMLGWAAFPAILVGLALQAVFFGFGGLLVLGVNTLTMAAPAVLAWALFRGLADRLAPSRAPVLAAICGGLAVLVSALLVAGVLALSDQAFLPAAGLVVLGNLPVIGLESLITGAAVALLHRVRPEMLPRQGGRPWSGSFVS

SEQ ID NO: 9164 - DNA, 705 bp, Moorella thermoacetica ATCC 39073
  CDS (1)..(705): transl_table=11
atgcatatcgccgaaggcttcctgcctttcaattgggccgccttttggtttatcgtcgtcctgcccttctggatctggggcctgcgctccatccggcataccgttaaaagtaaccccggcctgaaaatgctcctgggcctggccggcgcctatacctttgtcctctcggccctgaaactcccttcagtgaccgggagctgttcccatcctaccggcatcggcctgggggccgttctcttcggcccggcagccatgagcatcctggggggcattgttctcctcttccaggccctgttactggcccacgggggtcttagtaccctgggcgccaacaccttttccatggccgtcgtcggtccctttgtggcctacggcctttaccgcctggtaagaaagctcaaagggtcaatgcccctggccgtcttcctggctgccaccctgggtgatttgatgacctatgtcaccacctccctccagctcgccctggctttcccggcccaggccgggggagtggtagcttccatgctcaaattcatgggcatctttgccgttacccaactacctctggccatcagtgagggctttttaacggtcatcgtctttaaccttctggccacctataacaaaaacgacctggaggagctgtcaatcatgccggggaagacggcggctgaaggtggccccagccggcagtacagccggtaa

SEQ ID NO: 9165 - protein, 234 aa, Moorella thermoacetica ATCC 39073
MHIAEGFLPFNWAAFWFIVVLPFWIWGLRSIRHTVKSNPGLKMLLGLAGAYTFVLSALKLPSVTGSCSHPTGIGLGAVLFGPAAMSILGGIVLLFQALLLAHGGLSTLGANTFSMAVVGPFVAYGLYRLVRKLKGSMPLAVFLAATLGDLMTYVTTSLQLALAFPAQAGGVVASMLKFMGIFAVTQLPLAISEGFLTVIVFNLLATYNKNDLEELSIMPGKTAAEGGPSRQYSR

SEQ ID NO: 9166 - DNA, 1059 bp, Moorella thermoacetica ATCC 39073
  CDS (1)..(1059): transl_table=11
gtgcatattcccgacggttacttaagtccccagacctgtgcggtactgggtgcggccatggtgcctgtgtggggcacggccgcccgcaaggtcaaagccaccctgaaggccaggcaggctcccctcctggccatcggcgccgctttttccttcactatcatgatgtataatatccccatccccgacgggacgacggcccacgccaccggcggcgccctattagccatcctcctgggcccgtgggcggcggctatcggcatctctatcgccctggccatccaggcccttttcttcggcgacggcggcatcctggccttcggcgccaatgcctttaatatggcctttatccttcccttcgccagttactacatctatcgcctcttatccggccggacaagcctgcactccggctggcgggccgtggcggccgccatcgccgggtttgtcggccttaacctggccgccctggccgcagcggtggaattcggcctgcaacccctcctcttccatacggccagcggtgttcccctctacagcccctaccccctggccttagccgtcccggccatggccctggcccacgtcctgatagccgggccggccgaaggaatagtcaccggcctggttattcgctacctgcagcgggttaattccggtctgctgcgggtttacccggcgacaggagctgtggtggcagctcaagcgacgggtgacggtgccagccttaagaaactggcctgggggttggttatcctcgtcctgttatcccccctggggttgctggctgccggtaccgcctggggcgagtggtcaccggaagacctgcaacaaatcctcggtttcgttcccccgggtctggcccgcctggctaccacctggactcatgcccttttcccggattataccgtcccgggcctggaggggagcttttgggcccaggccctgggttatatcatcaccgccatggttgggctgggcataatcttccttatcttcctggcttttaaccggctcctggcccggccggggaagacaggagccgattatcatggcaaataa

SEQ ID NO: 9167 - protein, 352 aa, Moorella thermoacetica ATCC 39073
MHIPDGYLSPQTCAVLGAAMVPVWGTAARKVKATLKARQAPLLAIGAAFSFTIMMYNIPIPDGTTAHATGGALLAILLGPWAAAIGISIALAIQALFFGDGGILAFGANAFNMAFILPFASYYIYRLLSGRTSLHSGWRAVAAAIAGFVGLNLAALAAAVEFGLQPLLFHTASGVPLYSPYPLALAVPAMALAHVLIAGPAEGIVTGLVIRYLQRVNSGLLRVYPATGAVVAAQATGDGASLKKLAWGLVILVLLSPLGLLAAGTAWGEWSPEDLQQILGFVPPGLARLATTWTHALFPDYTVPGLEGSFWAQALGYIITAMVGLGIIFLIFLAFNRLLARPGKTGADYHGK

SEQ ID NO: 9168 - DNA, 741 bp, Desulfitobacterium hafniense Y51
  CDS (1)..(741): transl_table=11
atgaacaaacgtatacagctctttattggtttagtcttgatgatgttttttattccttataaagcatcggctatgcatattatggaaggttttttacagccggggtgggccattgcctggggagctttagcaataccctttgtcgtgttgggtatcttttcgattaagaaaaccatttctcttaatccacgcttgaagattcttttagctatggccggggcttttgtttttgtgctttctgctcttaaattaccctcggttaccgggagctgttcccatccaaccggagtaggctttggtgccatcctatttggccccacagctatggcagttatcggcgttattgtccttttgtttcaggccttgctgctggcccacggcggattgaccaccttaggcgccaataccttttctatggcagtggttggcccctttgtagcctttggcgtgtataaactggtacaaaaatttaaaggaccacaatggttaggtgtatttctggccgcttccttaggcgatttggccacctatgtcatgacttccattcaattggcccttgccttcccttcggaagtgggcggttttgctgcttctcttactaaatttgccagtatctttgctgtgactcagatacccttagcgatcagtgaggggattctgactgtcatcatcttcaacgcactggccagctatggaaaaagtgagctgcaagatctcaagctgttaacaaaggaggtataa

SEQ ID NO: 9169 - protein, 246 aa, Desulfitobacterium hafniense Y51
MNKRIQLFIGLVLMMFFIPYKASAMHIMEGFLQPGWAIAWGALAIPFVVLGIFSIKKTISLNPRLKILLAMAGAFVFVLSALKLPSVTGSCSHPTGVGFGAILFGPTAMAVIGVIVLLFQALLLAHGGLTTLGANTFSMAVVGPFVAFGVYKLVQKFKGPQWLGVFLAASLGDLATYVMTSIQLALAFPSEVGGFAASLTKFASIFAVTQIPLAISEGILTVIIFNALASYGKSELQDLKLLTKEV

SEQ ID NO: 9170 - DNA, 696 bp, Methanococcoides burtonii DSM 6242
  CDS (1)..(696): transl_table=11
atgcatatattcgagggattcttgccatcaccatggtggcaactttggtttgtgttctctattccggtaatattcttcggtatgtacaggcttaataagcttgtatctgaaaagcgcgagctattaccattattggcagtagcgggagcattcatattcgtactttcatctttgaagatgccatctgttacgggcagttcatcccatccgacaggtaccggcatggcagctattctttttggccctgctattgcagcggtcctgagtttgatcgttttgttatatcaggcaattttcctggctcacggtggtcttacgacacttggtgcaaacgtcgcatcaatgggtatcattggtcctgtttttgcatatgtcatctataaagcaggcatgaaagctaacatcaatttctatgttgttgttttccttgccacagcatttgcagactgggcaacatatgttgtgacagccacacaacttgcgctggcattcccggcagaagttggtggagtggctgcttcacttaaagcattcttgcttgtgttcgctacaacccaggttcctctggctatcatggaaggtgcattgaccgctcttatcttcaagtatatcatacaggtcaagagcgattctcttctagagcttaaagttatcacagaatcagttcttaataagatcaagggggcaggtcagtga

SEQ ID NO: 9171 - protein, 231 aa, Methanococcoides burtonii DSM 6242
MHIFEGFLPSPWWQLWFVFSIPVIFFGMYRLNKLVSEKRELLPLLAVAGAFIFVLSSLKMPSVTGSSSHPTGTGMAAILFGPAIAAVLSLIVLLYQAIFLAHGGLTTLGANVASMGIIGPVFAYVIYKAGMKANINFYVVVFLATAFADWATYVVTATQLALAFPAEVGGVAASLKAFLLVFATTQVPLAIMEGALTALIFKYIIQVKSDSLLELKVITESVLNKIKGAGQ

SEQ ID NO: 9172 - DNA, 657 bp, Methanococcoides burtonii DSM 6242
  CDS (1)..(657): transl_table=11
atgcacataccggattcatttatgccactatcacaagcacttgtttactgggcaatagcaatcccattcatcttcatgtccctcagatgggcaagaagggatatggatgacatgaaaataccaatccttgcagcattgtctgcagggatatttgccattcaggcactcaacatcccaattggaatgggaaccagcggccacatggtcggtgcagctcttgtagcaataatattgggcagtccgtttgcaggagtgcttgttcttacactcgtattactagtacaaggaattgtatttgcagatggtggaatcaccgtaatgggtgcgaacatactcaacatgggagttatttcaggatttattggctactatgggtttgtcgcactccggaaaaggaacattgacataaagatatcggcatttatcggcgcatggcttggtctgttcatatcatctattgcaacagccatagagatgagcatcgccggtacattcccacttgttccgggaatagttgcaatgggaacatttcactttgtgatagggataatcggagaaggtcttatcactgccatcgccattggtgcaattgcaaaagcacgtcccgaccttgtagatgataaggcagtggaaagttcaaaggaggcaacattgtga

SEQ ID NO: 9173 - protein, 218 aa, Methanococcoides burtonii DSM 6242
MHIPDSFMPLSQALVYWAIAIPFIFMSLRWARRDMDDMKIPILAALSAGIFAIQALNIPIGMGTSGHMVGAALVAIILGSPFAGVLVLTLVLLVQGIVFADGGITVMGANILNMGVISGFIGYYGFVALRKRNIDIKISAFIGAWLGLFISSIATAIEMSIAGTFPLVPGIVAMGTFHFVIGIIGEGLITAIAIGAIAKARPDLVDDKAVESSKEATL

SEQ ID NO: 9174 - DNA, 744 bp, Clostridium perfringens ATCC 13124
  CDS (1)..(744): transl_table=11
atgtcaaaaaagaatcaagtatttataggatttttattaatgttcttattaataccaagaagtgtttcagctatgcatatcatggaaggatttttacaacctaaatggtgtatagcatggggagttataactataccatttatagtattaggattattctctattaagaataaggttggaaataatccaagactaaagattttattagctatggcaggagcttatgcttttgttctttcagcattaaagcttccatcagttacaggtagttgctcacatcctacaggagttggtcttgcagcaatattatttggacctacagcagcatcagttttaggacttatcgtacttttattccaagcattacttttagctcatggtggtcttactactcttggagctaatactttttcaatggctgtagttgggcctttagtatcatacggactttataaattagtaaaaaaacttaatggaccaacatggttaggtgtatttttagcatctgctcttggagatttagcaacttacatggttacttcagttcaattaggactagccttcccagcagaggttggaggagttatggcatcagttatgaaattcatgggtatatttgctgttactcaagttcctctagctataagtgaaggaatattaacagtcataatctttaatacaatagaaaattatgcaaaagaagatttaatggaacttaacattttttcaaagggggtaaaataa

SEQ ID NO: 9175 - protein, 247 aa, Clostridium perfringens ATCC 13124
MSKKNQVFIGFLLMFLLIPRSVSAMHIMEGFLQPKWCIAWGVITIPFIVLGLFSIKNKVGNNPRLKILLAMAGAYAFVLSALKLPSVTGSCSHPTGVGLAAILFGPTAASVLGLIVLLFQALLLAHGGLTTLGANTFSMAVVGPLVSYGLYKLVKKLNGPTWLGVFLASALGDLATYMVTSVQLGLAFPAEVGGVMASVMKFMGIFAVTQVPLAISEGILTVIIFNTIENYAKEDLMELNIFSKGVK

SEQ ID NO: 9176 - DNA, 711 bp, Rhodococcus sp. RHA1
  CDS (1)..(711): transl_table=11
gtggaacccgtggcaatgcacatgagcgacggcctgatcaatgcgccgacctccctgctgttcgtcgtggtggcggtggcgggactgtcgatcgccgcgtggcgtgcgcgctcggaactcgacgaacgcaccgccccgatggccggtctcgtggcggccttcatcttcgcggtccagatggtcaacttcccgatccttcccggtgtgagcgggcacctcctcggcggcgcgctcgccgccatcctcgtcggcccctacaccggcatgctctgcgtctcgatcgtgctgatcgtgcaggccctgctgttcgccgacggtgggctgacggcgctcggagcgaacatcaccaacatggcgatcatcggggtggtcgtcggctacggcgtcgcggtcgccctgcgcccgctcgtgatgcgacagcagcgactgcacttccggatcctcggtgggctcgcgttcgccgcggcactgtgcggaacggtggcggcgtcgatgggcttcgtcctcgaatacgcgatcggcggtcatgcgacgtccggagattcgacgtcgctgggcgcggtggcggcctacatcctcggggcgcacgtgctgatcggcatcggcgaaggcctcatcaccgccgtcacggtgacggccgtcgcgaaggcgcgccccgacctcgtgtacctgctgcggacggcgccccgccgagtcgaggtgcgggcatga

SEQ ID NO: 9177 - protein, 236 aa, Rhodococcus sp. RHA1
MEPVAMHMSDGLINAPTSLLFVVVAVAGLSIAAWRARSELDERTAPMAGLVAAFIFAVQMVNFPILPGVSGHLLGGALAAILVGPYTGMLCVSIVLIVQALLFADGGLTALGANITNMAIIGVVVGYGVAVALRPLVMRQQRLHFRILGGLAFAAALCGTVAASMGFVLEYAIGGHATSGDSTSLGAVAAYILGAHVLIGIGEGLITAVTVTAVAKARPDLVYLLRTAPRRVEVRA

SEQ ID NO: 9178 - DNA, 645 bp, Trichodesmium erythraeum IMS101
  CDS (1)..(645): transl_table=11
atgcatatttcagaaggtattctgccagctcaactttgtattagtggttatggatttacttctctaattacctggtattctctacgcaaaattaatcgtctagcaaatcctcaagctagtattcccaaagcttctttattaacagcagcattttttgtagcttctagtattcatattcctatgccaataggtagcgttcatttagtgttaaatggattattaggaactttgttaggttattatgcttttccagccatattaattggcttatttttgcaagtaatagtgtttgggcatggtggtttaactactttaggaattaacgctataattatgggtataccagcaattttggcttatcaaatatttcaattacgtcacattttagggaataaaataaatgaaaatttatcaataaaaattttagggtttattgctggagcaactgctattggagtttctagtttaatattttttagtttaattattacaaatattccgtctggatttaatacttcattagaggagaaagcaatttatggattaatgatttctcatattcctttgatgggaatagaaggaattttaactgctatgatagtcagttttatgcatcgagtcatgccagaacttttaccttcttaa

SEQ ID NO: 9179 - protein, 214 aa, Trichodesmium erythraeum IMS101
MHISEGILPAQLCISGYGFTSLITWYSLRKINRLANPQASIPKASLLTAAFFVASSIHIPMPIGSVHLVLNGLLGTLLGYYAFPAILIGLFLQVIVFGHGGLTTLGINAIIMGIPAILAYQIFQLRHILGNKINENLSIKILGFIAGATAIGVSSLIFFSLIITNIPSGFNTSLEEKAIYGLMISHIPLMGIEGILTAMIVSFMHRVMPELLPS

SEQ ID NO: 9180 - DNA, 654 bp, Alkalilimnicola ehrlichei MLHE-1
  CDS (1)..(654): transl_table=11
atgcacattcctgacggcttactcgccccccaaacctacctgcccgcctttgcattggccgcccccctttggctgcatgccacccggaagctgcgggggacgctcgacgagaccctgttgccccgactggcggtattcacggccctcgccttcctcctctccagcctcatggtgcccctgcctggcggaacctccacccacgccgtgggtgtggccctaatggcattagtcctcggcccctggactgcctttctggcctacaccctggtgctggtggtccaggccctgctggtgggtgctggcggtatcaccgccctggctgccaacgcgctgctcatggggttcgtcggggcctggaccgctgtgatactgcatcgctggctgcaccctctccacggagacgctgccaccggcgtcgccgtctgggtctcggtggtgctctcggcaaccctgatggccacactcctcggcgtccagccgttgattgcccaggacgagacgggcagcccgctgtattttcccttcgggttaacggtgacgctaccagcggtggtcctcccacacatgctgctggccattggcgaggcggtattgacccttctcattcttcgtcatgcccggcaccgcggctggatggaggcccgcgcactatga

SEQ ID NO: 9181 - protein, 217 aa, Alkalilimnicola ehrlichei MLHE-1
MHIPDGLLAPQTYLPAFALAAPLWLHATRKLRGTLDETLLPRLAVFTALAFLLSSLMVPLPGGTSTHAVGVALMALVLGPWTAFLAYTLVLVVQALLVGAGGITALAANALLMGFVGAWTAVILHRWLHPLHGDAATGVAVWVSVVLSATLMATLLGVQPLIAQDETGSPLYFPFGLTVTLPAVVLPHMLLAIGEAVLTLLILRHARHRGWMEARAL

SEQ ID NO: 9182 - DNA, 891 bp, Solibacter usitatus Ellin6076
  CDS (1)..(891): transl_table=11
gtgcatatacccgacggatttctttcgacgcccgtgtgggccgcgatggatgtggcggccgcaccagcggtagggtatgtcgcgcgcaaggcgcagcagggcttcgacgacgccaaagtgccgctgctcggggtgatgggcgccttcgtcttcgcggcgcaaatgatcaactttccggtgggcgtgggcacgagcgggcacctcgtcggaggcgcgctgctggcgtgtacgctggggccggcggcggcgagcgtggtgatgtgcgcaatccttgccatccaggcgctggttttccaggatggcgggattctcgcgctcggagcgaacgtcttcaacatggcgatcgccggcgtgctggcgggctatctgccgtactatttgtggggccgcggaccgcggcggcgcgcggcgatctttgccggcggaacgctttcgctgttgaccagcgcgattctggctttggccgaactgctgatctccggagtgcggatgccggcgccggtgctcggcgtctcgctcgcgctgttcgtggtttcggctttggtagagggcgcgattacggtggcggtggtgatcgcgctggaacgtattcaaccgaacctgacgcgggctcccgggaccggccgctcgcccgccttcgcagctctggccctggtggcggtgctgctggcggccggcagcgtggtcttcgcctccaccgcgcccgatggaattgaacggctggccatgcagacggggattgcgtcacacgcgcgcacgttaatttcgacgccgttgaaggactaccaggcagcctggctgggctcgggatggccggcgcaggccggcgcgggactggcgggtctcgggctggtctacggggcctgcctgatgatcgggcggaagcggtag

SEQ ID NO: 9183 - protein, 296 aa, Solibacter usitatus Ellin6076
MHIPDGFLSTPVWAAMDVAAAPAVGYVARKAQQGFDDAKVPLLGVMGAFVFAAQMINFPVGVGTSGHLVGGALLACTLGPAAASVVMCAILAIQALVFQDGGILALGANVFNMAIAGVLAGYLPYYLWGRGPRRRAAIFAGGTLSLLTSAILALAELLISGVRMPAPVLGVSLALFVVSALVEGAITVAVVIALERIQPNLTRAPGTGRSPAFAALALVAVLLAAGSVVFASTAPDGIERLAMQTGIASHARTLISTPLKDYQAAWLGSGWPAQAGAGLAGLGLVYGACLMIGRKR

SEQ ID NO: 9184 - DNA, 1293 bp, Magnetococcus sp. MC-1
  CDS (1)..(1293): transl_table=11
atgcacattgtggatggtgcgttggcccctgttgtcttggtggtggggggtggtgtggcgctgcttggttgtgcgctgggtttaaaacggatggatgaggcacatattccccaagtggggttgctgagtgccgccttttttttggcctcgttaatccatgtgcccattggcccttcgagtgttcacctgattttaaatggtttggtggggttggtgttggggtgggccgcttttccggcgctgttggtggggttgttgttgcaggcggtcttctttggttttggcgggctgttggtgctgggggttaatgtggtcaatattgccctgcctggggtggtcgtagccgcgctggtgcggccccatttggcagggaacaacagcagtaagcgcgctttttattggggtgcgttgggtggtggtctggcgatcttgttaacctcggtaatggtggcattatcgctctatctgagtggggatgcttttctcttaacggccaaagcggtattgctggcgcatctgccgattatgctggtggagggggtgctgaccggtgcggcggtggtgttgatccagcgggttaagcctgcactgtttacccctcactttatcccggttgcgccggttaaggcggtcgagccaaaagcgccgccgttaatcctggcgggtctgttggcctttgcgctgttcgccctgcaaagtgggatggtttgggcccacaatatggtggcggatctctacgctgaggggatgcagattgagggtgaggtgggttttagtgggggcggggcggcccgtgatgtagcggtgagcatgtatgatgctgagggcagactgctggggcagacccgcagtgatgccgagggtatctttcgttttcacgcgcagcaggtgatggattaccattttcgggtggatgccggggccggacatgtggtggaactgaccctgcctgccgagcagttaagcggggatggtacagaagccacaaccccagccagctccagtttggatcaagagggtggggggcaaagtacggttcaaagtgggggcgaaaagctggcgcaagagggcgagattttgcccatcgcggcgccctcgatgctggatgcggcgcagttggagcgtatgattgaaagcgcggttgccaaacagattaagcccctgcgcaaacagcttttacagtatgaaaacaaggtgcgcttgcaagatatcctgggtgggttgggctatattttgggtttgaccggcttggccatggggtggagccgtcgccgtggggttaatcctccgtga

SEQ ID NO: 9185 - protein, 430 aa, Magnetococcus sp. MC-1
MHIVDGALAPVVLVVGGGVALLGCALGLKRMDEAHIPQVGLLSAAFFLASLIHVPIGPSSVHLILNGLVGLVLGWAAFPALLVGLLLQAVFFGFGGLLVLGVNVVNIALPGVVVAALVRPHLAGNNSSKRAFYWGALGGGLAILLTSVMVALSLYLSGDAFLLTAKAVLLAHLPIMLVEGVLTGAAVVLIQRVKPALFTPHFIPVAPVKAVEPKAPPLILAGLLAFALFALQSGMVWAHNMVADLYAEGMQIEGEVGFSGGGAARDVAVSMYDAEGRLLGQTRSDAEGIFRFHAQQVMDYHFRVDAGAGHVVELTLPAEQLSGDGTEATTPASSSLDQEGGGQSTVQSGGEKLAQEGEILPIAAPSMLDAAQLERMIESAVAKQIKPLRKQLLQYENKVRLQDILGGLGYILGLTGLAMGWSRRRGVNPP

SEQ ID NO: 9186 - DNA, 687 bp, Mycobacterium smegmatis str. MC2 155
  CDS (1)..(687): transl_table=11
atgcacatgagcgatggcatcgtgaacgtccagacgtcgttggtgttcggtgccctggcggtcgccgcgctcggtgtgtgcgccctgcgcgcccgagacgaactcgacgagcggacggtgccgctggccggtctcgtggcggcgttcatcttcgccgtgcagatggtgaacttcccgatcctgcccggggtcagcggtcacctgctcggcggtgcgctcgcggcgatcctcgtcgggccgtacaccggggcgctgtgcatcgcgatcgtgctggtggtgcagtcgctgctgttcgccgacggcggcgtgagcgcgctggggacgaacatcaccaacatggcgctgatcggcgtcgcggccggctacgcgaccgcggtggtgctgtccaccgtgctccgcggacggggcgcggcgggatctccgccggaccgccacatcggtgtggtggccttcgtggcggccctcgtgggaaccgtgtgcgcggccatgggtttcgtcgtcgaatacgtcatcgggggcgtcgcgacgacgtcgatacaagcggtggcgggctacatgttcggcacgcacgtgctgatcgggatcggtgaaggcatcatcacggcactcacggtcaccgcggtcgcgcgggtgcggccggatctcgtgtacctgctacggcgtcagcgtcaggaggtcgccgcgtga

SEQ ID NO: 9187 - protein, 228 aa, Mycobacterium smegmatis str. MC2 155
MHMSDGIVNVQTSLVFGALAVAALGVCALRARDELDERTVPLAGLVAAFIFAVQMVNFPILPGVSGHLLGGALAAILVGPYTGALCIAIVLVVQSLLFADGGVSALGTNITNMALIGVAAGYATAVVLSTVLRGRGAAGSPPDRHIGVVAFVAALVGTVCAAMGFVVEYVIGGVATTSIQAVAGYMFGTHVLIGIGEGIITALTVTAVARVRPDLVYLLRRQRQEVAA

SEQ ID NO: 9188 - DNA, 690 bp, Nocardioides sp. JS614
  CDS (1)..(690): transl_table=11
atgcacgtccccgacggcttcctcgacgcgccgacgtccgcggccacgggcgccgtcgcggtcgcggtggtcggcgtggcgctcgtcagggcccgcaacgagctcgacgacaagacggcgccgatggccgggctggtcgccgccttcatcttcgccgtgcagatgctgaacttcccggtcggtgccggcaccagcggccacctcatggggggtgcgctcgcggcggtgctggtggggccgtggaccggcgtgctctgcgtcagcgtcgtcctgctggtccagtcgctgctctttgccgacggcggcatcaccgcgctcggcaccaacatcgtgctgatggcgatcacgaccgtcctggtcggctgggtcgtcttcagactcctccagctcgtgctccccaagcggctctcgctgacgccggcgcaggcgggcatcggcgcgttcgtgtcggtcccggtggccgcgtcggtcttcgtggtcctctacgccctgggcggtacggcggacatcccgttcgacacgctcatgacggccatgttcggcgtgcacaccctgatcggcatcggcgagggcgtgatcaccgccctcgcggtcggcgcgatcatcgccgtgcggcccgacctcgtccacggtgcccgcccggtgctcgcgcagcgcgagctggtcatcaagccgaaggtggccgcatga

SEQ ID NO: 9189 - protein, 229 aa, Nocardioides sp. JS614
MHVPDGFLDAPTSAATGAVAVAVVGVALVRARNELDDKTAPMAGLVAAFIFAVQMLNFPVGAGTSGHLMGGALAAVLVGPWTGVLCVSVVLLVQSLLFADGGITALGTNIVLMAITTVLVGWVVFRLLQLVLPKRLSLTPAQAGIGAFVSVPVAASVFVVLYALGGTADIPFDTLMTAMFGVHTLIGIGEGVITALAVGAIIAVRPDLVHGARPVLAQRELVIKPKVAA

SEQ ID NO: 9190 - DNA, 627 bp, Azoarcus sp. BH72
  CDS (1)..(627): transl_table=11
atgcatctggcagaaggcgtgctctccgcgcccgcactgctcggcagcgccgctgtggccgccatgggcgtcggcctcggcctgcgacgcctggacgacgcgcgcctgccgctggccgccctgctcggcgcggcctttttcgtcgccagcaccatccatgtcccggtcggcgtcggcagcgtgcacctcattctcaacggcctcgccgggctgttgctcggctgggcggcgtttccggtgttcttcgtcgcgctgctgctgcaggcggcgttgttctcgttcggcggcttcacggtgctgggcgccaacctgctgatcatggcgctgccggcggtcgccgcccactacctgctgcgcggcctggtggcgtcgcgcgcgccgggcggaccgggccggcgccgcctgatgctggcgggtgccgcgtgcgggctggtcggcatcggcggcgccatcctcatcgccagcctgctgcttgccctggcgggcggccgggccttcgccgacctcatcgcgctgctggtggcggcgcacctgccggtgctcgcggtcgatgccgtcatcggtgcggtcgcggtcgcgctgctgggccggatgatgccgcgcgcactggcggcgggggcggcatga

SEQ ID NO: 9191 - protein, 208 aa, Azoarcus sp. BH72
MHLAEGVLSAPALLGSAAVAAMGVGLGLRRLDDARLPLAALLGAAFFVASTIHVPVGVGSVHLILNGLAGLLLGWAAFPVFFVALLLQAALFSFGGFTVLGANLLIMALPAVAAHYLLRGLVASRAPGGPGRRRLMLAGAACGLVGIGGAILIASLLLALAGGRAFADLIALLVAAHLPVLAVDAVIGAVAVALLGRMMPRALAAGAA

SEQ ID NO: 9192 - DNA, 699 bp, Mycobacterium sp. KMS
  CDS (1)..(699): transl_table=11
gtgaacgtcgaccacgtcgccatgcacatgagcgacggtatcgtcaacgcgccgacgtcgctgctattcggcgcgatagccgttgccgcgcttggattttgcgtcatccgtgcgagatccgaactcgacgagcgcgcggtacccctcgccggcctcgtcgcggcgttcatcttcgccgtgcagatggtgaacttcccgatcctgcccggcgtcagcggtcacctgctgggtggggcgctggccgcgatcctcgtcggccccttcaccggtgccctgtgcatcgcgctcgtgttgacggtgcaggcgctgctgttcgccgacggtgggatcaccgctctgggcgccaacatcaccaacatggcggtgatcggcgtggccgccggttacggcaccgcggtgctgctctacgcgttcgtccggcgcagggcccgggtgccggtgacggccgtcggcgtcgtcgcattcgtcgccgccctgatcggaactctctgcgcagcaatgggtttcgtgctcgaatacagcatcggtggcgcggcgcccgcgtcgctgggtgcggtgctggcctacatgggcggcacccacgctctgatcggggtgggggagggcgtcatcaccgccctcacggtggtggccgtcgcacgcgtgcgcccggatctggtgtacctgatgcgcagcacgcgggccgaggtgccggtatga

SEQ ID NO: 9193 - protein, 232 aa, Mycobacterium sp. KMS
MNVDHVAMHMSDGIVNAPTSLLFGAIAVAALGFCVIRARSELDERAVPLAGLVAAFIFAVQMVNFPILPGVSGHLLGGALAAILVGPFTGALCIALVLTVQALLFADGGITALGANITNMAVIGVAAGYGTAVLLYAFVRRRARVPVTAVGVVAFVAALIGTLCAAMGFVLEYSIGGAAPASLGAVLAYMGGTHALIGVGEGVITALTVVAVARVRPDLVYLMRSTRAEVPV

SEQ ID NO: 9194 - DNA, 651 bp, Magnetospirillum magnetotacticum MS-1
  CDS (1)..(651): transl_table=11
atgcatatcatggaaggttttcttcccgccgggcatgccctggcctggacctgcgtgtccgcccccttcgtggtgctgggcgcccgctcgatgaagcggatcctggccgaaaggcccgaggcgcgcctgaatatcgcggcttcggccgggttcaccttcgtgctgtcggccctgaaactgcccagcgtcagcggttcgtgctcgcatcccaccggcacggccttgggcgccatgcagttcggccccggcatcatggcggtgatcggcgccatcgtgctgttgttccaggcactgttgctggcccatggcggcctgtccacactgggcgccaatatcttttccatggccatcgccgggccttgggtggccttcggcgtgtggaagctggccgggcggcttggcgctccggctgccctggcggtattcctgtcggcctttctcggcgatctttccacctatctggtgacgtcgttccagttggccctggctttccccgatgcccagagcggctttggcggcgcgttcgccaagttcgcgggcatcttcgccatcacccaactgcccctggccgtggccgaggggctggtcaccgtggtggtgatgaatgccctgcaagcccgcaacgttcaggtggaaggagccaaggcatga

SEQ ID NO: 9195 - protein, 216 aa, Magnetospirillum magnetotacticum MS-1
MHIMEGFLPAGHALAWTCVSAPFVVLGARSMKRILAERPEARLNIAASAGFTFVLSALKLPSVSGSCSHPTGTALGAMQFGPGIMAVIGAIVLLFQALLLAHGGLSTLGANIFSMAIAGPWVAFGVWKLAGRLGAPAALAVFLSAFLGDLSTYLVTSFQLALAFPDAQSGFGGAFAKFAGIFAITQLPLAVAEGLVTVVVMNALQARNVQVEGAKA

SEQ ID NO: 9196 - DNA, 924 bp, Nostoc punctiforme PCC 73102
  CDS (1)..(924): transl_table=11
atgcatattcctgatggatttgtttctgttccggtggcaggggctactggtttagccagtgtagcagcactttttattgccttcgagcgatcgcaagaagcttttggtatccgtcgtgcgcccatactgggattaaccactgccttcatttttgccgcccagatgatcaattttccggtagctggaggtactagtggtcacttattaggaggaaccttagctgcgatcgttttgggtagtccgtgggcagggacgttgtgtattgccacagttttaattattcaagctgtgctatttgctgatggtggcattacagccttgggagcaaacattttcaatatggcagtagttggtgtttgggtaggctggattttaacccaaaccttgcaacggctgttggggggatttaaagggcgtttacccctagctgctggtatagctgctggtgtaagtgtagtggtagctgctatagcttgtgctattgagttagccctctctggtactgcacctgtagccatagttttaccagctatgactggcgtacatattttgattggcattggcgaagggataattactgggggtgtgctgacttatttagctacagcccgaccagatttgttaccaggggaacagcaggaatttcgcgggtggtcagtgcctattgtcaccattttcttgattgcaggagtgctttcactctttgcctcagcctggcctgatggtttggaaaaagtcgctgaaaagacaggtttcattgatttagctgcaaaagtccgggtaattgtgccgactcccttagctgactatagtattaagggtttggggccaattggtactagtatcgctggacttatgggagctacagtttgctttgctgtagcctttgggattgccaaggtggtgaaaccgaagaatgcttaa

SEQ ID NO: 9197 - protein, 307 aa, Nostoc punctiforme PCC 73102
MHIPDGFVSVPVAGATGLASVAALFIAFERSQEAFGIRRAPILGLTTAFIFAAQMINFPVAGGTSGHLLGGTLAAIVLGSPWAGTLCIATVLIIQAVLFADGGITALGANIFNMAVVGVWVGWILTQTLQRLLGGFKGRLPLAAGIAAGVSVVVAAIACAIELALSGTAPVAIVLPAMTGVHILIGIGEGIITGGVLTYLATARPDLLPGEQQEFRGWSVPIVTIFLIAGVLSLFASAWPDGLEKVAEKTGFIDLAAKVRVIVPTPLADYSIKGLGPIGTSIAGLMGATVCFAVAFGIAKVVKPKNA

SEQ ID NO: 9198 - DNA, 621 bp, Haemophilus influenzae R2866
  CDS (1)..(621): transl_table=11
atgcatttatctgaaggcgtgttacatacgcctattttattagctggcgcagtgcttgctgttgcgggcattgccgtggggttgcgtcgtttagaatcagaacgtttaccgctcaccgcactttttgccgctgcattttttgtggcaggaaccattcatgtgcctgtaggaattggtagcgtgcatttaattttaaatggcatggcaggtttattccttgggtgggctgtttttccagcattcctcatcgcacttttattacaagtcattttcttttcttttggtggatttgccgtgttaggcgtcaatctttgtgtgatggcaacgccagcggtgatcgcttattatcttttccgttctcgtttacagccacaaatggcattaaaagatcgcttattagttggtattggagctggcgtaattggcgttggcggggcaggcgcgcttgcttcttttgtgctgatgttagatggtggaaaaagttatctgaatcttgtttggctcttgctagtctctcatcttccggtatttattttggatagtattatcagcgtaggggtgattaccttgcttggtaaaatgtatcctgaagtcatgaatcgtacccagaatgtctcttaa

SEQ ID NO: 9199 - protein, 206 aa, Haemophilus influenzae R2866
MHLSEGVLHTPILLAGAVLAVAGIAVGLRRLESERLPLTALFAAAFFVAGTIHVPVGIGSVHLILNGMAGLFLGWAVFPAFLIALLLQVIFFSFGGFAVLGVNLCVMATPAVIAYYLFRSRLQPQMALKDRLLVGIGAGVIGVGGAGALASFVLMLDGGKSYLNLVWLLLVSHLPVFILDSIISVGVITLLGKMYPEVMNRTQNVS

SEQ ID NO: 9200 - DNA, 600 bp, Magnetospirillum magnetotacticum MS-1
  CDS (1)..(600): transl_table=11
ttggcccatattcccgatggcgtgttgtccggtccggtgctggtggcggggggaatccttgccgcggtcggggtggcgcgcgggctgaaggaattggagccggagcggattcccaaggtggccatgctctcggcggtgatgttcgtggcctcgctgatccatctgcccgccggtccggcctcggtgcatctgctgctcaacggtatggctgggatcatgctgggctgggccgcctttcccgccctgctggccgccttgctgttgcaggcggtgctgttcgggttcggcggcttgctggtgctgggcgtcaacacggttaacatggcggcgcccgccgtcctggccgggctgatcttccgccgcttggccaaggatgcgtcgacgcgccgaatcgccatgatcgccgccctatgctcgggcggggccgtgctgctgacgggcgtgatggtggcggggtccctggcggcttcgggtcgcgaattcgaggccgcggcgcggctggtggtgttgtcccatctgccggtgatggggatcgaggcggtctttgcctccgccgccatcggcctcttggcgcgggtcaagccggaggcgctggcatga

SEQ ID NO: 9201 - protein, 199 aa, Magnetospirillum magnetotacticum MS-1
MAHIPDGVLSGPVLVAGGILAAVGVARGLKELEPERIPKVAMLSAVMFVASLIHLPAGPASVHLLLNGMAGIMLGWAAFPALLAALLLQAVLFGFGGLLVLGVNTVNMAAPAVLAGLIFRRLAKDASTRRIAMIAALCSGGAVLLTGVMVAGSLAASGREFEAAARLVVLSHLPVMGIEAVFASAAIGLLARVKPEALA

SEQ ID NO: 9202 - DNA, 723 bp, Crocosphaera watsonii WH 8501
  CDS (1)..(723): transl_table=11
atggtacagataatccaaaattccctcttaacgccctatttggctctacacattcccgatggctttttaagcccttctgttagcttattttgttgggtgattaccattgttttaatcactgtttccctcaaaaaagtacaaagagactaccaagaaaaaacagtccctttgatgggggtttgtgcagcctttatttttgccgcacaaatgatcaacttccctattcctggggggacatcgggccatttagtggggggaaccctagccggtattatccttggaccttgggctggtaccttagtggtaactgtggtgtttattgtccaggcggttttgttccaagatggcggtttaaccgttttaggagcaaatatcttgaatatgggactaataggaactttttgcggttattatctctatagagcaattcgtttctcgttaaaccctcgctccttgaaaagtatgaccatcgccactgtggttgcttcttggtgtagtgtggtcattgctgcgatcgcaactgcctttcaattagctttatcaggcactgttcccctaattgcatccttgatcgctatgatcggttggcacgtgcttatcggcgtgggagaagcccttattaccatgatcgctgtgggatatatctggaaatctcgtccggatctcatctacgatagtccttcctctgtcaggttggataccagacagaaagttcatggctaa

SEQ ID NO: 9203 - protein, 240 aa, Crocosphaera watsonii WH 8501
MVQIIQNSLLTPYLALHIPDGFLSPSVSLFCWVITIVLITVSLKKVQRDYQEKTVPLMGVCAAFIFAAQMINFPIPGGTSGHLVGGTLAGIILGPWAGTLVVTVVFIVQAVLFQDGGLTVLGANILNMGLIGTFCGYYLYRAIRFSLNPRSLKSMTIATVVASWCSVVIAAIATAFQLALSGTVPLIASLIAMIGWHVLIGVGEALITMIAVGYIWKSRPDLIYDSPSSVRLDTRQKVHG

SEQ ID NO: 9204 - DNA, 597 bp, Prosthecochloris aestuarii DSM 271
  CDS (1)..(597): transl_table=11
atgcatatttcagaaggtgttctgccgcttgctacactggctgcaggctatgcagtaagtaccggaggcatagccatcggccttcaaaaaatccgggatgatgaaatggttaaaaccgcgatgatctcctgcgccttttttcttgcttcgttcattcacattcccgttggccctgcacatatccatctcgtgctcaacggactggctggacttctttgtggatggtcggtgttcatcgctatcgccatagccctgttgcttcaggctctcctcttccagttcggaggcatcacaacgctcggcatcaacaccctcaacatggcgctgcctgcgctatgctgttttctgatcttcgctcctctccttgcccggaagaaactctcccctgctgtagcaggatttttctgtggcacgctctctgtctttttaagcgcgatcatgctcagcctctcgttgatcagtgcaggagaagcctttcttccaacggcacaacttatttttgtctcgaatataccgctcatgatcatcgacggccttctgaccggtgcggcattgcagtttatcagaacagtaaaacccgaaatgcttggattatga

SEQ ID NO: 9205 - protein, 198 aa, Prosthecochloris aestuarii DSM 271
MHISEGVLPLATLAAGYAVSTGGIAIGLQKIRDDEMVKTAMISCAFFLASFIHIPVGPAHIHLVLNGLAGLLCGWSVFIAIAIALLLQALLFQFGGITTLGINTLNMALPALCCFLIFAPLLARKKLSPAVAGFFCGTLSVFLSAIMLSLSLISAGEAFLPTAQLIFVSNIPLMIIDGLLTGAALQFIRTVKPEMLGL

SEQ ID NO: 9206 - DNA, 621 bp, Oceanospirillum sp. MED92
  CDS (1)..(621): transl_table=11
atgcatattgttgatggtgcgctcgctttgcctgtgttggcgacgggggctgcgctgactgtagcgggtgttgctataggtctgaagaagatggattacgatcacctgcctcaggttggcgtgttgtcagctgccttctttatcgcctcctatatccatttgccaattggcttctccagtgtgcatctgatcctgaatgggttaatcggcctggcgctaggctgggccgcttttccagcactcttggttgcgttgtttcttcaggcggtgttctttggctttggtggttttctggtgctcggggtcaatgcagtgaatatcgctctgcctgcggtcatggtttattacctgtgccgacacggtatcagttcgccatcgcccaaagtggcagcaacctggggggcgattggtggtgcaggatcgattgtgatcaccaccgttatggtggctttctcgttgatgctttcgggagaggccttcctgttagctgccaaagcaacctttgtggcgcatatccctgttatggtcgtcgaaggctttgtcactgcagcggcagtactattgatccgtaaagtgaaacctgaatttttagggatcgatgaggagcgggcttatgggtaa

SEQ ID NO: 9207 - protein, 206 aa, Oceanospirillum sp. MED92
MHIVDGALALPVLATGAALTVAGVAIGLKKMDYDHLPQVGVLSAAFFIASYIHLPIGFSSVHLILNGLIGLALGWAAFPALLVALFLQAVFFGFGGFLVLGVNAVNIALPAVMVYYLCRHGISSPSPKVAATWGAIGGAGSIVITTVMVAFSLMLSGEAFLLAAKATFVAHIPVMVVEGFVTAAAVLLIRKVKPEFLGIDEERAYG

SEQ ID NO: 9208 - DNA, 699 bp, delta proteobacterium MLMS-1
  CDS (1)..(699): transl_table=11
atgcatattgccgatgggatactgagcgggccggtggtgctgggggggctggtgggcagcgccggggtggcctggttctgcctgcggcggatcggccagcggggcaatccccatgccggggtgcccaaagcggctttgctgaccgccgtttttttcgttgcctcgctgatccacctgccactgccgccggccggagtccatctggtacttaacgggctgttgggggtggtactgggctggtacgcctttccagctattttaatcggtctttttctgcaggcggtgatgtttggccatggcggactgaccaccatcggagtcaatggcttgatcctgggcttaccggctctgctggcctggcggctttttctgctgggccggccggcggccgttggtcaccgggccagcgcaacggtaaccgatcacgggggccacggcgatcagccggcggcaagcagcggccgcatggccctggccgggtcgctggccggggggctggccatcaccgcctctctgctgctttttgtcgccgccctgaccctggggctgccggcggaatttgtgcagggggccggccgcggcgccattatcaccctgctggtcgcccacctgccgctgctggtgctggaagccggtgccaccggcctgctggtcgcctttctgcatcgggtgaaaccacaaatcctggacggtacctaa

SEQ ID NO: 9209 - protein, 232 aa, delta proteobacterium MLMS-1
MHIADGILSGPVVLGGLVGSAGVAWFCLRRIGQRGNPHAGVPKAALLTAVFFVASLIHLPLPPAGVHLVLNGLLGVVLGWYAFPAILIGLFLQAVMFGHGGLTTIGVNGLILGLPALLAWRLFLLGRPAAVGHRASATVTDHGGHGDQPAASSGRMALAGSLAGGLAITASLLLFVAALTLGLPAEFVQGAGRGAIITLLVAHLPLLVLEAGATGLLVAFLHRVKPQILDGT

SEQ ID NO: 9210 - DNA, 699 bp, delta proteobacterium MLMS-1
  CDS (1)..(699): transl_table=11
atgcatattgccgatgggatactgagcgggccggtggtgctgggggggctggcgggcagcgccggggtggcctggttctgtttgcggcggatcggccagcgaggcaatccccatgccggggtgcccaaagcggccttgctgaccgccgtttttttcgttgcctcgctgatccacctgccactgccgccggccggagtccatctggtacttaacgggctgttgggggtggtactgggctggtacgcctttccagctattttaatcggtctttttctgcaggcggtgatgtttggccatggcggactgaccaccatcggagtcaatggcttgatcctgggcttaccggctctgctggcctggcggctttttctgctgggccggccggcggccgttggtcaccgggccagcgcaactgtaactgatcacggggtccacggcgatcagccggcagcaagcagcggccgaatagccctggccgggtcgctggccggggggctggccatcaccgcctctctgctgctttttgtcgccgccctggccctggggctgccggcggaatttgtgcagggggccggccgcggcgccattatcaccctgctggtcgcccacctgccgctgctggtgctggaagccggtgccaccggcctgctggttgcctttctgcatcgggtgaaaccacaaatcctggacggtacctaa

SEQ ID NO: 9211 - protein, 232 aa, delta proteobacterium MLMS-1
MHIADGILSGPVVLGGLAGSAGVAWFCLRRIGQRGNPHAGVPKAALLTAVFFVASLIHLPLPPAGVHLVLNGLLGVVLGWYAFPAILIGLFLQAVMFGHGGLTTIGVNGLILGLPALLAWRLFLLGRPAAVGHRASATVTDHGVHGDQPAASSGRIALAGSLAGGLAITASLLLFVAALALGLPAEFVQGAGRGAIITLLVAHLPLLVLEAGATGLLVAFLHRVKPQILDGT

SEQ ID NO: 9212 - DNA, 648 bp, Magnetospirillum gryphiswaldense
  CDS (1)..(648): transl_table=11
atgcatatcatggaaggttttcttcccgcaggccacgcgctggcctggaccgccgtctcggcgccgttcgtctttgtcggtgtcgcccggttgcgcaaggtgttgcgcgatcgccctgagatgcgcctgaccctggccgccgccggcgccttcgcctttgtcctgtcggccttgaagttgcccagcgtcaccgggtcgtgctcgcaccccaccggtaccggcctgggggccatggtggttggaccggcggcgaccacggtgctgggcaccatcgtgcttctgttccaatccctgttgctggcccatggcgggctgaccaccttgggtgccaacgtgttttccatggcggtggccggaccctggatcgccttcggcgtgtggaagctggccggaaggctgggcgcgcctgtgggcttggcggtgttcctgggcgcggccttgggcgatctgggcacctatgtggtgacctcggcccagttggccttggcttttcccgatgaaatcagcggctatggcggcgccttcgccaagttcgccggtattttcgccctgacccagattccgctggccatcgccgagggtctgctgaccgtggtggtgatgaatgccctggtcggacgccagatcaagctggaggtgcgggcatga

SEQ ID NO: 9213 - protein, 215 aa, Magnetospirillum gryphiswaldense
MHIMEGFLPAGHALAWTAVSAPFVFVGVARLRKVLRDRPEMRLTLAAAGAFAFVLSALKLPSVTGSCSHPTGTGLGAMVVGPAATTVLGTIVLLFQSLLLAHGGLTTLGANVFSMAVAGPWIAFGVWKLAGRLGAPVGLAVFLGAALGDLGTYVVTSAQLALAFPDEISGYGGAFAKFAGIFALTQIPLAIAEGLLTVVVMNALVGRQIKLEVRA

SEQ ID NO: 9214 - DNA, 729 bp, Microcystis aeruginosa PCC 7806
  CDS (1)..(729): transl_table=11
atgtctattaattttctaggggttggtttgtttcaccctctcctgaccccttatctcgccctccatatacccgacggctttttgagtccatcggtgagtctatttacttggataattgccgtcgtcctgattggcttttctcttaaaaaagtgcgcggtcactacgctgaacgggctgtacctttgatgggagtttgtgccgcctttatttttgccgcccagatgattaattttcccattccagggggaacctccggacatttgttaggggggactctcgcgggggttttactcggtccctgggcgggttctctggtgatggcggtggtttttatcgtgcaagctttattttttcaagatggtggtttaacggttttaggggctaatatcgtcaatatgggtctgatcgggacgtttggcggttattatctctatctggggattagaaaagccttcggttttcatcgttggcgcagtatggcgatcgctgttgccgtggctgcttggacaagtgtggtggtggcggcgttagcttgcgccctgcaattggctttatcggggactgtaccgcctttagtcgcccttgtggccatgttatcttggcatatccttatcggtatcggggaagcggtgattaccgttttcgctgtcggttatatctggcgaacccgtcccgatcttctctacgatccgccccattccgttaatacttttgtttctccttcctaa

SEQ ID NO: 9215 - protein, 242 aa, Microcystis aeruginosa PCC 7806
MSINFLGVGLFHPLLTPYLALHIPDGFLSPSVSLFTWIIAVVLIGFSLKKVRGHYAERAVPLMGVCAAFIFAAQMINFPIPGGTSGHLLGGTLAGVLLGPWAGSLVMAVVFIVQALFFQDGGLTVLGANIVNMGLIGTFGGYYLYLGIRKAFGFHRWRSMAIAVAVAAWTSVVVAALACALQLALSGTVPPLVALVAMLSWHILIGIGEAVITVFAVGYIWRTRPDLLYDPPHSVNTFVSPS

SEQ ID NO: 9216 - DNA, 657 bp, Archaeoglobus fulgidus
  CDS (1)..(657): transl_table=11
gtgatgcacataatggagggttacctgccacctgagtgggctgcattctggtatgtttttgccataccatttctggtctacggagctcttcgagttaagaggattatagaggaaaagccatcgatgaagtccttaattgctgtttctgcaggcttcatcttcgtcctctcagccctcaagcttccatctgtgactggaagctgctcacatccgactgggactggcatagcagtggtgtttttcgggcctgcggtgacagccctgctttcggcaatagtgctgctctaccaagccttgctgctggctcatggagggataacaacgctcggagcaaacactgcttccatgggcgttataggcccctttgttgggtggattgctttcaagctgctgaagaatgtcaatttcagagtggctgtttttgctgctgcgatgctctcggatctggtaacttatgtggtcacctcactgcagctcgcccttgcctttcccagctcagctggagttgcaggcataatcaaatccgctgcgaccttcatgggcatattcgccgtaactcaggttccgctctccatcattgagggcgtggtggctgtgatgctcgtctcctacatctttgaagttagaagcgacgttctggaggtggtaaaggcatga

SEQ ID NO: 9217 - protein, 218 aa, Archaeoglobus fulgidus
MMHIMEGYLPPEWAAFWYVFAIPFLVYGALRVKRIIEEKPSMKSLIAVSAGFIFVLSALKLPSVTGSCSHPTGTGIAVVFFGPAVTALLSAIVLLYQALLLAHGGITTLGANTASMGVIGPFVGWIAFKLLKNVNFRVAVFAAAMLSDLVTYVVTSLQLALAFPSSAGVAGIIKSAATFMGIFAVTQVPLSIIEGVVAVMLVSYIFEVRSDVLEVVKA

SEQ ID NO: 9218 - DNA, 774 bp, Streptomyces coelicolor; identical to SEQ ID NO: 9086
  CDS (1)..(774): transl_table=11

SEQ ID NO: 9219 - protein, 257 aa, Streptomyces coelicolor
MVPVSQETGQGASSIHEVLERVCRVMHIAEGFLPPAHAIAWGVASAPFVVHGVRSLTREVREHPESTLLLGASGAFTFVLSALKLPSVTGSCSHPTGTGLGAILFRPPIMAVLGTITLLFQALLLAHGGLTTLGANVFSMAIVGPWAGYGVYRLLRRWDVPLMVTVFFGAFVADLSTYCVTSVQLALAFPDPSSGFLGALGKFGSIFAVTQIPLAVSEGLLTVIVMRLLVQSSKGELTRLGVLLTRTGERKQEAVAR

SEQ ID NO: 9220 - DNA, 669 bp, Rhodobacter capsulatus
  CDS (1)..(669): transl_table=11
atgcatatcatggagggctatctgcccgtcacccatgccattggctggtcccttgccgccggcccctttgtcgtcgcgggcgcggtgaagatccgcaagatcgtcgccgagcgtcccgaggcccggatgacccttgccgcctcgggggcctttgccttcgtgctctcggcgctgaaaattccgtccgtcaccggctcgtgctcgcatccgaccggcaccgggctgggcgcggtcgtcttcggcccctcggtcatggcagtgcttggggtgatcgtgctgctgtttcaggcgcttttgctggcgcatggcggtctgacgacgcttggcgccaatgccttctcgatggcgatcgtcgggccctgggtggcctggggcgtctataaactggcgggcaaggccggggcctcgatggcggtggcggtgtttctggccgctttcctcggcgatctggcgacctatgtgaccacctcgctgcagctggcgctggcttaccccgatccggtttcgggcttcctcggcgcggcgctgaaattcggctcggtcttcgcgctgacgcagatcccgctggcgattgccgagggcttcctgaccgtgatcgtcgtcgatgcgctggcgggcaaggtcgatgacaaggacaaattgcgcattctggccggggaggcacgctga

SEQ ID NO: 9221 - protein, 222 aa, Rhodobacter capsulatus
MHIMEGYLPVTHAIGWSLAAGPFVVAGAVKIRKIVAERPEARMTLAASGAFAFVLSALKIPSVTGSCSHPTGTGLGAVVFGPSVMAVLGVIVLLFQALLLAHGGLTTLGANAFSMAIVGPWVAWGVYKLAGKAGASMAVAVFLAAFLGDLATYVTTSLQLALAYPDPVSGFLGAALKFGSVFALTQIPLAIAEGFLTVIVVDALAGKVDDKDKLRILAGEAR

SEQ ID NO: 9222 - DNA, 744 bp, Lactobacillus reuteri
  CDS (1)..(744): transl_table=11
atgggagcattgaaaaaatatcgaaaatttatgttatttttagcaattggttttatttatacccttgcttatccgatgacagctcacgcaatgcatatcatggaaggaatgctgccgcctaagtggtgtattttctggtttgttgtatccgcaccattcttcatttatggattatatcgaatgcacaagatcgtcaattcagatattcctaatgctaaggttatgttagcgctttgtggagcttttgtttttgttctctcgtcattaaaactgccgtcagttactggttcatgttctcacccgacaggtgttgggttaggaacagtaatgtttggcccaggtgttatgtctgttttgggtgttattgtgctattattccaggctttattgttagctcatggtggattaactactcttggagctaatgaattttcgatgaccattgttggaccaatagttgggtatgctgtttggaaactttgtcgagcaatgaaggttagacggtctatatcattattcctttgtgcaatgtttgcggattggtcaacatatgtaacaactgcctttcaattagcaattgtttttccagatccaaacggtggtgttggagcagcacttgtcaagttcctcggaatttatgccgtaacacaaattccattagcgattgctgaaggcttattaacggttattgtttacaacttagtaatcagtaatgatctttggaaggagtcggctttacaatga

SEQ ID NO: 9223 - protein, 247 aa, Lactobacillus reuteri
MGALKKYRKFMLFLAIGFIYTLAYPMTAHAMHIMEGMLPPKWCIFWFVVSAPFFIYGLYRMHKIVNSDIPNAKVMLALCGAFVFVLSSLKLPSVTGSCSHPTGVGLGTVMFGPGVMSVLGVIVLLFQALLLAHGGLTTLGANEFSMTIVGPIVGYAVWKLCRAMKVRRSISLFLCAMFADWSTYVTTAFQLAIVFPDPNGGVGAALVKFLGIYAVTQIPLAIAEGLLTVIVYNLVISNDLWKESALQ

SEQ ID NO: 9224 - DNA, 606 bp, Candidatus Kuenenia stuttgartiensis
  CDS (1)..(606): transl_table=11
ttgcatattagcgacggagtactttctccctacattgtcattaccggatgggctgttgcagccccttcgttagcgatgtcggtaaaaagcctgaaacctgacaaagtcggtgcatacggagtaattgccgctgttttttttgcaggttcgacaatccacataccccttggacctttcagcatgcatcttgtcctcaatggtattgcaggacttttactgggatggagcgctgtaaccgtaataacggtaggccttttgctgcaggctttgttccttggttttggaggattgactgtgttgggggtaaatattgctgttatggcgttgcctggcgcgattatcggcatgcttggacgccattggatgaaacagttttcagcgaaaaaacggccatggataggatcgttcgcgggtggcggtgctgtatgtatttcgtccgttttactctttgttgcgctttctacaacccatgcggcgctggcgccccttgccaaactggttttttggggacatgttcctgtcatacttgttgaaggcgttatcagttattggctggtacactttttgcaaaaagcaaaaccttcgttattaggaattttacattga

SEQ ID NO: 9225 - protein, 201 aa, Candidatus Kuenenia stuttgartiensis
MHISDGVLSPYIVITGWAVAAPSLAMSVKSLKPDKVGAYGVIAAVFFAGSTIHIPLGPFSMHLVLNGIAGLLLGWSAVTVITVGLLLQALFLGFGGLTVLGVNIAVMALPGAIIGMLGRHWMKQFSAKKRPWIGSFAGGGAVCISSVLLFVALSTTHAALAPLAKLVFWGHVPVILVEGVISYWLVHFLQKAKPSLLGILH

SEQ ID NO: 9226 - DNA, 750 bp, Candidatus Kuenenia stuttgartiensis
  CDS (1)..(750): transl_table=11
ctgttaaatataacggtttttttgctcgtgttccttgtttccgataaggctgcatatgcaatgcacattacagaaggaattctgcccacagaatgggcagtaacattgtttgccgtctcgattccttttttaggtattgggatttaccaggtgaaacggaagaaaagagagatgcatagttacctgccgttagttggcatgctgggagcggcagtattcgttttttcgtgcttccccgttcccgtcgtagcattaaacggaatggcaacttcccatccatgcggcacaggcatgagtgctattttgctgggaccttttgtcagtgtactgatagcgggcattgccttgcttattcaagccttgtttttggcgcatggcgggttaacaacgctgggcgggaatatattttccatgggtattttaggctctttctccggattttttgcgttcaaaataacccggcgctgcggcatgccattattttggtgcggcttctttgcaggtgtaatttctgatttatttacttatttgggtacctctattgaactgggattgctcgtaataaataatggtgggtctttcttcagggcgactgcagaaatatttggcgtctttatgatgacctcacagggggtcttatgtattgtggaaggcgtggttgttggatttattctggtttttatagaaaaaagaaggccggatattttggttcaacttgggatgataaagaaaaatgcaaaacctgtttaa

SEQ ID NO: 9227 - protein, 249 aa, Candidatus Kuenenia stuttgartiensis
MLNITVFLLVFLVSDKAAYAMHITEGILPTEWAVTLFAVSIPFLGIGIYQVKRKKREMHSYLPLVGMLGAAVFVFSCFPVPVVALNGMATSHPCGTGMSAILLGPFVSVLIAGIALLIQALFLAHGGLTTLGGNIFSMGILGSFSGFFAFKITRRCGMPLFWCGFFAGVISDLFTYLGTSIELGLLVINNGGSFFRATAEIFGVFMMTSQGVLCIVEGVVVGFILVFIEKRRPDILVQLGMIKKNAKPV

SEQ ID NO: 9228 - DNA, 780 bp, Moorella thermoacetica
  CDS (1)..(780): transl_table=11
atgttccgccgtacaacctggttaacactgtatcttctcctggctatggccgcgctggcccggccggcctttgccatgcatatcgccgaaggcttcctgcctttcaattgggccgccttttggtttatcgtcgtcctgcccttctggatctggggcctgcgctccatccggcataccgttaaaagtaaccccggcctgaaaatgctcctgggcctggccggcgcctatacctttgtcctctcggccctgaaactcccttcagtgaccgggagctgttcccatcctaccggcatcggcctgggggccgttctcttcggcccggcagccatgagcatcctggggggcattgttctcctcttccaggccctgttactggcccacgggggtcttagtaccctgggcgccaacaccttttccatggccgtcgtcggtccctttgtggcctacggcctttaccgcctggtaagaaagctcaaagggtcaatgcccctggccgtcttcctggctgccaccctgggtgatttgatgacctatgtcaccacctccctccagctcgccctggctttcccggcccaggccgggggagtggtagcttccatgctcaaattcatgggcatctttgccgttacccaactacctctggccatcagtgagggctttttaacggtcatcgtctttaaccttctggccacctataacaaaaacgacctggaggagctgtcaatcatgccggggaagacggcggctgaaggtggccccagccggcagtacagccggtaa

SEQ ID NO: 9229 - protein, 259 aa, Moorella thermoacetica
MFRRTTWLTLYLLLAMAALARPAFAMHIAEGFLPFNWAAFWFIVVLPFWIWGLRSIRHTVKSNPGLKMLLGLAGAYTFVLSALKLPSVTGSCSHPTGIGLGAVLFGPAAMSILGGIVLLFQALLLAHGGLSTLGANTFSMAVVGPFVAYGLYRLVRKLKGSMPLAVFLAATLGDLMTYVTTSLQLALAFPAQAGGVVASMLKFMGIFAVTQLPLAISEGFLTVIVFNLLATYNKNDLEELSIMPGKTAAEGGPSRQYSR

SEQ ID NO: 9230 - DNA, 738 bp, Geobacter metallireducens
  CDS (1)..(738): transl_table=11
atgaaaacggtgctttttatagggtgcgtgctccttattatggcctctcccgcccatgccatgcacatctccgagggaatcctcccctttggctgggctgcgctctggttcgcggtggcggtgccattcctggcggtggggctcaggcggctcaacgagctttcccgggacgacctctccatgaagccgctggtggggctcatggcggcggtggtctttatcatctcctgcatgccgatcccggtccccagcgccggcacctgttcccacccctgcggtaccggtatctcggccatcctggtgggacccttcgtgtcggtggccatcgccgcggtggcactcctcattcaggcgctcctcctggcccacggggggctgtcgaccctgggggccgacatcgtttccatgggagtggtgggctcattcgcggggtggtttgtgttccaggggatgcgccgggtgagggcgagccttgccgtggcggggttcgcggcggggcttcttgccgactgggccacctatctggccacctccggggagctggccgccggtatccggggaagcgagccctttatccccctttttctgaagattgccgtggccttcatcccgacacagcttcccctggggattctcgaaggggccatgaccgccggtatggtggtgctcctctcccgcaagcggcccgacctgctggtgaagatgcgggtgctccgggccgaagaggtggcggcgtga

SEQ ID NO: 9231 - protein, 245 aa, Geobacter metallireducens
MKTVLFIGCVLLIMASPAHAMHISEGILPFGWAALWFAVAVPFLAVGLRRLNELSRDDLSMKPLVGLMAAVVFIISCMPIPVPSAGTCSHPCGTGISAILVGPFVSVAIAAVALLIQALLLAHGGLSTLGADIVSMGVVGSFAGWFVFQGMRRVRASLAVAGFAAGLLADWATYLATSGELAAGIRGSEPFIPLFLKIAVAFIPTQLPLGILEGAMTAGMVVLLSRKRPDLLVKMRVLRAEEVAA

SEQ ID NO: 9232 - DNA, 735 bp, Carboxydothermus hydrogenoformans
  CDS (1)..(735): transl_table=11
atggtggagggcatgttaaaaaccaattttcgcttattgtttctgttaatttttcttttaattcccaccccggttcttgccatgcatattatggaagggtttttaccggtaaaatgggtgattttctgggatcttgttactctaccttttataatggtaggttttatccgtttgcaaagggaagctacccaggggccgggagcgaaactaatgttagcttttgccggagcgtttatctttgttttatcggcgctaaaaatgccttcggtaacgggcagttgttcccatcctaccggaacggggttggctgcaattttatttgggccctttatcacaaccgtattaggttttattgttttgatttttcaggctcttcttttagcccacggtggccttaccacccttggtgctaatactttctccatggcagttgctggaccactggtagcttacggggtttataaagggttacagaaagccggaattaatagtaattttagcatttttttagcggccatgctgggagacctggtcacctatatcgttacttcggtccaactggcgttagcctttccgggaagttctctttttttaagtgctttaaaatttatgggaatctttgccttaacccaaattcctttagctataagtgaagggattttaacggttttaacctataatttcttgagccgttatgaagatgccaaaatatgggtagaaaagggtgagcattaa

SEQ ID NO: 9233 - protein, 244 aa, Carboxydothermus hydrogenoformans
MVEGMLKTNFRLLFLLIFLLIPTPVLAMHIMEGFLPVKWVIFWDLVTLPFIMVGFIRLQREATQGPGAKLMLAFAGAFIFVLSALKMPSVTGSCSHPTGTGLAAILFGPFITTVLGFIVLIFQALLLAHGGLTTLGANTFSMAVAGPLVAYGVYKGLQKAGINSNFSIFLAAMLGDLVTYIVTSVQLALAFPGSSLFLSALKFMGIFALTQIPLAISEGILTVLTYNFLSRYEDAKIWVEKGEH

SEQ ID NO: 9234 - DNA, 777 bp, Anabaena variabilis
  CDS (1)..(777): transl_table=11
atgattctcacatcgaaacgcgcttccctcatcctcatggggattctgagcttttatatcattgttagttcatctgcgccagcttatgcgatgcacattatggagggctacctaccagcaggatgggcagctttttggtggttagtagctttaccgtttatggttttaggagtgcgatcgctcacccgcatcaccaaagccaacccagaactaaaattattgttagcattggcgggggcttttactttcgtattatccgctttgaaattgccctctgtgacgggtagttgttctcacccgacaggtacaggcttaggggctgtgctgttcgggcctttggcgatgtctgttttgggtagtctagtattgttgtttcaagcattgttgctggcccacggtggtttaacaaccttgggtgcaaacgctttttcaatggcgatcgctggcccatttgccgcctattggatatatcatctgacaatccagttaactggtaagcaaagaatcgccatctttttagcagccaccttagcagatttgctaacctacattattacttccgtccaactagccttagcctttcccgcaccagtgggcggatttatcgcctcattcgccaaatttgctggtatttttgccattactcaaatccctctagccattagtgaaggattattgactgtcttagtatggaactggctacaatcctattcaccgcaagaactccaactgctgaaattaatccaaagggaacctcaaagccatgaatcaatctaa

SEQ ID NO: 9235 - protein, 258 aa, Anabaena variabilis
MILTSKRASLILMGILSFYIIVSSSAPAYAMHIMEGYLPAGWAAFWWLVALPFMVLGVRSLTRITKANPELKLLLALAGAFTFVLSALKLPSVTGSCSHPTGTGLGAVLFGPLAMSVLGSLVLLFQALLLAHGGLTTLGANAFSMAIAGPFAAYWIYHLTIQLTGKQRIAIFLAATLADLLTYIITSVQLALAFPAPVGGFIASFAKFAGIFAITQIPLAISEGLLTVLVWNWLQSYSPQELQLLKLIQREPQSHESI

SEQ ID NO: 9236 - DNA, 978 bp, Streptococcus vestibularis
  CDS (1)..(978): transl_table=11
atgcatattcctgaaaattacctaagccctacgacttgtgcggcaatgggggctgttatgttgcctatttggtataaggccgtcaaggaagtaaaggttaaagttgatactgataaaaaaacgattcctatgttgggaatcgggacttccttgtccttccttatcatgatgtttaatcttccagccccaggtggaacgagcgcccatgctgttggggcagtgttaattgctatattgttaggaccttgggcttcctgtttagcagttagtgtagccctggctatgcaggccttgctctttggtgatggtggaatcttggactttggtgctaatgccttttgtatggccgttgttatgccatttgtgggttatgctgtttataaactcttgaacaagtggacaaagaacaggataattgctagcttttttggaggttatattgggattgtagctgcggccctgactgttgcagttttactaggaattcaacctattctctttaaagatggcagtggtaatccactttacaatccataccctttgagagtgacgcttccagtaatgggcttgactcacctcctcatcggtctggtagaaggattcttcacagcaggtgtccaagaattcattgaacgtttgaatattgataatactcaggaactaacgactaaaaaactacgtcctttattgctctttatcctagccttaattatcctaacgccacttggtttattggcgacgggaacagcttttgcggaatgggatgtcaaagagttggtggaaaaattgtcccactatcatgtggaagcccaagccccaaaaggaatgttgaatggtttctcatttaatgccctcttcccagattatagtatcgcgggcattccggaagtcttgggttatatcctgagcgctgcctctgctgttttgattttcttcatcctctatcgcttgattttcggtagaaaggttgaaaaatga

SEQ ID NO: 9237 - protein, 325 aa, Streptococcus vestibularis
MHIPENYLSPTTCAAMGAVMLPIWYKAVKEVKVKVDTDKKTIPMLGIGTSLSFLIMMFNLPAPGGTSAHAVGAVLIAILLGPWASCLAVSVALAMQALLFGDGGILDFGANAFCMAVVMPFVGYAVYKLLNKWTKNRIIASFFGGYIGIVAAALTVAVLLGIQPILFKDGSGNPLYNPYPLRVTLPVMGLTHLLIGLVEGFFTAGVQEFIERLNIDNTQELTTKKLRPLLLFILALIILTPLGLLATGTAFAEWDVKELVEKLSHYHVEAQAPKGMLNGFSFNALFPDYSIAGIPEVLGYILSAASAVLIFFILYRLIFGRKVEK

SEQ ID NO: 9238 - DNA, 738 bp, Escherichia blattae
  CDS (1)..(738): transl_table=11
atgaaggcgcagatccgctacctcgccatgagtgccggggcgccagccctggtcctgatggcggtgcctgccgatgcctgggcgatgcacatcatggagggttttttaccgcctcttcacgccctggtgtggtggcttttgttcctgccgtgcctgtggctggggctggtgcgcctgcgccagatagtcagcgcagacagcaaccagaaagtgctgctggccctgtgcggtgcgtttatttttgtgctctcggcactgaagatcccctccgtcaccggcagttgttcacacccgaccggcgcggggctggcggttattctgttcggccccggggtggtggctattctcggggcgattgtgctgctgtttcaggcactgctgctggcccacggggggctgaccacccttggcgctaacggcatgtcgatggcggttctcggcccggtggtcgggtatctggtctggaggctggctacccgtgccgggctgcgccgggatgtggccatattcctgtgcgcggcgctggcggatctggcgacctatgtggtcacctcgctacagctcggggtcgccttcccggatccccacagcggggttgccggatcggtgatgaaatttatggggatcttctgcctcacccaggtgcctgtcgccattgccgaagggctgctgacggtgctgatttatgatcagctgagtaaacgccacctggtacaggccccgggagtacgcggatga

SEQ ID NO: 9239 - protein, 245 aa, Escherichia blattae
MKAQIRYLAMSAGAPALVLMAVPADAWAMHIMEGFLPPLHALVWWLLFLPCLWLGLVRLRQIVSADSNQKVLLALCGAFIFVLSALKIPSVTGSCSHPTGAGLAVILFGPGVVAILGAIVLLFQALLLAHGGLTTLGANGMSMAVLGPVVGYLVWRLATRAGLRRDVAIFLCAALADLATYVVTSLQLGVAFPDPHSGVAGSVMKFMGIFCLTQVPVAIAEGLLTVLIYDQLSKRHLVQAPGVRG

SEQ ID NO: 9240 - DNA, 738 bp, Salmonella choleraesuis
  CDS (1)..(738): transl_table=11
atgaaacttgaacagcagcttcgacagttgtctttcagtggactggctgcagcgctattgctgatggttgtcccgcaacaggcgtttgcgatgcatatcatggagggctttttaccgccagtgtgggcgctggcctggtggttactgtttttaccctgcttgtggtatggactggtgcgcttacggcgtattgtgcaggaggataatcatcagaaggtactgctggcactgtgcggcgcgtttatttttgtcctgtccgcgctcaaaattccgtcggtaacggggagttgttcacatccgaccggcgttggtctggcggttatcttgttcgggcccgggggggtggcgattctcggcgcggttgtgctgttgtttcaggcgctattgctggcgcacggcggcctgacgacgcttggcgcaaatggaatgtcgatggcggtgattggcccggttgtcggttatctggtgtggaaaatggcctgccgtgccggactgcgccgcgatgtcgctgtttttctgtgcgcgatgctggcggatttggcgacctattttgtgacttcagtccagcttggcgttgcgtttcccgatccccatgccggagcgacagggtctgttgtgaagtttatggggattttctgcctcacacagattcctgtcgctattgctgaaggtttattaaccgtcatgatttatgaccagttaaccaaacggcaagtgattaccgtacaaggacattaa

SEQ ID NO: 9241 - protein, 245 aa, Salmonella choleraesuis
MKLEQQLRQLSFSGLAAALLLMVVPQQAFAMHIMEGFLPPVWALAWWLLFLPCLWYGLVRLRRIVQEDNHQKVLLALCGAFIFVLSALKIPSVTGSCSHPTGVGLAVILFGPGGVAILGAVVLLFQALLLAHGGLTTLGANGMSMAVIGPVVGYLVWKMACRAGLRRDVAVFLCAMLADLATYFVTSVQLGVAFPDPHAGATGSVVKFMGIFCLTQIPVAIAEGLLTVMIYDQLTKRQVITVQGH

SEQ ID NO: 9242 - DNA, 744 bp, Geobacillus kaustophilus
  CDS (1)..(744): transl_table=11
atgaagagagcggttcgatggagcggaatggcggctttgttcgtttcctattttttgttgacgaatgaaaatgaagcgtatgccatgcatattatggaaggatttttgcctgtcaaatgggcgctgttttggtggctgttgtttttgccgttctttgtgttcggattgcggcggcttgtgcatacgctgaagcagcaccccgaacataagcttctgatggcgttagctggcgcgtttacatttgtattgtcggcgttgaaaattccatccgtcaccggcagcagctcgcatccgaccgggatcggcttcggctcggttttgtttggaccatgggtgatggtggtgatcggcacagtcgttcttctctttcaagcgctgcttcttgcccacggaggagtgacgacgcttggggccaatgcgatgtcgatggcgatcgtcggcccgttcgtcgcgtacggagtgtatcaactgtgccgaaaaggggcggtatccaatcgagcggctttgtttcttgccgcttgtttgtctgatttggctacatatgtcatgacgtccctgcagcttgccctggcgtttccgtctcctgatgggggagtcaccgcctcgtttttgaaattcgccggcatttttgccattactcaagtgccgttggcggtgacggaaggcatcataacggtaatcgtctggaactggctttcctcctatcaagcttctccgctgttccaaaaggaaaagggggcgtaa

SEQ ID NO: 9243 - protein, 247 aa, Geobacillus kaustophilus
MKRAVRWSGMAALFVSYFLLTNENEAYAMHIMEGFLPVKWALFWWLLFLPFFVFGLRRLVHTLKQHPEHKLLMALAGAFTFVLSALKIPSVTGSSSHPTGIGFGSVLFGPWVMVVIGTVVLLFQALLLAHGGVTTLGANAMSMAIVGPFVAYGVYQLCRKGAVSNRAALFLAACLSDLATYVMTSLQLALAFPSPDGGVTASFLKFAGIFAITQVPLAVTEGIITVIVWNWLSSYQASPLFQKEKGA

SEQ ID NO: 9244 - DNA, 630 bp, Desulfotalea psychrophila; identical to SEQ ID NO: 9134
  CDS (1)..(630): transl_table=11

SEQ ID NO: 9245 - protein, 209 aa, Desulfotalea psychrophila
MLLSWRHYMHISEGVLSPPVLALGGVITVAGTAMGLKHLDGEKIMTTALLTSTFFVASLIHVPVGPANVHLILSGLMGITLGWACFPAILTALFLQVLFFQYGGFTVLGVNTANMAVPAIICYLLFRPLLTSGKKGQKVAAFASGFIAVLLGTLFMAGSLFASDQQFFNTAKLVCIAHIPLMFIEGIITMFAVTFLAKVQPEFLQLKTK

SEQ ID NO: 9246 - DNA, 1041 bp, Geobacter sulfurreducens; identical to SEQ ID NO: 9110
  CDS (1)..(1041): transl_table=11

SEQ ID NO: 9247 - protein, 346 aa, Geobacter sulfurreducens
MKRITLYAAGSAIIGAMLLAGPAHAMHISEGILPLGWAALWFAVAAPFLALGIRRVNELSRHDLSFKPLVGLMAAVVFIISCMPIPVPTAGTCSHPCGTGIAAILVGPLVSVVITTVALLIQALFLAHGGLSTLGADVVSMGVAGSFAGWFVFRGMRRLGAGLAVAAFVAGLLADWATYLTTALELSSGVRGSEPFYPLFLKIVAAFVPTQLPLGVLEGAMTAGMVVLLHRKRPDLLAKMGVVDAGGPGAGPRRATVVMLALFCLLASLLVAGPSRASEKWPGVDETVVEKIAAEHGREPRDPLINTDQGDLLLFVFLLAGTVGGFAAGYFWRMLVAERRTYDDHT

SEQ ID NO: 9248 - DNA, 978 bp, Streptococcus salivarius
  CDS (1)..(978): transl_table=11
atgcatattcctgaaaattacttaagccctatgacttgtgcggcaatgggggcagttatgttgcctatttggtataaggctgtcaaggaagtgaaggtaaaggttgacactgataaaaaaacgattcctatgttgggaatcgggacttccttgtccttccttatcatgatgtttaatcttccagccccaggtggaacgagtgcccatgctgttggggcagtgctaattgctatattattaggaccttgggcctcctgtttagcagttagtgtggctctagctatgcaggctttgctatttggtgatggtgggattttggcctttggtgcgaatgccttttgtatggctgttgtcatgccatttgtgggttatgctgtttataaactcttgaataagtggacgaagaacaggataattgctagcttttttggaggttatattggaattgtagttgcggccctaactgttgcggttttactaggaattcaaccgattctctttaaagatagcagtggtaatccgctttacaatccataccctttgagagtgacgcttccagtaatgggcttgactcacctgcttatcggcttggtagaaggatttttcacagccggtgttcaagaattcattgaacgtttgaatattgataatactcaggaaataacgactaaaaaactacgtcctttattgctctttatcctagccttaattatcctaacgccacttggtttattggcgacgggaacagcttttgcagaatgggatgtcaaagagttggtagaaaaattgtctcattaccatgtggaagcccaagcgccaaaaggaatgttgaatggtttttcattcaatgccctcttcccagattatagtatcgcaggcattccagaagttttgggttatatcctgagcgctgcctctgctgttttgattttcttcatcctctatcgcttgattttcggtagaaaggttgaaaaatga

SEQ ID NO: 9249 - protein, 325 aa, Streptococcus salivarius
MHIPENYLSPMTCAAMGAVMLPIWYKAVKEVKVKVDTDKKTIPMLGIGTSLSFLIMMFNLPAPGGTSAHAVGAVLIAILLGPWASCLAVSVALAMQALLFGDGGILAFGANAFCMAVVMPFVGYAVYKLLNKWTKNRIIASFFGGYIGIVVAALTVAVLLGIQPILFKDSSGNPLYNPYPLRVTLPVMGLTHLLIGLVEGFFTAGVQEFIERLNIDNTQEITTKKLRPLLLFILALIILTPLGLLATGTAFAEWDVKELVEKLSHYHVEAQAPKGMLNGFSFNALFPDYSIAGIPEVLGYILSAASAVLIFFILYRLIFGRKVEK

SEQ ID NO: 9250 - DNA, 978 bp, Streptococcus thermophilus
  CDS (1)..(978): transl_table=11
atgcatattcctgaaaattacctaagccctatgacttgtgcggcaatgggggcagttatgttgcctatttggtataaggctgtcaaggaagtgaaggtaaaggttaacactgataaaaaaacgattcctatgttgggaatcgggacttccttgtccttccttatcatgatgtttaatcttccagccccaggtggaacgagtgcccatgctgttggggcagtgctaattgctatattgttaggaccttgggcctcctgtttagcagttagtgtggctctagctatgcaggctttgctatttggtgatggtgggattttggcctttggtgcgaatgccttttgtatggctgttgtcatgccatttgtgggttatgctgtttataaactcttgaataagtggacaaagaataggataattgctagcttttttggaggttatattggaattgcagttgcggccctgactgttgcggttttactaggaattcaaccgattctctttaaagatagcagtggtaatccgctttacaatccatatcctttgagagtgacgcttccagtaatgggcttgactcacctgcttatcggcttggtagaaggatttttcacagccggtgttcaagaattcattgaacgtttgaatattgataatactcaggaaataacgactaaaaaactacgtcctttattgctctttatcctagccttaattatcctaacgccacttggtttattggcgacgggaacagcttttgcagaatgggatgtcaaagagttagtagaaaaattgtctcattaccatgtggaagcccaagcgccaaaaggaatgttgaatggtttttcattcaatgccctcttcccaaattatagtatcgcaggcattccagaagttttgggttatatcctgagtgctgcctctgctgttttgattttcttcatcctctatcgcttgattttcggtagaaagagtgaaaaatga

SEQ ID NO: 9251 - protein, 325 aa, Streptococcus thermophilus
MHIPENYLSPMTCAAMGAVMLPIWYKAVKEVKVKVNTDKKTIPMLGIGTSLSFLIMMFNLPAPGGTSAHAVGAVLIAILLGPWASCLAVSVALAMQALLFGDGGILAFGANAFCMAVVMPFVGYAVYKLLNKWTKNRIIASFFGGYIGIAVAALTVAVLLGIQPILFKDSSGNPLYNPYPLRVTLPVMGLTHLLIGLVEGFFTAGVQEFIERLNIDNTQEITTKKLRPLLLFILALIILTPLGLLATGTAFAEWDVKELVEKLSHYHVEAQAPKGMLNGFSFNALFPNYSIAGIPEVLGYILSAASAVLIFFILYRLIFGRKSEK

SEQ ID NO: 9252 - DNA, 1002 bp, Lactobacillus plantarum
  CDS (1)..(1002): transl_table=11
gtgaggtgctcatccgtgcatattccggataattatttaagtcccgcaacttgcggaacgttggtcaccgcgatggctcccgtctggaccgtcgccgttttaaaagttaaagttcaaatcaaaaaacatcatgaaaccctgccaatgctcggcatcgccgcttcattggcttttttaattatgatgttcaacttgccgattccaggtgggaccacggctcacgctgtcgggggaaccctgttagctgtcttgattggcccatgggcggcgtgtcttgcgctgaccgtgacgttactactacaagccttattattcggtgatggcggtatcctagcctttggcgctaacgcgttgaatatggcggtcattatgccgtttgtcggctacgcctgctatcgcctaggtcaaaaatggcaccatgaaaagttggggctcgcaattggtgcttacttaggcattaatatggcggcgctagttgctggtatcgagctcgggttacaacccatactggctcatacggcaagtggtgcgccgctctactgcccatacggcctcaacattacgatacccgcaatgttgacggctcacttattagtcgccggctgggtcgaagtcgtcttcacactgcttgtctttcaatttgtaaaacgagtcgcaccgactaacctctatcagacacccactcggcgcaatcagcggccgtggatcgcactgctactcggattagcggtgttatcaccattaggcttgttggctagcaatacggcttggggcgaatggagcccccaagaattacagcaacggctagcgcaacaacatatcagtactcacgcgcctcaaggaatggtccacgggttccattttcaggccctgttcagtgattacgccatcgcgggcttaccggttagtgtaggttatattttatcggccattaccgctgttttgattttcttacttttgattcgaggtcttcaacatgaaaccgacacgtcccaacactga

SEQ ID NO: 9253 - protein, 333 aa, Lactobacillus plantarum
MRCSSVHIPDNYLSPATCGTLVTAMAPVWTVAVLKVKVQIKKHHETLPMLGIAASLAFLIMMFNLPIPGGTTAHAVGGTLLAVLIGPWAACLALTVTLLLQALLFGDGGILAFGANALNMAVIMPFVGYACYRLGQKWHHEKLGLAIGAYLGINMAALVAGIELGLQPILAHTASGAPLYCPYGLNITIPAMLTAHLLVAGWVEVVFTLLVFQFVKRVAPTNLYQTPTRRNQRPWIALLLGLAVLSPLGLLASNTAWGEWSPQELQQRLAQQHISTHAPQGMVHGFHFQALFSDYAIAGLPVSVGYILSAITAVLIFLLLIRGLQHETDTSQH

SEQ ID NO: 9254 - DNA, 726 bp, Clostridium tetani
  CDS (1)..(726): transl_table=11
atgaaaaagaatctaacttttttcatggtgattgcactactatttacaattaccccaaatgtttatgctatgcatatagcggaaggatttttaccacctatgtggagtggagtatactttgtaatttccgcaccatttataattataggtcttaaacaaataagagaaagggcaaaggataataaagatattaaaatgcttttaggattagtggcagcatatgcatttatactttctgctatgaaaattccatcagtaactggaagttgttctcacccgacaggtacaggtctttcagcaataatttttgggccttttatatcagcaattgtaggacttatagtattaatttttcaagctatcttactagctcatggtggaataacaaccttaggtgctaatacattatcaatgggaattatgggacctatagtatcatatttaatttacagaggatttaaaaataaaaatcaaaaggttgcagtatttttagcagcaactttaggggacttatttacgtattttattacctcagtacaacttgctttagcattcccagctcaacaaggaggaatagcagcatcctttgcaaaatttttctcaatattttctataacacaaattcctttagctataatggaaggaatattaacggttataatatttgaatttgtaatgaaatacgcatcaaaggaaatagaagtattaggtggtgttagaaaatga

SEQ ID NO: 9255 - protein, 241 aa, Clostridium tetani
MKKNLTFFMVIALLFTITPNVYAMHIAEGFLPPMWSGVYFVISAPFIIIGLKQIRERAKDNKDIKMLLGLVAAYAFILSAMKIPSVTGSCSHPTGTGLSAIIFGPFISAIVGLIVLIFQAILLAHGGITTLGANTLSMGIMGPIVSYLIYRGFKNKNQKVAVFLAATLGDLFTYFITSVQLALAFPAQQGGIAASFAKFFSIFSITQIPLAIMEGILTVIIFEFVMKYASKEIEVLGGVRK

SEQ ID NO: 9256 - DNA, 774 bp, Synechococcus elongatus
  CDS (1)..(774): transl_table=11
atggtcaaacctactcaagcaaagcgatatgcttccctgggggcgatcgcccttctgaccacatctctcgtggtagcaagtcctaaccccgccttggccatgcacatcagcgagggctttttgcccctgggttgggccgtgggttggtggctggcctttctcccctttttggcatggggactgtggtcattgcaacaacagatcaaacaacactccgaatccgtcctactggttgccttggcaggcgcctatgcctttgttgtttcttctttgaagattccctcggttacaggcagctgttcccatcctattgggattgccctgggggctattctttttcggccccccttaatggcagtattggggacactggtgttgctctttcagagcctcctcattgcccatggcggattgacgacactgggagccaacgccttctcaatggcggtcgtaggaccgtggttggcttggctcacctactgcggtgtgtctcgtttgagagtgaagccggcgatcgctctgtttgccgctagcttcatcagcaatgtgggtacttacaccttgacctctttgcaattggccttggcctttcccgacagcgtgggtggcctggccacttcctttgccaaatttggcaccctctttgcagtcacacagattcccctcgccatcagtgaagggctgctgacggtcttggtgtggaactggttgacgacctactgcgttgcagaactgcaggccttaagactcttgcctcaggaagagttgccctag

SEQ ID NO: 9257 - protein, 257 aa, Synechococcus elongatus
MVKPTQAKRYASLGAIALLTTSLVVASPNPALAMHISEGFLPLGWAVGWWLAFLPFLAWGLWSLQQQIKQHSESVLLVALAGAYAFVVSSLKIPSVTGSCSHPIGIALGAILFRPPLMAVLGTLVLLFQSLLIAHGGLTTLGANAFSMAVVGPWLAWLTYCGVSRLRVKPAIALFAASFISNVGTYTLTSLQLALAFPDSVGGLATSFAKFGTLFAVTQIPLAISEGLLTVLVWNWLTTYCVAELQALRLLPQEELP

SEQ ID NO: 9258 - DNA, 756 bp, Chlorobium tepidum
  CDS (1)..(756): transl_table=11
atgaccaatttgaaattccgctttttcgccgtggcctcgatggccgtggcttttatgctcttcggtggcggcgaggcttatgccatgcacatcatggagggcttcctgccgccgggctggagcctgttctggtggctggtgtcgctgccgtttttcgtgctcggcttcatctccctgcgccggatcgtggcgagcaatccgcgcatgaagctgctgctggccatggcgggggcgttcgccttcgtgctctcatcgctcaagattccctccgtgaccgggagttgctcgcacccgaccggcgtcgggcttggggcgatcatgttcgggccgtcggtgatgagcgtgctcggcgcgatcgtgctgctcttccaggcgctgctgctggcgcatggtggcttgaccacgctcggcgcgaacgcattttcgatggcgattaccgggccgttcgtgtcatggggtttgtacaaacttttcgacagtttgcgctcgccgcgctggctgtcggtctttgtcgctgcttcgattggcgatctggcaacttacgtggtcacctcttttcagctcgccttcgcgttcccttccatcaccggcggcgttgtcgcttcggcggtcaagttcctcggtattttcgccatcacccaggttccgctcgccgtgagcgagggcatcctgacggtgatggtctataacgccatcatggcctacacgggtcaatcattctttggcgcgcagtcgctttccagggaggtgaagtga

SEQ ID NO: 9259 - protein, 251 aa, Chlorobium tepidum
MTNLKFRFFAVASMAVAFMLFGGGEAYAMHIMEGFLPPGWSLFWWLVSLPFFVLGFISLRRIVASNPRMKLLLAMAGAFAFVLSSLKIPSVTGSCSHPTGVGLGAIMFGPSVMSVLGAIVLLFQALLLAHGGLTTLGANAFSMAITGPFVSWGLYKLFDSLRSPRWLSVFVAASIGDLATYVVTSFQLAFAFPSITGGVVASAVKFLGIFAITQVPLAVSEGILTVMVYNAIMAYTGQSFFGAQSLSREVK

SEQ ID NO: 9260 - DNA, 786 bp, Anabaena sp; identical to SEQ ID NO: 9068
  CDS (1)..(786): transl_table=11

SEQ ID NO: 9261 - protein, 261 aa, Anabaena sp
MLRRVLASKRASLILMGMLSFYIIVSASAPAYAMHIMEGYLPAGWAAFWWLVALPFMLLGVRSLTRITKANPELKLLLALAGAFTFVLSALKLPSVTGSCSHPTGTGLGSVLFGPLAMSVLGSLVLLFQALLLAHGGLTTLGANAFSMAIAGPFAAYWIYHLTIKLTGKQRIAIFLAATLADLLTYIITSVQLALAFPAPVGGFIASFAKFAGIFAITQIPLAISEGLLTVLVWNWLQSYSPQELQLLKLIQGESQSHESI

SEQ ID NO: 9262 - DNA, 735 bp, Listeria innocua; identical to SEQ ID NO: 9066
  CDS (1)..(735): transl_table=11

SEQ ID NO: 9263 - protein, 244 aa, Listeria innocua
MKKLWKFLPFVLIGVIYFTLTNPESAHAMHIMEGFLPVKWAVFWLIVFIPFLVLGLIRIRKLIALDKNNKLLLALCAAFIFVLSALKIPSVTGSCSHPTGVGLATVMFGPLVVSVLGVIVLLFQALLLAHGGITTLGANAMSMAVIGPMVGFVVYKLARKLNCNKSVSIFLCAMTADLATYLTTSVQLGVVFPDPASGMMASILKFMAIFCVTQVPIAIAEGLLTVVMYNLISKNLPEKVAQLR

SEQ ID NO: 9264 - DNA, 708 bp, Propionibacterium freudenreichii subsp
  CDS (1)..(708): transl_table=11
gtgcatatcgcagaaggcgttctaccacccgtccaatgcgccatctggttcgcagcagccgcacccttcgtggtgcatggcgccgtccaggtggtcaagcagatcaagcaccatccggagaaccggctgctgctggccacggcgggcgcctgtaccttcctcctgagctccatcaagctgcccagcgtcaccggctccagctcgcaccccaccggcaccggcgtcggcgcggtgttgttcaagccgccggtgatggccttcatgggcctcatcgtgctgatcttccaggccctgctgctggcccacggcggcatcaccacgctgggtgcgaacaccttctcgatggccatcgtcggcccctgggtgggctacggcgcctatgtgctcaacaagaagctcggcggcccattggcgctgggcatcttcctggccatgttcctgtcggacctgtccacctactgcgtgacgagcttccagctcgccttcgcctaccccgatccgtccagcggcgtgctcggcgcggccgagaagttcctgggcatcttcgccatctcgcagatcccgctgtcggtggccgagggcatcctgggcatcctgctgttccgcttcctgttcaaggtggccggcccgcagctgcaggccctgggcgtgcggatcggcaacaagcgcaccgccaacgccgaggttccggaggtggcacatgtctga

SEQ ID NO: 9265 - protein, 235 aa, Propionibacterium freudenreichii subsp
MHIAEGVLPPVQCAIWFAAAAPFVVHGAVQVVKQIKHHPENRLLLATAGACTFLLSSIKLPSVTGSSSHPTGTGVGAVLFKPPVMAFMGLIVLIFQALLLAHGGITTLGANTFSMAIVGPWVGYGAYVLNKKLGGPLALGIFLAMFLSDLSTYCVTSFQLAFAYPDPSSGVLGAAEKFLGIFAISQIPLSVAEGILGILLFRFLFKVAGPQLQALGVRIGNKRTANAEVPEVAHV

SEQ ID NO: 9266 - DNA, 609 bp, Actinobacillus pleuropneumoniae
  CDS (1)..(609): transl_table=11
gtgcatttgtctgaaggtgttttatattccacaaccctgattaccggtgcggtaatcgcactggcgggagtggcaatcggtctgcgtaagttagattaccgccgcttatcattaaccgctttgtttgcctcggcattttttgtggcggggacgattcacgtgccggtcgggataggaagcgttcaccttatcctcaatgggatggcgggattatttcttgggtggacggtatttcccgcttttttaattgcgcttttattgcaggttttgttgttttcgttcggcggattctccgtactcggcgtaaatttatgcattatggcattacctgcattactggttcattatcttttccgcaattcactgaaacgaaatttatcacgcaattacctgatctttacgggtatttgcgtgggaactatcggagtcggcggggcggcatttttggcttcgttggtgttagcgttcgacggcggtaaggcttataccgatttgatcggcttgcttattgtttctcatttacctatttttgttgtcgatagtatcgtaagcgtgggggttgtattgacgctcaccaaaatgatgccttccgccttacatttcgattaa

SEQ ID NO: 9267 - protein, 202 aa, Actinobacillus pleuropneumoniae
MHLSEGVLYSTTLITGAVIALAGVAIGLRKLDYRRLSLTALFASAFFVAGTIHVPVGIGSVHLILNGMAGLFLGWTVFPAFLIALLLQVLLFSFGGFSVLGVNLCIMALPALLVHYLFRNSLKRNLSRNYLIFTGICVGTIGVGGAAFLASLVLAFDGGKAYTDLIGLLIVSHLPIFVVDSIVSVGVVLTLTKMMPSALHFD

SEQ ID NO: 9268 - DNA, 702 bp, Methanocaldococcus jannaschii
  CDS (1)..(702): transl_table=11
ttgcacataatggagggatatctcccaccaatgtggtgtgcagtttggtgggttctctcaggtattgtaattgcctacggtattgttaaattaaaaaaactacttgaagaaagtccagaaatgaagccattagttgcaatatctggggcatacatgtttatattgagttccttaaagatgccatcagttactggaagttgttctcacccatgtggtaacggtttaggggcagtgttattcggtgttccaataactgctgtgttagcggctattgttctattgttccaagcgttattcttagctcatggaggtttaacaacacttggagctaacgatttctcaatgggtattgttggacctgccgccgcagtgattgtatatagattatgtatgaaggcaggtttaagctctacagttggaatattcttcgcggcattgtttggagactggctaacttatgtcacaactgctgttcagttagcacttgcattcccaatcccttcattcacagcggcatttacaaaattcattgtaatttatgcatatacacaagttccattggcaattgcagaaggtatattgacagttataatatgggactacattaagaaattaagacctgacttattgttgaagttaggagtagttccagaagaggagttaaaaccatatttaaccccctctcctgcaggaggtgagtaa

SEQ ID NO: 9269 - protein, 233 aa, Methanocaldococcus jannaschii
MHIMEGYLPPMWCAVWWVLSGIVIAYGIVKLKKLLEESPEMKPLVAISGAYMFILSSLKMPSVTGSCSHPCGNGLGAVLFGVPITAVLAAIVLLFQALFLAHGGLTTLGANDFSMGIVGPAAAVIVYRLCMKAGLSSTVGIFFAALFGDWLTYVTTAVQLALAFPIPSFTAAFTKFIVIYAYTQVPLAIAEGILTVIIWDYIKKLRPDLLLKLGVVPEEELKPYLTPSPAGGE

SEQ ID NO: 9270 - DNA, 738 bp, Salmonella typhimurium
  CDS (1)..(738): transl_table=11
atgaaacttgaacagcagcttcgacagttgtctttcagtggactggctgcagcgctattgctgatggttgtcccgcaacaggcgtttgcgatgcatatcatggagggctttttaccgccagtgtgggcgctggcctggtggctactgtttttaccctgcttgtggtatggactggtgcgcttacggcgtattgtgcaggaggataatcatcagaaggtactgctggcgctgtgcggcgcgtttatttttgtcctgtccgcgctcaaaattccgtcggtaacggggagttgttcacatccgaccggcgttggtctggcggttatcttgttcgggcccggggtggtggcgattctcggcgcggttgtgctgttgtttcaggcgctattgctggcgcacggtggcctgacgacgcttggcgcaaatggaatgtcgatggcggtgattggcccggttgtcggttatctggtgtggaaaatggcctgccgtgccggactgcgccgtgatgtcgccgtttttctgtgcgcgatgctggcggatttggcgacctattttgtgacttcagtccagcttggcgttgcgtttcccgatccccatgccggagcgacagggtctgttgtgaagtttatggggattttctgcctcacacagattcctgtcgccattgctgaaggtttattaaccgtcatgatttatgaccagttaaccaaacggcaagtgattaccgtacaaggacattaa

SEQ ID NO: 9271 - protein, 245 aa, Salmonella typhimurium
MKLEQQLRQLSFSGLAAALLLMVVPQQAFAMHIMEGFLPPVWALAWWLLFLPCLWYGLVRLRRIVQEDNHQKVLLALCGAFIFVLSALKIPSVTGSCSHPTGVGLAVILFGPGVVAILGAVVLLFQALLLAHGGLTTLGANGMSMAVIGPVVGYLVWKMACRAGLRRDVAVFLCAMLADLATYFVTSVQLGVAFPDPHAGATGSVVKFMGIFCLTQIPVAIAEGLLTVMIYDQLTKRQVITVQGH

SEQ ID NO: 9272 - DNA, 669 bp, Methanocaldococcus jannaschii
  CDS (1)..(669): transl_table=11
atgcacataccagatggctaccttggcccaataacatgtgctttcttctatttgataatgataccaatttggtataagagtattaaagagcttaaaaagttagacccaagaaagttgccattgttgggagttttaacagctttctctttcttagttatgatgttcaaccttccagttccagatggaacaacagctcacatggttggagggacattgatagcaatattgatggataatccatgggttgcgacgatagcaatatctattgttttaattatacaggcaatattctttggagatgggggaataacttgtattggagcaaactgcttcaatatgggtgttgtgttaccgtttgttggttattatgtttataaattcttaagagataaggttggagaagtaattgcaagtggtattggggcttatgttggaattgttgcagcagcaattgttgcaggctttgagtttggattacagccatttatagagccaggttattgtccataccctttcaccgtctcagttccagcaatggcatttgctcacttgataacagcaggacctgcagcagcggtagtaactgcaatagttgtttggtatgtaaagaaagtaagacctgatttattcacatcaaaagaacagcaagttagtggggtgaatgcatga

SEQ ID NO: 9273 - protein, 222 aa, Methanocaldococcus jannaschii
MHIPDGYLGPITCAFFYLIMIPIWYKSIKELKKLDPRKLPLLGVLTAFSFLVMMFNLPVPDGTTAHMVGGTLIAILMDNPWVATIAISIVLIIQAIFFGDGGITCIGANCFNMGVVLPFVGYYVYKFLRDKVGEVIASGIGAYVGIVAAAIVAGFEFGLQPFIEPGYCPYPFTVSVPAMAFAHLITAGPAAAVVTAIVVWYVKKVRPDLFTSKEQQVSGVNA

SEQ ID NO: 9274 - DNA, 621 bp, Haemophilus influenzae
  CDS (1)..(621): transl_table=11
atgcatttatctgaaggcgtgttacatacgcctattttattagctggtgcagtgcttgctgttgcgggcattgctgtggggttacgtcgtttagaatcagaacgtttaccgctcaccgcactttttgccgctgcattttttgtggcaggaaccattcatgtgcctgtaggaattggtagcgtgcatttaattttaaatggcatggctggtttatttcttgggtgggctgtttttccagcattcctcatcgcacttttattgcaagtcattttcttttcttttggtggatttgccgtgttaggcgtcaatctttgtgtgatggcaacgccagcggtgatcgctcattatcttttccgttctcgtttacagccacaaatggcattaaaagatcgcttattagttggtattggagctggcgtaattggcgttggcggggcaggcgcgcttgcttcttttgtgctgatgttagatggtggaaaaagttatctgaatcttgtttggctcttgctagtctctcatattccggtatttattttggatagtattatcagcgtaggggtgattaccttgcttggtaaaatgtatcctgaagtgatgaatcgtaccgagaatttctcttaa

SEQ ID NO: 9275 - protein, 206 aa, Haemophilus influenzae
MHLSEGVLHTPILLAGAVLAVAGIAVGLRRLESERLPLTALFAAAFFVAGTIHVPVGIGSVHLILNGMAGLFLGWAVFPAFLIALLLQVIFFSFGGFAVLGVNLCVMATPAVIAHYLFRSRLQPQMALKDRLLVGIGAGVIGVGGAGALASFVLMLDGGKSYLNLVWLLLVSHIPVFILDSIISVGVITLLGKMYPEVMNRTENFS

SEQ ID NO: 9276 - DNA, 24 bp, Artificial sequence
  primer
atgcacattcccgatggtctattg

SEQ ID NO: 9277 - DNA, 20 bp, Artificial sequence
  primer
ttaactctccagtaattccg

SEQ ID NO: 9278 - protein, 231 aa, Artificial sequence
  consensus sequence
  Variant (4)..(5): Xaa in position 4 to 5 is any amino acid
  Variant (7)..(7): Xaa in position 7 is any amino acid
  Variant (9)..(43): Xaa in position 9 to 43 is any amino acid
  Variant (44)..(50): Xaa in position 44 to 50 is any or no amino acid
  Variant (52)..(53): Xaa in position 52 to 53 is any amino acid
  Variant (55)..(61): Xaa in position 55 to 61 is any amino acid
  Variant (63)..(68): Xaa in position 63 to 68 is any amino acid
  Variant (69)..(72): Xaa in position 69 to 72 is any or no amino acid
  Variant (74)..(84): Xaa in position 74 to 84 is any amino acid
  Variant (86)..(95): Xaa in position 86 to 95 is any amino acid
  Variant (96)..(97): Xaa in position 96 to 97 is any or no amino acid
  Variant (99)..(100): Xaa in position 99 to 100 is any amino acid
  Variant (103)..(107): Xaa in position 103 to 107 is any amino acid
  Variant (110)..(112): Xaa in position 110 to 112 is any amino acid
  Variant (115)..(115): Xaa in position 115 is any amino acid
  Variant (117)..(119): Xaa in position 117 to 119 is any amino acid
  Variant (121)..(161): Xaa in position 121 to 161 is any amino acid
  Variant (162)..(186): Xaa in position 162 to 186 is any or no amino acid
  Variant (188)..(211): Xaa in position 188 to 211 is any amino acid
  Variant (212)..(226): Xaa in position 212 to 226 is any or no amino acid
  Variant (228)..(230): Xaa in position 228 to 230 is any amino acid
MHIXXGXLXXXXXXXXXXXXXXXXXXXXXXXXXXXXXXXXXXXXXXXXXXAXXFXXXXXXXPXXXXXXXXXXHXXXXXXXXXXXGXXXXXXXXXXXXLXXQAXXXXXGGXXXLGXNXXXMXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXEXXXT

SEQ ID NO: 9279 - protein, 21 aa, Artificial sequence
  protein pattern
  Variant (2)..(2): Xaa in position 2 is Ala, Gly, Ser or Val
  Variant (3)..(3): Xaa in position 3 is Ala, Ile, Leu or Val
  Variant (4)..(4): Xaa in position 4 is Phe, Ile, Leu, Met or Val
  Variant (5)..(5): Xaa in position 5 is Phe, Ile, Leu or Val
  Variant (6)..(6): Xaa in position 6 is Ala, Gly, Gln or Ser
  Variant (7)..(7): Xaa in position 7 is any amino acid
  Variant (10)..(10): Xaa in position 10 is Phe, Ile, Leu or Val
  Variant (11)..(12): Xaa in position 11 to 12 is any amino acid
  Variant (15)..(15): Xaa in position 15 is any amino acid
  Variant (16)..(16): Xaa in position 16 is Asp or Asn
  Variant (17)..(19): Xaa in position 17 to 19 is any amino acid
  Variant (20)..(20): Xaa in position 20 is Ile, Leu or Met
  Variant (21)..(21): Xaa in position 21 is Ala, Gly, Ser or Thr
QXXXXXXGGXXXLGXXXXXXX

SEQ ID NO: 9280 - DNA, 786 bp, SYNECHOCYSTIS SP.
  CDS (1)..(786): transl_table=11
atgaaatttattggcattgatttgggttggcgttctggggagagtggactatgtcgtttgcaactgcaatcaacccccactggcgatcgcctagggattgaagaccttacctgtcgcttgagtttggaggaaattttcgcctggctggacaaaggtttaggtgaagcggagggagtcatggtggcggtggatgctccgaccattattcccaatcagactgggactcgtttgcccgatcgcctgacccataaatattttggcaagtaccatgcgggttgttatccggccaatttgggccgaccttttgccgaaagaaccaccggagtgggcaaattactagaagaaagggggtttctccatgccccggagattcaagcccaacggcaagggcgttaccaaattgaagtatttccccaccctgccatggtgcaactttttcagctagagcggatcatcaaatacaagaaagggagtctagccaaaaaaagacagggtttgctggaattacagtcctacattgaaaatattttgccccaactaaccccggctctggaccttaccctcccccctggtatggaaccttggcgatcgccattgaccttgaacggcaaggaattgaaacaccaggaagaccaatgggatagtttaatttgtgcttatattggcgcttattggtggtactggggtcgagaacggaactgggttttaggcgatgaaagtacgggctatattgtggtgcccaccttaggtgctgaccaacccgtaccggatgcagagaaaaactaa

SEQ ID NO: 9281 - protein, 261 aa, SYNECHOCYSTIS SP.
MKFIGIDLGWRSGESGLCRLQLQSTPTGDRLGIEDLTCRLSLEEIFAWLDKGLGEAEGVMVAVDAPTIIPNQTGTRLPDRLTHKYFGKYHAGCYPANLGRPFAERTTGVGKLLEERGFLHAPEIQAQRQGRYQIEVFPHPAMVQLFQLERIIKYKKGSLAKKRQGLLELQSYIENILPQLTPALDLTLPPGMEPWRSPLTLNGKELKHQEDQWDSLICAYIGAYWWYWGRERNWVLGDESTGYIVVPTLGADQPVPDAEKN

SEQ ID NO: 9282 - DNA, 741 bp, Nostoc sp. PCC 7120
  CDS (1)..(741): transl_table=11
atgaaatttattgggattgatttaggttggaagtctcaaccgagtggtttatgttgtctgcaattaattgagggtaaattagagatagttgatttagatcgtcaagatgcgatcgctcatattttcacctggatagatacctgggtgcaaccaaatgaaccagcaatcatcggcgtagatgcacccacccttatacctaacttgacgggaagtcgtctccctgacaaactcacccataaatattttggtaaatatcacgctggttgttacccagccaaccaaggtctagcttttgcagaacgaactataaattttggtttagaattggagtctcgtggttttgcccatgcgccgacaatagaagcgcaaaaattaggcagatatcaaatagaagtctttcctcatcccgcaatagttcagctattcagtttagatcgtattcttaaatataaaaaagggcgcatcagtgagcgccgcttagaattaatcaaactttatcaatatattgtggatatcctacccacaatggaacctactttgtgtgtaaaaaagttatcccttggtgaaattccctacacaggtgcagaactgaaagccgccgaagacaaactagatagcttaatttgtgcttacgtagctgcttattggtggtattggggagaacaacgtaacctagtattaggcgatcgcactactggttacattgtcatccctaagtcagtgctgagtcttgaattgtga

SEQ ID NO: 9283 - protein, 246 aa, Nostoc sp. PCC 7120
MKFIGIDLGWKSQPSGLCCLQLIEGKLEIVDLDRQDAIAHIFTWIDTWVQPNEPAIIGVDAPTLIPNLTGSRLPDKLTHKYFGKYHAGCYPANQGLAFAERTINFGLELESRGFAHAPTIEAQKLGRYQIEVFPHPAIVQLFSLDRILKYKKGRISERRLELIKLYQYIVDILPTMEPTLCVKKLSLGEIPYTGAELKAAEDKLDSLICAYVAAYWWYWGEQRNLVLGDRTTGYIVIPKSVLSLEL

SEQ ID NO: 9284 - DNA, 756 bp, Thermosynechococcus elongatus BP-1
  CDS (1)..(756): transl_table=11
atgcggtttctcggcgttgatctggcttggcaaggaggggcatcagggtactgctgtttgcagtggcaagggcaagatttggtggtggttgccctcgatcgcgcctgtgatacacaggaactcttggcatggattgatcgcgatgccccctctgcccaagcagcaatggtggcggtggatgcgcccctaattattcccaatttcaggggaatgcgctcctgcgatcgccagtcccatcaagtcctggggcggtaccatgctggctgttatcctgcgaatcagcagtcgccctttgcaagccacaccacgggttttagtcaagccctcagccaacggggctttcaccatgcccctaccatccggccgcagcaatcgggacggtttcaaattgaagtcttcccccatgccacggcgatcgccctctttcagcttgatcaaatcatcaagtacaaaaaaggccgtcttacagagcgacgccgggggttagctcgtcttcgagagttaatgacaacccacctttgccactgtgagccgcccctaaggttgcagttcccggaagcactgcccaccactgggcgcgatctcaaagtgctggaagatcaactggatgccattctctgtgcctataccggcgcttcctggtggtactgggggagcgatcgccactgggtgttaggcagcgagtcattttcaccagcgccagcaaccaccgatgcctaccttaaaacgggatatatcgttgttccccgtcgctaa

SEQ ID NO: 9285 - protein, 251 aa, Thermosynechococcus elongatus BP-1
MRFLGVDLAWQGGASGYCCLQWQGQDLVVVALDRACDTQELLAWIDRDAPSAQAAMVAVDAPLIIPNFRGMRSCDRQSHQVLGRYHAGCYPANQQSPFASHTTGFSQALSQRGFHHAPTIRPQQSGRFQIEVFPHATAIALFQLDQIIKYKKGRLTERRRGLARLRELMTTHLCHCEPPLRLQFPEALPTTGRDLKVLEDQLDAILCAYTGASWWYWGSDRHWVLGSESFSPAPATTDAYLKTGYIVVPRR

SEQ ID NO: 9286 - DNA, 792 bp, Mycobacterium avium subsp. paratuberculosis K-10
  CDS (1)..(792): transl_table=11
atgtacttcgccggcgtcgacctcgcctgggcggggcggaacccgacgggcgtcgccgtcatcgactccgcaggcgagctggtgagcgtgggcgcggtccacgacgacgacgagatcctggccgcgctcgacccgtacgtgcgcggggagtgcctggtcgccttcgatgcgccgctggtggtgaacaacccgaccggccagcgtcccgccgagaccgcgctcaaccgcgacttccgcaggttccaggccggcacccacccgtgcaacaccgggaaacccgaattcgccgacggcccgcgggcggcccggctggccgcggcgctgggcctcgcgctggacccgcgttcgccgcggccccggcgcgccatcgaggtctacccgcacgccgcgaccgtcgccctgttcgggttgcagcaaaccctgaaatacaaggccaagcccggccgcagcctggagcggctcaagtccgagctgctgctgctgatggcgggcgtggagcggctggcgcacgccccggtcccggtgcgggtcggccgccacgccggttggcgcgcgctgcgccgggccgtcgaatgcgcgcagcgcaagagcgagctgcgccgcgccgaggatcccgtcgacgccgtcgtctgcgcctatgtggcgctgttcgcccagcgccgcccggacgcggtgaccagctacggcgaccccggcaccggctgcatcgtgacgccgtcgctgccggcggcccgccggcaatcgctcagatctgcaccggccgctgatcgatcggggccagcacctcgatga

SEQ ID NO: 9287 - protein, 263 aa, Mycobacterium avium subsp. paratuberculosis K-10
MYFAGVDLAWAGRNPTGVAVIDSAGELVSVGAVHDDDEILAALDPYVRGECLVAFDAPLVVNNPTGQRPAETALNRDFRRFQAGTHPCNTGKPEFADGPRAARLAAALGLALDPRSPRPRRAIEVYPHAATVALFGLQQTLKYKAKPGRSLERLKSELLLLMAGVERLAHAPVPVRVGRHAGWRALRRAVECAQRKSELRRAEDPVDAVVCAYVALFAQRRPDAVTSYGDPGTGCIVTPSLPAARRQSLRSAPAADRSGPAPR

SEQ ID NO: 9288 - DNA, 729 bp, Mycobacterium sp. JLS
  CDS (1)..(729): transl_table=11
gtgtacttcgtcgggatcgacctcgcgtggggtgagcgcagccccaccggcgtcgccgtcgccgattcggacggcagcctggtgcacctcgccgccgccacgaccgacgccgacatcgtcgcgcagctcatgccctacaccgccgagcagtgcctgctggcgatcgacgctcccctggtcgtgacgaacccgagcgggaaccggccgtgtgaggcggcgctcaaccgggatttccgcgccttcgaggcgggctgtcacccgtcgaacaccggtcatccgtggttcgcgtcgggcagccgcggcgcccgactggccgaggcgctgggcgcgcccgccgtcgaggtctatccgcacgccgcaaccgtcgcacttttcggactgccgaagactctgaagtacaagcagaaaccggggcgggacgtcgcgcagctacgcggtgaactgcttcggctgatcggcctggtcgaaacgctcatccgcgcggacccctcgctgaacgtcgagcagcacgccgggtgggtggccctgcgggacgcggtccggacggcgacccgcaaggccgaactgcgccgggcggaggacccggtcgacgcggtcgtgtgtgcctacgtcgcgctgttcgccacccgcaggcctgccgacgtcacgagctacggcgacgacgccaccggccggatcgtgacgcccgcactccgtcgggccgctacgccaggtgcgtggggtcggtga

SEQ ID NO: 9289 - protein, 242 aa, Mycobacterium sp. JLS
MYFVGIDLAWGERSPTGVAVADSDGSLVHLAAATTDADIVAQLMPYTAEQCLLAIDAPLVVTNPSGNRPCEAALNRDFRAFEAGCHPSNTGHPWFASGSRGARLAEALGAPAVEVYPHAATVALFGLPKTLKYKQKPGRDVAQLRGELLRLIGLVETLIRADPSLNVEQHAGWVALRDAVRTATRKAELRRAEDPVDAVVCAYVALFATRRPADVTSYGDDATGRIVTPALRRAATPGAWGR

SEQ ID NO: 9290 - DNA, 741 bp, Anabaena variabilis ATCC 29413
  CDS (1)..(741): transl_table=11
atgaaatttattggtatcgatttgggttggaagtctcaaccgagtggtttatgttgcttgcaattaattgagggtaagttagagatagttgacttagatcgtcaagatgcgatcgctcatattttcacctggatagatacttgggtgcaaccggatgaaccagccatcatcggcgtagatgcacccacccttatacctaactcgacgggaagtcgtctccctgacaaactcacccataagtatttcggtaaatatcacgctggttgttaccccgccaaccaaggtctagcttttgcagaacggactataaattttggtttagaattagaatctcgtggttttgcccatgcacctacaatagaagcacaaaaattaggcagatatcaaatagaagttttcccccatccggcaatagttcacctattcagcttagatcgtattcttaaatataaaaaagggcgcatcagtgagcgccgcttagaattaatcaaactttatcaatatattgtggatatcctacccacaatggaacctgctttgtgtgtcaaaaagttatcccttggtgaaattccccacactggtgcagaactgaaagccgccgaagacaaactcgatagcttaatttgtgcttacgtagctgcccattggtggtattggggagaacaacgtaacctagtattaggtgatcgcaccactggttacattgtcatccctaagtcagtgctgagtcatgagttgtaa

SEQ ID NO: 9291 - protein, 246 aa, Anabaena variabilis ATCC 29413
MKFIGIDLGWKSQPSGLCCLQLIEGKLEIVDLDRQDAIAHIFTWIDTWVQPDEPAIIGVDAPTLIPNSTGSRLPDKLTHKYFGKYHAGCYPANQGLAFAERTINFGLELESRGFAHAPTIEAQKLGRYQIEVFPHPAIVHLFSLDRILKYKKGRISERRLELIKLYQYIVDILPTMEPALCVKKLSLGEIPHTGAELKAAEDKLDSLICAYVAAHWWYWGEQRNLVLGDRTTGYIVIPKSVLSHEL

SEQ ID NO: 9292 - DNA, 732 bp, Trichodesmium erythraeum IMS101
  CDS (1)..(732): transl_table=11
atgaaatttattggaatagacctaggttggcagtctggaaaaagcggtctttgctgtctacaatactcagataataaattaaaaatattagacatagactgcatactagaaattgaagatattctcaattggattgataatttaactcccctttcaactccagctctaattgccgtagatgctcccacaataattcctaataaaacaggaactagactaccagataaacttactcataaatattttggtcgttatcatgcaggatgttatccggcaaatcttaaccgtccttttgctcagagaacagtcaaatttggcattagtttagaagctaaagaatttatccatgcaccaaccattaagcctcaaaaaataggacgttttcaaattgaagttttcccccatccagctatagttaatctgtttcaattagaaaaaattttgaaatataaaaaaggtaggttagccgaccgtaaattagaacttttgaaactgcaaaaatacattataaatattctaccaactctagagcccgctctagtaatttcccacaacttcctaaataccgaaacaattaatagtatcaccactctcaaaactacagaagataaattagacagtttaatttgtgcttatattggagcatattggtggtattggggtgaaacaaaaaacttggtattgggaaatcacacaactggatatatagtagttcctaaaagattagattaa

SEQ ID NO: 9293 - protein, 243 aa, Trichodesmium erythraeum IMS101
MKFIGIDLGWQSGKSGLCCLQYSDNKLKILDIDCILEIEDILNWIDNLTPLSTPALIAVDAPTIIPNKTGTRLPDKLTHKYFGRYHAGCYPANLNRPFAQRTVKFGISLEAKEFIHAPTIKPQKIGRFQIEVFPHPAIVNLFQLEKILKYKKGRLADRKLELLKLQKYIINILPTLEPALVISHNFLNTETINSITTLKTTEDKLDSLICAYIGAYWWYWGETKNLVLGNHTTGYIVVPKRLD

SEQ ID NO: 9294 - DNA, 792 bp, Mycobacterium avium 104
  CDS (1)..(792): transl_table=11
atgtacttcgccggcgtcgacctcgcctgggcggggcggaacccgacgggcgtcgccgtcatcgactccggcggcgagctggtgagcgtggccgcggtccgcgacgacgacgagatcctggccgcgctcgacccgtacgtgcgcggggagtgcctggtcgccttcgacgcgccgctggtggtgaacaacccgaccggccagcgtcccgccgagaccgcgctcaaccgcgacttccgccggttccaggccggcacccacccgtgcaacaccgggaaacctgaattcgccgacggcccgcgggcggcccggctggccgcggcgctgggcctcgcgctggacccgcgttcgccgcggccccggcgcgccatcgaggtctacccgcacgccgcgaccgtcgccctgttcgggttacagcaaaccctgaaatacaaggccaagcccggccgcagcctggagcggctcaagtccgagctgctgctgctgatggcgggcgtggagcggctggcgcacgccccggtcccggtgcgggtcggcggccacgccggttggcgcgcgctgcgccgggccgtcgaatgcgcgcagcgcaagagcgagctgcgccgcgccgaggatcccgtcgacgccgtcgtctgcgcctatgtggcgctgttcgcccagcgccgcccggacgcggtaaccagctacggcgaccccggcaccggctgcatcgtgacgccgtcgctgccggcggcccgccggcaatcgctcagatctgcaccggccgctgatcgatcggggccagcacctcgatga

SEQ ID NO: 9295 - protein, 263 aa, Mycobacterium avium 104
MYFAGVDLAWAGRNPTGVAVIDSGGELVSVAAVRDDDEILAALDPYVRGECLVAFDAPLVVNNPTGQRPAETALNRDFRRFQAGTHPCNTGKPEFADGPRAARLAAALGLALDPRSPRPRRAIEVYPHAATVALFGLQQTLKYKAKPGRSLERLKSELLLLMAGVERLAHAPVPVRVGGHAGWRALRRAVECAQRKSELRRAEDPVDAVVCAYVALFAQRRPDAVTSYGDPGTGCIVTPSLPAARRQSLRSAPAADRSGPAPR

SEQ ID NO: 9296 - DNA, 729 bp, Mycobacterium sp. KMS
  CDS (1)..(729): transl_table=11
gtgtacttcgtcgggatcgacctcgcgtggggtgagcgcagccccaccggcgtcgccgtcgccgattcggacggcagcctggtgcacctcgccgccgccacgaccgacgccgacatcgtcgcccagctcatgccctacaccgccgagcagtgcctgctggcgatcgacgctcccctggttgtgacgaacccgagcgggaaccggccgtgcgaggcggcgctcaaccgggatttccgcgccttcgaggcgggctgtcacccgtcgaacaccggtcatccgtggttcgcgtcgggcagccgcggcgcccgactggccgaggcgctgggcgctcccgccgtcgaggtctatccgcacgccgcgaccgtcgcacttttcggactgccgaagaccttgaagtacaagcagaaaccggggcgggacgtcgcgcagctacgcggtgaactgcttcggctgatcggcctggtcgaaacgctcatccgcgcggacccctcgctgaacgtcgggcagcacgccgggtgggtggccctgcgggacgcggtccggacggcgacccgcaaggccgaactgcgccgggcggaggacccggtcgacgcggtcgtgtgtgcctacgtcgcgctgttcgccacccgcaggcctgccgacgtcacgagctacggcgacgacgccaccggccggatcgtgacgcccgcactccgtcgggccgctacgccaggtgcgtggggtcggtga

SEQ ID NO: 9297 - protein, 242 aa, Mycobacterium sp. KMS
MYFVGIDLAWGERSPTGVAVADSDGSLVHLAAATTDADIVAQLMPYTAEQCLLAIDAPLVVTNPSGNRPCEAALNRDFRAFEAGCHPSNTGHPWFASGSRGARLAEALGAPAVEVYPHAATVALFGLPKTLKYKQKPGRDVAQLRGELLRLIGLVETLIRADPSLNVGQHAGWVALRDAVRTATRKAELRRAEDPVDAVVCAYVALFATRRPADVTSYGDDATGRIVTPALRRAATPGAWGR

SEQ ID NO: 9298 - DNA, 741 bp, Nostoc punctiforme PCC 73102
  CDS (1)..(741): transl_table=11
atgacaatgaaatttattggcattgatttaggctggcgatcgcaaccaagcggactatgctgtttagaatggatagatggacaactgcaattactcgatttagaccgtaaagaagctattgcagacatcttcacctggatcgatcgcagcgtccaaccagacgaaccagccatcatcgccgtagatgcacctaccctcatacctaatcctaccgggagtcgcctccccgacaaactcagccacaagtactttggcaaatatcatgcgggatgctatccagctaatcaaaacttacccttcgccgatcgcaccatcaactttggtttagagttagaatcacgcggttttgcccacgcacccacgattgaaccgcaaaaactcagccgatatcaaatagaagtcttcccccacccagcaatcgttaacctattcaacttagaacgcatcctcaaatacaaaaaaggacgactcagcgatcgccgcctagaattaatcaaactccaaaattatcttctcgatatcctcccctccttttctccccctctgcgttccctgcgcctctgcggttcattccttcttgaaatccccaccacaggcgcagacctcaaagcaaccgaagataaactagatagcctagtttgcgcttatgttgctgcatactggtggtattggggagaagaacgtaacttagttctaggcgatcgcaccacaggctacattatcatccctcaaagaatttaa

SEQ ID NO: 9299 - protein, 246 aa, Nostoc punctiforme PCC 73102
MTMKFIGIDLGWRSQPSGLCCLEWIDGQLQLLDLDRKEAIADIFTWIDRSVQPDEPAIIAVDAPTLIPNPTGSRLPDKLSHKYFGKYHAGCYPANQNLPFADRTINFGLELESRGFAHAPTIEPQKLSRYQIEVFPHPAIVNLFNLERILKYKKGRLSDRRLELIKLQNYLLDILPSFSPPLRSLRLCGSFLLEIPTTGADLKATEDKLDSLVCAYVAAYWWYWGEERNLVLGDRTTGYIIIPQRI

SEQ ID NO: 9300 - DNA, 24 bp, Artificial sequence
  primer
atgaaatttattggcattgatttg

SEQ ID NO: 9301 - DNA, 24 bp, Artificial sequence
  primer
ttagtttttctctgcatccggtac

SEQ ID NO: 9302 - protein, 265 aa, Artificial sequence
  consensus sequence
  Variant (2)..(2): Xaa in position 2 is any amino acid
  Variant (4)..(4): Xaa in position 4 is any amino acid
  Variant (6)..(6): Xaa in position 6 is any amino acid
  Variant (9)..(9): Xaa in position 9 is any amino acid
  Variant (11)..(15): Xaa in position 11 to 15 is any amino acid
  Variant (16)..(16): Xaa in position 16 is any or no amino acid
  Variant (18)..(38): Xaa in position 18 to 38 is any amino acid
  Variant (39)..(45): Xaa in position 39 to 45 is any or no amino acid
  Variant (47)..(50): Xaa in position 47 to 50 is any amino acid
  Variant (52)..(60): Xaa in position 52 to 60 is any amino acid
  Variant (61)..(62): Xaa in position 61 to 62 is any or no amino acid
  Variant (64)..(64): Xaa in position 64 is any amino acid
  Variant (68)..(71): Xaa in position 68 to 71 is any amino acid
  Variant (73)..(74): Xaa in position 73 to 74 is any amino acid
  Variant (76)..(76): Xaa in position 76 is any amino acid
  Variant (78)..(86): Xaa in position 78 to 86 is any amino acid
  Variant (88)..(91): Xaa in position 88 to 91 is any amino acid
  Variant (95)..(95): Xaa in position 95 is any amino acid
  Variant (97)..(97): Xaa in position 97 is any amino acid
  Variant (99)..(101): Xaa in position 99 to 101 is any amino acid
  Variant (103)..(117): Xaa in position 103 to 117 is any amino acid
  Variant (119)..(122): Xaa in position 119 to 122 is any amino acid
  Variant (124)..(125): Xaa in position 124 to 125 is any amino acid
  Variant (126)..(131): Xaa in position 126 to 131 is any or no amino acid
  Variant (133)..(133): Xaa in position 133 is any amino acid
  Variant (134)..(134): Xaa in position 134 is any or no amino acid
  Variant (138)..(138): Xaa in position 138 is any amino acid
  Variant (141)..(141): Xaa in position 141 is any amino acid
  Variant (143)..(143): Xaa in position 143 is any amino acid
  Variant (145)..(145): Xaa in position 145 is any amino acid
  Variant (148)..(148): Xaa in position 148 is any amino acid
  Variant (150)..(152): Xaa in position 150 to 152 is any amino acid
  Variant (157)..(157): Xaa in position 157 is any amino acid
  Variant (158)..(159): Xaa in position 158 to 159 is any or no amino acid
  Variant (162)..(171): Xaa in position 162 to 171 is any amino acid
  Variant (173)..(179): Xaa in position 173 to 179 is any amino acid
  Variant (181)..(184): Xaa in position 181 to 184 is any amino acid
  Variant (186)..(186): Xaa in position 186 is any amino acid
  Variant (188)..(201): Xaa in position 188 to 201 is any amino acid
  Variant (202)..(210): Xaa in position 202 to 210 is any or no amino acid
  Variant (212)..(214): Xaa in position 212 to 214 is any amino acid
  Variant (217)..(218): Xaa in position 217 to 218 is any amino acid
  Variant (220)..(222): Xaa in position 220 to 222 is any amino acid
  Variant (226)..(240): Xaa in position 226 to 240 is any amino acid
  Variant (241)..(241): Xaa in position 241 is any or no amino acid
  Variant (244)..(245): Xaa in position 244 to 245 is any amino acid
  Variant (246)..(258): Xaa in position 246 to 258 is any or no amino acid
  Variant (261)..(261): Xaa in position 261 is any amino acid
  Variant (264)..(264): Xaa in position 264 is any amino acid
MXFXGXDLXWXXXXXXGXXXXXXXXXXXXXXXXXXXXXXXXXXXXIXXXXDXXXXXXXXXXXAXDAPXXXXNXXGXRXXXXXXXXXFXXXXAGCXPXNXXXPXXXXXXXXXXXXXXXGXXXXPXXXXXXXXRXXIEVXPHXAXVXLFXLXXXLKYKXXXGRXXXXXXXXXXLXXXXXXXLXXXXPXLXXXXXXXXXXXXXXXXXXXXXXXLXXXEDXXDXXXCAYXXXXXXXXXXXXXXXXGDXXXXXXXXXXXXXXXTGXIVXP

SEQ ID NO: 9303 - protein, 43 aa, Artificial sequence
  protein pattern
  Variant (2)..(5): Xaa in position 2 to 5 is any or no amino acid
  Variant (9)..(9): Xaa in position 9 is any amino acid
  Variant (10)..(10): Xaa in position 10 is Ile, Leu or Val
  Variant (11)..(11): Xaa in position 11 is Ile or Val
  Variant (12)..(12): Xaa in position 12 is Asn or Pro
  Variant (14)..(15): Xaa in position 14 to 15 is any amino acid
  Variant (17)..(17): Xaa in position 17 is any amino acid
  Variant (19)..(19): Xaa in position 19 is any amino acid
  Variant (20)..(20): Xaa in position 20 is Ala, Cys or Pro
  Variant (21)..(21): Xaa in position 21 is Asp or Glu
  Variant (22)..(27): Xaa in position 22 to 27 is any amino acid
  Variant (28)..(28): Xaa in position 28 is Phe or Leu
  Variant (29)..(29): Xaa in position 29 is any amino acid
  Variant (30)..(30): Xaa in position 30 is Lys or Arg
  Variant (31)..(31): Xaa in position 31 is Phe or Tyr
  Variant (32)..(32): Xaa in position 32 is any amino acid
  Variant (35)..(35): Xaa in position 35 is Cys or Thr
  Variant (36)..(36): Xaa in position 36 is His or Tyr
  Variant (38)..(38): Xaa in position 38 is Ala or Cys
  Variant (40)..(40): Xaa in position 40 is any amino acid
  Variant (41)..(41): Xaa in position 41 is Gly, Asn or Gln
  Variant (42)..(42): Xaa in position 42 is any amino acid
  Variant (43)..(43): Xaa in position 43 is Ala or Pro
VXXXXDAPXXXXNXXGXRXXXXXXXXXXXXXXAGXXPXNXXXX

SEQ ID NO: 9304 - protein, 29 aa, Artificial sequence
  protein pattern
  Variant (2)..(2): Xaa in position 2 is any amino acid
  Variant (3)..(3): Xaa in position 3 is Ala or Gln
  Variant (7)..(7): Xaa in position 7 is Phe or Tyr
  Variant (10)..(10): Xaa in position 10 is any amino acid
  Variant (11)..(11): Xaa in position 11 is any or no amino acid
  Variant (13)..(14): Xaa in position 13 to 14 is any amino acid
  Variant (15)..(15): Xaa in position 15 is any or no amino acid
  Variant (18)..(18): Xaa in position 18 is Gly, Asn, Gln or Ser
  Variant (20)..(20): Xaa in position 20 is Asp, Glu or Gln
  Variant (21)..(22): Xaa in position 21 to 22 is any amino acid
  Variant (23)..(23): Xaa in position 23 is Ile or Leu
  Variant (27)..(27): Xaa in position 27 is any or no amino acid
  Variant (29)..(29): Xaa in position 29 is Gly or Pro
RXXIEVXPHXXAXXXLFXLXXXXKYKXKX

SEQ ID NO: 9305 - protein, 20 aa, Artificial sequence
  protein pattern
  Variant (2)..(2): Xaa in position 2 is any amino acid
  Variant (4)..(4): Xaa in position 4 is Ile, Leu or Val
  Variant (6)..(6): Xaa in position 6 is Ile or Val
  Variant (9)..(11): Xaa in position 9 to 11 is any or no amino acid
  Variant (13)..(14): Xaa in position 13 to 14 is any amino acid
  Variant (16)..(17): Xaa in position 16 to 17 is any amino acid
  Variant (18)..(18): Xaa in position 18 is Cys, Gly or Ser
  Variant (19)..(19): Xaa in position 19 is Cys, Gly or Val
  Variant (20)..(20): Xaa in position 20 is Ala or Leu
MXFXGXDLXXXGXXSXXXXX

SEQ ID NO: 9306 - protein, 15 aa, Artificial sequence
  protein pattern
  Variant (2)..(2): Xaa in position 2 is any amino acid
  Variant (3)..(4): Xaa in position 3 to 4 is any or no amino acid
  Variant (7)..(7): Xaa in position 7 is any amino acid
  Variant (8)..(8): Xaa in position 8 is Ala, Gly, Ser or Thr
  Variant (11)..(11): Xaa in position 11 is any amino acid
  Variant (13)..(13): Xaa in position 13 is Ile or Val
  Variant (14)..(14): Xaa in position 14 is any amino acid
VXXXGDXXTGXIXXP

SEQ ID NO: 9307 - DNA, 1056 bp, SYNECHOCYSTIS SP.
  CDS (1)..(1056): transl_table=11
atgcggggcttaggcaatcgccagcaatttgtggctacggtggaaaaggctctagccgggggcattaaccacatcgaaacagcggcggcctacggagaaagcgaagtttatttgggggagttactgaaggaatataatcgctccgatatttacctcaccagtaaagtttgtcccacggagaactcagcacaatttatccagggccttgaccgttctctgcaacgactccaggtggattatttagactgctttgctatccatggcattaatacctccgagcattggcaatggttacagcaattgtggccggcgatagaaagagcccaacaacagggaaaatttaaacatcttggcttttctacccacggtagtttgcccctagtacaagaggtcgttgcttcgggaaaatttgcctttgttaacctgcattattactggtttaatcagcatcttgccccggcgatcgcctcagcctatgggcacgatatgggcattttcatcatttcccctgctgacaagggcggtcaactatacacaccaaccgtaactttgcagaacctctgtcaaccctttacccctttgggtttaacctaccgttttctcttgagcgatgctcgcattacaaccctgagtcttggccccgccattccccaggaattgaatgaacctctatcccttggcgatcacctggagccattgagtgagcaagaacagagaattttgcaaaatttgcttgaccatcaaaaacaagcattgggtacggatgcctgccaccagtgttatcaatgtttgccctgcccggaggaaattaacattcccgaaattctacgtctacgcaatttagctgtcgcctttgatatgcaaagttttggtcaatatcgctatcaaatgttggaaaatgcggggcactggtttcccggtaaaaaaggcgatcggtgtaccgactgcggggattgtttgccccggtgtccccataatctggccattcccgagcttttgcgggatactcaccaacggttgcggggtaaaagccgtcgtcgtttatggcaggattaa

SEQ ID NO: 9308 - protein, 351 aa, SYNECHOCYSTIS SP.
MRGLGNRQQFVATVEKALAGGINHIETAAAYGESEVYLGELLKEYNRSDIYLTSKVCPTENSAQFIQGLDRSLQRLQVDYLDCFAIHGINTSEHWQWLQQLWPAIERAQQQGKFKHLGFSTHGSLPLVQEVVASGKFAFVNLHYYWFNQHLAPAIASAYGHDMGIFIISPADKGGQLYTPTVTLQNLCQPFTPLGLTYRFLLSDARITTLSLGPAIPQELNEPLSLGDHLEPLSEQEQRILQNLLDHQKQALGTDACHQCYQCLPCPEEINIPEILRLRNLAVAFDMQSFGQYRYQMLENAGHWFPGKKGDRCTDCGDCLPRCPHNLAIPELLRDTHQRLRGKSRRRLWQD

SEQ ID NO: 9309 - DNA, 1293 bp, Synechocystis sp. PCC 6803
  CDS (1)..(1293): transl_table=11
gtgcccagggggctttgggttaccctaaaaaataatcaagcaatgacatttcccgatcgcagttccgcaaatttccccaaccctatgctttatcgacgttttggccgtactgaattgtccatgccggttttttcctgtgggggcatgcgctatcagttccaatggcaggatgcgccctttgcccaggttcccaaggataaccaacacaatttgcaaagtaccattgagcgttccctggagttgggcattaaccacattgaaacagctaggggttatggcacttccgaaatgcagttgggaaaaattttgccccggttacccagggaaacattgattgtgcaaacaaaagttagtcccaaggatgaccccaaggaatttcgtcgggagtttgataaatctttgggctatttaaatctggaatatgtcgatttgttgggtatccacggcattaataaccgggaaaccctagagcaaagtttacgccccggcggttgtttggatgtttgtcggcagttacaaagggaaggccgagtgcgtttcgtgggtttttccacccatggtcccaccgccatcattaccgaagccattaattccggggaatttgattacgtcaacctccactggtactacatttttcaagataattggccggcgatcgccgctgcgacagcccaggatatgggggtctttattattagcccgtccgataaagggggacaactctataacccgcccgaaaagctagtgaatttatgccaacccctcagcccgatcatatttaataatcttttctgtttatcccatccccaggtacataccctcagcattggcgcatcgcggccggcggactttgatgagcatttaaaaaccttatcttatctagcgtcagaccaggagaccgaaaaagttctgcaaccaattttggcaaagctccatggggccatggtggaagctttaggagaagattgggtcaacagttggcgcatcggcttacccagcccggagcagacccctggggaaatcaatatccctaaaattctctggctttataatctttgccaaagcttcgacctggtggagtacagcaaaatgcgctacaacctgttgggcaatggcggccattggttccccggccaaccggccagcaactttgatcgacaacagctctggcaatgtttagcccccagtccccatcggcagaaggtgttggaagttttacaggaaacggatcgtttgcttaaaggagaaacggtgcaaagattgtcccgtcaagaggtggccaaaactagctag

SEQ ID NO: 9310 - protein, 430 aa, Synechocystis sp. PCC 6803
MPRGLWVTLKNNQAMTFPDRSSANFPNPMLYRRFGRTELSMPVFSCGGMRYQFQWQDAPFAQVPKDNQHNLQSTIERSLELGINHIETARGYGTSEMQLGKILPRLPRETLIVQTKVSPKDDPKEFRREFDKSLGYLNLEYVDLLGIHGINNRETLEQSLRPGGCLDVCRQLQREGRVRFVGFSTHGPTAIITEAINSGEFDYVNLHWYYIFQDNWPAIAAATAQDMGVFIISPSDKGGQLYNPPEKLVNLCQPLSPIIFNNLFCLSHPQVHTLSIGASRPADFDEHLKTLSYLASDQETEKVLQPILAKLHGAMVEALGEDWVNSWRIGLPSPEQTPGEINIPKILWLYNLCQSFDLVEYSKMRYNLLGNGGHWFPGQPASNFDRQQLWQCLAPSPHRQKVLEVLQETDRLLKGETVQRLSRQEVAKTS

SEQ ID NO: 9311 - DNA, 1182 bp, Nostoc sp. PCC 7120
  CDS (1)..(1182): transl_table=11
atgctatatagaaaatttggacgcacagaattacagatgccggtgttctcttgcggcggcatgagataccaatataaatggcaagatgttagttattcggatattccggcggatcagcaagcaaatctggaagcaactattaatcgcgctattgaggtggggatcaatcacattgaaactgcccgtggttatggtagttccgaaatgcaattggggaaaatattgcctaagtttccccgcgaaaaattaattgtccaaaccaaacttgcgcctgttgccgatgggaaagagttccgcaaaacttttgagcaatcattgagttatcttcagttagactacgtagatttactaggaatacatggaattaatactcctgagttattagactatagtgtacgtcctgggggttgtttggacgtagtgcaacagttgcaagcagaaggtaaagtccgatttgtgggcttttccacccacggttctacggatgtaatcatccaggcaattaatactaaccaatttgattatgtcaacctgcactggtactacatcaatcaatggaattggccagccattgaagcggctacccgtcatgatatgggggtgtttattattagccccacagataagggaggtcagctttataatccacctcaaaaattagtggatttatgcgcccctttaagtccgatggtgtttaatgatttattttgtctgagtcattctcaagtgcataccttgagtttaggcgcagctaaaccccaagattttgatgaacacttgcagacattggacttaataaaccgggcatcagagattttaccaccaattttagggaggttggaagatgcagcgatcgcctctttgggagaagattgggtaaaaacctgggaaaccaatttaccccaatgggaacaaacccctggtcagataaatatccgggtgattttatggctgctaaatctagctactacctacgatttagtggactatgccaaaatgcggtacaacttattgggcaacgctagtcactggttccctggtaacaaagccgataaactcaacgaaatagacttgcagcaatgcctcagatatagtcctcatgctgataaaattccccaatttttagccaaggcgcatcaattattagcaggtgaagaattgcagcgtttatctcagagctaa

SEQ ID NO: 9312 - protein, 393 aa, Nostoc sp. PCC 7120
MLYRKFGRTELQMPVFSCGGMRYQYKWQDVSYSDIPADQQANLEATINRAIEVGINHIETARGYGSSEMQLGKILPKFPREKLIVQTKLAPVADGKEFRKTFEQSLSYLQLDYVDLLGIHGINTPELLDYSVRPGGCLDVVQQLQAEGKVRFVGFSTHGSTDVIIQAINTNQFDYVNLHWYYINQWNWPAIEAATRHDMGVFIISPTDKGGQLYNPPQKLVDLCAPLSPMVFNDLFCLSHSQVHTLSLGAAKPQDFDEHLQTLDLINRASEILPPILGRLEDAAIASLGEDWVKTWETNLPQWEQTPGQINIRVILWLLNLATTYDLVDYAKMRYNLLGNASHWFPGNKADKLNEIDLQQCLRYSPHADKIPQFLAKAHQLLAGEELQRLSQS

SEQ ID NO: 9313 - DNA, 1071 bp, Nostoc sp. PCC 7120
  CDS (1)..(1071): transl_table=11
atgcgctacttggctgatagcgaaaatgtgcagcaaactattgccacagctttagcgctaggaattaatcatatagaaacagccagaggttatggtaaaagtgaggagtattttggccaagcaatcaaagtcggtttatctgtagctcgttcccaactttacgtaactaccaaaattccaccaacatctgatgctgaaagtatgcgtcggtacatcgatgaatccctagaacgattgaatttagattatctggattgtttaggaattcacggcttaaatacttgggaacatctggagtgggtacaagccaaaggtggctgtatgaaagctgtcgaggaagcgattaacgacagacgaattagacacgttggcttctctacccacggatcattagaggtaattcaagcagcaattaacacagatttttttgaattcgttaacctccattattactatttctttcaaagaaatgccccagccatcaagctagcatctgaaaaagatatgggcatttttattatctccccagccgataagggaggaaaactgtacacggcaccccaaactctccaagatttgtgtcagcccttttcgcctttagaattaaactatagatttttactaagtgatcaacggattactaccttgagtgtagggccagcgactccaaaagaactggtggaacccttacaagttgctgataattatggcgagctaacatcagcagaaattgccgtttttcaacgcttacaaaatcatcaaaaatcagttttagaaactcaacagtgtagccagtgctatgcttgtttaccctgtccagaaaatatcaatattcctgaagttcttaggttacggaatttggcagtggcatacaacatgacagattacggacaataccgttacggaatgtttgaaaatgctggtcattggttcccaggtatgaaagctaaccgttgtacagaatgcggtgattgtttaccccggtgtccagaaaatttagatattccttctttattagaagatgcccacaatcgattaaatggcaaagcggggagaaggttgtggggataa

SEQ ID NO: 9314 - protein, 356 aa, Nostoc sp. PCC 7120
MRYLADSENVQQTIATALALGINHIETARGYGKSEEYFGQAIKVGLSVARSQLYVTTKIPPTSDAESMRRYIDESLERLNLDYLDCLGIHGLNTWEHLEWVQAKGGCMKAVEEAINDRRIRHVGFSTHGSLEVIQAAINTDFFEFVNLHYYYFFQRNAPAIKLASEKDMGIFIISPADKGGKLYTAPQTLQDLCQPFSPLELNYRFLLSDQRITTLSVGPATPKELVEPLQVADNYGELTSAEIAVFQRLQNHQKSVLETQQCSQCYACLPCPENINIPEVLRLRNLAVAYNMTDYGQYRYGMFENAGHWFPGMKANRCTECGDCLPRCPENLDIPSLLEDAHNRLNGKAGRRLWG

SEQ ID NO: 9315 - DNA, 1239 bp, Thermosynechococcus elongatus BP-1
  CDS (1)..(1239): transl_table=11
atgaccaggggccgccaattccgacaaaatagtgaaggaaccctcgttgagtgcagtatgcgctaccgtcgctttggtcgtaccgaactgccaatgcctgtcttttcctgtggcggcatgcgctatcagttttcctggcaggatgtcaatcccagtaccattcccgcagaaaatcaacgcaacctagaggcgactattcggcgtgctctggccttgggcatcacccacattgaaacggcgcgcggctatggcacctccgaaattcagttggggaaaattctgcctcggctgccccgcgaaaagctcattgtccaaaccaaggtggggccgcgacccactgccaaggagtttcgggaaaccctcgaaacctcactgcggaacctccagttagactacattgacttactcgctatccatggcctgaacctgccggagcatttagagcaggtactgcggccggggggatgcttagatgtagcgcgggaatggcaagcatcaggtaagattcgcttcattggtttttctacccatggcagcttagaggtgattcgccaggcgatcgccagcgatgtctttgattacgttaatctgcactggtactacatcaatcaacagaattggcctgccatcctcgatgctcaagcccgtgatatgggggtttttatcattagcccggcagacaaggggggaatgctctacaaaccaccccaacgccttgtggaactctgtgcccccttaagcccaatggtctttaacgatctcttttgcctctcccatccccaggtgcacaccctgagtatcggtgcggctcgtcccagtgactttgatgaacatctcaaggccctcgagctgctggatcaggcaggtgagattctaccgccgatcttggcacggctggagcaagccgccattgaccgcttgggggaagactggtaccacacttggcatgagggattgccagactaccggcacacccccggtgaagtgaatatccccgtcattctctggctgtggaacctagtgcaggcctacgatttgctggactatgcccgtatgcgctataacctgctgggcaacggtggccactggtttccgggagcaaatgctgcacggatcaaagacttggatttaggcccctgtttacggcacagtccccatcggcaaaagattccaaggattttacaagcggcccatgatctcctaagtggcactccccggcagcgattatctcaatcctaa

SEQ ID NO: 9316 - protein, 412 aa, Thermosynechococcus elongatus BP-1
MTRGRQFRQNSEGTLVECSMRYRRFGRTELPMPVFSCGGMRYQFSWQDVNPSTIPAENQRNLEATIRRALALGITHIETARGYGTSEIQLGKILPRLPREKLIVQTKVGPRPTAKEFRETLETSLRNLQLDYIDLLAIHGLNLPEHLEQVLRPGGCLDVAREWQASGKIRFIGFSTHGSLEVIRQAIASDVFDYVNLHWYYINQQNWPAILDAQARDMGVFIISPADKGGMLYKPPQRLVELCAPLSPMVFNDLFCLSHPQVHTLSIGAARPSDFDEHLKALELLDQAGEILPPILARLEQAAIDRLGEDWYHTWHEGLPDYRHTPGEVNIPVILWLWNLVQAYDLLDYARMRYNLLGNGGHWFPGANAARIKDLDLGPCLRHSPHRQKIPRILQAAHDLLSGTPRQRLSQS

SEQ ID NO: 9317 - DNA, 1122 bp, Thermosynechococcus elongatus BP-1
  CDS (1)..(1122): transl_table=11
atgcgttaccgccgttttggtcgcacggggctagacctctcggtgttttccctgggaacgatgcgtgccttgggcagcccagaggtgatgcaggcggtcattgagggggcgatcgcccacggcattaaccacattgaaaccgccgccgcctacggcgccagtgaagcctacattggccgtgccctcaaggccttgggccagccccctgtctatatcaccaccaaactattgccccaaggggatgcggctcacgtccagcgacaaattgagcaatccctggagcgtctccaagtcccacgcttagacggtgtcgccctccacggagtgaatacccctgagcatctggcctggctgagcagtgaagggatggccatgctgcagcaattgcaggcaaagggggtgattggcgctttgggtttttccagtcatggatcgttgtcggtgattttggaagcgatcgccagcgatcaatttgactttgtgaatctgcattacacctactttcagcaacgcaatgccccagcgatcgcagctgccgctgagcggaatctcggcattttcatcatttccccagccgacaaagggggcaagctctaccagccttcccaacggctccaggagctctgtgggccttttcacccgctccattggagctaccgctggttgctgagccagcctgccatcaccaccttgagcattgggcctgccaccgttgccgagttggcctttcccttggcagtggccgatcaggtcgatcccctgagtcccgaagagcaagctgtgggcgatcgcctacaagccgtcatgcaggaaaccctaggcagagatttgtgtcaacaatgttatgcctgtctgccctgtccgcaggagattcacatccccgaagtgttgcggctccacaacttggccgtcgcctacgacatgacggaatttggcaaatatcgctatgggatgtttggccgcgccgggcattggtttgcgggacaacccgccaaccgctgtactgaatgtggcgactgtttgccccgctgtcccagtcggttggagattccgcggctgttgcgggaaacccatgagcagttgcaaggcagctcgcgatcgcgcctttggcagacgatttag

SEQ ID NO: 9318 - protein, 373 aa, Thermosynechococcus elongatus BP-1
MRYRRFGRTGLDLSVFSLGTMRALGSPEVMQAVIEGAIAHGINHIETAAAYGASEAYIGRALKALGQPPVYITTKLLPQGDAAHVQRQIEQSLERLQVPRLDGVALHGVNTPEHLAWLSSEGMAMLQQLQAKGVIGALGFSSHGSLSVILEAIASDQFDFVNLHYTYFQQRNAPAIAAAAERNLGIFIISPADKGGKLYQPSQRLQELCGPFHPLHWSYRWLLSQPAITTLSIGPATVAELAFPLAVADQVDPLSPEEQAVGDRLQAVMQETLGRDLCQQCYACLPCPQEIHIPEVLRLHNLAVAYDMTEFGKYRYGMFGRAGHWFAGQPANRCTECGDCLPRCPSRLEIPRLLRETHEQLQGSSRSRLWQTI

SEQ ID NO: 9319 - DNA, 1137 bp, Prochlorococcus marinus subsp. marinus str. CCMP1375
  CDS (1)..(1137): transl_table=11
atgagtcataaaagaaatccatttggtcttggccctgaggtgagtttatttacattagggacaatgcgcgcaattgaatcaatagatcagatgtatttgattcttaaggaagcttattttgcaggaattaatcatatagaaacatctcctgcatatggaccagcagaaattttcctaggggaatctctaaaaaagctgaaagccaaaggaattgagcctagaggtggttggataataaccagcaaacttcttccaagcattaaattctccaatggcaaaaaacaacttaaaggaatcatcaagagactaggaatatccaaagttcataatcttgcaattcatggcttaaatctccctgagcaccttaactgggctttacaaggagaaggtgctgaattgctaaaatgggcccaatctgaggacctaattggacaagtaggcttcagctctcatggctcatttcaattaatcaatgaggcaattgaaagtaatcaatttaatttctgcagtcttcatctacatttattagatcaagaaaggataccgctggcacaggcagctttaaaaaaaggaatgggagttatagccatttcacctgcagataaaggaggtcatttacatacaccaagtcaaactctgattgaagattgttccccattcaagccactcgagttggcttatcgatacttattatcacaaggaattagcactcttaccttaggagcaaataagactaaagacttataccttgcaaaaaagcttggggattcaaattcaccactatctagttccgaaaagcttttaattgatcgcctaatgaaaaacatcactcatcgcttggggaatacattttgtggccaatgtagagagtgcttaccttgtcccaatgaagtcccaatcccaaatattttacgcctccgaaacctcgacattggacttaatcttcaaactttctcaaaagaaagatataatctcattgggaaagcagggcattggtgggaaaaatatgatgcaagtgcttgtatgaaatgtggagattgcctgcctagatgtccaaataacctaaatattccagaacttcttgaagaaactcattctaaattaattgataaaccagaaagaagattatggggatga

SEQ ID NO: 9320 - protein, 378 aa, Prochlorococcus marinus subsp. marinus str. CCMP1375
MSHKRNPFGLGPEVSLFTLGTMRAIESIDQMYLILKEAYFAGINHIETSPAYGPAEIFLGESLKKLKAKGIEPRGGWIITSKLLPSIKFSNGKKQLKGIIKRLGISKVHNLAIHGLNLPEHLNWALQGEGAELLKWAQSEDLIGQVGFSSHGSFQLINEAIESNQFNFCSLHLHLLDQERIPLAQAALKKGMGVIAISPADKGGHLHTPSQTLIEDCSPFKPLELAYRYLLSQGISTLTLGANKTKDLYLAKKLGDSNSPLSSSEKLLIDRLMKNITHRLGNTFCGQCRECLPCPNEVPIPNILRLRNLDIGLNLQTFSKERYNLIGKAGHWWEKYDASACMKCGDCLPRCPNNLNIPELLEETHSKLIDKPERRLWG

SEQ ID NO: 9321 - DNA, 1224 bp, Prochlorococcus marinus subsp. marinus str. CCMP1375
  CDS (1)..(1224): transl_table=11
gtgaataatatttccaataattgcgattcactaccttgtaggcgattcgggcgaacggaaatgaatatccctgttttgtcgttaggcggcatgcgctttcagcatagttggagcgatctcgcaatgaaagaagttacaaatgatagtcagatgaatttagaagaaattctaaaatttgcatctaaaaatggtttccatcatatagaaacagccagacattatgggacttctgagctgcaactcggcagtgctatgaaaagggttgtggactctaaaagaattgttcaaacaaaaattccaccaagagaagacccgaatgagtttgagaaagaacttgaactgagttactcaaaattgcaatgtaaaaaaattgatcttcttgcaatacatggcttgaatcttccagagcatttggatcagaccattcgcccaggaggatgtctagaagttgttcgcagatggcagaggaatgatcgtattaaacatgttggcttttcaacgcatggacctacggatttaatagttaaagcgattgaaacaaatgaatttgactacataaatctgcattggtattttatttttcaagataatgaacctgcattggcggcggcagcaaaattcgatttaggtgtttttatcattagccctactgacaaagggggacatttacataccccatcagcaaagcttttaaaactatgttcaccacttcatccaattgtttttaatgatttattttgcttaagtgatgcaagagttcataccataagcgttggggcatctaacattagagattttcttttacatcttcatgcagttgatacacttgatcaagctcatcatgtgttgcctggaattaaaaaacgtctactagatgccgccaatagctcgttaggagaagactggatggccacatggagagaaggcttgccagtatgggatcaaactccaggagaaattaatattcctgtattgatatggttatataatcttcaaatatcttggggtatggaagactatgcaaaagcccgctatagattactaggtggaggtagccattggttccctggtgcaaactgtgacaatctggataatactgtaagtgtagatgatcttaaagaagcactacaacttagtccttgggttgatgaaattgttgaaagattacgtgaacttcgcgaaaagtttaaagggattcctgttcaaagattgtcagatgtttga

SEQ ID NO: 9322 - protein, 407 aa, Prochlorococcus marinus subsp. marinus str. CCMP1375
MNNISNNCDSLPCRRFGRTEMNIPVLSLGGMRFQHSWSDLAMKEVTNDSQMNLEEILKFASKNGFHHIETARHYGTSELQLGSAMKRVVDSKRIVQTKIPPREDPNEFEKELELSYSKLQCKKIDLLAIHGLNLPEHLDQTIRPGGCLEVVRRWQRNDRIKHVGFSTHGPTDLIVKAIETNEFDYINLHWYFIFQDNEPALAAAAKFDLGVFIISPTDKGGHLHTPSAKLLKLCSPLHPIVFNDLFCLSDARVHTISVGASNIRDFLLHLHAVDTLDQAHHVLPGIKKRLLDAANSSLGEDWMATWREGLPVWDQTPGEINIPVLIWLYNLQISWGMEDYAKARYRLLGGGSHWFPGANCDNLDNTVSVDDLKEALQLSPWVDEIVERLRELREKFKGIPVQRLSDV

SEQ ID NO: 9323 - DNA, 1146 bp, Prochlorococcus marinus subsp. pastoris str. CCMP1986
  CDS (1)..(1146): transl_table=11
atgataattcattctaagaaaagatcatttgggaaagcgtgccatgtaagtttatttactttaggcacaatgagagccacagaaaatattgataaaatgaattaccttataaaaagtgctcatgatgcgggcattaatcatttagaaactgctgctgcttacggtaatgctgaaaaactgatcggggattcattaaaggaattagaaacttccgaaaatatttttaggaaagaatggataattactaccaaagtattacctaaaggagattttaattatttaaaagagaatttcgaaaactcactcaaaaatttaaagctagagaaaataaataatcttgcaatccatggaataaacttaaaggagcatttagattgggttctaaatggagagggtggaaagtttttaaaatgggtaattaaaaagggcctggttgatcaagttgggttcagttcacatggcagttataaactgattgagaatgcaattaactgtgaagtatttagtttttgcaatcttcatttacattttttagatcaatcaaaaataagccttgcccaactagctttaaaaaagcaaatgggtgtattggcaatatcacctgctgataagggtggaagattatatgctccaagcgaaaccttattaaaagcatctgcaccataccatcctttggaactagcttatagatttttactatcgaaaggaatcacgactctatctttaggagctacaaaatttgaagattttaatattgcaaaaaagcttataaactcaactcaaaaactaacatcttctgaaattagagcattagaaaatatcgaaaattttgcaaacgaggagttaaagtcttcaaaatgtgagcaatgcagatcttgcctaccatgtccaagcgaaattcctattccagagatacttcgtttgagaaatatatctattgggtatggccaattagaatttgctaaagaaagatataatttaatagggcgggcaggccactggtgggaagaaaaagatgcttctttttgcttagattgcaatgaatgcattccaaaatgtcctagtaaattaaatattccagctttattaaaagaaactcacaacttattaatcgaaaagcctaaaaaaagattatggggttcatga

SEQ ID NO: 9324 - protein, 381 aa, Prochlorococcus marinus subsp. pastoris str. CCMP1986
MIIHSKKRSFGKACHVSLFTLGTMRATENIDKMNYLIKSAHDAGINHLETAAAYGNAEKLIGDSLKELETSENIFRKEWIITTKVLPKGDFNYLKENFENSLKNLKLEKINNLAIHGINLKEHLDWVLNGEGGKFLKWVIKKGLVDQVGFSSHGSYKLIENAINCEVFSFCNLHLHFLDQSKISLAQLALKKQMGVLAISPADKGGRLYAPSETLLKASAPYHPLELAYRFLLSKGITTLSLGATKFEDFNIAKKLINSTQKLTSSEIRALENIENFANEELKSSKCEQCRSCLPCPSEIPIPEILRLRNISIGYGQLEFAKERYNLIGRAGHWWEEKDASFCLDCNECIPKCPSKLNIPALLKETHNLLIEKPKKRLWGS

SEQ ID NO: 9325 - DNA, 1200 bp, Prochlorococcus marinus subsp. pastoris str. CCMP1986
  CDS (1)..(1200): transl_table=11
atggagttgccttgtcgcagatttggtagaaccaatctaaaaatgcctgttttatccttaggaggcatgagatttcaaaaaagttgggatgaattgaaattttcagagatttcacgaaaagaacagaataaagttgaaaatatattgaatcttgccaataaatttggttttaatcacatagagacagctaagtattatgggacttcagaaatacagttaggtatgggtttcaagagtattgaaaaaaaaccaaaaatcattcaaacaaaaatccctcctaatcgtgatccgaaattattcgaagcagaacttttgaaaagctttgaaaaattgcaagtaaagaaaattgatttattagcaattcacggcataaatacacctgaacatcttcatcaagctgtaaaagatggaggctgtattgatattttaaaaaaattccaacaagaaaatttaattggatatataggattttcgactcatggagaattatctcttatagaaaaagcgataactacaaatttatttgattatattaatttgcactggtattttatcaatcaaacgaattccaagttaattgagttggctcataaatatgatcttggagtttttataataagtcctaccgataaaggaggacatcttcacactccatcaacaaaaattttggaactttgcagccctttacacccaatagtatttaacgatcttttttgcttaaggaataaatatgttcatacaattagtgtcgggatagccaaagagcaagactttaatttacatttagaagcagtttcattattgtcagaatctgatcattatattcctaaaatactaaatagattaaaagaggaatcaataaattcattaggtatagaatggtataaaagttgggataaaaatttaccaaattggaaaaatacaccaggaggaataaatattccggttcttctctggctcgcgaatttaatagattcctttgatttagaagaatttgcaaaatctagataccaattacttggtaatggaagtcattggtttccaggcaataatgcaaatttgttagatgttaatgtatgcgaaagtcaattattaaaagttttagaaaggcatataaaacccaaaaaggttataaagaaattaagagtcctaaaagacaagtttggggataaatcattaaaaaggctatcaaagaattaa

SEQ ID NO: 9326 - protein, 399 aa, Prochlorococcus marinus subsp. pastoris str. CCMP1986
MELPCRRFGRTNLKMPVLSLGGMRFQKSWDELKFSEISRKEQNKVENILNLANKFGFNHIETAKYYGTSEIQLGMGFKSIEKKPKIIQTKIPPNRDPKLFEAELLKSFEKLQVKKIDLLAIHGINTPEHLHQAVKDGGCIDILKKFQQENLIGYIGFSTHGELSLIEKAITTNLFDYINLHWYFINQTNSKLIELAHKYDLGVFIISPTDKGGHLHTPSTKILELCSPLHPIVFNDLFCLRNKYVHTISVGIAKEQDFNLHLEAVSLLSESDHYIPKILNRLKEESINSLGIEWYKSWDKNLPNWKNTPGGINIPVLLWLANLIDSFDLEEFAKSRYQLLGNGSHWFPGNNANLLDVNVCESQLLKVLERHIKPKKVIKKLRVLKDKFGDKSLKRLSKN

SEQ ID NO: 9327 - DNA, 1137 bp, Prochlorococcus marinus str. MIT 9313
  CDS (1)..(1137): transl_table=11
atgatgccaatacgacgcccctttggtcggggaccggcagtgagcctgttcacccttgggacgatgagggcaatcggctcagccgagcaaatgtatggcgttgttaaagctgcccaggccgctggtattaaccacatcgaaacctccccggcctatggcccggcagaaagttttcttggcactgctctgcgacagctgcaacaaaagcaagctgaaccttctggaggctgggtcatcaccagcaaacttctgccagggctaagcctgaaagaagggcagtgcgaattgcacaaccttttggcgcgacttggaaggcccaagcttgaaaaccttgcagtgcatggcctcaatcgccctgagcacctagagtgggctctaagtggtgacggcgcagcgctactccgttgggctgaggaagaggatcttgttgttcaagtgggattcactagccatggctcctttcccctcatcaaggaagccttagcaagcggtcgttttcaattctgcagcctgcatctgcaccttctagatcccgaacgtattcccctggcacgggaggcccttgcgtcaggcatgggtgtcatggcaatctcccctgctgataaaggaggacggcttcaggacccaagcccaaccctggttgaggactgcagcccactctcgcctctccagcttgcctatcgcttcctgctggctgcaaagatcagcaccctcagccttggtgctgctcagccagaggacctgacacttgctgcgcagttggccaacgccgatgggccactcaatcaacgcgagcaaagagccctcaaccaacttcgtcaacaaggtgagcgccgcttaggcgaaaatcgctgcggccagtgcaaagcctgcctgccctgcccgaaatctgtacccataccagatctactacgactacgaaatctggccgtaggccacaaccttcaagcctttacagaagagcgttacaacctgatcggacgagcaggacactggtgggaaggtattgatggcagcgcctgcgagcgctgtggcgaatgcctaccccgctgcccccatcacctgccgatcccggatctcctcgctgacacgcaccaacgcctagcagcagctcccaggcgcaggctatggggttga

SEQ ID NO: 9328 - protein, 378 aa, Prochlorococcus marinus str. MIT 9313
MMPIRRPFGRGPAVSLFTLGTMRAIGSAEQMYGVVKAAQAAGINHIETSPAYGPAESFLGTALRQLQQKQAEPSGGWVITSKLLPGLSLKEGQCELHNLLARLGRPKLENLAVHGLNRPEHLEWALSGDGAALLRWAEEEDLVVQVGFTSHGSFPLIKEALASGRFQFCSLHLHLLDPERIPLAREALASGMGVMAISPADKGGRLQDPSPTLVEDCSPLSPLQLAYRFLLAAKISTLSLGAAQPEDLTLAAQLANADGPLNQREQRALNQLRQQGERRLGENRCGQCKACLPCPKSVPIPDLLRLRNLAVGHNLQAFTEERYNLIGRAGHWWEGIDGSACERCGECLPRCPHHLPIPDLLADTHQRLAAAPRRRLWG

SEQ ID NO: 9329 - DNA, 1221 bp, Prochlorococcus marinus str. MIT 9313
  CDS (1)..(1221): transl_table=11
atgaaggcgtctttggagcagagctctctgccttgccgccgctttggccgcaccggtttatcaatgcctgtgttgtctttaggggggatgcgctttcagcagagctggacagatttggaggcggaggttattacctctgagtcgcagcaactgctgaaggacattttggagcgcgcggtggcctgtggctttcatcatgtggagacggcacgccattacggcagctctgagcggcagttgggatgggcgctgcgtgatgtcttggatccacagcggctgttgcagagcaaagtccctcctcgtgaggatcccaaagtctttgaggctgagttggcactaagttttgaacgattgggatgtgaacgattggatctagttgccatccatggcctcaacctttcggagcatctggagcagaccttgcgaccaggaggttgcatggatgtgttgcgtcgttggcagggtgatggacgcatcggccatgtgggtttttccacccatggccccacagacctaatcgtgcaggcgatcgagacggatgcctttgattatgtgaaccttcactggtatttcatttatcaagacaatgatcctgcactggatgcagctgctcgtcatgacctaggcgttttcatcattagcccgacagataagggtggccatctgcatagtccctcgtctcaacttctggaactctgtgctccacttcatccaattgtgttcaatgatctgttttgcttgcaagacccaagggttcatacgatcagcgttggcgcagcgcgacccagtgatctcgatcggcatctcgaggcggtggatctcttgcagagtgccgctgagttgctgccaccagttcagcagcgactcgttgatgcggcacagttggctttaggtgaggcttggtggaccagttggcagaggggcttgccgccctggcaggagtctccaggcgagatcaatcttccgatcttgctttggctccataatcttgtagaggcttggggaatggagggttatgcaaaagcccgctacggcttactgggcagtgggagccactggttccctggagcgaatgccgaagcactggatgcagatgtgagtgagacggccctcagggaggtgttggtgaacagcccctggtgtgatcagatcccaggcttgctgcgtaggttgcgcaaccgtcttggtggtcaccctcagcagcgactgaccagtgtttaa

SEQ ID NO: 9330 - protein, 406 aa, Prochlorococcus marinus str. MIT 9313
MKASLEQSSLPCRRFGRTGLSMPVLSLGGMRFQQSWTDLEAEVITSESQQLLKDILERAVACGFHHVETARHYGSSERQLGWALRDVLDPQRLLQSKVPPREDPKVFEAELALSFERLGCERLDLVAIHGLNLSEHLEQTLRPGGCMDVLRRWQGDGRIGHVGFSTHGPTDLIVQAIETDAFDYVNLHWYFIYQDNDPALDAAARHDLGVFIISPTDKGGHLHSPSSQLLELCAPLHPIVFNDLFCLQDPRVHTISVGAARPSDLDRHLEAVDLLQSAAELLPPVQQRLVDAAQLALGEAWWTSWQRGLPPWQESPGEINLPILLWLHNLVEAWGMEGYAKARYGLLGSGSHWFPGANAEALDADVSETALREVLVNSPWCDQIPGLLRRLRNRLGGHPQQRLTSV

SEQ ID NO: 9331 - DNA, 1206 bp, Synechococcus sp. WH 8102
  CDS (1)..(1206): transl_table=11
ttgatgcccgacctgcccacccgtcgttttggccgcacggagttgcccattccgttgctctccttgggcggaatgcgctttcagcagagctggaccgatctgccggcatcggagatcacgtctgactcccaaaacaacctgcaggcgactctccagcgcgccacgcagttaggcctgcatcacattgagaccgcgcgtcactacggcagctccgaacgccagttgggctgggcttttcccacaacgccagacccgacacggatcctgcaaagcaaggtgccgccccgggaagatcctgatgccttcgaggccgagctggccctcagctttgagcggcttggctgtcagcgtctcgacctgctggccattcacggcatcaacctgccggagcatctggagcagacccttcgtcccggcggatgcatggaggtggtgcgtcgctggcaagccgatggacgcattggccatgtgggcttctccacccacggtccgacagacgtgatcgtcgccagctgcaacagcggtgccttcgactacatgaatgtccactggtattacatccgccaagacaactcgcctgccctggatgcagcgcagcggcaggacatgggggtgttcatcatcagtcccaccgacaaaggcggtcacctgcacacaccatcacaacgtctgctcgagttgtgcgaccccgtgcatcccatcgtcttcaacgatctcttctgtctgcgtgacccccgcgtgcacaccatcagtgttggggcggcccgaccgtcggatcttgacctgcaccttgaggccgttggtctcctcgatcacgccgatgcgctgattgcgccggtgcatgcgcggctgcggcaggcggctatggaaaccctgggagaggcctggctgaacagctggcggacagggcttcctacttggcaggacacgccgggagacatcaatcttccggtgctgctgtggctgcacaacctgcttgaagcctgggatcttgagagttatgccagggcccgttaccggttgctgggcagtggtggccattggttcgcgggctccaatgccgatgccctcgatgcgggggtctcgatcgccgagctggatgtggtattgcatgccagtccatggcgtcagcagattcccgacatcctgcgctcgctcaagaccaggctggcgggggaggcgcagatgcgtctcagcagcgtttga

SEQ ID NO: 9332 - protein, 401 aa, Synechococcus sp. WH 8102
MMPDLPTRRFGRTELPIPLLSLGGMRFQQSWTDLPASEITSDSQNNLQATLQRATQLGLHHIETARHYGSSERQLGWAFPTTPDPTRILQSKVPPREDPDAFEAELALSFERLGCQRLDLLAIHGINLPEHLEQTLRPGGCMEVVRRWQADGRIGHVGFSTHGPTDVIVASCNSGAFDYMNVHWYYIRQDNSPALDAAQRQDMGVFIISPTDKGGHLHTPSQRLLELCDPVHPIVFNDLFCLRDPRVHTISVGAARPSDLDLHLEAVGLLDHADALIAPVHARLRQAAMETLGEAWLNSWRTGLPTWQDTPGDINLPVLLWLHNLLEAWDLESYARARYRLLGSGGHWFAGSNADALDAGVSIAELDVVLHASPWRQQIPDILRSLKTRLAGEAQMRLSSV

SEQ ID NO: 9333 - DNA, 1116 bp, Synechococcus sp. WH 8102
  CDS (1)..(1116): transl_table=11
atgagacgtccattcggtgccggacgaccggtcagcctgttcaccttggggaccatgcgagccctgggctcgctcgagcagatgcaggaggtggtgcaggcagcggtcctcgccggcatcaaccatctcgagacagcagccgcctacggcccggcagaagattttctggggcatgcactgaagcaggcagaacaacccgaggggggctgggtcgtcaccagcaaactgctgccgggattgaccctgcgtgaggggaagcatcagctgctgaagatcctggagcgtcttggctgcgacaacctcgacaatctggccatccatggcatcaaccgccctgaacacctcgactgggccctgcatggggatggcaaggacttgctggactgggcccagggggagggccatgccgctcaggtgggattcagcagccatggcagccaagcactgattgccgcggccatcagcagtgggcgatttcagttttgctgcctgcatctgcatctgctggatccacagcgtctgccgttggcccatcaggcccttgagcaaggcattggggtcctggcgatttctccggctgacaaggggggacgcctgcaagcacctagtccgaccctgatcagcgattgtgccccgttctccccattgcagctggcttaccgcttcctgctggcccaggggatctccaccctcagtgtcggtgcggctcaggcctccgacctggagctcgccgctgcgctgcagagcagagattcacccctctctctcgaggaacaatccagcctgcaacggctggccgaccatcgccatgagcgtgtcggcgctgatctctgcgggcagtgccaggcctgtctgccctgcccgaacgaggtgccaattccagagctgctgcggttacgcaatctggccatcggccatgacctgatccccttctgccaggagcgttacaacctcatcgggcgagcgggtcactggtgggaaaccgttgatgccagcgcctgcaagcagtgtggggactgcctgccccgctgtcctcaccagctgacgattccagacttgctggctgacacccaccgtcgactgcaggcctccccacgccgacggttatggggttga

SEQ ID NO: 9334 - protein, 371 aa, Synechococcus sp. WH 8102
MRRPFGAGRPVSLFTLGTMRALGSLEQMQEVVQAAVLAGINHLETAAAYGPAEDFLGHALKQAEQPEGGWVVTSKLLPGLTLREGKHQLLKILERLGCDNLDNLAIHGINRPEHLDWALHGDGKDLLDWAQGEGHAAQVGFSSHGSQALIAAAISSGRFQFCCLHLHLLDPQRLPLAHQALEQGIGVLAISPADKGGRLQAPSPTLISDCAPFSPLQLAYRFLLAQGISTLSVGAAQASDLELAAALQSRDSPLSLEEQSSLQRLADHRHERVGADLCGQCQACLPCPNEVPIPELLRLRNLAIGHDLIPFCQERYNLIGRAGHWWETVDASACKQCGDCLPRCPHQLTIPDLLADTHRRLQASPRRRLWG

SEQ ID NO: 9335 - DNA, 1119 bp, Gloeobacter violaceus PCC 7421
  CDS (1)..(1119): transl_table=11
gtgctttaccgtcgcttcggcaaaaccgatctgcgcctgtcggtgttcaccttcggggcgatgcgctacctcgactccaaagaaaacgccgtgaataccgtcaaagaagcggtgcgattggggatcaaccacctggagacggcccggggctacggcgagagcgaaaaatttttgggggcggcctttcgagccggtgtgcctcgcgacaaagtctacgtcaccaccaagatcccgcccaccccggacggcgagacgatgcgccggcagatcgaagaatctctcagccgcatggggatcgaccgcatcgacatcttcgacctgcacgggatcaacacccgcgaacatctggagctgtcggtgcgcaagaacggctgcctggaggccatccgccgggccgtggccgaggggctcatcggccatttgggcttttccacccacggcccgctcccactgattctcgacacgatcgccacgggcgaattcgaatcggtcaatttgcactattactacttcaaccagcgcaacgccccggccatcgagctggcccaccgcctcgacatgggcgtgtttatcatctcgcccaccgacaaaggcgggcagctgttcaaaccgccggcccgcttggttgagctgtgtgctccctacacgcccatcgccgtcaaccaccgctttttgctctgtgatccgcgggtacacacgttgagtctaggggcggcaaatccggccgaatttgcgccgcacctggtggtggccgacatgggcggccccctcagcgaagcggaagcggcgattattgcccgcctcgaccggcagttccgcgagatcccttcggcctgcgagcagtgctaccagtgccttccctgtcccgaagccatccatattcccgaggtgctgcggttgcgcaatctggcggtgggcttcgagatggacgactttgcccgctaccgctataacatgttcggcaatgccggccactggtttcccggcaccaaggccaacggctgcaccgagtgcggcgattgcctgccgcgctgtccggtcggcctcgatattcccgccctgctggggcaaacccaccagatgctgcaccagggcgaacgcaaacgcttgtggggttga

SEQ ID NO: 9336 - protein, 372 aa, Gloeobacter violaceus PCC 7421
MLYRRFGKTDLRLSVFTFGAMRYLDSKENAVNTVKEAVRLGINHLETARGYGESEKFLGAAFRAGVPRDKVYVTTKIPPTPDGETMRRQIEESLSRMGIDRIDIFDLHGINTREHLELSVRKNGCLEAIRRAVAEGLIGHLGFSTHGPLPLILDTIATGEFESVNLHYYYFNQRNAPAIELAHRLDMGVFIISPTDKGGQLFKPPARLVELCAPYTPIAVNHRFLLCDPRVHTLSLGAANPAEFAPHLVVADMGGPLSEAEAAIIARLDRQFREIPSACEQCYQCLPCPEAIHIPEVLRLRNLAVGFEMDDFARYRYNMFGNAGHWFPGTKANGCTECGDCLPRCPVGLDIPALLGQTHQMLHQGERKRLWG

SEQ ID NO: 9337 - DNA, 1098 bp, Prochlorococcus marinus str. AS9601
  CDS (1)..(1098): transl_table=11
gtgagcctattcactttagggacaatgcgaggaactgaaagtcttgaaaaaatgtatagcataataaaaaatgcatattatgtaggaattaatcacatagaaacagcaccctcttatggtgatgctgaatcacttattggaaattcaataaaaaaattagcaatagaagagaatataaaagaaaaaaattgggtaattacttccaaagttttaccaaagggtgattttgactttttaaaaaataattttaaaaagtctcttaaaaatttaaatcgcgagaaaattaataatcttgcaattcacggactcaacttaaaacaacatctagattgggctcttgttggagagggtaagaaattcatatcttggatacttgaaaaggaactagttgatcaagttggttttagttctcacggaagttattcactaattaaagatgcaattaactgtgaagtttttaatttttgtagtcttcacttacattatttagatcaatctaagatttctttagcggaggaagctataaaaaaaggtatgggagttttagcaatatcacctgctgataaaggtggtaaattgtattctccaagtgatattttaatagaggcctctaagccttttcatccattagaattagcgtatcgatttctgctcgcaaaaggcgttacaactttatccttgggggcggcaaacaaaaaagattttgaatttgcatataaacttagaaattcattcgataagcttacaaaacttgaaaaaagcgcccttaataaaattgaggaagtttctaatgaaagattaaactcaaccaaatgtgaacaatgtagatcttgtcttccatgtccaaatgaagtgcctattccagaaatacttcgtttaagaaatatatctattggttatggccaaatagaattttcaaaagaaagatacaatttaataggaaaagctggccactggtgggaagaaaaaaattcctcattttgtcaagaatgtaatgaatgtgttcctaaatgtcctagtaaattagacataccaaatttattaacggaagcccataacttattaactgaaaatcctacaaaaagattatggggataa

SEQ ID NO: 9338 - protein, 365 aa, Prochlorococcus marinus str. AS9601
MSLFTLGTMRGTESLEKMYSIIKNAYYVGINHIETAPSYGDAESLIGNSIKKLAIEENIKEKNWVITSKVLPKGDFDFLKNNFKKSLKNLNREKINNLAIHGLNLKQHLDWALVGEGKKFISWILEKELVDQVGFSSHGSYSLIKDAINCEVFNFCSLHLHYLDQSKISLAEEAIKKGMGVLAISPADKGGKLYSPSDILIEASKPFHPLELAYRFLLAKGVTTLSLGAANKKDFEFAYKLRNSFDKLTKLEKSALNKIEEVSNERLNSTKCEQCRSCLPCPNEVPIPEILRLRNISIGYGQIEFSKERYNLIGKAGHWWEEKNSSFCQECNECVPKCPSKLDIPNLLTEAHNLLTENPTKRLWG

SEQ ID NO: 9339 - DNA, 1194 bp, Prochlorococcus marinus str. AS9601
  CDS (1)..(1194): transl_table=11
atgcaatatcgtagatttggtagaaccaatctgaagattcctgttttatctttaggtggtatgagatttcaaaaaagttgggatcaattagatttttctgaggtttcatacgaagaacaaaataaagtagaaaatatattagatcttgcatcacaatatggcttaagtcatgtagaaaccgccaagtactatggaacttctgaggtgcaattagggatgtgttttaagaatactaagaaaatcccaaatataatccaaacaaagattccaccaaatagtgatccggaaatttttgagcgagatgtattatctagcattgaaaaattgaaagttaaaaaaattgatttgttagcaatacatggtattaatactgctgaacatttacatcaggctattcgagatggaggttgcattgatattttgaggaattttcaaaaagaaaatttaattggatctattggattttcaacgcatggaaaatcttcacttattgaaaaggccatatcaacaaacttatttgattatgtaaatttgcactggtatttcattaatcaggaaaatacaaaggttattaatttagccaataagcatgatcttggggttttcataataagtcccactgataaagggggacatcttcatacaccctcaagaaaaatgttggaattttgtaaaccacttcatcctatagtttttaatgatcttttttgcttaagaaataaaaatgtccatactttgagtgtcggtattgcaaaagagacagattttgctctgcatttagaagctatcgcattgttatcagaatctgagaagtatgtgcctaagataattaacaaattaaggcaggaatcagttaattccttaggtttagagtggcatcaaaattggaatagaaatttaccaagttgggaatatactccgggaaatattaatattcctgttctgctttggctttcaaatttaattgattggttgggtatggaaggctatgcaagagccagatatcaattacttggtaatggaagccactggttcccaggattcaacgcgaatttactagatgtagatgtttctgaagggcaattattgaaagtattagaagatcatataaatccaaaaaaagttataaaaaaattgagaaatttaaaagaaaagtttggagataagaatgctaaaagattatcaagaaaataa

SEQ ID NO: 9340 - protein, 397 aa, Prochlorococcus marinus str. AS9601
MQYRRFGRTNLKIPVLSLGGMRFQKSWDQLDFSEVSYEEQNKVENILDLASQYGLSHVETAKYYGTSEVQLGMCFKNTKKIPNIIQTKIPPNSDPEIFERDVLSSIEKLKVKKIDLLAIHGINTAEHLHQAIRDGGCIDILRNFQKENLIGSIGFSTHGKSSLIEKAISTNLFDYVNLHWYFINQENTKVINLANKHDLGVFIISPTDKGGHLHTPSRKMLEFCKPLHPIVFNDLFCLRNKNVHTLSVGIAKETDFALHLEAIALLSESEKYVPKIINKLRQESVNSLGLEWHQNWNRNLPSWEYTPGNINIPVLLWLSNLIDWLGMEGYARARYQLLGNGSHWFPGFNANLLDVDVSEGQLLKVLEDHINPKKVIKKLRNLKEKFGDKNAKRLSRK

SEQ ID NO: 9341 - DNA, 1143 bp, Prochlorococcus marinus str. MIT 9515
  CDS (1)..(1143): transl_table=11
atgattattgattctcagaaaagattatttggcaaaggttgcaatgtaagtttatttactttaggcacaatgcgagcgactgaaaatcttaataaaatgtactctctgataaaaagggctcatcaagcgggcattaatcatttagaaacagctgcatcttatggaaaagcagaaatcctgataggggaagtattaaataagttagaaaattccgaaaaaataacgaagaaagaatggataattactactaaagttttacctaaaggagattttaattatctaaaaaaaaatttcaaaaattctctaaaaaatttaaagctaaaaaaaattcataatcttgctattcatggaataaatttagatgagcatttggattgggttttaaatggagagggggtaaagtttttacagtggttaattaagaatgacctagttgatcaagttggttttagttcgcatggaagttataaacttattgaaaaagcaattaattgtgaagtatttagtttttgcaatcttcatttacattttttagatcaatcgaagataagccttgcccagttagctttaaaaaagaaaatgggtgttttagctatatcccctgctgataaaggcggaagattatatgcaccaagtgatactttattaaaagcatctgcaccataccatcctttagcactggcttatagatttttactttcaaaaggaattacaactctatctttaggagcttcaaaaattgaagatttttatattgcagaaaaacttattaattcaagtcaaaaacttacttcttctgaaattaatgcattaaaaaatatcgaaaaggtcgctaatgaagaattaaagtcctcaaaatgtgagcaatgtagatcttgccttccatgcccaagtgaaatccctatacctgaaatacttcgtttaagaaatatctctttaggttatggccagatagagtttgctaaagaaagatataatttaataggtagagctggccactggtgggaagagaaaaatgcctctttttgtttagagtgtaatgaatgcgttccaaaatgtccaagtgaattaaatattccagaattattaaaacaaactcacaacctattagttgaaaagcctaaaaaaagattatggggttga

SEQ ID NO: 9342 - protein, 380 aa, Prochlorococcus marinus str. MIT 9515
MIIDSQKRLFGKGCNVSLFTLGTMRATENLNKMYSLIKRAHQAGINHLETAASYGKAEILIGEVLNKLENSEKITKKEWIITTKVLPKGDFNYLKKNFKNSLKNLKLKKIHNLAIHGINLDEHLDWVLNGEGVKFLQWLIKNDLVDQVGFSSHGSYKLIEKAINCEVFSFCNLHLHFLDQSKISLAQLALKKKMGVLAISPADKGGRLYAPSDTLLKASAPYHPLALAYRFLLSKGITTLSLGASKIEDFYIAEKLINSSQKLTSSEINALKNIEKVANEELKSSKCEQCRSCLPCPSEIPIPEILRLRNISLGYGQIEFAKERYNLIGRAGHWWEEKNASFCLECNECVPKCPSELNIPELLKQTHNLLVEKPKKRLWG

SEQ ID NO: 9343 - DNA, 1200 bp, Prochlorococcus marinus str. MIT 9515
  CDS (1)..(1200): transl_table=11
atggagttgccttgtcgcagatttggtagaactaatctgaaaatgcctgttttgtcattaggaggtatgagatttcaaaaaagttgggatgacttaaaattttcagaaatttcaagaaaagaacagaataaagttgaaaatattttgaatattgcaaataacttcggttttaatcacatagagacagctaaatattatgggacttctgaaattcaattaggtatgggtttaaaaagtattaaaaaaataccaaaaatcattcaaacaaaaatccctcctaatcgtgatccgaaattattcgaagcagaacttttgaaaagctttgaaaatttgcaagtaaagaaaattgatttattagcaatacatggaatcaatacacctgaacatcttcatcacgccataaaagatggaggctgtattgatattttaaaaaatttccaaaaagaaaatttaattggaaatataggattttcgactcatggagaatcatctcttatagaaaaaaccatatcaacaaatttttttgattacgttaatttgcattggtatttcattaatcaaaccaatactaaagtaattgatttagctcgtaaatatgatcttggggttttcataataagtcctacagataaaggtggacatcttcacactccatcaacaaaaatgttagaactttgtagccctctacatccaatagtatttaataatcttttttgcttaagaaataaaaatgttcatacaataagtgttgggatcgcaaaagagaaagactttgatttacatttagaggcagtttcgttattgtcagaaactgattattatattcctaaaatattgaatagattaaaagaggaatcaataaattcgttaggtctagagtggtatgaaagttggaataaagatttaccaaattggcaaaatacacctggaggaataaatatccctgttcttctctggctctcgaatttaatagactcctttgatttagaagattttgcaaaatctagataccaattacttggtaatggtagccattggttcccaggtaataatgcaaatttattagatgttgatatatgtgaaagtcaattattaaaagttttagaaaggcatatgaaacccaaagaggtcataaagaaattaagagtcctaaaagaaaaatttggaaaaaaatcattaacgagattatcaaaaaattaa

SEQ ID NO: 9344 - protein, 399 aa, Prochlorococcus marinus str. MIT 9515
MELPCRRFGRTNLKMPVLSLGGMRFQKSWDDLKFSEISRKEQNKVENILNIANNFGFNHIETAKYYGTSEIQLGMGLKSIKKIPKIIQTKIPPNRDPKLFEAELLKSFENLQVKKIDLLAIHGINTPEHLHHAIKDGGCIDILKNFQKENLIGNIGFSTHGESSLIEKTISTNFFDYVNLHWYFINQTNTKVIDLARKYDLGVFIISPTDKGGHLHTPSTKMLELCSPLHPIVFNNLFCLRNKNVHTISVGIAKEKDFDLHLEAVSLLSETDYYIPKILNRLKEESINSLGLEWYESWNKDLPNWQNTPGGINIPVLLWLSNLIDSFDLEDFAKSRYQLLGNGSHWFPGNNANLLDVDICESQLLKVLERHMKPKEVIKKLRVLKEKFGKKSLTRLSKN

SEQ ID NO: 9345 - DNA, 1227 bp, Prochlorococcus marinus str. NATL1A
  CDS (1)..(1227): transl_table=11
gtgccaataaataaagatagtaaaaacaattcaattcctagaagaagatttgggcgaactgagattcagataccagtcttatctttgggagggatgcgctttcaacaaagctggaaggatttagatcctaaagagatcaataatcaacagcaagacatcttgcaaaaaataattaaccatgctgctaaaaatggtatgcatcatatagaaactgctcgtcattatggaacatcagaacgccagataggctgggccttcgatcaaatcgatgacccaaaaagaatattacaaacgaaagtaccaccaaataatgatccttcgatattcgagcaagaacttgagttaagtatgagtagattaaattccaaaaaaattgatttattagctattcatggtatcaaccttcctgagcacttggatatgactattcgtcctaatggatgtctacagattgttcgtcgttggcaaaaagatggtcttattggtcatgttggcttctcaactcatgcaaacgttgacctgataattaaaacaattgaaacagggctttttgattatgttaatttgcattggtattttattcgtcaggaaaacgaaagagctttgcaagcagcggatgctaatgatatgggggtttttattataagtcctactgataagggaggtcatttacatacaccgtcattgaaacttttagatttatgtagtcctttgcatccaatagaatttaatgatctattttgtttgagggatcaaagagttcatacattaagtgttggagcctcaattcctgaagatctggatattcatttaagtgcgatttctaaaattgacaccatgcatggggtaattaataccattgaaaagcgactaataaatgcctcgtataaatcgcttggagagtcatggttgactacttggaatataggtctacctcgctgggatcaaactccaggagagataaatatacctactttattatggctaaacaatttattagaggcttgggatatggaaagctttgttaaagatcgttatggtcttttagggagagggggacattggttcccaggggcaaacgcagattgcttggattgtgaagtgagtgaggatgacttgaaaaaagttttgattaatagcccttggagctctgaaataccttctgtacttagaaaattgaaagatagattgggaggggaaagaagagatagattatgggggatttag

SEQ ID NO: 9346 - protein, 408 aa, Prochlorococcus marinus str. NATL1A
MPINKDSKNNSIPRRRFGRTEIQIPVLSLGGMRFQQSWKDLDPKEINNQQQDILQKIINHAAKNGMHHIETARHYGTSERQIGWAFDQIDDPKRILQTKVPPNNDPSIFEQELELSMSRLNSKKIDLLAIHGINLPEHLDMTIRPNGCLQIVRRWQKDGLIGHVGFSTHANVDLIIKTIETGLFDYVNLHWYFIRQENERALQAADANDMGVFIISPTDKGGHLHTPSLKLLDLCSPLHPIEFNDLFCLRDQRVHTLSVGASIPEDLDIHLSAISKIDTMHGVINTIEKRLINASYKSLGESWLTTWNIGLPRWDQTPGEINIPTLLWLNNLLEAWDMESFVKDRYGLLGRGGHWFPGANADCLDCEVSEDDLKKVLINSPWSSEIPSVLRKLKDRLGGERRDRLWGI

SEQ ID NO: 9347 - DNA, 1221 bp, Prochlorococcus marinus str. MIT 9303
  CDS (1)..(1221): transl_table=11
atgaaggcgtctttggagcagagctctctgccttgccgccgctttggccgcaccggtttatcaatgcctgtgttgtctttaggggggatgcgctttcagcagagctggacagatttggaggcggaggtcattacctctgagtcgcagcaactgctgcaggacattttggagcgagcggtggcctgtggcttccatcatgtggagacggcacgccattacggcagctctgagcggcagttgggatgggcgctgcgtgatgtcttggatccagagcggctgttgcagagcaaagttcctcctcgtgaggatcccaaagtctttgaggctgagttggcactcagctttgaacgattgggatgtgaacgattggatctagttgccatccatggcctcaacctttcggagcatctggagcagaccttgcgaccaggaggttgcatggatgtgttgcgtcgttggcagggtgatggacgcatcggccatgtgggtttttccacccatggccccacagacctaatcgtgcaggcgatcgagacggatgcctttgattatgtgaacctgcactggtatttcatttatcaagacaatgatcctgcactggatgcagctgctcgtcatgacctaggcgttttcatcattagcccgacagataagggtggccatctgcatagtccctcgtctcaacttctggaactctgcgctccacttcatccaattgtgttcaacgatctgttctgcttgcaagacccaagggttcatacgatcagcgttggcgcagcgcgacccagtgatctcgatcggcatctcgaggcggtggatctcttgcagagtgccgctgagttgctgccaccagttcagcagcgactcgttgatgcggcacagttggctttaggtgaggcttggttgaccagttggcataggggcttgccgccctggcaggagtctccaggcgagatcaatcttccgatcttgctttggcttcataatcttgtagaggcttggggaatggagggttatgcaaaagcccgctacggcttacttggcagtggcagccactggttccctggagcgaatgccgaagcactggatgcagatgtgagtgaggcggccctcagggaggtgttggtgaacagcccctggtgtgatcagatcccaggcttgctgcgtaggttgcgcaaccgtcttggtggtcatcctcagcaacgactgaccagtgtttaa

SEQ ID NO: 9348 - protein, 406 aa, Prochlorococcus marinus str. MIT 9303
MKASLEQSSLPCRRFGRTGLSMPVLSLGGMRFQQSWTDLEAEVITSESQQLLQDILERAVACGFHHVETARHYGSSERQLGWALRDVLDPERLLQSKVPPREDPKVFEAELALSFERLGCERLDLVAIHGLNLSEHLEQTLRPGGCMDVLRRWQGDGRIGHVGFSTHGPTDLIVQAIETDAFDYVNLHWYFIYQDNDPALDAAARHDLGVFIISPTDKGGHLHSPSSQLLELCAPLHPIVFNDLFCLQDPRVHTISVGAARPSDLDRHLEAVDLLQSAAELLPPVQQRLVDAAQLALGEAWLTSWHRGLPPWQESPGEINLPILLWLHNLVEAWGMEGYAKARYGLLGSGSHWFPGANAEALDADVSEAALREVLVNSPWCDQIPGLLRRLRNRLGGHPQQRLTSV

SEQ ID NO: 9349 - DNA, 1137 bp, Prochlorococcus marinus str. MIT 9303
  CDS (1)..(1137): transl_table=11
atgatgccaatacgacgcccctttggtcggggaccggcagtgagcctgttcacccttgggacgatgagggcaatcggctcagccgagcaaatgtatggggttgttaaagctgcccaggccgctggcattaaccacatcgaaacctccccggcctatggccaggcagaaagttttcttggcactgctctgcgacagctgcaacaaaaccaagctgaaccttctggaggctgggtcatcaccagcaaacttctgccagggctcagcctgaaagaagggcagtgcgaattgcacaaccttttagcgcgacttggacgacccaagcttgaaaaccttgcagttcatggcctcaatcgccctgagcacctggagtgggccctaaggggagacggcgcagcgctaatgcgttgggctgaggaagaggatcttgttgtccaagtgggattcactagccatggctcatctcccctcatcaaggaagccttagcaagcagtcgttttcaattctgcagcctgcatctgcacctactagatcccgaacgtattcccctggcacaggaggcccttgcatcaggcatgggtgtgatggcaatctcccctgctgataaaggaggacggcttcaagacccaagcccaaccctggttgaggactgcagcccactctcgcctctccaacttgcctatcgcttcctgctggctgcaaagatcagcaccctcagccttggtgctgcgcagccagaagacctgacccttgctgcgcagttggccaacgccgatgggccactcaatcaacgcgagcaaagagctctcaaccaacttcgccaacaaggtgagcgccgcctaggtgaaaaccgatgcggccagtgcaaagcctgcctgccctgcccaaattctgtacccataccagatctactacgactacgaaatctggccgtaggccataaccttcaagcttttacagaagagcgttacaacctgatcggacgagcaggacactggtgggaaggtattgatggcagcgcctgcgagcgctgtggcgaatgcctaccccgctgcccccatcacctgccgatcccggatctcctcgctgacacgcaccaacgcctagcggcagctcccaggcgcaggctatggggttga

SEQ ID NO: 9350 - protein, 378 aa, Prochlorococcus marinus str. MIT 9303
MMPIRRPFGRGPAVSLFTLGTMRAIGSAEQMYGVVKAAQAAGINHIETSPAYGQAESFLGTALRQLQQNQAEPSGGWVITSKLLPGLSLKEGQCELHNLLARLGRPKLENLAVHGLNRPEHLEWALRGDGAALMRWAEEEDLVVQVGFTSHGSSPLIKEALASSRFQFCSLHLHLLDPERIPLAQEALASGMGVMAISPADKGGRLQDPSPTLVEDCSPLSPLQLAYRFLLAAKISTLSLGAAQPEDLTLAAQLANADGPLNQREQRALNQLRQQGERRLGENRCGQCKACLPCPNSVPIPDLLRLRNLAVGHNLQAFTEERYNLIGRAGHWWEGIDGSACERCGECLPRCPHHLPIPDLLADTHQRLAAAPRRRLWG

SEQ ID NO: 9351 - DNA, 1143 bp, Prochlorococcus marinus str. MIT 9301
  CDS (1)..(1143): transl_table=11
atgattattaattcacaaaaaagatcatttggtagaggggcgaaagtgagcttattcactttggggacaatgcgatcaactgaaagtctcgaaaaaatgtatagcataataaaaaatgcatattatgtaggaattaaccacatagaaacagcaccctcttatggtgatgctgaatcacttattggaaattcaataaaaaaattagcaatagaagagaatataaaagaaaaaaattgggtgattacttccaaagttttaccaaagggtgattttgactttttaaaaaataattttaaaaagtctcttaaaaatttaaatcgcgagaaaattaataatcttgcaattcacggactcaacttaaaacaacatctagattgggttctttctggagagggtaagaaattcatttcttggatacttgaaaaggaactagttgatcaagtcggttttagttctcacggaagttattcactaattaaagatgcaattaactgtgaagtttttactttttgtagtcttcatttacattatttagatcaatctaagattgctttagcagaggaagctataaaaaaaggtatgggagttttagcaatatcacctgcagataaaggcggtagattgtattctccaagtgatattttgatagaggcctctaagccttttcatccattagaattagcgtatcgatttcttctcgcaaaaggcattactactttatccttgggggcgacaaacaaaaaagattttgaatttgcgcataaacttagaaactcattcgagaagcttacaaaacttgaaaaaagcgcccttaataaaattgaggaagtttctaatgaaagattaaactcaaccaaatgtgaacaatgtagatcttgtcttccatgtccaaatgaagtgcctattcctgaaatacttcgtttaagaaatatatctgttggttatggccaattagaatttgcaaaagaaagatacaatttaataggaaaagctggccactggtgggaagaaaaaaattcctcattttgtcaagaatgtaataaatgtgttcctaaatgtcctagtaaattagatataccaaatttattaaaggaaactcataacttattaattgaaaatccttcaaaaagattatggggataa

SEQ ID NO: 9352 - protein, 380 aa, Prochlorococcus marinus str. MIT 9301
MIINSQKRSFGRGAKVSLFTLGTMRSTESLEKMYSIIKNAYYVGINHIETAPSYGDAESLIGNSIKKLAIEENIKEKNWVITSKVLPKGDFDFLKNNFKKSLKNLNREKINNLAIHGLNLKQHLDWVLSGEGKKFISWILEKELVDQVGFSSHGSYSLIKDAINCEVFTFCSLHLHYLDQSKIALAEEAIKKGMGVLAISPADKGGRLYSPSDILIEASKPFHPLELAYRFLLAKGITTLSLGATNKKDFEFAHKLRNSFEKLTKLEKSALNKIEEVSNERLNSTKCEQCRSCLPCPNEVPIPEILRLRNISVGYGQLEFAKERYNLIGKAGHWWEEKNSSFCQECNKCVPKCPSKLDIPNLLKETHNLLIENPSKRLWG

SEQ ID NO: 9353 - DNA, 1194 bp, Prochlorococcus marinus str. MIT 9301
  CDS (1)..(1194): transl_table=11
atgcaatatcgtagatttggtaggactaatctgaagattcctgttttatctttaggtggtatgagatttcaaaaaagttgggatcaattagatttttctgaggtttcatttgaagaacaaaataaagtagaaaacatattagatcttgcaacacaatatggcttaagtcatgtagaaaccgcaaagtactatggaacttctgaggtgcaattgggtatgtgtttcaagaatactaagaaaatcccaaatataattcaaacaaagattccaccaaatagtgatccagaaatttttgagaaagatgttacgacaagtattgaaaaactgaaagttaaaaaaattgatttgttagccatacatggcattaatacatctgaacatttgcatcaggctattcgagatggaggttgcattgatattttgaggaattttcaaaaagaaaatttaattggatctataggattttcaacccatggaaaatcgtcacttattgaaaaggctatatcaacaaacttatttgattatgtaaatttgcactggtatttcattaatcaggaaaatacaaaggttattaatttagccaataagcatgatcttggggttttcataataagtcccactgataaagggggacatctgcatactccctcaataaaaatgttggaattttgtaaaccacttcatcctatagtttttaatgatcttttttgcttaagaaatcaaaatgtccatactttgagcgtaggtattgcaaaagagacagattttgctctgcatttagaagctgtctcgttgttatcagaatctgagaagtatgtgcctaagataataaacagattaaggcaggaatcaattaattccttaggtttagagtggcatcaaaattggaatagaaatttaccaagttgggaatatacgccggggaatatcaatattcctgttctgctttggctttcaaatttaatcgattggttaggtatggaaggatatgcaagatctagatatcaattgcttggtaatggaagccactggttcccaggatgcaacgcaaatttgctagatgtagatgtttctgaaggacaattattgaaagtattagaaggtcatataaacccaaaaaaagttataagaaaattgagaaatttaaaagataagtttggagataagaactctaaaagattatcaaagaaataa

SEQ ID NO: 9354 - protein, 397 aa, Prochlorococcus marinus str. MIT 9301
MQYRRFGRTNLKIPVLSLGGMRFQKSWDQLDFSEVSFEEQNKVENILDLATQYGLSHVETAKYYGTSEVQLGMCFKNTKKIPNIIQTKIPPNSDPEIFEKDVTTSIEKLKVKKIDLLAIHGINTSEHLHQAIRDGGCIDILRNFQKENLIGSIGFSTHGKSSLIEKAISTNLFDYVNLHWYFINQENTKVINLANKHDLGVFIISPTDKGGHLHTPSIKMLEFCKPLHPIVFNDLFCLRNQNVHTLSVGIAKETDFALHLEAVSLLSESEKYVPKIINRLRQESINSLGLEWHQNWNRNLPSWEYTPGNINIPVLLWLSNLIDWLGMEGYARSRYQLLGNGSHWFPGCNANLLDVDVSEGQLLKVLEGHINPKKVIRKLRNLKDKFGDKNSKRLSKK

SEQ ID NO: 9355 - DNA, 1158 bp, Synechococcus sp. WH 7803
  CDS (1)..(1158): transl_table=11
ttgagcaacgcacccgcgccactgacccagcggcgcgccttcggcgacggccccgcggtgagcctgttcaccctcggaacgatgcgagcgctgcaatcaccggagcagatgctgtctgtgctgcgcagcgcccgcgacgccggcatcaaccacgtcgagacagcaccggcctacggtccagcggagacctttctgggacaagcgctcaagcagctggatcaggagggggccacgcctgcacagggcgactgggtcatcaccagcaaactgttgcccggtcagaccctcgaccaagcgcgtcgagcccttgatgccagcttggaacggctgaatcgtccccggcttgagaacctggcgatccatggcatcaaccggcaagagcatctccactgggctttgaccggtgatggggcacagctgatcgactgggcactgaccagcggcagagttgggcaggtgggcttcaccagtcatggatccaacgcgctgatccagcaagccatccaaagcggtcgcttccgcttctgcggccttcacctgcacgttctggatccgcagcgcatccccttggcagccgaagctttaagccagcagatgggtgtgctcgccatctccccggccgacaagggcggacgtctgcaggcacccagcgatcaactgatcagcgactgcgctcccttcactcccctggcactggcttaccgctttctgctcgctgcaggcgtgagcacactcacgctgggagcagagagagccagcgacctgaccctggccgccgcactcgccaaccaggacggccccctgagcgagcaggaagctgcagttcttgcgcgcctgcaagaactgcgcaaggaacgcttaggcacggagttctgcgcgcaatgccgtgcctgcctgccctgtccgcgcgaggtgccgattcccgagttgctgcgactgcgcaatctgacccttggccacgatctcagggagttcgcggaagagcgttacaacctgatcggccgagccgggcactggtgggaaacggtgaaggcggatgcctgcgcacactgcggcgactgtctgccgcgctgtccccatcacttgccgattcccaacctgctcggtgacacccaccgcaggcttgccgcggcgccgcgacggcgcctatggggctga

SEQ ID NO: 9356 - protein, 385 aa, Synechococcus sp. WH 7803
MSNAPAPLTQRRAFGDGPAVSLFTLGTMRALQSPEQMLSVLRSARDAGINHVETAPAYGPAETFLGQALKQLDQEGATPAQGDWVITSKLLPGQTLDQARRALDASLERLNRPRLENLAIHGINRQEHLHWALTGDGAQLIDWALTSGRVGQVGFTSHGSNALIQQAIQSGRFRFCGLHLHVLDPQRIPLAAEALSQQMGVLAISPADKGGRLQAPSDQLISDCAPFTPLALAYRFLLAAGVSTLTLGAERASDLTLAAALANQDGPLSEQEAAVLARLQELRKERLGTEFCAQCRACLPCPREVPIPELLRLRNLTLGHDLREFAEERYNLIGRAGHWWETVKADACAHCGDCLPRCPHHLPIPNLLGDTHRRLAAAPRRRLWG

SEQ ID NO: 9357 - DNA, 1203 bp, Synechococcus sp. WH 7803
  CDS (1)..(1203): transl_table=11
gtgaccactcttcccacacgccgctttggacggaccgagctctcgatgccggttctctccctcggaggaatgcgctttcagcagagctggagtgatcttgaagcgaaggcgatcacggcccagtcccaacagttgctgcagcgcaccctcgaacgtgctgttgcgcttggttttcgtcacatcgaaacagcacggcattacggaagttcggagcggcagctgggctgggccatgcctgactgtcctgacccaggccgcattcttcaaaccaaagttccgcctcaacaggaccctgccctgtttgaggcggagttggagctcagcatgcagcggttgggtgtgcagcgcgtggacctgctcgccatccatggcatcaaccgacgcgaccacctcgtgcagacgatcaggccaggaggctgcctggaggtggtgcggcgttggcagcaatcagggcgcatcggccatgtcggcttttccacccatggggacaccgatgtgattgttgaagcgattgagaccgatgcgttcgattacgtgaacctgcactggtacttcatccgtcaggacaatgagccggcgattgccgctgcgcatcgccacgacatgggcgtgttcatcatcagccccacagacaaaggtggccatctgcacacaccggcgcaacggctggtcgcgctgaccgaccctcttcatcccatcgtcttcaacgatctgttctgtctgcgcgatgcgcgtgttcacaccctcagcgtgggtgcggcccgccctgaagatctcgacctgcatctggaggctgtcagtcgactggatcacgctcaggctttggtgagccccatcgaggcccgtttgcatcaggccgagttggaggccctcggggccgactggctgaacagttggcggcaggggcttcccgattggcaaaccacccccggggacatcaatctgcccgtgctgctctggcttcacaatcttgtggaggcctggggcctggatggctatgcccgggcccgttatggcctcttgggcagggctggacactggttccccggtgccaatgctgacgcccttgatcgcgacgtgagtgaggaagaacttgatgcggccctgggcgcgagtccgtggcggacctccatccccgcgcgactgcgcgatctgcgcgagcgggtgggaggtgaccgtcaggagcggttgtcgtcagcctga

SEQ ID NO: 9358 - protein, 400 aa, Synechococcus sp. WH 7803
MTTLPTRRFGRTELSMPVLSLGGMRFQQSWSDLEAKAITAQSQQLLQRTLERAVALGFRHIETARHYGSSERQLGWAMPDCPDPGRILQTKVPPQQDPALFEAELELSMQRLGVQRVDLLAIHGINRRDHLVQTIRPGGCLEVVRRWQQSGRIGHVGFSTHGDTDVIVEAIETDAFDYVNLHWYFIRQDNEPAIAAAHRHDMGVFIISPTDKGGHLHTPAQRLVALTDPLHPIVFNDLFCLRDARVHTLSVGAARPEDLDLHLEAVSRLDHAQALVSPIEARLHQAELEALGADWLNSWRQGLPDWQTTPGDINLPVLLWLHNLVEAWGLDGYARARYGLLGRAGHWFPGANADALDRDVSEEELDAALGASPWRTSIPARLRDLRERVGGDRQERLSSA

SEQ ID NO: 9359 - DNA, 1098 bp, Prochlorococcus marinus str. MIT 9215
  CDS (1)..(1098): transl_table=11
gtgagcttatttactttagggacaatgagagcaactgaaagtctcgaaaaaatgtatagcataataaaaaatgcctattatgcaggaattaatcacatagaaacagcaccttcttatggtgatgccgaatcacttattggaaattcaataaagaaactagaaatagaagagaatataaatgagaaaaattgggtgatcacttccaaagttttaccaaagggtgattttaaatttttaaaaaacaattttaagaattctcttaaaaatttaaaacgcgagaaaattaataatctcgcaattcatggactcaacttaaaacaacatttagattgggttctagctggagaaggtaaaaaattcatatcatggatacttgagaaagaactgattgatcaagttggttttagttcacacggaaattattcactaattaaagaagcaattaactgtgaagtttttagtttttgtagtttacatttacattatttagatcaatctaaaattactttggcagaggaagctataaaaaaaggtatgggagtattagcaatatcacctgctgataaaggcggtagattatattctccaagtgatgttttgttagaggcctctgaaccttttcatccattagaattagcgtatagatttcttttggcaaaaggcattacaactttgtccttgggtgcaacaaacaaaaaagattttgaatttgcgcataaacttagaaactccttcgataagctttcaaaacttgaaaaaagcgccctaaataaaattgaggaagttgctaatgaaagattaaactcaaccaagtgtgaacaatgcagatcttgtcttccatgcccaaatgaaataccaattccagaaatacttcgtttaagaaatatatctattggttatggccaattagaattttcaaaagaaagatacaatttaataggaaaagctggccactggtgggaagaaaaaaatgcctcattttgtcaagaatgcaatgtatgtgtttctaaatgtcctagtaaattagatataccaaatttattaaaacaaacccataacttattaattgcaactcccacaaaaagattatggagttaa

SEQ ID NO: 9360 - protein, 365 aa, Prochlorococcus marinus str. MIT 9215
MSLFTLGTMRATESLEKMYSIIKNAYYAGINHIETAPSYGDAESLIGNSIKKLEIEENINEKNWVITSKVLPKGDFKFLKNNFKNSLKNLKREKINNLAIHGLNLKQHLDWVLAGEGKKFISWILEKELIDQVGFSSHGNYSLIKEAINCEVFSFCSLHLHYLDQSKITLAEEAIKKGMGVLAISPADKGGRLYSPSDVLLEASEPFHPLELAYRFLLAKGITTLSLGATNKKDFEFAHKLRNSFDKLSKLEKSALNKIEEVANERLNSTKCEQCRSCLPCPNEIPIPEILRLRNISIGYGQLEFSKERYNLIGKAGHWWEEKNASFCQECNVCVSKCPSKLDIPNLLKQTHNLLIATPTKRLWS

SEQ ID NO: 9361 - DNA, 1194 bp, Prochlorococcus marinus str. MIT 9215
  CDS (1)..(1194): transl_table=11
atggaatatcggagatttggtcgtacgaatttaaagatacctgttttatctttgggtggaatgagatttcaaaaaagttgggatcaattagatttttctgagatttcatgggaagaacaaaataaagtagaaaatattttgaatttggcaagtgaatatggcttaagtcatgtcgaaactgctaagtactatggaacttctgagattcaattaggcatgggctttaaaaatacaaataatatcccaaacattattcaaacaaagattcctccaaatagtgatccagaaatttttgagagagacgtgatgacaagttttgaaaaattgaaagttaaaagaattgatttgctggcaatacatggcattaatacaaatgaacatttatctcaagctgttaaagatggaggttgtattgatatcctaaggaacttacaaaaaaaaaatttaattggatctattggattttcgactcatggcaaatcttcactcattgagaaggctatatcaacaaacttgtttgattatgtgaatttgcactggtatttcattaatcaagaaaatacaaaggtcataaatttagcaaataagtatgatcttggggttttcataataagtcccactgataaagggggacatcttcatacaccctcaaaaaaaatgttggaactttgtaagccactacatcctatagtttttaatgatcttttttgtttaagaaatcaaaatgtccatactcttagtgtaggtattgcaaatgagacagattttgctctgcatttagaagctgtctcgttgttatcagaatctgaggactatattcctcagataataaacagattaaggcaagaatcaattcattctttaggtttagattggcatcaaaattggaatagaaatttaccaagttgggaatatacccctggtaatattaatattccagttctgctttggctttcaaatttgattgattggttggatatggaaggatatgcaagatctagatatcaattgctaggtaatggaagccactggttcccaggattcaacgcaaatatactagatgtagatgtttctgaaggacaattattgaaagtattagaaggtcatataaatccaaaaaaagttataaaaaaattgagaaatttaaaagaaaagtttggagataagaatgctaaaagattatcaagaaaataa

SEQ ID NO: 9362 - protein, 397 aa, Prochlorococcus marinus str. MIT 9215
MEYRRFGRTNLKIPVLSLGGMRFQKSWDQLDFSEISWEEQNKVENILNLASEYGLSHVETAKYYGTSEIQLGMGFKNTNNIPNIIQTKIPPNSDPEIFERDVMTSFEKLKVKRIDLLAIHGINTNEHLSQAVKDGGCIDILRNLQKKNLIGSIGFSTHGKSSLIEKAISTNLFDYVNLHWYFINQENTKVINLANKYDLGVFIISPTDKGGHLHTPSKKMLELCKPLHPIVFNDLFCLRNQNVHTLSVGIANETDFALHLEAVSLLSESEDYIPQIINRLRQESIHSLGLDWHQNWNRNLPSWEYTPGNINIPVLLWLSNLIDWLDMEGYARSRYQLLGNGSHWFPGFNANILDVDVSEGQLLKVLEGHINPKKVIKKLRNLKEKFGDKNAKRLSRK

SEQ ID NO: 9363 - DNA, 1137 bp, Prochlorococcus marinus str. MIT 9211
  CDS (1)..(1137): transl_table=11
atgaaaattgttcgaagaccttttggaaaagaagtggaagtcagcctgttcacattagggaccatgagagcccttgagtcttctgaagcaatgtatgcggtagttaaagaggcttgcttggctgggatcaatcacatagaaacttctccttcatatggacctgctcaaaagttcctaggcgaatctttacaaaaacttagatttcataaaatcaatcctcagaatggctgggtagtcacaagcaagatccttccaggcattaccttctcagaaggccaaaggcaactacagcaaactttagtagacattgggattccaaagattgacaatcttgcagttcatggtcttaatcttcctgaacatttaacatgggccctacatggagacgggattaaactgattcagtgggctaaagaaaaaaatcttattgcccagttcgggtttacctctcatggtgatcaatcccttatagagaaagctataaaaagtcgccaatttaatttttgtagtctacatttacatcttctcgaccaaggtaggctccatcttagcaaacttgctttgaatcaagacatgggggtaatggctatttcaccagcagacaaaggtggtcacttgcatactccaagtcaaaccttaattaaagattgctctccaatatctcctatcgaattggcatatagatttctattagctcaaggggtcagtacattaacactaggagccaataagccagaagagctctctatagctaaaaagctagtagcagcaaatgggcaattaaccaaagcagaggaagcctctatgaatcgtctatatcaagaggggaagcgtcggctaggggatactttatgtgggcaatgtcgagaatgtatcccatgtccaaacaatgttccaatacctgagatattgcgattgcgaaacttatctatcggacatgatctaacttccttctcaaaagaaagatataacctcatagggaaagcagggcattggtgggaagaggttgatgctagtgcttgcaagaagtgtggggattgtctaccacgttgtccaaatcatctaaaaataccggacttacttgaacaaacacatcatcacttattagatagacctaaaagaagattatggggttga

SEQ ID NO: 9364 - protein, 378 aa, Prochlorococcus marinus str. MIT 9211
MKIVRRPFGKEVEVSLFTLGTMRALESSEAMYAVVKEACLAGINHIETSPSYGPAQKFLGESLQKLRFHKINPQNGWVVTSKILPGITFSEGQRQLQQTLVDIGIPKIDNLAVHGLNLPEHLTWALHGDGIKLIQWAKEKNLIAQFGFTSHGDQSLIEKAIKSRQFNFCSLHLHLLDQGRLHLSKLALNQDMGVMAISPADKGGHLHTPSQTLIKDCSPISPIELAYRFLLAQGVSTLTLGANKPEELSIAKKLVAANGQLTKAEEASMNRLYQEGKRRLGDTLCGQCRECIPCPNNVPIPEILRLRNLSIGHDLTSFSKERYNLIGKAGHWWEEVDASACKKCGDCLPRCPNHLKIPDLLEQTHHHLLDRPKRRLWG

SEQ ID NO: 9365 - DNA, 1209 bp, Prochlorococcus marinus str. MIT 9211
  CDS (1)..(1209): transl_table=11
atgactaaaggatctataccttctaggcggtttggacgtactgagattcagattcctgttttatctcttgggggtatgcgttttcagcaaagctggactgatttggggatcaaagatatacctatttcgaatcaagttaatttggaaaagattcttcatgaggctgtaaacaatggacttcatcatttggaaacggcaaggcattacgggacctcagaacttcaaattggtttatcaataagcaatgttaatgatcctaaaaggatccttcagacaaaagttccaccaagggatgatcctaaggattttgagcaggagcttgagttgagttttaaaagattgcaatgcaaaagagtagatctccttgcaattcatggcataaatctccctgaacatttagagcaaactattaggcctggaggatgtattgatattgtgcggcgatggcaaaagaagggtctgattggacatgttggcttctcaacccatggctctaatgatttaattgtccaagcaattgagacaaatgaatttgattatgtaaaccttcactggtatttcatttatcaagataattcacctgcattagatgcagcagcaaaattagaccttggagtttttattattagccctactgataaaggggggcatttacatacaccatcatccaagctcgtagagttatgtgcacctttgcatccaattgctttcaatgatctcttttgcttaacagataaaagagttcatacgattagtgttggtgcggccaatccaggtaactttgaacgccatattgaggcgcttagattgctaaataactctggtgaattattgtcgactattcaagaacgtctattagatgcatctcgatcatccttaggtgatgagtggctgtcaacttggcgagttggtttgcctaggtgggatcaaacacctggcgggataaatattcctgttttgttatggttacatactttgatcgaatcttgggagatggaagacttcgcaaaatctcgctataggttgttaggtaaagctagtcattggttcccagggtctaatgctgattgttttgatgatgacgtgagcgaagacgatcttagggaagttcttctggagagtccttggtgtgatgagattccttttttacttcgccaattgaaaactagattagcgggcgagccttctcagagattatctagcatttga

SEQ ID NO: 9366 - protein, 402 aa, Prochlorococcus marinus str. MIT 9211
MTKGSIPSRRFGRTEIQIPVLSLGGMRFQQSWTDLGIKDIPISNQVNLEKILHEAVNNGLHHLETARHYGTSELQIGLSISNVNDPKRILQTKVPPRDDPKDFEQELELSFKRLQCKRVDLLAIHGINLPEHLEQTIRPGGCIDIVRRWQKKGLIGHVGFSTHGSNDLIVQAIETNEFDYVNLHWYFIYQDNSPALDAAAKLDLGVFIISPTDKGGHLHTPSSKLVELCAPLHPIAFNDLFCLTDKRVHTISVGAANPGNFERHIEALRLLNNSGELLSTIQERLLDASRSSLGDEWLSTWRVGLPRWDQTPGGINIPVLLWLHTLIESWEMEDFAKSRYRLLGKASHWFPGSNADCFDDDVSEDDLREVLLESPWCDEIPFLLRQLKTRLAGEPSQRLSSI

SEQ ID NO: 9367 - DNA, 1122 bp, Synechococcus elongatus PCC 6301
  CDS (1)..(1122): transl_table=11
atgcactatcgccaatatggtcggacggggcgattgatctcgcgcttttccctcggcttgatgcgctgtttggactctgccgcgcaattggaggctgtgcttgatgctgcgtggcggcttggcatcaaccactttgagacggcgcagtcctacggccccagcgaagcctatctggcgcaagccctgcattctctgcaattgccccgtgatcaagtcatcatcacgactaaaatcctgcccgatcgcgacccccagcagatggtagaagccgtgttgcgatcgcgtgatcgcttagggattgactcgatcgattgtcttgccctgcatggtctcaaccagcccgagcatttgcagcaggcgatcgctgcattaccggcgctccaaaccctgcaagcggaaggcgtctttcagcatttgggcttttccagtcacggcgatcgcgaattgattctggaggcgatcgctaccgatgcgtttgactttgtcagcctccattactacctgctgtttcaacgtcacgcgccggtcattgaagcagctgcagccaaaaatctaggaattttcatcatttcgcccgtcgataagggtggactcctgcaccaaccttctgcccaactgatcgaggactgtcagcccttcagtcctctggcactcaactatcgatttctgctcagcgatcgccggattacaaccctcagttttggtgctgcaaaggccgaggaattagcggttcttcaggacttcgttgatgcggatcagccgctgagtctggaggaagctgaggcgatcgcgcgactggaacaagttcgccagcagcggctgggcagggactactgtcagcagtgttatgcctgtttgccctgtcccgaggcgatcaacattcctgaggtactgcggctgcggaatctggcaatcgcccacgacatgcaagcctacggacgatatcgatatcgcatgtttgaaaatgccggacattggttcccggggcagcgaggcagccgctgcacggattgtggcgattgcctaccccgttgcccccatcacttgccgatcgcggatttggtgcgcgatgctgatcagcgattagcaggcgctcctcggcggcgtttgtggggagattag

SEQ ID NO: 9368 - protein, 373 aa, Synechococcus elongatus PCC 6301
MHYRQYGRTGRLISRFSLGLMRCLDSAAQLEAVLDAAWRLGINHFETAQSYGPSEAYLAQALHSLQLPRDQVIITTKILPDRDPQQMVEAVLRSRDRLGIDSIDCLALHGLNQPEHLQQAIAALPALQTLQAEGVFQHLGFSSHGDRELILEAIATDAFDFVSLHYYLLFQRHAPVIEAAAAKNLGIFIISPVDKGGLLHQPSAQLIEDCQPFSPLALNYRFLLSDRRITTLSFGAAKAEELAVLQDFVDADQPLSLEEAEAIARLEQVRQQRLGRDYCQQCYACLPCPEAINIPEVLRLRNLAIAHDMQAYGRYRYRMFENAGHWFPGQRGSRCTDCGDCLPRCPHHLPIADLVRDADQRLAGAPRRRLWGD

SEQ ID NO: 9369 - DNA, 1185 bp, Synechococcus elongatus PCC 6301
  CDS (1)..(1185): transl_table=11
atgcgctaccgacgctttggccgaaccgagcttgccatgcccgtgttttcctgtgggggcatgcgctaccagcagtcttggaaagatgtggactggccggagatctcggttgagagtcaagccaacctagaagcgactctggcgcgatcgctagagttgggcatcaatcatattgagacagcccgctattacggcagctcagaacggcagctcggtaaagccctagccgcctatccgcgatcggagattattctgcaaacgaaggtcccccccagcgaagatccggcggaatttctagagaccttcgatcgcagcatgagcttgctgcagactgattacgtcgacctgctgagcattcacggcgtcaataacgcagaactgctggattgggcgctgcgcaagggcggctctttagatgtggcggaacgactgcaagcagaaggacgggttcgccacatcggcttttcgacccatgcaccgctgccagtgatcctagaggcaatcgctagcgatcgccttagttatatcaatctgcactggtactacatcttccagaccaatcaagccgcgctagaagctgcccaaaaacacgacatgggtgtgttcatcatcagcccctctgataagggcggacacctctactcaccgccgcaaaaactggtcgatctctgcgagccactgcaccccatggtcttcaatgacctcttttgcctcagccagccccaaatccataccctcagcattggtgcggcgcggcccagtgattttgatcgccacttggaaaccttgcccttgcttgaccaagcggatcaggtattgccgccaatcttggagcgcctcgaagcagctgccactgctgcactggggcaagactggctggacacctggatggttggcttgcccacccctgacaccaccccgggggaaattaatatcccgacgattgtctggctttacaatcttgtgcaagctttcgacatggtcaaatacgccaaagctcgctacaacttgcttggtaatggtggccactggtttccggggcaaagggcaggacagtttgatccagttgcactctccgcagccctcgatcaaagccctcatcgcgatcgcattctccaaattctcaaggaaatggatgcttggttggggggtgagtctgtcgttcgactctcccaaagcagctga

SEQ ID NO: 9370 - protein, 394 aa, Synechococcus elongatus PCC 6301
MRYRRFGRTELAMPVFSCGGMRYQQSWKDVDWPEISVESQANLEATLARSLELGINHIETARYYGSSERQLGKALAAYPRSEIILQTKVPPSEDPAEFLETFDRSMSLLQTDYVDLLSIHGVNNAELLDWALRKGGSLDVAERLQAEGRVRHIGFSTHAPLPVILEAIASDRLSYINLHWYYIFQTNQAALEAAQKHDMGVFIISPSDKGGHLYSPPQKLVDLCEPLHPMVFNDLFCLSQPQIHTLSIGAARPSDFDRHLETLPLLDQADQVLPPILERLEAAATAALGQDWLDTWMVGLPTPDTTPGEINIPTIVWLYNLVQAFDMVKYAKARYNLLGNGGHWFPGQRAGQFDPVALSAALDQSPHRDRILQILKEMDAWLGGESVVRLSQSS

SEQ ID NO: 9371 - DNA, 1227 bp, Prochlorococcus marinus str. NATL2A
  CDS (1)..(1227): transl_table=11
gtgccaaaaaataaagatagtaaaaacaattcaattcctagaagaagatttgggcgaactgagattcagataccagtcttatctctgggagggatgcgctttcaacaaagctggaaggatttagatcctaaagagatcaataatcaacaacaagaaatcttgcaaaaaactattagctatgccgctcaaaaaggtatgcatcatatagaaactgctcgtcattatggaacatcagaacgccagataggctgggccttcgatcaaatcgatgacccaaaaagaatattacaaacgaaagtaccaccaaataatgatccttcgatattcgagcaagaacttgagttgagcatgagtagattaggttccaaaaaaattgatttattagctattcatggtatcaaccttcctgaacacttagatatgactattcgtcctaatggatgtctacaaattgttcgtcgttggcaaaaagatggtctcattggtcatgttggcttctcaactcatgcaaacgttgacctgataattaaaacaattgaaacaggtttttttgattatgttaatttgcattggtattttattcgtcaggaaaacgaaaaagctttgcaagcagcggatgctaatgatttgggggtttttattataagtcctactgataagggaggtcatttacatacaccgtcattaaaacttttagatttatgtagtcctttgcatccaatagaatttaacgatctgttttgtttgagggataaaagaattcatacattaagtgttggagcttccagtcctgaagatctggatattcatttaagtgcgatttctaaaatggacaccatgcatggggtaattaataccattgaaaagcgactaataaatgcctcgtataaatcgcttggagagtcatggttgactacttggaatataggtcttcctcgctgggaccaaactccaggagagataaatatacctactttattatggctaaacaatttattagaggcttgggatatggaaagctttgttaaagatcgttatggtcttttagggagagggggacattggtttccaggggcaaacgcagattgcttggattgtgaagtgagtgaggatgacttgaaaaaagttttgattaatagcccttggagctctgaaataccttctgtacttagaaaattgaaagatagattgggaggggaaagaagagatagattatgggggatttag

SEQ ID NO: 9372 - protein, 408 aa, Prochlorococcus marinus str. NATL2A
MPKNKDSKNNSIPRRRFGRTEIQIPVLSLGGMRFQQSWKDLDPKEINNQQQEILQKTISYAAQKGMHHIETARHYGTSERQIGWAFDQIDDPKRILQTKVPPNNDPSIFEQELELSMSRLGSKKIDLLAIHGINLPEHLDMTIRPNGCLQIVRRWQKDGLIGHVGFSTHANVDLIIKTIETGFFDYVNLHWYFIRQENEKALQAADANDLGVFIISPTDKGGHLHTPSLKLLDLCSPLHPIEFNDLFCLRDKRIHTLSVGASSPEDLDIHLSAISKMDTMHGVINTIEKRLINASYKSLGESWLTTWNIGLPRWDQTPGEINIPTLLWLNNLLEAWDMESFVKDRYGLLGRGGHWFPGANADCLDCEVSEDDLKKVLINSPWSSEIPSVLRKLKDRLGGERRDRLWGI

SEQ ID NO: 9373 - DNA, 1161 bp, Anabaena variabilis ATCC 29413
  CDS (1)..(1161): transl_table=11
atgcccacagggcttgactgcactcaaactatgctctaccgacgctttggcaaaactaatctgcacctctcggttttttctttagggacaatgcgctacttggctgatagcgaaaatgtgcagcaaactattgccacagctttagcgctaggaattaatcatatagaaacagccagaggttatggtaaaagtgaggagtattttggccaagcaatcaaagtcggtttatctgtagctcgttcccaactttacgtaactaccaaaattccaccaacatctgatgctgatagtatgcgtcggtacatcgatgaatccctagaacgattgaatttagattatctggattgtctaggaattcacggcttgaatacttgggaacatctggagtgggtacaagccaaaggtggctgtatgaaagctgtcgaggaagcgattaacgacggacgaattagacacgttggcttttctacccacggttcattagaggtaattcaagcagcaattaacacagatttttttgaattcgttaatctccactattactatttctttcaaagaaatgccccagctatcaaactagcatctgaaaaggatatgggcatttttattatctctccagccgataagggaggaaaactgtacacagcaccccaaaccctccaagatttgtgtcagcccctttcgcctctagaattaaactatagatttttactcagtgatcaacgaattactaccttgagtgtagggccagccactccagaggaattggtcgaacccttacaagtcgctgatagttgtggcgaactaacatcagcagaaattaccatttttcaacgcttacaaaatcatcaagagtcagttttagaaactgataagtgtagccaatgctatgcttgtttaccctgtccagaaaacatcaatattcctgaagttcttaggttacgaaatttggcagtggcatacaacatgacagattacggacaataccgttacggaatgtttgaaaatgccggtcactggttcccaggtatgaaagctaaccgttgtacagaatgcggtgattgtttacctcggtgtccagaaaagttagacattcctaatttattagaagatgcccacaatcgattaaatgggagagcagggagaaggttgtggggataa

SEQ ID NO: 9374 - protein, 386 aa, Anabaena variabilis ATCC 29413
MPTGLDCTQTMLYRRFGKTNLHLSVFSLGTMRYLADSENVQQTIATALALGINHIETARGYGKSEEYFGQAIKVGLSVARSQLYVTTKIPPTSDADSMRRYIDESLERLNLDYLDCLGIHGLNTWEHLEWVQAKGGCMKAVEEAINDGRIRHVGFSTHGSLEVIQAAINTDFFEFVNLHYYYFFQRNAPAIKLASEKDMGIFIISPADKGGKLYTAPQTLQDLCQPLSPLELNYRFLLSDQRITTLSVGPATPEELVEPLQVADSCGELTSAEITIFQRLQNHQESVLETDKCSQCYACLPCPENINIPEVLRLRNLAVAYNMTDYGQYRYGMFENAGHWFPGMKANRCTECGDCLPRCPEKLDIPNLLEDAHNRLNGRAGRRLWG

SEQ ID NO: 9375 - DNA, 1182 bp, Anabaena variabilis ATCC 29413
  CDS (1)..(1182): transl_table=11
atgctatacagaagatttggacgtacagaattacagatgccggtattttcttgcggcggcatgagataccagtataaatggcaagatgttagttactcggatattccggcggatcagcaagcaaatctggaagcaactattaatcgcgctgttgaggtggggatcaatcacattgaaactgcccgtggttatggtagttcggaaatgcagttggggaaaatattaccccaatttccccgcgaaaaattaattgtccaaaccaaacttgcccctgttgctgatgcgaaagagttccgcaaaacttttgagcaatcattgagttatcttcagttagactacgtagatttactaggattacatggaattaatactgctgaattattagaatatagtgtacgtcctgggggctgtttggatgtagtgcgacagttgcaggcagagggtaaagtccgatttgtcggcttttctactcacggttccacggatgtaattgtccaggcaattaataccaaccaatttgattatgtcaacctgcactggtattacatcaatcaatggaattggccagccattgaagcggctacccgtcatgatatgggggtatttattattagccccacagataagggaggtcggctttataatccgccgaaaaaattagtggatttatgcacccctttaagtccgatggtgtttaatgatttattttgtttgagtcattctcaagtgcataccttgagtttaggcgcagctaaaccccaagattttgatgaacacttgcagacattggacttaataaatcgggcatcagagattttaccgccaattttagcgaggttggaagatgcagcgatcgcctctttgggagaagattgggtaaaaacctgggaaaccaatttacctcaatgggaacaaacccccggacaagtaaatatccgggtgattttatggctgttaaatctagctactacctacgatttagtagactatgccaaaatgcggtacaacttattgggcaatgctagtcactggttccctggtaacaaagccgataaactcaacgaaatagacttgcagccatgcctcagatacagtccccacgctgataaaattccccaatttttagccaaggcgcatcaattattagcaggtgaagaattgcagcgtttatctcagagctaa

SEQ ID NO: 9376 - protein, 393 aa, Anabaena variabilis ATCC 29413
MLYRRFGRTELQMPVFSCGGMRYQYKWQDVSYSDIPADQQANLEATINRAVEVGINHIETARGYGSSEMQLGKILPQFPREKLIVQTKLAPVADAKEFRKTFEQSLSYLQLDYVDLLGLHGINTAELLEYSVRPGGCLDVVRQLQAEGKVRFVGFSTHGSTDVIVQAINTNQFDYVNLHWYYINQWNWPAIEAATRHDMGVFIISPTDKGGRLYNPPKKLVDLCTPLSPMVFNDLFCLSHSQVHTLSLGAAKPQDFDEHLQTLDLINRASEILPPILARLEDAAIASLGEDWVKTWETNLPQWEQTPGQVNIRVILWLLNLATTYDLVDYAKMRYNLLGNASHWFPGNKADKLNEIDLQPCLRYSPHADKIPQFLAKAHQLLAGEELQRLSQS

SEQ ID NO: 9377 - DNA, 1122 bp, Synechococcus sp. CC9605
  CDS (1)..(1122): transl_table=11
gtgaacacccgctccttcggcagcggccgccccgtcagcctgttcaccctcggcacgatgcgcgccctgaactcagcggcgcagatggccgaggtgctggatgcagcagcggaagctgggatcaatcatctggaaaccgccccggcctacggacctgcggaacgatttctgggagaggcccttcgccagaacagcagcacaggatcagacaactgggtgatcaccagcaaactgctgccagtgctgagtttcgaggagggacaacgccgccttgatcagattctggagcggctgggctgtccacagctcgacaacctcgccatccatggcatcaaccgggaggagcatctggactgggccctggggggcgatggatcaaagcttctggactgggccctcagcagtggccgtgtcagccaggtgggcttcagcagccatggcagcaacccgctgatcgatcgggcgctgcgcagccaacgcttcagtttctgcagcctgcacctgcattggctggatccccagcgcctgcccctggcccgttgggccctggaacacggcctcggtgtgatggcgatctcccctgccgacaaaggcggtcgcctgcaggctcccagccccacactgatggacgactgcaccccctttgtccccctcgagctggcctaccggttcctgctggcacagggcatcagcaccctgaccgttggtgccgcagttgcaggcgatcttcaactcgccgcaaccctggcgcaggcggatggccccctcagtcaggccgagcaacaggctctgatcacggcagaaaggcggcagcaggaacggctcggccaggagcattgcaaacagtgtcaggcctgcattccctgtccgaacgaggttccgatccccgaactcttgcgcctgcgcaatctggccatcgggcatgggctcaacgaatttgcacaggagcgctacaacctcatcggccgtgctggccactggtgggaagagcacgatgcctccgactgtgaacgctgtggggcgtgccttccccgttgcccgcatcacttgcccattcctgatctgttggcggacacccaccaacgcttgaaggcttcaccgcgacggcggctctggagctga

SEQ ID NO: 9378 - protein, 373 aa, Synechococcus sp. CC9605
MNTRSFGSGRPVSLFTLGTMRALNSAAQMAEVLDAAAEAGINHLETAPAYGPAERFLGEALRQNSSTGSDNWVITSKLLPVLSFEEGQRRLDQILERLGCPQLDNLAIHGINREEHLDWALGGDGSKLLDWALSSGRVSQVGFSSHGSNPLIDRALRSQRFSFCSLHLHWLDPQRLPLARWALEHGLGVMAISPADKGGRLQAPSPTLMDDCTPFVPLELAYRFLLAQGISTLTVGAAVAGDLQLAATLAQADGPLSQAEQQALITAERRQQERLGQEHCKQCQACIPCPNEVPIPELLRLRNLAIGHGLNEFAQERYNLIGRAGHWWEEHDASDCERCGACLPRCPHHLPIPDLLADTHQRLKASPRRRLWS

SEQ ID NO: 9379 - DNA, 1200 bp, Synechococcus sp. CC9605
  CDS (1)..(1200): transl_table=11
atggcgcttcccacccgccgattcggccgaacggagcttgagatccccctgttgtctcttgggggaatgcgctttcagcagagctggaccgaccttcctgctgatgagatcacgtctgcgtcgcagacccagcttgaggcgaccctgaagcgcgcggtggatctgggctttcaccacgtggaaacggcgcggcactacggcagctccgagcgtcagctgggttgggccctgccgcgcacacccgacccctcccgtctgctgcagagcaaggtgcctcctcggcccgatcccgacgccttcgaggcggaactggagctcagttttgagcggttgggctgtgatcgcctggatttactggccatccatggcatcaacctgccggagcatctcgagcagaccctgcaaccggggggctgcatggaggtggtgcgccgctggcaggcggagggtcgcattggtcacgtgggcttctccacccatggccccacagccttgatcgcagaggcctgcgactccggtgccttcgattatgtgaatctgcactggtattacatccgccaggacaacggccctgccttggatgcagcccttcgtcaggacatgggtgtgttcatcatcagtcccaccgacaaaggcggtcatctgcacacgccatcccaacgactcttggagctgtgtgcaccgctgcatcccatcgtcttcaatgacctgttctgtcttcaggatccgcgggtgcacaccatcagcgtgggagcggcccggccggaggatctcgagcttcacctggaggctttgcgcctgctgcaggatgcagcgtccttgattgctcctgtggatcagcggcttcggcaagcggccgatgaagcgctgggtcgcgactggatggccacctggtccgtcgggctgccgccttggcatgcgacgcccggtgagatcaacctccccgtcttgctttggttgtacaacctcctggaggcctgggatctcgagagttatgccaaggcccgctatgggttgttgggctccggcgggcactggtttgccggggccaatgccgatggctttgaggatgaggtcagcgtggaggatttgcagagcgtcttgcaggagagtccatggcgtgagcgcatcccggagatcctgcgcagcctcaagcagcggctcaagggcgaatcccagctgcgtttgtcgagtgtctga

SEQ ID NO: 9380 - protein, 399 aa, Synechococcus sp. CC9605
MALPTRRFGRTELEIPLLSLGGMRFQQSWTDLPADEITSASQTQLEATLKRAVDLGFHHVETARHYGSSERQLGWALPRTPDPSRLLQSKVPPRPDPDAFEAELELSFERLGCDRLDLLAIHGINLPEHLEQTLQPGGCMEVVRRWQAEGRIGHVGFSTHGPTALIAEACDSGAFDYVNLHWYYIRQDNGPALDAALRQDMGVFIISPTDKGGHLHTPSQRLLELCAPLHPIVFNDLFCLQDPRVHTISVGAARPEDLELHLEALRLLQDAASLIAPVDQRLRQAADEALGRDWMATWSVGLPPWHATPGEINLPVLLWLYNLLEAWDLESYAKARYGLLGSGGHWFAGANADGFEDEVSVEDLQSVLQESPWRERIPEILRSLKQRLKGESQLRLSSV

SEQ ID NO: 9381 - DNA, 1143 bp, Prochlorococcus marinus str. MIT 9312
  CDS (1)..(1143): transl_table=11
atgattattaattcacagaaaagatcatttggtaaaggggcaaaagtgagcttattcactttagggacaatgcgcgcaactgaaagtgtcgaaaaaatgtatagcataataaaaaatgcatactatgtcggaattaaccacatcgaaacagctccttcttatggtgattcagaattacttgttggaaattcaataaaaaaactagcaatagaagagaacatatctgaaaaaaattgggtgattactaccaaagttttaccaaagggtgattttgaatttctaaaaaataattttcaaaattctcttaagaagttaaatcttaagaaaattaataatcttgcagttcatggaataaacttaaaacaacatctagattgggttctggctggagagggtaagaaattcatatcatggatacttgagaaggaactagttgaacaagttggttttagttctcacggaagttattcacttattaatgaagcaattaacagtgaagtttttagtttttgtagtcttcatttacattatttagatcaatctaaaattactttggcggagcaagctataaaaaaaggtatgggagtaatagcaatatcgcctgctgataaaggcggaagattatattctccaagtgatattttgttagaagcctctaagccttttcatccattagaattagcatatagatttttgttggcaaaagggattacaactttgtccttgggagcaacaaataaaaaggattttgagtttgcgaataaacttagaaactcttgcgagaggcttacaatacttgaaaaaagcgccctaaataaaattgaggaagtagctaatgaaagattaaactcaacaaaatgtgagcaatgcagatgctgtctaccatgcccaaatgaaatacctattccagagatacttcgtttaaggaatatatctattggttatggccaattagaattttcaaaagaaagatacaatttaataggaaaagcaggccactggtgggaagagaaaaattcctcattttgtcaagaatgcaatgaatgtgttcctaaatgtcctagtaaattagatataccaaatttattaaaacaaactcataacttattaattgaaactccaagaaaaagattatggggttaa

SEQ ID NO: 9382 - protein, 380 aa, Prochlorococcus marinus str. MIT 9312
MIINSQKRSFGKGAKVSLFTLGTMRATESVEKMYSIIKNAYYVGINHIETAPSYGDSELLVGNSIKKLAIEENISEKNWVITTKVLPKGDFEFLKNNFQNSLKKLNLKKINNLAVHGINLKQHLDWVLAGEGKKFISWILEKELVEQVGFSSHGSYSLINEAINSEVFSFCSLHLHYLDQSKITLAEQAIKKGMGVIAISPADKGGRLYSPSDILLEASKPFHPLELAYRFLLAKGITTLSLGATNKKDFEFANKLRNSCERLTILEKSALNKIEEVANERLNSTKCEQCRCCLPCPNEIPIPEILRLRNISIGYGQLEFSKERYNLIGKAGHWWEEKNSSFCQECNECVPKCPSKLDIPNLLKQTHNLLIETPRKRLWG

SEQ ID NO: 9383 - DNA, 1194 bp, Prochlorococcus marinus str. MIT 9312
  CDS (1)..(1194): transl_table=11
atggaatatcgtagatttggtcgaaccaatctgaagatgcctattttatctttgggtggtatgagatttcaaaaaagttgggatcaattagatttttctgagatttcatatgaagaacaaaataaagtagaaaatatattaaacatggcaaacaaatatggcttacatcatatagaaactgctaagtattatggaacttctgaggtgcaattaggaataggttttcaaaatactaaaaaaatcccaaacattattcaaacaaagattcctccaaatagtgatccagaaatttttgagagagatgttatgacaagtatggaaaaattgaaagttaaaagaattgatttgctagcaatacatggcattaatacagatcaacatttacatcaggctgttaaagatggaggttgtattgacattttaaggaatttgcaaaaagaaaatttaattggatctattggattttcgtcccatggaaaatcttcacttattgagaaggctatatcaacaaacttatttgattatgtaaatttgcactggtatttcatcaatcaagaaaatacaaaggctataaatttagcaaataagtatgatcttggggttttcataataagtcccacggataaagggggacatcttcatactccttcaataaaaatgttggaattttgtaagccacttcatcctatagttttcaatgatcttttttgcttaagaaataaaaacgtccacactcttagtgtcggtattgcaaaagaggcagattttgatcttcatttagaagctgtctcgttgctatcagaatctgagaagtatgttccaaagataataaaaagattaagacaggaatcaattagtgctttaggcttagagtggtatcaaaattggaatagaaatttaccgagttgggaatatacgccaggaaatattaatattcccgttttgctttggctttcaaatttaatagattcgttggatatggaaggatttgcaagggctagatatcaattgctaggtaatggaagtcattggttcccaggatgtaacgccaatttaatagatgtggatgttgctgaaggtcaattattaaaagttttagaaggccatataaatccaaaaaaagttataaataaattgagaaccttaaaagaaaagtttggagatcaagttgctaaaagattatcaaaaaaataa

SEQ ID NO: 9384 - protein, 397 aa, Prochlorococcus marinus str. MIT 9312
MEYRRFGRTNLKMPILSLGGMRFQKSWDQLDFSEISYEEQNKVENILNMANKYGLHHIETAKYYGTSEVQLGIGFQNTKKIPNIIQTKIPPNSDPEIFERDVMTSMEKLKVKRIDLLAIHGINTDQHLHQAVKDGGCIDILRNLQKENLIGSIGFSSHGKSSLIEKAISTNLFDYVNLHWYFINQENTKAINLANKYDLGVFIISPTDKGGHLHTPSIKMLEFCKPLHPIVFNDLFCLRNKNVHTLSVGIAKEADFDLHLEAVSLLSESEKYVPKIIKRLRQESISALGLEWYQNWNRNLPSWEYTPGNINIPVLLWLSNLIDSLDMEGFARARYQLLGNGSHWFPGCNANLIDVDVAEGQLLKVLEGHINPKKVINKLRTLKEKFGDQVAKRLSKK

SEQ ID NO: 9385 - DNA, 1116 bp, Trichodesmium erythraeum IMS101
  CDS (1)..(1116): transl_table=11
gtgtattaccgcaggtttggcaaaactaatttcaatctctcagtattttccttgggtactatgcgatatttggtatctcaggaaaatgctattcaaacaatacaacaagctgtgaaaatgggaattaatcatatagaaacagctaggggttatggtcaaagtgaaaagtatctgggcacagccttggcctctgggttgcggcgtgatcaactttatataacaacgaaaattacgccgacacaagatgtcagtctgatagaaagttccatagatgaatcattgaaaaatctcaatattgactatttagactttctagctattcatggcattaatacctggaaacatttagaaactactctttatgggataagagcccttcataaagtaattagtgatgggcgagtccgacatattggcttttcaactcatgggcctttagaggtaattttagcaaccattaatacagatttttttgaatttattaatttacattactactactttttccaacgtcatgctcctgcagtcgagttagcccaccagaaagatatgggcatttttattatttctccaggagataaaggtggacaattatatacaccacctcctaatcttcagaagttgtgtcagccttttctgccactggaattaaattatcgttttttattaagtgatcctagaattacaactttgagcttgggtgctgctaggccacaagaattagaatggcctttgactatgagcgatcgcatagaacctctaagctctcaggaaacagaaatatttcagcgtttagaaaaccaagctttaaagcgcttgggaacggaaaaatgtagccaatgttatgcttgtttaccttgtccagaagatattcagattccagaaattctaagattaaggaatttggggatagcttatgatatgatagattttgctaaatatcgatacggaatgtttgaaaatgctggtcattggtttcctggtaagaaaggtaaccgatgtactgagtgtggtgagtgtttacctagatgtccggaaaaattggatataccaaatttgttgaaagatacccatgaaaggtttaagggtgtatctggtcgtcgattgtgggaataa

SEQ ID NO: 9386 - protein, 371 aa, Trichodesmium erythraeum IMS101
MYYRRFGKTNFNLSVFSLGTMRYLVSQENAIQTIQQAVKMGINHIETARGYGQSEKYLGTALASGLRRDQLYITTKITPTQDVSLIESSIDESLKNLNIDYLDFLAIHGINTWKHLETTLYGIRALHKVISDGRVRHIGFSTHGPLEVILATINTDFFEFINLHYYYFFQRHAPAVELAHQKDMGIFIISPGDKGGQLYTPPPNLQKLCQPFLPLELNYRFLLSDPRITTLSLGAARPQELEWPLTMSDRIEPLSSQETEIFQRLENQALKRLGTEKCSQCYACLPCPEDIQIPEILRLRNLGIAYDMIDFAKYRYGMFENAGHWFPGKKGNRCTECGECLPRCPEKLDIPNLLKDTHERFKGVSGRRLWE

SEQ ID NO: 9387 - DNA, 1185 bp, Trichodesmium erythraeum IMS101
  CDS (1)..(1185): transl_table=11
atgatgcaatatcgacgctttgggcgcacagaattatcaataccagtgttttcctgtggcggaatgaggtataaatataaatggcaagatgttcctaaaaatgaaatcccacttaataatcaacaaaacttagaaaatacaatccgtcgctctctagaatgtgggattaaccacatagaaacggcccgtaattatggcacatctgaaatgcaactgggagaaattttacctcaactaccacgggaaaaattgattatccaaacaaaaattagcccaagcgttgactcccaagaattcaaatccaagtttgatcagtctctccattttttacaactagaatatgttgacttgctggccatacatgggattaacacgttagaacgtcttgactattctattagaccaggaggttgtttagatatagttagaaaattacaagagcagggaaaagtcaggtttgttggtttctctactcatgggccaactgatgtaataattaaaactatagaaaccaatcaatttgactatgttaacctacactggtactacattaatcaggagaattggtccgcaatagaggttgctaataagtttgatctgggagtatttattattagtccttctgataagggtggtaaattgtatcaaccgccacaaaaattaatagatttgtgctatccattaagcccaatggtgtttaataatctattttgtttgagtcatccccaagttcatacattgagtttgggagcttcaaaaccaacagattttgatgagcacttaaaaacattggaatttttagagaaaccagatgagatattacaaccaatattaaatagtctagaaaaagaagcgatcgctaaactaggagaaaattggtaccaaacttggcatattggtttgcctactccagaaaatactccaggaaatattaatattcctgtgattttatggttaagaaatttagcgatcgcctacgatatgtgggaatatgctaaagtacgctataacttattgggcaatggtagtcattggtttcctggtgcaaatgctgaacaagtagaaaaatataacttgagtaaatttcttgtgaatagtcctcatgctgataaaattccagatattcttcaagatgctcatcaattactggtagggactccagtagaacttttgtctagcacttaa

SEQ ID NO: 9388 - protein, 394 aa, Trichodesmium erythraeum IMS101
MMQYRRFGRTELSIPVFSCGGMRYKYKWQDVPKNEIPLNNQQNLENTIRRSLECGINHIETARNYGTSEMQLGEILPQLPREKLIIQTKISPSVDSQEFKSKFDQSLHFLQLEYVDLLAIHGINTLERLDYSIRPGGCLDIVRKLQEQGKVRFVGFSTHGPTDVIIKTIETNQFDYVNLHWYYINQENWSAIEVANKFDLGVFIISPSDKGGKLYQPPQKLIDLCYPLSPMVFNNLFCLSHPQVHTLSLGASKPTDFDEHLKTLEFLEKPDEILQPILNSLEKEAIAKLGENWYQTWHIGLPTPENTPGNINIPVILWLRNLAIAYDMWEYAKVRYNLLGNGSHWFPGANAEQVEKYNLSKFLVNSPHADKIPDILQDAHQLLVGTPVELLSST

SEQ ID NO: 9389 - DNA, 1128 bp, Synechococcus sp. CC9311
  CDS (1)..(1128): transl_table=11
gtgcgtcgtgcctttggcaagggtcccgcggtgagcttgttcaccctgggcacgatgcgtgcgttgaaagaccgcgagcaaatggttgccgtagtacgagcagcccatgctgctgggatcaatcacctcgagacggcacccgcctatggccctgctgaagtctttttggggcaggctttggatcagctggagcaacaaggaattgcccctgagggggggtggttaatcacgagcaaactccttccaagcctgtcttttgaacaagggcaacgcgccttgtcggcatgccttgaacggttgggacgtccctttttgcatggcctggcggtccatggtctgaatcgtgcggaacacctgcattgggcgatcgacggggaaggagccaggctcttggaatgggccctgagatctgggcttgtgggtcaggttggtttcagcagccatggctccaattcattgatcgcgcgggcgatctcaagtggtcgctttcagttctgcagcctccatctccatctcttggatccagcacggctccccttggcattggaagcgctggctggaggaatgggcgttatggcgatctcccctgcagataagggtggacgcttgcaagcaccaagctcattgctacaggcagattgccagccatgggaacccttagctctggcttaccgctacctgttagctgctgggataagcaccctgacggtcggggccaacagcccggccgatctcaaccttgccgcctccatggccagcagcgatggggcgctcacccttgcagaacagaccgctttgacacgcttggaacttttgcgtcaacagcggctcggggaaacgctttgccaacaatgcagagcctgtcttccctgtccgcaggaggttcctatccctgagctgctgcgactgcgcaaccttcgactcgctcatgacctcaaggagttcacagaagagcgttacaacttgattgggcgcgctggccactggtgggaggaggtcaatgccgaaggctgtgagacctgtggggattgccttccacgatgtccccatcaactggcgattcctgatttgttggcggagacccatcagcttttggctgcggcccctcgacgacgtttatggggctga

SEQ ID NO: 9390 - protein, 375 aa, Synechococcus sp. CC9311
MRRAFGKGPAVSLFTLGTMRALKDREQMVAVVRAAHAAGINHLETAPAYGPAEVFLGQALDQLEQQGIAPEGGWLITSKLLPSLSFEQGQRALSACLERLGRPFLHGLAVHGLNRAEHLHWAIDGEGARLLEWALRSGLVGQVGFSSHGSNSLIARAISSGRFQFCSLHLHLLDPARLPLALEALAGGMGVMAISPADKGGRLQAPSSLLQADCQPWEPLALAYRYLLAAGISTLTVGANSPADLNLAASMASSDGALTLAEQTALTRLELLRQQRLGETLCQQCRACLPCPQEVPIPELLRLRNLRLAHDLKEFTEERYNLIGRAGHWWEEVNAEGCETCGDCLPRCPHQLAIPDLLAETHQLLAAAPRRRLWG

SEQ ID NO: 9391 - DNA, 1194 bp, Synechococcus sp. CC9311
  CDS (1)..(1194): transl_table=11
ttgccaacacggcgttttggtcggacagaacttgctatgcccgttctatcgcttgggggcatgaggtttcagcaaagctggtcagaccttgaggctgacctgattactcaggaggctcaacgcacggtggcagacactctgcagagggcagtggagcttgggtttcatcatctggaaacggcccggcattacggcagctccgagcggcaacttggttgggccctcccccattctcctgatcccaatcgcattgttcaaaccaaagtgccgccccgggacgaccctgcggagtttgaagctgagctcgaactcagcctcgagcgcttaaacgttcagcgaatcgagttgctagcgatccatggaatcaacaggctggatcatctagagcaaacggtgcgaccaggggggtgtatggaggtggttcggcgttggcagcgagagggtcgtatcgatcatgtgggcttttcgacgcatgctgaaaccagcgtcatcgaagctgcgatcaagaccgatgccttcgattatgtgaacttgcattggtactacatccggcaagacaacgaaccagctcttattgcagcccaacgccatgacatgggcgtgttcatcattagtcccaccgataaaggtggccatcttcataccccttcgctgctgttgaagcagctctgcgctccccttcacccgatcgtgtttaacgatctgttttgcctgcaagattcacgggttcacaccatcagtgttggtgcatccagaccgagtgatctcgatcttcatcttgaggctgttgggcaacttgatcaagcggaatcgctcattgctccgattcaagatcggttgcaggcgcaagcgcgcaaggccctgggtgagccttggttgatgacctggcgtgaagggttgccccattggcaagacacgccagggggcctcaatcttcctgtgttgctctggcttcacaatctggttgaggcttgggatttagagggttatgccagggcgcgttatggaattcttggtcatgcaggacattgggccccaggtgccaatgctgatgccttggaccaggaggtcagcgagaaagacctccgcgctgttttgaaccaaagcccttgggctgacacgattccaggattgctgagggggttaaaggaacgggttggtggtgtccctcaggaacgcttgtcgtctgcctga

SEQ ID NO: 9392 - protein, 397 aa, Synechococcus sp. CC9311
MPTRRFGRTELAMPVLSLGGMRFQQSWSDLEADLITQEAQRTVADTLQRAVELGFHHLETARHYGSSERQLGWALPHSPDPNRIVQTKVPPRDDPAEFEAELELSLERLNVQRIELLAIHGINRLDHLEQTVRPGGCMEVVRRWQREGRIDHVGFSTHAETSVIEAAIKTDAFDYVNLHWYYIRQDNEPALIAAQRHDMGVFIISPTDKGGHLHTPSLLLKQLCAPLHPIVFNDLFCLQDSRVHTISVGASRPSDLDLHLEAVGQLDQAESLIAPIQDRLQAQARKALGEPWLMTWREGLPHWQDTPGGLNLPVLLWLHNLVEAWDLEGYARARYGILGHAGHWAPGANADALDQEVSEKDLRAVLNQSPWADTIPGLLRGLKERVGGVPQERLSSA

SEQ ID NO: 9393 - DNA, 1152 bp, Magnetococcus sp. MC-1
  CDS (1)..(1152): transl_table=11
atggaatatcgtcgatttgggcaaacagaaaaacagatttcggtctttaccatgggcggtatgcggtttttgcatgtctgggataaaccccatgaccagctaccggcggatagcgaggagcactgctatcagatgctgcaaaccgccctggatgggggtattaacctcattgaaaccgcaaaaggttatggcaagagtgagcgtcttatcggtcgggcgctgcccaggttgcggcaaagccgggaccaataccaccttatgaccaaagccagccccaccgaaaccgctggccaaatgcgccgccacgtggaagacgcgcttcgccatatgggggtggatcacattgatttttttgccctacacggtattaatacccgcccgttattgagattaagcctgcgctctggtggccccatgtcggcattggaggcgctgcaacgggagggcaaaattggccatatcggttttgccacccatgccccgctaccggtgattttggataccatccaatcgggccgatttgcctttatcaatctccactactatttttttcggcagggcaatcgaacggccattgaggccgctgcggcgcgggatatgggcatttttattatctccccccaagataaagggggactactctacaccccaccgccacgcttggccgaacagagcgcacccctgcccattgccaactttaatgagcgctggattctctctcatccggccattcacaccatgaccgtgggcatgagtgagccaagccacttggatttgcatctgcactctttggcgctgggtaaaccctattggggggcggctgaacgggccgtggagattcgtttaaaacaggctgcggccaccacagagctagatcgctgcggccattgcaccgcctgtttgccctgcccagaacgcattgagatacccgatttactgcgcttagagcatctggcccgcgcccatgatatggtcgcctttgcacaatatcggtatggtttgatggagcctaactgccactgggtacccggtgcccatggggatcggtgtagcgattgcggcgactgtctaccacgctgtccgcaagggttggatattccgctactggtgcgccaagcccataccagaatgcataaggccagcgggagctaa

SEQ ID NO: 9394 - protein, 383 aa, Magnetococcus sp. MC-1
MEYRRFGQTEKQISVFTMGGMRFLHVWDKPHDQLPADSEEHCYQMLQTALDGGINLIETAKGYGKSERLIGRALPRLRQSRDQYHLMTKASPTETAGQMRRHVEDALRHMGVDHIDFFALHGINTRPLLRLSLRSGGPMSALEALQREGKIGHIGFATHAPLPVILDTIQSGRFAFINLHYYFFRQGNRTAIEAAAARDMGIFIISPQDKGGLLYTPPPRLAEQSAPLPIANFNERWILSHPAIHTMTVGMSEPSHLDLHLHSLALGKPYWGAAERAVEIRLKQAAATTELDRCGHCTACLPCPERIEIPDLLRLEHLARAHDMVAFAQYRYGLMEPNCHWVPGAHGDRCSDCGDCLPRCPQGLDIPLLVRQAHTRMHKASGS

SEQ ID NO: 9395 - DNA, 1131 bp, Nostoc punctiforme PCC 73102
  CDS (1)..(1131): transl_table=11
atgcaataccgacgctttgggaaaacgaatctgcacctctcggttttctctctgggaacaatgcgctacctggcttcttttgaaaatgctcaccagatcattgaacaagccttagcgctaggaattaatcatctagaaaccgccagaggttacggcaaaagcgaggagtatcttggtagggcattaaaagctgggttgtcaataccccgaacgaagctttacatcactaccaaaatctcagccacagcagatgctgacaccatgcgtcggtacatcgacgaatctctagagcgattacagctagattatttagattgcttaggggttcatggcttgaacacttggcaacatttggagtgggtgcaagccaaaaatggctgtatgaaagccgtagaggaagctgttgctgatggtcgagtgcgacacgttggtttttccagccacgggtcattagagctaattcaggcagctatcaaaacaaatttttttgagtttgtcaatctgcattattactatttttttcaacggcacgcaccagcaattcaactagctgccgaaaaggacatgggcattttcattatttcccctgctgacaaagggggaaagctgtatacgccaccccaaaccctaaaagatttgtgtcacccgtattcccccttagaactaagctatcgttttttacttggtgacaaccgtattaatactttaagtatagggccagccaacccagatgaattaatagaacctttgcaagttgctgaccatgatggagagctaaaatcagcagaaatttctgctttccagaggttagaaaatcaccaaaaacttgctttgggaactgataaatgtagccaatgttatgcttgtttgccctgtccagaaaatatcaatattccagaggtattgcggttacgtaatctcgtagtggcatacgacatgaaagactatggacaatatcgttacggaatgcttgaaaatgctggtcactggttccctggaatgaaaagcgatcgctgtacagaatgcggagactgtttacctcggtgtccagaaaagttagatattccagaattattggaagatactcaccaaaaattaaatgggaaagcaggtcggaggttgtggggataa

SEQ ID NO: 9396 - protein, 376 aa, Nostoc punctiforme PCC 73102
MQYRRFGKTNLHLSVFSLGTMRYLASFENAHQIIEQALALGINHLETARGYGKSEEYLGRALKAGLSIPRTKLYITTKISATADADTMRRYIDESLERLQLDYLDCLGVHGLNTWQHLEWVQAKNGCMKAVEEAVADGRVRHVGFSSHGSLELIQAAIKTNFFEFVNLHYYYFFQRHAPAIQLAAEKDMGIFIISPADKGGKLYTPPQTLKDLCHPYSPLELSYRFLLGDNRINTLSIGPANPDELIEPLQVADHDGELKSAEISAFQRLENHQKLALGTDKCSQCYACLPCPENINIPEVLRLRNLVVAYDMKDYGQYRYGMLENAGHWFPGMKSDRCTECGDCLPRCPEKLDIPELLEDTHQKLNGKAGRRLWG

SEQ ID NO: 9397 - DNA, 1182 bp, Nostoc punctiforme PCC 73102
  CDS (1)..(1182): transl_table=11
atgctatatagacgatttggacgcacagaattacagatgccagtgttttcctgcggtggcatgagatatcagtttaagtggcaggatgtccccaataatgagattcctgctgatagccaggcgaatctggaagcgacgattagaaggtcagtcgaggttgggattaatcatattgaaactgctcgtggttatggcacttccgaaatgcaattgggaagagttctaccccagtttccccgtgaaaagttgattgttcagaccaaaatcagcccgcaggaagatgcgaaagaattccgcgagacatttgaacaatcattgaaaaatctccagctagattatgtcgatctactgggattgcacggtattaaccatgctgagtcattagactatagcatccgtcccggtggttgtttggaagtagcacagcagttgcaagcagaaggaaaagttagatttattggcttttccacacacggatcaacagatacaattgtgcagacaattaataccaatctatttgattacgtgaacctgcactggtactacatcaatcaatggaattgggcggcaattgaagcagctaaacgccacgatatgggggtgtttatcattagtccatctaataaaggaggtttgttgtatgaacctccgcaaaaattagtgaatctttgcgctcctttgagtccaatggtgtttaatgatttgttttgtttgagtcatcaagaggtgcatactctgagtgtgggagcagcaaaaccacaagattttgacgaacatctgaagactttagaattagtagatcgagcatcagaaattttgccgccaattttagcaaggttggaagaagaagcgatcgctactttgggagaagattgggtaaaatcctgggaaacaaatctaccaacctttgaccaaacccctggtgaggtcaacattcgggtgattttatggctgcggaatttagcgatcgcctaccatttggtagattatgccaaaatgcgctataacctgcttggtaatggcggtcactggtttcctggtaataaagccgatcggttagacgaattaaacttgcagcaatgtcttgcccgcaatccctatgccgataaaatcccccaatttctggagcaagcgcatcaaatgttggcaggtgaagcggtcaaacgtctatctaaaacttaa

SEQ ID NO: 9398 - protein, 393 aa, Nostoc punctiforme PCC 73102
MLYRRFGRTELQMPVFSCGGMRYQFKWQDVPNNEIPADSQANLEATIRRSVEVGINHIETARGYGTSEMQLGRVLPQFPREKLIVQTKISPQEDAKEFRETFEQSLKNLQLDYVDLLGLHGINHAESLDYSIRPGGCLEVAQQLQAEGKVRFIGFSTHGSTDTIVQTINTNLFDYVNLHWYYINQWNWAAIEAAKRHDMGVFIISPSNKGGLLYEPPQKLVNLCAPLSPMVFNDLFCLSHQEVHTLSVGAAKPQDFDEHLKTLELVDRASEILPPILARLEEEAIATLGEDWVKSWETNLPTFDQTPGEVNIRVILWLRNLAIAYHLVDYAKMRYNLLGNGGHWFPGNKADRLDELNLQQCLARNPYADKIPQFLEQAHQMLAGEAVKRLSKT

SEQ ID NO: 9399 - DNA, 1182 bp, Crocosphaera watsonii WH 8501
  CDS (1)..(1182): transl_table=11
atgaaatatcgaagatttggccgtacagaattagaaatgcctgttttttcctgtggaggaatgcgttatcaacataagtggcaagatgttccggaagatgaaattcctgaagagaatcaacgtaacttagaagccacaattaaacgttctttagaagttggtatcaatcatattgaaaccgctcgaggttacgggacatcggaaatgcagctagggaaggtcttgcctaaaattcccagagaaaagttaattgttcaaaccaaggtttctcctaaagaagaccctaaagaatttcgtctacaatttaatcagtctttgaattttttgcaactagattatgttgatctattgggattacacgggattaatactgacgaaattttagactattgtattcgacctgggggttgtttagacgaagctagaaaattacaagaacagggtaaagttcgttttattggcttttcaacccacggacctactgatgtcatcaaaaaaactatagaaaccgattgttttgactatgtgaatctccattggtactatatcaatcaagctaattggccagctatagaagcagcgaagaaacatgacatgggggtgtttattattagtccttccgataaaggaggaaaactttatgaacctcctgaaaaattggttgaattatgtcaacctttgagtccgatggtgtttaacaatctcttctgtttatcccacccagaagttcatactctcagtttaggggcagcccgtccaacagattttgatgaacatttaaagaccctttctttgttagatgatcctcaacccatactaaagcctattataactagattagaagaagaagctatcaaaattttaggagaaaattgggttcaaacttggaagcagggattaccaaaacatcaggaaacacctggaaatattaatataaaaaccattttatggctgagaaatttagccttagcttatgatatgattgagtatagtaagatgagatatagtctattaggaaatggaggacattggttccctggtaaaaaagcagaaaatgtcaatgaattagacttatctaaatatttagttaatagtcctcacagagagaaaatacctaatttgttagcggaagctgatagtttattggggggacaatctgtacaaagattatcccaaagttaa

SEQ ID NO: 9400 - protein, 393 aa, Crocosphaera watsonii WH 8501
MKYRRFGRTELEMPVFSCGGMRYQHKWQDVPEDEIPEENQRNLEATIKRSLEVGINHIETARGYGTSEMQLGKVLPKIPREKLIVQTKVSPKEDPKEFRLQFNQSLNFLQLDYVDLLGLHGINTDEILDYCIRPGGCLDEARKLQEQGKVRFIGFSTHGPTDVIKKTIETDCFDYVNLHWYYINQANWPAIEAAKKHDMGVFIISPSDKGGKLYEPPEKLVELCQPLSPMVFNNLFCLSHPEVHTLSLGAARPTDFDEHLKTLSLLDDPQPILKPIITRLEEEAIKILGENWVQTWKQGLPKHQETPGNINIKTILWLRNLALAYDMIEYSKMRYSLLGNGGHWFPGKKAENVNELDLSKYLVNSPHREKIPNLLAEADSLLGGQSVQRLSQS

SEQ ID NO: 9401 - DNA, 1131 bp, Crocosphaera watsonii WH 8501
  CDS (1)..(1131): transl_table=11
atgcaatatcggcgttttgggaaaacaaatttgaatttgtctattttttctctgggaaccatgcgctgtttagcttcagaaacggtttttaacgaaactttggaaagggctatttctctggggataaatcatctagaaactgcgagaggatatggaaaaagtgaagagtttttgggtcgttttttacaacaacaaggattagttgctcgagagaaaatttatataaccacaaagttgaccccaaaccctgatgctgaaaaaatgagtcggtggattgatgaatctttacaaaagttacagttaaattatatcgattgtctagctattcatggtgtcaatacttgggagcatctggaatggatcacaaagcccaatggctgttttttgcccctacaaagggctttagatgaaggtaagataaatcacctcggtttctcaactcacggtagtctagaggtcattttagccgccatggagacggggttatttgagtttgttaaccttcattattactatttttggcggcgcaatgccccggcgatcgccttagcttctcaaaaggacatgggcattttcattatttctcctggggacaaaggaggcttactctacacaccctctgctttactcacagacttatgtgcgcctttttcacccctggctttaacctatcgcttcttgttgagcgatgaccgcgttacaaccttaagcactggggcatcgcatcctaaggagttcaaatctattttatcactttttgagcaaaatgacaaattaagccccgaagaaagtcagaaattaaaggaactagaggagcatttaaacagggttttaaataccgataaatgtagtcaatgttatcaatgtttaccttgtcctgaaaccattaatatccctgaaattttgcgcttaagaaacctaactattgcttatgatctgaaaaactatggacaatatcgttatggaatgttagaaaatgccggacattggttccctggtaacaaaggacatcgttgtacagaatgtggtgaatgtttaccccgttgtcctgaaaatttagatatccccaagttattaaaagatgctcacactagattgaaagggacttctcgaagacgcttatgggaatga

SEQ ID NO: 9402 - protein, 376 aa, Crocosphaera watsonii WH 8501
MQYRRFGKTNLNLSIFSLGTMRCLASETVFNETLERAISLGINHLETARGYGKSEEFLGRFLQQQGLVAREKIYITTKLTPNPDAEKMSRWIDESLQKLQLNYIDCLAIHGVNTWEHLEWITKPNGCFLPLQRALDEGKINHLGFSTHGSLEVILAAMETGLFEFVNLHYYYFWRRNAPAIALASQKDMGIFIISPGDKGGLLYTPSALLTDLCAPFSPLALTYRFLLSDDRVTTLSTGASHPKEFKSILSLFEQNDKLSPEESQKLKELEEHLNRVLNTDKCSQCYQCLPCPETINIPEILRLRNLTIAYDLKNYGQYRYGMLENAGHWFPGNKGHRCTECGECLPRCPENLDIPKLLKDAHTRLKGTSRRRLWE

SEQ ID NO: 9403 - DNA, 1137 bp, Synechococcus sp. RS9917
  CDS (1)..(1137): transl_table=11
gtgacggcccagcgtcggcccttcggccggggaccggccgtgagcctgttcacgctcggcacgatgcgggccctggcctcccaggcacagatggatgcggtggtgcgggccgcactcgatgccggcatcaaccatctggagacggccccggcctatggcccggcggaaaccttcctgggcgctgccctcgccaggctcgaacggcaggacctgaggcctgacggggggtgggtggtcaccagcaagatcctgccgggggtgagcttcagcgaggggcgctcccagctgcaggcgagcctgaagcgcctgggattgcaccatcttccaaacctggcggttcacggcatcaatcggcaggagcacctgctgtgggcccaggacggtgaagggcgacaactgctccaatgggcacgcgactccggcctggtggggcaggtgggattcagcagccatgggtcccatgccctgattgccgaggcgatcgccagcgggctgttcgagttctgcaatctgcacctgcatctgctcgatcccagccgcatggggctggccaacgacgccctggcgcgaggcatgggcgtgctggcgatctccccggctgacaagggagggcggctgtgggacccgagcccaacgctctgcgaggactgcgctccattcccaccgctgacactcgcctatcgctatctgctggcggccggcatttccaccctgaccgtcggcgccagccaaccgcaggacctggacctcgcccatcgacttgccgaagccagcggcgccctcagcccggcggagcgcagcgccctggcccgcctggagcaacggcggcggcagcgactcgggcgggagcactgcggccagtgccgctcctgcctgccctgccccaaccaggtgccgatcccggagctgctgcgcctgcgcaatcttcgcctcggccacgacctgcaggccttcaccgaggagcgctacaacctgatcggtcgagccgggcactggtgggagcagcgcgatgccagcgcctgccaaggctgtggcgactgcctgccccgctgcccccatgacctgccgatccccgagctgctggccgagacccatcgcctgctggcagcgcgcccccggcgccgactgtgggggtga

SEQ ID NO: 9404 - protein, 378 aa, Synechococcus sp. RS9917
MTAQRRPFGRGPAVSLFTLGTMRALASQAQMDAVVRAALDAGINHLETAPAYGPAETFLGAALARLERQDLRPDGGWVVTSKILPGVSFSEGRSQLQASLKRLGLHHLPNLAVHGINRQEHLLWAQDGEGRQLLQWARDSGLVGQVGFSSHGSHALIAEAIASGLFEFCNLHLHLLDPSRMGLANDALARGMGVLAISPADKGGRLWDPSPTLCEDCAPFPPLTLAYRYLLAAGISTLTVGASQPQDLDLAHRLAEASGALSPAERSALARLEQRRRQRLGREHCGQCRSCLPCPNQVPIPELLRLRNLRLGHDLQAFTEERYNLIGRAGHWWEQRDASACQGCGDCLPRCPHDLPIPELLAETHRLLAARPRRRLWG

SEQ ID NO: 9405 - DNA, 1134 bp, Synechococcus sp. RS9917
  CDS (1)..(1134): transl_table=11
atgcgctttcagcagagctggaccgatctcgccgctgatgcgatcacgcatgcgtcgcagcaacagctggaggccaccctgcgccgcgccgtggcctgcggctttcaccatgtggaaaccgcgcgccattacggcagctccgagcgccagctgggctgggcgctgcctcaggtgcctgatgcgcaacggattctgcagaccaagattccccccgggaacgatgcggcggctttcgagcaggagctcagcctcagcgtggaacgactgggcggggcccggatcgatcttctggccattcatggcatcaaccggccggaccatctggaacagaccctgcgccccggcggctgcctggaggtggtgcggcgttggcaacagcttggccgggtgggccatgtcgggttctccacccatggacccactgatctgatcgtcgaggcgattcgcagtgatgccttcgactatgtgaatttgcattggtattacatccgccaggacaacgagccggcgatcgaggcggcagcgcagcacgacatgggggtgttcatcatcagccccaccgacaaaggcgggcatctgcacacgccatcgccccgtcttcaggcgttgtgtgagcccctgcatccgatcgtgttcaacgatctgttctgcctgcgagatccccgcgtccacacgatcagcattggcgccgcctgccccggcgatctcgacctccatctggaggcggtggatcggctcgatcaggtggatcagctgctgcccccggtggagcggcgcctggaggatgccgccaggcaggccctcggatccgcctggctggagagctggcatcggggcctgccgtcctgggatcagacgcctggaggtatcaatgtgccagtgctgctctggctgcatgggctggtggaggcctgggggctggagggctatgcccgcgcccgctatggcctcctcggccaaggcagccattggttccctggtgccaatgctgatccgctcgatcagaacgtgtcggaggcggagctgctcgctgcggttggcgccagcccctgggcgaggcagattccctccatcttgcggtctctacggacccgggtgggtggtgtcgtgagcgagaggctgtccagcgcctga

SEQ ID NO: 9406 - protein, 377 aa, Synechococcus sp. RS9917
MRFQQSWTDLAADAITHASQQQLEATLRRAVACGFHHVETARHYGSSERQLGWALPQVPDAQRILQTKIPPGNDAAAFEQELSLSVERLGGARIDLLAIHGINRPDHLEQTLRPGGCLEVVRRWQQLGRVGHVGFSTHGPTDLIVEAIRSDAFDYVNLHWYYIRQDNEPAIEAAAQHDMGVFIISPTDKGGHLHTPSPRLQALCEPLHPIVFNDLFCLRDPRVHTISIGAACPGDLDLHLEAVDRLDQVDQLLPPVERRLEDAARQALGSAWLESWHRGLPSWDQTPGGINVPVLLWLHGLVEAWGLEGYARARYGLLGQGSHWFPGANADPLDQNVSEAELLAAVGASPWARQIPSILRSLRTRVGGVVSERLSSA

SEQ ID NO: 9407 - DNA, 1209 bp, Synechococcus sp. WH 5701
  CDS (1)..(1209): transl_table=11
ttgacaggcgcgctgccctgccgtcgcttcgggcgcacggatctggccatgccggtgctgtcgctgggggggatgcgctatcagcagagctggagcgatctgccggccgctgagatcacggcccagagccaggccaacctgcgcgccaccctggagaaggccgtggccgccgggttccatcacatcgaaaccgcccgccattacggaacgtccgagcggcaactgggtgatctgctgcgggaggtgcccgatccccggcgcattctccagaccaaggtgccgccccatgaggatcccgcccagttcgaggcggatctggagctgagctttgagcggctgcgcatcgagcggctcgatctgctcggcatccatggcctcaacctgcccgagcatctggagcagaccctgcggcccggcggctgcctcgacgtggtgcggcgctggcaggctcagggccgcatcggccatgtgggcttctccacccacgcgcccctgccgctgatcctcgaggcgatcgccagcgatgccttcgactacatcaacctgcactggtactacatccgccaggacaatcgcccggcccttgaggccgcccgccgtcacgacatgggcgtgttcgtgatcagccccaccgacaagggcggccacctgcacaccccctccgagcggatcagtgagctgtgcgcgccgctgcacccgattgagttcaacgacctgttctgcctgcgcgaggcggcgatccacacgatcagcgtgggcgccgccggcccagctgatctcgacctgcacctgcaggcggtggcgcgcctgcccgaggccgagtgctggctggccccggtgcaggagcggctggagcacgccaggctcgaggccctcggcgcccgctggctcgagagctggagtgatggtctgcccgcctgggaggccacccctggagggctgaacctgccggtgctgctctggctgcacaacctcctggaggcctgggacctggaggggtatgcccgcgcccgctatggcctcctgggccaggggagccactggtttcccggcgccaatgccgaggccctcgaccgggaggtgagcgaagccgacctgctggcggtgctgacggccagcccctgggccgagcagattccggcgctgctgcggagcctgcgcgagcgcctggggggcaccagcgtccgtcggctgatggcggctgagtga

SEQ ID NO: 9408 - protein, 402 aa, Synechococcus sp. WH 5701
MTGALPCRRFGRTDLAMPVLSLGGMRYQQSWSDLPAAEITAQSQANLRATLEKAVAAGFHHIETARHYGTSERQLGDLLREVPDPRRILQTKVPPHEDPAQFEADLELSFERLRIERLDLLGIHGLNLPEHLEQTLRPGGCLDVVRRWQAQGRIGHVGFSTHAPLPLILEAIASDAFDYINLHWYYIRQDNRPALEAARRHDMGVFVISPTDKGGHLHTPSERISELCAPLHPIEFNDLFCLREAAIHTISVGAAGPADLDLHLQAVARLPEAECWLAPVQERLEHARLEALGARWLESWSDGLPAWEATPGGLNLPVLLWLHNLLEAWDLEGYARARYGLLGQGSHWFPGANAEALDREVSEADLLAVLTASPWAEQIPALLRSLRERLGGTSVRRLMAAE

SEQ ID NO: 9409 - DNA, 1137 bp, Synechococcus sp. WH 5701
  CDS (1)..(1137): transl_table=11
gtgccaccagagcggcgcccgttcggcacgggccctgaggtctccctgttcaccctgggcacgatgcgggccctcggcagccccgagcagatgctggaggtgctggaggctgccctagatgtggggatcaaccacattgagacggccccctcctacgggccggcggaggtttacctgggccaggccctggcccggatcggtgcctgccgccccagtgagcgcggcgatctggtgctcaccagcaagatcctgcccggtgcctccctcgagagcggccaggcccagctgcgcgcgagcctcgagcggctcggggcaggccgcctcgacaacctcgcggtgcatgggatcaacaggcccgagcacctggactgggccctccatggggcgggggcccggctgctggagtgggccctggcgcaggggctggtgggtcagctggggttcagcagccatggctccacccccttgatcgagcaggccctggccagcgggcggttcagcttctgcagcctgcacctgcatctcttcgatcaggagcggctgccgctggcccagcgggccctggccgggggcctcggggtcttggccatttcaccggccgataagggcgggcgcctctacgaccctcccccggagctgatcgccgactgcgcgcccctggaacccctgcggctggcctaccgattcctgctggcccagggaatcagcagcctgaccctcggggccgagcgaaggcaggatctggaactggccaggcaactcacggccgctgccggccccctggaaaacgaggagctcagtgccctcgaccgcctggaggccagcggccgcgcccgcctcggcgccgagcgctgcggcctatgccgggcctgcctgccctgtcccagcggcgtaccgatccccgagctgctgcggctgcgcaatctggccctgggccatggcatggaggccttcgccagcgagcgctacaacctgatcggcagggcaggccactggtgggaagcgctggatgccagtgcctgccgatgctgcggcgcctgtctgccccgctgtccccatgggctggagatcccagccctgctggccgacacccaccggcgcctggcagcggccccgcgacgccggctctggggctag

SEQ ID NO: 9410 - protein, 378 aa, Synechococcus sp. WH 5701
MPPERRPFGTGPEVSLFTLGTMRALGSPEQMLEVLEAALDVGINHIETAPSYGPAEVYLGQALARIGACRPSERGDLVLTSKILPGASLESGQAQLRASLERLGAGRLDNLAVHGINRPEHLDWALHGAGARLLEWALAQGLVGQLGFSSHGSTPLIEQALASGRFSFCSLHLHLFDQERLPLAQRALAGGLGVLAISPADKGGRLYDPPPELIADCAPLEPLRLAYRFLLAQGISSLTLGAERRQDLELARQLTAAAGPLENEELSALDRLEASGRARLGAERCGLCRACLPCPSGVPIPELLRLRNLALGHGMEAFASERYNLIGRAGHWWEALDASACRCCGACLPRCPHGLEIPALLADTHRRLAAAPRRRLWG

SEQ ID NO: 9411 - DNA, 1134 bp, Synechococcus sp. WH 7805
  CDS (1)..(1134): transl_table=11
atgcgctttcagcagagctggagcgacctagaggcccaggcgatcacggtgcggtctcagcagttgctgcagggcaccctcgaacgtgctgtcgaccttggctttcatcacatcgaaacggcacggcattacggaagctcagagcggcagctgggctgggccatgcctgattgtcctgatccaagccgcattctgcaaaccaaagttcctccccaacaggaccctgccctgtttgaagctgagttggagctcagcatgcagcggttgggtgtgcagcgcgtggacctgctcgccatccatggcatcaaccgacgggaccacctcgcccagacgatcaggccaggaggctgcttagaggtggcgcggcgttggcagcaatcagggcgcatcggtcatgtcggcttttccacccatggggacaccgatgtgattgttgaagcgattgagacagacgccttcgattacgtgaacctgcactggtatttcatccggcaggacaacgagccggcaattgccgctgcgcatcgacacgacatgggcgtgttcatcatcagtcccacagacaagggtgggcacctgcacacgcctgcgcaaaggttggtcgaactgaccgcccctctccaccccatcgttttcaatgatttgttctgtctgcgagatcagcgtgttcacactctcagtgtgggtgcggcatgccctcaggatctggacctccatctagaggctgtcagttgcctggaggacgccctggctctggtgagccccattgaggcccgccttcatcaagccgagaaggaggcccttggacccgactggttgagcagttggcggcagggtcttcctggttggcaagacacgcccggggagatcaacttgcccgttctcctctggctccataatcttgttgaatcctggggcctggagagttacgcccgagctcgttatggccttttgggcagggcgggacattggtttcctggcgccaatgctgacgcgcttgatcgtgatgtgagtgcggaggagcttgatgctgccttgctggatagtccttggaggtcctccatcccagggcgtctgcgcaatctgcgtgaacgggtgggtggcgaacgtcaagagcggttgtcgtcagcctga

SEQ ID NO: 9412 - protein, 377 aa, Synechococcus sp. WH 7805
MRFQQSWSDLEAQAITVRSQQLLQGTLERAVDLGFHHIETARHYGSSERQLGWAMPDCPDPSRILQTKVPPQQDPALFEAELELSMQRLGVQRVDLLAIHGINRRDHLAQTIRPGGCLEVARRWQQSGRIGHVGFSTHGDTDVIVEAIETDAFDYVNLHWYFIRQDNEPAIAAAHRHDMGVFIISPTDKGGHLHTPAQRLVELTAPLHPIVFNDLFCLRDQRVHTLSVGAACPQDLDLHLEAVSCLEDALALVSPIEARLHQAEKEALGPDWLSSWRQGLPGWQDTPGEINLPVLLWLHNLVESWGLESYARARYGLLGRAGHWFPGANADALDRDVSAEELDAALLDSPWRSSIPGRLRNLRERVGGERQERLSSA

SEQ ID NO: 9413 - DNA, 1137 bp, Synechococcus sp. WH 7805
  CDS (1)..(1137): transl_table=11
atgacaaggcggcgcgccttcggcgacggcccagctgtgagcctgttcacgctcggcaccatgcgagcgctgcaatcaaaagaccagatgctgtccgtgctgcgaagcgcccgcgacgctggcatcaaccacgtggaaacagcaccggcctacggtccggctgaaacctttctgggacaagcgctgaggcagctggatcaggagggaactggtcctgcggaaggcgactgggtcatcaccagcaaactgttgcctggccagaccctggaccaagcccgtcgcgctcttgatgccagcctggaacgcttggatcgccccaggatggagaacctggcgatccatggcatcaaccgggaggagcatctccactgggccctgatcggtgacggagcacagctgatcgactgggcactgaccagcggcaaggtcggacaggtgggattcaccagtcatggatccaatgcactgatccagcaggcgatcaacagcggccgcttccggttctgcggccttcacctccacctcctggatccgcagcgcatctccttggctgaggacgctttgggccagcagatgggtgtgctcgctatctccccggcagacaagggcggtcgactgcaggcaccgagtgatcaactggtcagcgactgcgctcccttcgctcccctcgcgctggcttaccgctttctgctggccgcaggggtgagcacactcacggtgggagcggagacacccaccgacttgagcctggccgctgccctggccaaccaagacggccccctgatggagcaggaaacgaaggttcttgcccgcctggaagcgctgagacgcgaacgggtgggagtggagttctgcggccaatgccgtgcctgcctgccctgtcccagcgaagtcccaattcccgagctgctgcgattgcgcaatctggccctcggccacgatctcaaggaattcgcagaggagcgatacaacctgattggacgcgcggggcactggtgggaaacagtgaatgccgatgcctgcgcacactgcggggactgcctgccccgctgtcccaatcacttgccgatccccgatctgctggatgacactcaccgcaggcttgccgcagcgccaaggcggcgcctatggggctga

SEQ ID NO: 9414 - protein, 378 aa, Synechococcus sp. WH 7805
MTRRRAFGDGPAVSLFTLGTMRALQSKDQMLSVLRSARDAGINHVETAPAYGPAETFLGQALRQLDQEGTGPAEGDWVITSKLLPGQTLDQARRALDASLERLDRPRMENLAIHGINREEHLHWALIGDGAQLIDWALTSGKVGQVGFTSHGSNALIQQAINSGRFRFCGLHLHLLDPQRISLAEDALGQQMGVLAISPADKGGRLQAPSDQLVSDCAPFAPLALAYRFLLAAGVSTLTVGAETPTDLSLAAALANQDGPLMEQETKVLARLEALRRERVGVEFCGQCRACLPCPSEVPIPELLRLRNLALGHDLKEFAEERYNLIGRAGHWWETVNADACAHCGDCLPRCPNHLPIPDLLDDTHRRLAAAPRRRLWG

SEQ ID NO: 9415 - DNA, 1158 bp, Synechococcus sp. RS9916
  CDS (1)..(1158): transl_table=11
atgaccggcatggccaccaacccgaaggcccggcgtcggcccttcggggatggaccggcggtgagcctgttcactctggggaccatgcgagccctcgccacgtcggtccagatgctggaggtggtggaagcggcggtgaacgccggcatcaaccacctggaaacggctccggcctacggccctgccgaaagcttccttggggccgcgttgcagaccctcgaccataggggcatcgcaccagctggcggctgggtgatcaccagcaaggtgctgccgggggtgagcctggcggacggccaggagcagctgctggcctgcatgaaacgcctgggggtgtcccgtctcgacaactgggccatccatggtctgaatcgagaggagcatctccactgggccctggagggcgacggccaagccctgatgcattgggcgcagacacaaggcctggtgggacaggtgggattcagcagccacggcagcaacaggctgattgagaccgctctgcgcagtggcgccttccggttttgcagcctgcatttgcaccttctcgaccctcagcgcatgcccctggcagtcctggccttggagaagggccttggggtgatggccatctccccagccgacaaaggcggacggctccaggaccccagccccaccctgatcgacgactgccagccccatgccccgctggcgttggcctatcgctatctgctcagtgccggcatcagcaccctcacccttggtgccagccaagcctccgatctgcaactcgcccagcaactggcggcatcagaccaccccctgagcagcagcgaagaggaggccttggtccagctgaacgcccgccgcagcgaacgcctggggtcaagccaatgcggccaatgccaggcctgtctcccctgcccgaacgcggtgccgattccagccctgctgcgcttgcgcaacctgcggctcgggcacgacctgcagggttactgcgaggagcgttacaacctcatcggccgtgcaggccattggtgggaatcccacgatgccagtgcctgtaaccgttgtcaggcctgtctgccccggtgcccccaccagctccccattcccgaccttttggccgaaacccacgctctgctgtcggcgcctccccgcaggcgcctatggggttga

SEQ ID NO: 9416 - protein, 385 aa, Synechococcus sp. RS9916
MTGMATNPKARRRPFGDGPAVSLFTLGTMRALATSVQMLEVVEAAVNAGINHLETAPAYGPAESFLGAALQTLDHRGIAPAGGWVITSKVLPGVSLADGQEQLLACMKRLGVSRLDNWAIHGLNREEHLHWALEGDGQALMHWAQTQGLVGQVGFSSHGSNRLIETALRSGAFRFCSLHLHLLDPQRMPLAVLALEKGLGVMAISPADKGGRLQDPSPTLIDDCQPHAPLALAYRYLLSAGISTLTLGASQASDLQLAQQLAASDHPLSSSEEEALVQLNARRSERLGSSQCGQCQACLPCPNAVPIPALLRLRNLRLGHDLQGYCEERYNLIGRAGHWWESHDASACNRCQACLPRCPHQLPIPDLLAETHALLSAPPRRRLWG

SEQ ID NO: 9417 - DNA, 1206 bp, Synechococcus sp. RS9916
  CDS (1)..(1206): transl_table=11
atgccttcggccttgccgacccgtcgcttcgggcgcaccgagctgtccatgccggtgctgtcgctgggcggcatgcgttttcagcagagctggaccgatcttcccgctgcagacatcaccaccagttctcagcagacagttgctgaaaccttgaagcgggctgtgtcctgcggtttccatcatctggaaacagctcgccactacggcagttccgagcgtcagatcggttgggctttgcctgatgtgcctgatccgcaaaggattttgcaaaccaaggtgccgcccaaggacgatcccgcgctctttgagcaggaactggagctcagcgtggaacgcctcggcggattaaggctcgatctgctggcgattcatggcatcaacctgcctgaacatcttgactggacggtgcgggcaggcgggtgtctggatgtggtgcgtcgctggcagcagcagggccgtatcggccatgtcggcttttccacccatggccccacggagctcatccttgcggcgattgccaccgatgccttcgatttcgtcaacctgcattggtacttcatccgtcaagacaacgaccctgctctgacggcggcaacccgtcacgacatgggcgtgttcatcattagtcccactgataaaggcgggcacctgcacacgccttcggctcgattgtccgagctgtgcaagcccctgcatccgatcgtcttcaacgatctgttctgtctcagtgatccccgcgtccacaccatcagcgttggtgccgcccgtccgggcgatcttgaccttcatctggatgcgctcacccatctggagcatgcacaggagctgattgcaccgattgcagcgcggctggaggctgcggcgcgttcgtctctgggggaggcctggtgtgacacctggcgtcaggggcttcccgactgggatcaaacacccgggcagatcaatttaccggtgctgctgtggctgcatggtctggtggaggcctggggcttagagggatatgcccgtgcccgttatgggttgctgggtcaggggtcccattggttcccgggtgcgaatgccgatgccctcgaccatgcggtcagcgaggcgaatctgcagaccgtgctgggcgagagtccttggagtgatcagatccctgagcttttgcggggcttgcgcaagcgggtgggaggcgcgacgcagaaacggctgtcgagcacctga

SEQ ID NO: 9418 - protein, 401 aa, Synechococcus sp. RS9916
MPSALPTRRFGRTELSMPVLSLGGMRFQQSWTDLPAADITTSSQQTVAETLKRAVSCGFHHLETARHYGSSERQIGWALPDVPDPQRILQTKVPPKDDPALFEQELELSVERLGGLRLDLLAIHGINLPEHLDWTVRAGGCLDVVRRWQQQGRIGHVGFSTHGPTELILAAIATDAFDFVNLHWYFIRQDNDPALTAATRHDMGVFIISPTDKGGHLHTPSARLSELCKPLHPIVFNDLFCLSDPRVHTISVGAARPGDLDLHLDALTHLEHAQELIAPIAARLEAAARSSLGEAWCDTWRQGLPDWDQTPGQINLPVLLWLHGLVEAWGLEGYARARYGLLGQGSHWFPGANADALDHAVSEANLQTVLGESPWSDQIPELLRGLRKRVGGATQKRLSST

SEQ ID NO: 9419 - DNA, 1161 bp, Planktothrix agardhii NIVA
  CDS (1)..(1161): transl_table=11
atgaaatatcgtagatttggacgtacagaaattcccatgcctattttttcttgcgggggtatgcgttacatttatgatgagtttaaagagtatcctaaagaacaaattcccctggataatcaacaaaatttagaagcgaccatccgccgctccctagaaattggtattaatcaccatgaaactgctcgaatgtatggcacatctgagatgcagttaggggaaattttgccgaaactaccccgtcaaaaactgattatacaaacgaaagttacaccccaatctgatcctcaacaatttcgtcatttatttgaacaatccttagcttatttaggactagattatgttgacttgttgacgatacatggtattaattacaaaccacaactagatgaaaccattcgtcctggtgggtgtcttgatgtgatcaaacaattacaaatggaggggaaagttcgctttaggggattttctacccatgggccgacaaacctaatcatcaaaaccattgaaaccgatcaatttgattatgtaaatctgcattggtactatattaatcaatgcaattggtcagcaattgaagccgccaatcgttatgacatgggggtgtttattattagtccttcggataaagggggaatgctttacaaaccgccccaaaaattagtagacttgtgctatcctctgagtccgatgctatttaatgatctgttttgtttgagccatccccaagttcatacattaagtctaggtgcagccaaaccatcggattttgatgaacatttaaaagtgatcgaacttttagaaaaagccgatgaaattttacctgcaattataaatcgtttggaaacagaagcgatcgctaaattaggcgaaagttggtttcatacttggaatcttggtttaccttcctatcaagaaactcctggggaaatcaatattcccgtcatcttatggttaagaaatttagctttagcatacgatatgtttgactttgccaaaaggcgttacaaacacttaaaaactcgtgatccctggtttccgggtaacacagccgcaggattatccgaatttgacttagagcctgatctgaaaaacagtccccatcgagacaaaattgttagaatactagaagatgcccatcagctattcaacatttcataa

SEQ ID NO: 9420 - protein, 386 aa, Planktothrix agardhii NIVA
MKYRRFGRTEIPMPIFSCGGMRYIYDEFKEYPKEQIPLDNQQNLEATIRRSLEIGINHHETARMYGTSEMQLGEILPKLPRQKLIIQTKVTPQSDPQQFRHLFEQSLAYLGLDYVDLLTIHGINYKPQLDETIRPGGCLDVIKQLQMEGKVRFRGFSTHGPTNLIIKTIETDQFDYVNLHWYYINQCNWSAIEAANRYDMGVFIISPSDKGGMLYKPPQKLVDLCYPLSPMLFNDLFCLSHPQVHTLSLGAAKPSDFDEHLKVIELLEKADEILPAIINRLETEAIAKLGESWFHTWNLGLPSYQETPGEINIPVILWLRNLALAYDMFDFAKRRYKHLKTRDPWFPGNTAAGLSEFDLEPDLKNSPHRDKIVRILEDAHQLFNIS

SEQ ID NO: 9421 - DNA, 1128 bp, Microcystis aeruginosa PCC 7806
  CDS (1)..(1128): transl_table=11
atgcgttatcgacgatttggccgtactgattggcaattttcgctgttttccctggggacaatgcgctgtttgtcctcagagtcggtatttgccgcaacactcgatcgcgccctagaattggggattaatcacctagaaacggccagaggttacggtaatagcgaagtttttctcggtcgctatctgcagcgtcaaggggtgcgggagcgggtttatctgaccacgaaattggtccccactcccgatcgccaaactatggaaaaagcgatcgccgaatccctggaacgattacaattaaattacctcgattgtctagcaattcacggtattaacacccgcgagcatttaaactggattaaagacccgcaaggctgcatgaaagccgtttttatggctcaagaagctggaaaaatcggtcatattggcttttctacccatgcacccctagaaattattctcgagacgatcaatacagatttcttcgcttttgtcaatatccattactattttttttggcaaagacagcaaccagcgatcgctttggcccgagcaaaggacatgggtgtgtttattatctcccctgctgataagggaggtagtctccacagacctcccaagaagctagaggaattatgcgcccctttttcacccctagagctaaattatcgctttttattgagtgatccgcgcattactaccctcagcgtcggggcagcgatcccagaggaattagaggcaattattaacgtatctgaacgagatcagcccctagatgcggcagaaattgccgtttttaagcgtttagagacacatttaaccgataaattagctacagatttatgtagccaatgttatcaatgtttaccctgtcctgaaaatattaatatccccgaagtgttgagactgcggaatctggcagtagcttacgaaatgaccgattttggccagtatcgctatcgaatgctggaaaatgccggtcattggttccccggacgcaaggccaataattgtactgaatgtggtgattgtttacctcgctgcccggaaaaattgccgattcccagtctgttatttgatacacacgaactactcaacggaccagcgcaacggagattgtggtcatcttag

SEQ ID NO: 9422 - protein, 375 aa, Microcystis aeruginosa PCC 7806
MRYRRFGRTDWQFSLFSLGTMRCLSSESVFAATLDRALELGINHLETARGYGNSEVFLGRYLQRQGVRERVYLTTKLVPTPDRQTMEKAIAESLERLQLNYLDCLAIHGINTREHLNWIKDPQGCMKAVFMAQEAGKIGHIGFSTHAPLEIILETINTDFFAFVNIHYYFFWQRQQPAIALARAKDMGVFIISPADKGGSLHRPPKKLEELCAPFSPLELNYRFLLSDPRITTLSVGAAIPEELEAIINVSERDQPLDAAEIAVFKRLETHLTDKLATDLCSQCYQCLPCPENINIPEVLRLRNLAVAYEMTDFGQYRYRMLENAGHWFPGRKANNCTECGDCLPRCPEKLPIPSLLFDTHELLNGPAQRRLWSS

SEQ ID NO: 9423 - DNA, 1182 bp, Microcystis aeruginosa PCC 7806
  CDS (1)..(1182): transl_table=11
atgcagtatcgtcgtttcggtcgcactaatctacaaatgccggtgttttcctgtgggggaatgcgctatcaatttcagtggcaggatgtgccgatgtcgcaaattcccgacgagaatcaaggcaatttagaggcaattatcaataaatctctggaagtggggattaatcacatcgaaaccgctaggggttacggcacttccgagatgcaattggtcaaaattttgccgcaactaccgagggaaaagattatcgtgcagacgaaagtttctcctagtcaagatgtgcgggaatttcgccgtaaatttgagcaatccctgcaatttttacggttagattatgtggatttgttgggcatccatggcatcaacaccgaggaaattctcgatgatactatggccgagggcggttgttggcaagaggcgaaaaaattacagcaacagggaaaagttcgttttatcggtttctccacccatgcaccaactgatgtaattgtcaagaccattgcaacaaattgttacgattacctcaatttgcactggtactatatttttcagaataactggctggccatagaagcggcaaaacagcacgatatgggcgtttttatcattagtccctccgataagggcggccatctctacaatcctccccctaagctcgtcgctctctgttctcctctcagtccgatggtttttaatgacctattctgtctcagtcatccggctgttcataccctgagtattggtgcagcgcgagccaaggattttgatgaacacctgaaaactttacctttactcgatcgagccgaggagattttaccggcaattatcgagagattgcaaggggaaatgatcaactgtttaggcgataattgggtaaaaacgtggtctttgggtttacctagctgggaaaatacccccaatcacatcaatattccttctatcctctggttacgcaatctcgctatcgcctacgatatgattgactttgccaaggccagatacaatctcttggggaatgggggtcattggttcccgggtcaacaggcaaaagatatggaaaaactcgatttaactgcctgtttagccgctagtccccacgctgataaaattccttatcttctcgctgaaactcatcgattattgtcgggagagacagtacaacgcttaagcagtagttaa

SEQ ID NO: 9424 - protein, 393 aa, Microcystis aeruginosa PCC 7806
MQYRRFGRTNLQMPVFSCGGMRYQFQWQDVPMSQIPDENQGNLEAIINKSLEVGINHIETARGYGTSEMQLVKILPQLPREKIIVQTKVSPSQDVREFRRKFEQSLQFLRLDYVDLLGIHGINTEEILDDTMAEGGCWQEAKKLQQQGKVRFIGFSTHAPTDVIVKTIATNCYDYLNLHWYYIFQNNWLAIEAAKQHDMGVFIISPSDKGGHLYNPPPKLVALCSPLSPMVFNDLFCLSHPAVHTLSIGAARAKDFDEHLKTLPLLDRAEEILPAIIERLQGEMINCLGDNWVKTWSLGLPSWENTPNHINIPSILWLRNLAIAYDMIDFAKARYNLLGNGGHWFPGQQAKDMEKLDLTACLAASPHADKIPYLLAETHRLLSGETVQRLSSS

SEQ ID NO: 9425 - DNA, 20 bp, Artificial sequence
  primer
atgcggggcttaggcaatcg

SEQ ID NO: 9426 - DNA, 20 bp, Artificial sequence
  primer
ttaatcctgccataaacgac

SEQ ID NO: 9427 - protein, 402 aa, Artificial sequence
  consensus sequence
  Variant (3)..(8): Xaa in position 3 to 8 is any amino acid
  Variant (9)..(15): Xaa in position 9 to 15 is any or no amino acid
  Variant (17)..(17): Xaa in position 17 is any amino acid
  Variant (20)..(33): Xaa in position 20 to 33 is any amino acid
  Variant (34)..(47): Xaa in position 34 to 47 is any or no amino acid
  Variant (49)..(51): Xaa in position 49 to 51 is any amino acid
  Variant (53)..(54): Xaa in position 53 to 54 is any amino acid
  Variant (56)..(56): Xaa in position 56 is any amino acid
  Variant (60)..(61): Xaa in position 60 to 61 is any amino acid
  Variant (64)..(65): Xaa in position 64 to 65 is any amino acid
  Variant (67)..(69): Xaa in position 67 to 69 is any amino acid
  Variant (71)..(85): Xaa in position 71 to 85 is any amino acid
  Variant (86)..(92): Xaa in position 86 to 92 is any or no amino acid
  Variant (94)..(95): Xaa in position 94 to 95 is any amino acid
  Variant (97)..(109): Xaa in position 97 to 109 is any amino acid
  Variant (111)..(113): Xaa in position 111 to 113 is any amino acid
  Variant (115)..(121): Xaa in position 115 to 121 is any amino acid
  Variant (123)..(124): Xaa in position 123 to 124 is any amino acid
  Variant (127)..(127): Xaa in position 127 is any amino acid
  Variant (129)..(131): Xaa in position 129 to 131 is any amino acid
  Variant (134)..(138): Xaa in position 134 to 138 is any amino acid
  Variant (139)..(140): Xaa in position 139 to 140 is any or no amino acid
  Variant (142)..(157): Xaa in position 142 to 157 is any amino acid
  Variant (158)..(158): Xaa in position 158 is any or no amino acid
  Variant (162)..(162): Xaa in position 162 is any amino acid
  Variant (165)..(168): Xaa in position 165 to 168 is any amino acid
  Variant (170)..(172): Xaa in position 170 to 172 is any amino acid
  Variant (174)..(177): Xaa in position 174 to 177 is any amino acid
  Variant (179)..(182): Xaa in position 179 to 182 is any amino acid
  Variant (185)..(189): Xaa in position 185 to 189 is any amino acid
  Variant (191)..(198): Xaa in position 191 to 198 is any amino acid
  Variant (200)..(204): Xaa in position 200 to 204 is any amino acid
  Variant (207)..(208): Xaa in position 207 to 208 is any amino acid
  Variant (212)..(212): Xaa in position 212 is any amino acid
  Variant (217)..(217): Xaa in position 217 is any amino acid
  Variant (219)..(220): Xaa in position 219 to 220 is any amino acid
  Variant (222)..(224): Xaa in position 222 to 224 is any amino acid
  Variant (226)..(228): Xaa in position 226 to 228 is any amino acid
  Variant (230)..(230): Xaa in position 230 is any amino acid
  Variant (232)..(233): Xaa in position 232 to 233 is any amino acid
  Variant (235)..(240): Xaa in position 235 to 240 is any amino acid
  Variant (242)..(242): Xaa in position 242 is any amino acid
  Variant (244)..(248): Xaa in position 244 to 248 is any amino acid
  Variant (249)..(249): Xaa in position 249 is any or no amino acid
  Variant (251)..(251): Xaa in position 251 is any amino acid
  Variant (253)..(253): Xaa in position 253 is any amino acid
  Variant (255)..(284): Xaa in position 255 to 284 is any amino acid
  Variant (285)..(287): Xaa in position 285 to 287 is any or no amino acid
  Variant (289)..(294): Xaa in position 289 to 294 is any amino acid
  Variant (295)..(295): Xaa in position 295 is any or no amino acid
  Variant (297)..(305): Xaa in position 297 to 305 is any amino acid
  Variant (306)..(307): Xaa in position 306 to 307 is any or no amino acid
  Variant (310)..(310): Xaa in position 310 is any amino acid
  Variant (311)..(314): Xaa in position 311 to 314 is any or no amino acid
  Variant (316)..(319): Xaa in position 316 to 319 is any amino acid
  Variant (322)..(323): Xaa in position 322 to 323 is any amino acid
  Variant (325)..(325): Xaa in position 325 is any amino acid
  Variant (327)..(327): Xaa in position 327 is any amino acid
  Variant (330)..(341): Xaa in position 330 to 341 is any amino acid
  Variant (344)..(346): Xaa in position 344 to 346 is any amino acid
  Variant (348)..(350): Xaa in position 348 to 350 is any amino acid
  Variant (353)..(367): Xaa in position 353 to 367 is any amino acid
  Variant (368)..(373): Xaa in position 368 to 373 is any or no amino acid
  Variant (375)..(377): Xaa in position 375 to 377 is any amino acid
  Variant (379)..(382): Xaa in position 379 to 382 is any amino acid
  Variant (385)..(386): Xaa in position 385 to 386 is any amino acid
  Variant (388)..(395): Xaa in position 388 to 395 is any amino acid
  Variant (396)..(400): Xaa in position 396 to 400 is any or no amino acid
RRXXXXXXXXXXXXXGXMRXXXXXXXXXXXXXXXXXXXXXXXXXXXXAXXXGXXHXETAXXYGXXEXXXGXXXXXXXXXXXXXXXXXXXXXXKXXPXXXXXXXXXXXXXSXXXLXXXXXXXLXXHGXNXXXHLXXXXXXXGXXXXXXXXXXXXXXXXXGFSXHGXXXXIXXXIXXXXFXXXXLHXXXXXQXXXXXXXXAXXXXXGVXXISPXDKGGXLXXPXXXLXXXCXPXXPXXXXXXFXLXXXXXXTXSXGXXXXXXXXXXXXXXXXXXXXXXXXXXXXXXXXXLXXXXXXXLXXXXXXXXXXXLPXXXXXPXXXXIPXXLXLXNLXXXXXXXXXXXXRYXXXGXXXHWXXXXXXXXXXXXXXXXXXXXXLXXXPXXXXIPXXLXXXXXXXXXXXXXRL

SEQ ID NO: 9428 - protein, 46 aa, Artificial sequence
  protein pattern
  Variant (2)..(3): Xaa in position 2 to 3 is any amino acid
  Variant (4)..(5): Xaa in position 4 to 5 is any or no amino acid
  Variant (7)..(8): Xaa in position 7 to 8 is any or no amino acid
  Variant (10)..(10): Xaa in position 10 is any amino acid
  Variant (11)..(11): Xaa in position 11 is Ile, Leu or Val
  Variant (13)..(13): Xaa in position 13 is any amino acid
  Variant (15)..(15): Xaa in position 15 is any amino acid
  Variant (16)..(16): Xaa in position 16 is Gly or Asn
  Variant (17)..(17): Xaa in position 17 is Ile or Leu
  Variant (18)..(21): Xaa in position 18 to 21 is any amino acid
  Variant (22)..(22): Xaa in position 22 is Asp, Glu, Gly or Asn
  Variant (23)..(25): Xaa in position 23 to 25 is any amino acid
  Variant (26)..(26): Xaa in position 26 is Phe or Tyr
  Variant (27)..(27): Xaa in position 27 is Ala, Cys, Gly, Ser, Thr or Val
  Variant (28)..(29): Xaa in position 28 to 29 is any amino acid
  Variant (32)..(32): Xaa in position 32 is any amino acid
  Variant (33)..(33): Xaa in position 33 is Leu or Met
  Variant (34)..(34): Xaa in position 34 is Phe, Ile or Leu
  Variant (35)..(35): Xaa in position 35 is Glu or Gly
  Variant (36)..(36): Xaa in position 36 is any amino acid
  Variant (37)..(37): Xaa in position 37 is Ala or Gly
  Variant (38)..(38): Xaa in position 38 is Gly or Ser
  Variant (41)..(41): Xaa in position 41 is Phe or Trp
  Variant (42)..(45): Xaa in position 42 to 45 is any amino acid
  Variant (46)..(46): Xaa in position 46 is Ala, Gly or Ser
PXXXXIXXPXXLXLXXXXXXXXXXXXXXXRYXXXXXXXHWXXXXXX

SEQ ID NO: 9429 - protein, 25 aa, Artificial sequence
  protein pattern
  Variant (2)..(4): Xaa in position 2 to 4 is any amino acid
  Variant (6)..(6): Xaa in position 6 is Phe, Ile, Leu or Met
  Variant (7)..(7): Xaa in position 7 is any amino acid
  Variant (9)..(9): Xaa in position 9 is Ile, Leu or Val
  Variant (12)..(13): Xaa in position 12 to 13 is any or no amino acid
  Variant (15)..(16): Xaa in position 15 to 16 is any or no amino acid
  Variant (19)..(19): Xaa in position 19 is any amino acid
  Variant (20)..(20): Xaa in position 20 is Ala or Ser
  Variant (22)..(23): Xaa in position 22 to 23 is any amino acid
  Variant (24)..(24): Xaa in position 24 is Phe, Ile or Leu
AXXXGXXHXETXXAXXYGXXEXXXG

SEQ ID NO: 9430 - DNA, 852 bp, SACCHAROMYCES CEREVISIAE
  CDS (1)..(852)
atgattcaaatggtgcccatttattcatgctccgcattacttcggagaactataccgaaaaggccattctatcatgtgttatcagggttaactgtacgctttaaggtaaacccgcaattaaattacaatcttttcagagatctcactaggagggaatatgctaccaatccgagtaaaactcctcatataaagagcaagttgctcaatattcccaacattttgactttatcacgaataggatgtacaccctttatcggactcttcattataacgaataatttgaccccagcattaggtttgtttgcattttccagcatcactgattttatggatgggtatatagcaagaaaatacggcctgaaaaccattgcaggaaccatattagatccacttgcagataaactactcatgatcacaacaactttggcattatctgtaccatccggccctcagattataccggtatctattgcggcgataattctgggtagagatgtgctactagccataagtgctttgtttatacgatatagcactttaaagttgaaatatcctggtcgtgtggcatggaattcctattgggatattgttcgctatcccagcgctgaggtcagaccttcccaactatcaaaatggaacacgtttttccaaatggtatatcttggatctggagtattattacttttatatgagaaagaagagggctgtgaaaaaaccgaggaggatttcgaagatagaaaacaggactttcaaaaggcctttagctatttagggtatgtaaccgccacgaccacaataatgagcggagtatcctacgcattaaagagaaacgcttttaaacttttaaaatag

SEQ ID NO: 9431 - protein, 283 aa, SACCHAROMYCES CEREVISIAE [sequence omitted]

SEQ ID NO: 9432 - DNA, 930 bp, Glycine max
  CDS (1)..(930)
atggttctgttccgcaagttcctaaaacaaatactcgtcgacaacacccaaaccaaaacaaaagcccgaacctttttcacctcaacctcaaccgcaaccgcattcccatggtgcgcgcctcaccataacaaccgcctcttccggtccccaggcccaggcccaggcccaggccctctcttcctcgctcggcctccatggaaactctctcagtccgccacccctctctattcgcacggaaacgccttcaatttgcttcgctccacagcccctctccagttccctgatccggttccctcccattccaacaaaccctcgattttccacagcttcgtcaatctccccaacttcatttccttcacccgattactttccggtcctctcctcgcatggatgatctccaacgagttttatacttctgcaatggtagggctggctctctccggtgccaccgattggctggatggatacgtggctaggaagatgaagatcgattccgtagtgggttcctaccttgatccccttgctgacaaggtccttattggttgcgttgctcttgctatggtgcatagagatctactgcatcctggacttgttagtcttgttgtgttccgggacgtcttcctcgttggtggcgcagtatttctaagagcaaatagcttgggttggaagtgggaaagctggtttgatttttttaaccttgatgggacctgccgccaaaaggttgaaccactctttctaagcaaggtgaatacagtgttccaattagcactagttgctgcagctcttcttcaaccagagtttggaacccaggaaactcaattatatgttacttatttgagctatttagtggcttcaacaactgtagcatctactgcagcatatggagcacaatattttaggagactggctgtagtatcaaactcggtctag

SEQ ID NO: 9433 - protein, 309 aa, Glycine max
MVLFRKFLKQILVDNTQTKTKARTFFTSTSTATAFPWCAPHHNNRLFRSPGPGPGPGPLFLARPPWKLSQSATPLYSHGNAFNLLRSTAPLQFPDPVPSHSNKPSIFHSFVNLPNFISFTRLLSGPLLAWMISNEFYTSAMVGLALSGATDWLDGYVARKMKIDSVVGSYLDPLADKVLIGCVALAMVHRDLLHPGLVSLVVFRDVFLVGGAVFLRANSLGWKWESWFDFFNLDGTCRQKVEPLFLSKVNTVFQLALVAAALLQPEFGTQETQLYVTYLSYLVASTTVASTAAYGAQYFRRLAVVSNSV

SEQ ID NO: 9434 - DNA, 702 bp, Arabidopsis thaliana
  CDS (1)..(702)
atgggtgaagaagacaccgcgacggtggatcagaacagtttcggtggtggcaaagattcattgcttcgtaatcgtcattcgtcgccattgccttcaccgacacagctttcttctaaagtgattacattgcctaccgtattaacccttggccgtgtagctgccgttccgattctcgtcgccaccttttacgttgattgctggtggggaagaactgctacgacaagtattttcattgcagcagccattacagattggcttgatggatatattgcacggaagatgagattgggttctgaatttggtgcatttttggatccagtggcagataagcttatggtagcagctacattgatattgttgtgcactaaaccaatggtcgccgttgtcttaggaccagttccatggttagtgacagtaccttcaatcgccatcattggtagagagattactatgtctgcagtaagagaatgggctgcatctcaaaacggcaagctttcagaggctgttgctgtaaatagcttgggaaagtggaaaactgcaacgcagatgatagcgctaaccatacttcttgcaagccgggatagcagttttgagagactattaccgtcgggtattgggttgctctatgtatctgcagggctctctatatggtctttagttgtttatatgaggaagatatggagagtactgctaaagaagtag

SEQ ID NO: 9435 - protein, 233 aa, Arabidopsis thaliana
MGEEDTATVDQNSFGGGKDSLLRNRHSSPLPSPTQLSSKVITLPTVLTLGRVAAVPILVATFYVDCWWGRTATTSIFIAAAITDWLDGYIARKMRLGSEFGAFLDPVADKLMVAATLILLCTKPMVAVVLGPVPWLVTVPSIAIIGREITMSAVREWAASQNGKLSEAVAVNSLGKWKTATQMIALTILLASRDSSFERLLPSGIGLLYVSAGLSIWSLVVYMRKIWRVLLKK

SEQ ID NO: 9436 - DNA, 579 bp, Bacillus halodurans C-125
  CDS (1)..(579): transl_table=11
gtgaacgtaccaaataagatcacgttatcacgaataggcttaatcccgttatttatgctgtttttgctcgcccccattccgttaggtacagcggtgctgttcggtgtggaaatccctgtttcgcatttagtcgccctgtttctgtttgtattagcggctgctactgattggcttgacggttattatgcgaggaaatggaagcttgtaactaattttgggaagttccttgatccgctggctgacaaactgctcgtgacggcggcattagtggggcttgtagaaattggaacaattccagcatggatggccatcatcatcattagccgtgagtttgctgtcacagggattcgtcttgtggccgcctctgacggagcagtgatcgcagcaagtaagctcggaaaatggaaaacggtctcgcaaatcgtggcgattattgcctgcttgctttataacgttccttttgctgcagtaggttttccttttatgataatcgcgttatgggttgctaccattttaacgattgtttcaggcgtcgattatttcctgaaaaacaaagagtttttgttgaaatctaagtag

SEQ ID NO: 9437 - protein, 192 aa, Bacillus halodurans C-125
MNVPNKITLSRIGLIPLFMLFLLAPIPLGTAVLFGVEIPVSHLVALFLFVLAAATDWLDGYYARKWKLVTNFGKFLDPLADKLLVTAALVGLVEIGTIPAWMAIIIISREFAVTGIRLVAASDGAVIAASKLGKWKTVSQIVAIIACLLYNVPFAAVGFPFMIIALWVATILTIVSGVDYFLKNKEFLLKSK

SEQ ID NO: 9438 - DNA, 1026 bp, Arabidopsis thaliana
  CDS (1)..(1026)
atggcgatttacagatctctaagaaagctagttgaaatcaatcaccggaaaacaagaccattcttcaccgccgctacagcttccggcggaaccgtttctctgactccaccgcagttttcgccgttgttcccacatttctcacaccgtttatctccgctttcgaaatggttcgttcctcttaatggacctctcttcttatcttctcctccttggaaacttctccagtctgcgacacctttgcactggcgcggaaacggctctgttttgaaaaaagtcgaagctctgaatcttagattggatcgaattagaagcagaactaggtttccgagacagttagggttacagtctgtggtaccaaacatattgacggtggatcgcaacgattccaaggaagaagatggtggaaaattagtcaagagttttgttaatgtgccgaatatgatatcaatggcgagattagtatctggtcctgtgctttggtggatgatctcgaatgagatgtattcttctgctttcttagggttggctgtttctggagctagtgattggttagatggttacgtggctcggaggatgaagattaactctgtggttggctcgtaccttgatcctcttgcagacaaggttcttatcgggtgtgtagcagtagcaatggtgcagaaggatctcttacatcctggactggttggaattgtgttgttacgggatgttgcactcgttggtggtgcagtttacctaagggcactaaacttggactggaagtggaaaacttggagtgacttcttcaatctagatggttcaagtcctcagaaagtagaaccattgtttataagcaaggtgaatacagttttccagttgactctagtcgctggtgcaatacttcaaccagagtttgggaatccagacacccagacatggatcacttatctaagctggttagttgcttcgacgactatggcttcaactgcagcttatggtgtacaatactggaagaagagacctatatctatgattaagagatcatag

SEQ ID NO: 9439 - protein, 341 aa, Arabidopsis thaliana
MAIYRSLRKLVEINHRKTRPFFTAATASGGTVSLTPPQFSPLFPHFSHRLSPLSKWFVPLNGPLFLSSPPWKLLQSATPLHWRGNGSVLKKVEALNLRLDRIRSRTRFPRQLGLQSVVPNILTVDRNDSKEEDGGKLVKSFVNVPNMISMARLVSGPVLWWMISNEMYSSAFLGLAVSGASDWLDGYVARRMKINSVVGSYLDPLADKVLIGCVAVAMVQKDLLHPGLVGIVLLRDVALVGGAVYLRALNLDWKWKTWSDFFNLDGSSPQKVEPLFISKVNTVFQLTLVAGAILQPEFGNPDTQTWITYLSWLVASTTMASTAAYGVQYWKKRPISMIKRS

SEQ ID NO: 9440 - DNA, 633 bp, Xanthomonas campestris pv. campestris str. ATCC 33913
  CDS (1)..(633): transl_table=11
atgaagttgaccatccccacgtggctgacactgctgaggatcgtgatgatcccggtgttggtcgtggtgttctacctgccgtacaagtggaccaatttcgcctcggccggtgtgtttgccctggccgcgatcaccgactggctggatggctgggtcgcgcggcgttatcaccagtattcggcgtttggcgcatttctggacccggtggccgacaagctgatggtcgccgtggcgttgttcctcatcgtgcaagggcatcccacgccgtggatggcgttctgggcggcggtcatcgtgggtcgcgaaatcgcggtgtctgcattgcgcgagtggatggccgagatcggccagcgtgccaaggtgcgcgtggcaatgatcggcaaggtcaagaccaccgcacagatggttgcgttgctctgtttgctgtattcggtcacgccggggcagatgcccacgcatgaaatctggctgggcaacctgatcttccaggcggggtactggaccctggcaatcgccgcattgctgacgttgtggtcgggtttccagtatctgcaggccgcatggccaagtttgcgtgccgatgaaaaggccgcgattaccaacaaaccgaaaaaagtcgaaagcaacagttga

SEQ ID NO: 9441 - protein, 210 aa, Xanthomonas campestris pv. campestris str. ATCC 33913
MKLTIPTWLTLLRIVMIPVLVVVFYLPYKWTNFASAGVFALAAITDWLDGWVARRYHQYSAFGAFLDPVADKLMVAVALFLIVQGHPTPWMAFWAAVIVGREIAVSALREWMAEIGQRAKVRVAMIGKVKTTAQMVALLCLLYSVTPGQMPTHEIWLGNLIFQAGYWTLAIAALLTLWSGFQYLQAAWPSLRADEKAAITNKPKKVESNS

SEQ ID NO: 9442 - DNA, 579 bp, Nitrosomonas europaea ATCC 19718
  CDS (1)..(579): transl_table=11
atgctgatgaatcttcccaattttctgacgtggctgcgtatcatggcaattcccctgtttgtcggtattttttatctgccgacggactggatgtctccggccacgcagaatctggttgccaccatcgtatttgccggcgccgcgttgaccgactggctggatggctacctggcgcgggtgctcaaccagacttccgcatttggtgcctttcttgatccggtagcagacaaactgatggtagccgccgccctgatcgtactggtgtatctggaccggttggatgccccggttgctttgatcatcattggtcgtgaaattacaatttccgcactgcgtgaatggatggcgcaaattggcaaatccaagagtgtggcagtgtcttttctggggaagatcaaaacggctgcacaaatggtggcaattcccctgctgctctaccacgacagaatcaatgatgcgttcgattcacagacggctggcacctggctgatttacattgcagccattctgacattgtggtcgatgatctactacctgagagcagccattccacatgtgattcatcacagccagcattga

SEQ ID NO: 9443 - protein, 192 aa, Nitrosomonas europaea ATCC 19718
MLMNLPNFLTWLRIMAIPLFVGIFYLPTDWMSPATQNLVATIVFAGAALTDWLDGYLARVLNQTSAFGAFLDPVADKLMVAAALIVLVYLDRLDAPVALIIIGREITISALREWMAQIGKSKSVAVSFLGKIKTAAQMVAIPLLLYHDRINDAFDSQTAGTWLIYIAAILTLWSMIYYLRAAIPHVIHHSQH

SEQ ID NO: 9444 - DNA, 876 bp, Nasonia vitripennis
  CDS (1)..(876)
atgagttactctctgctattgcaacttgcacgatgtaggacattcaacagatgcatcttggagagatgcttaaaagagtttaggcctcgactctactgcataaacaatgacgatgcttacaccagaaagcaggagctcaaacagcaacgtcgcgccaggagaaaagaaatcaaagcccgactgatcaaagactttcagcagaccaaacaaaaagttgagcaaatcatagagagagaaaatatctggactgttcccaactttctctgcataggaagaatattgactactccgtgtataagctatctgatagtatgccaagattatcaggttgctctctggcttcttggatttgcgggtctttccgacctagctgatggatggattgcgcgtacctggacttcgcaagcttcaaagcttggaagttttcttgatccggtggcggacaaattgttagtcggcacaatgttcctgtctttaacatgggttagcttaattcccgtacctcttacgtgtctggtagtagcaagagatgttgccttagtagctgctgcatcgtatatcagatatcgttccttaccaccaccaaaaaccttggcaaggtattttgatgctacgcatgctacagtacagctggccccaacaacaatcagtaaattcaatacaggggtacagctaatgctgatagctgggactctagcagctcctgtattccactttgtggatcatccaatcctccaaggactgtgttatcttacagcgataacaactattgctggtggtgtgagttacttggtaacaaaagatacctacaaaattttgtccaagaaaaaaaaatccactaggcaatctccttcgtgtaaaaatgacgataattaa

SEQ ID NO: 9445 - protein, 291 aa, Nasonia vitripennis
MSYSLLLQLARCRTFNRCILERCLKEFRPRLYCINNDDAYTRKQELKQQRRARRKEIKARLIKDFQQTKQKVEQIIERENIWTVPNFLCIGRILTTPCISYLIVCQDYQVALWLLGFAGLSDLADGWIARTWTSQASKLGSFLDPVADKLLVGTMFLSLTWVSLIPVPLTCLVVARDVALVAAASYIRYRSLPPPKTLARYFDATHATVQLAPTTISKFNTGVQLMLIAGTLAAPVFHFVDHPILQGLCYLTAITTIAGGVSYLVTKDTYKILSKKKKSTRQSPSCKNDDN

SEQ ID NO: 9446 - DNA, 1035 bp, Aedes aegypti
  CDS (1)..(1035)
atgcttttcaacacggcttgccagctgccgggaaggatactgctctcggccagcaatgggacacttctgcagcgcattccgtcgacgattgcgagccgggttctggccggaactgcccgtcgtaagcttctgttccgctgtgcatttctgagtccggcctgtttgtaccatcagaaccgaggggatggcgcggccagtggccaccgattgctcggggtgcaacccaacacgcctttctacaagtgcttttcctcgtcgctcaagaagggggatgacttccagattaaatccgtcgaaggacgggagattctgcagaacgtcctggagaagaacaagcagctgctgcaggagaagaagaaggtgatcatccaggacatccgcgaccggaaggacaaggtgaaggaacgggtcgaggaggtcatcgagcgggagaatgtggccacgattccgaacttgctgtgcgtcgggaggattgtgatgtccccgtatctgggctacgtgattgtccagtcggagttctcgctggccatgggcatgctggtcgtggccgggctgaccgatctggcggatggtttcatcgcccggaattggcccagccaggccagtcggttgggttcgtttttggacccgatggcggataagatcctggttgggtcgctggtgatttcgatgagctacgccgaactgctgcctctgtggctgaccgggatgattctgttccgggatgtgttcctgatcggggcgggattcgtgatacggtacatcagtctacctcagccgcgcacattgtcgcgttattttgacgtaacgcacgccactgcccagctcgcaccgaccttcatcagcaaggttaacactgccgtacagttggccgccgtggccaccaccctgggggctcccatctggaactacgttgatcatccgtatctgcacgccctctggtatctgacgggatttacgacggtggccgccgccatgagctacatcatcaataaggacacgtacaaaatcttgaagaacaataagcagccatga

SEQ ID NO: 9447 - protein, 344 aa, Aedes aegypti
MLFNTACQLPGRILLSASNGTLLQRIPSTIASRVLAGTARRKLLFRCAFLSPACLYHQNRGDGAASGHRLLGVQPNTPFYKCFSSSLKKGDDFQIKSVEGREILQNVLEKNKQLLQEKKKVIIQDIRDRKDKVKERVEEVIERENVATIPNLLCVGRIVMSPYLGYVIVQSEFSLAMGMLVVAGLTDLADGFIARNWPSQASRLGSFLDPMADKILVGSLVISMSYAELLPLWLTGMILFRDVFLIGAGFVIRYISLPQPRTLSRYFDVTHATAQLAPTFISKVNTAVQLAAVATTLGAPIWNYVDHPYLHALWYLTGFTTVAAAMSYIINKDTYKILKNNKQP

SEQ ID NO: 9448 - DNA, 840 bp, Chlamydomonas reinhardtii
  CDS (1)..(840)
atgtcggagctgtatatcgcgctgggtatggtcttcctcttcctgcctctcaccatcattgtgtcgcgccttctgggctcgcgcgagccggcccaagatcaggtcccgtccaccagcaccgctagcagcagcaagccagcggcagacccggtgtacaacctgcccaacgcggtgtcggtggcgcggctggtgtcagggccgctcattggctactggctggtgcaggggcattacgaggcagccacactggcgctggccgtgtccggggccagtgactggttggatggctggctggcccggcggctaggcgcgtcatccgtgttcggatcctacctggacccgttggcggacaaggtgctcatcggctgtgtggctgcggcgctgctgatgaacggcgccatgccgggctgggtggcgggcgtggtggtggggcgggacgtgctgctagtggcaggcagcttcgtgttccggctgcgcggcttcggctggcgctggccgggcgccgcagccttcttccgcaccgtcgacacgtccgccgctgctgctggtgctgctacgggtgctgctaatggcgtggcttcgggtggcggtggcggcggcgagggcgtgtcgttcatgcggccgcttctgatcagcaaggccaacacggtgctgcagctgctgctgctgggtggctacctgctgcgcggcatggacggcggcgcggggctgcagctgctgctgccgggcggcggcggcgaggagctcatcatggggctggagctggctacggccgccaccacggtggcgtcggggctggcgtacggcaccatggcggtgcagggcaagctgttcaagtag

SEQ ID NO: 9449 - protein, 279 aa, Chlamydomonas reinhardtii
MSELYIALGMVFLFLPLTIIVSRLLGSREPAQDQVPSTSTASSSKPAADPVYNLPNAVSVARLVSGPLIGYWLVQGHYEAATLALAVSGASDWLDGWLARRLGASSVFGSYLDPLADKVLIGCVAAALLMNGAMPGWVAGVVVGRDVLLVAGSFVFRLRGFGWRWPGAAAFFRTVDTSAAAAGAATGAANGVASGGGGGGEGVSFMRPLLISKANTVLQLLLLGGYLLRGMDGGAGLQLLLPGGGGEELIMGLELATAATTVASGLAYGTMAVQGKLFK

SEQ ID NO: 9450 - DNA, 984 bp, Magnaporthe grisea 70-15
  CDS (1)..(984)
atgcagagattgagcgcctcgtccatggcactggcgggaggccgcgtctcgccgtcgtctgtgctgctgatgaggccaatgaccatgactacgacgacgatggcgactacagcatgttctcataatgctcaacgtattctttccaccctctgtcggccggcgagccgttcactactgcctgctgtctcccagagtctgttgctgccacagcggtcgttttccatcacgagaccttggctgtcgctggcgaaaaaggagcacaagggcgatggccaaagagggacgaccaagcaacagccaaaagttgtcggcgctgcagagccgctggcagtaacgccggcatcaggcaagtctgcgttggcgcgagagaacatttacacgatccccaacatcttgacggcctcgcgcctggtgattgcgccctttatcggatactgcatcgtgcacgactatcatgccacggccctgggcctctttgcctacgccggggtctcggacctgctcgatggctggatcgcacggcggtggaatcaaggcaccgttgtcggtaccatcattgatccgatggctgacaagatgctcatgatgatattgactgttagtctggctgtcaagggtgcactgccgctctggcttgtaactctcatcgtcggccgcgatgttggtctagcatgctcagccatatactacaggtgggtctccctgccgccacccaagacctttatgcgatactgggacttttcgctgccctctgccgaggtgcggccgacaacaatcagcaaatacaacacctttctgcagctggctctcatggggttgaccaccaccgcccctgtggttccgtatgaccttgatggggcgctggctgccatgcattgggttgtggccgtcacgacagtctggagtggcgctagctatgttttcagcaaggacgcggtgaaaattctgtcacaggcaaaggctgtcgacaagaagctgaagtag

SEQ ID NO: 9451 - protein, 327 aa, Magnaporthe grisea 70-15
MQRLSASSMALAGGRVSPSSVLLMRPMTMTTTTMATTACSHNAQRILSTLCRPASRSLLPAVSQSLLLPQRSFSITRPWLSLAKKEHKGDGQRGTTKQQPKVVGAAEPLAVTPASGKSALARENIYTIPNILTASRLVIAPFIGYCIVHDYHATALGLFAYAGVSDLLDGWIARRWNQGTVVGTIIDPMADKMLMMILTVSLAVKGALPLWLVTLIVGRDVGLACSAIYYRWVSLPPPKTFMRYWDFSLPSAEVRPTTISKYNTFLQLALMGLTTTAPVVPYDLDGALAAMHWVVAVTTVWSGASYVFSKDAVKILSQAKAVDKKLK

SEQ ID NO: 9452 - DNA, 813 bp, Candida glabrata CBS 138
  CDS (1)..(813)
atgagtataccaatgttgccagcgatattgtccaaaaatgtgggactacgaagtataagatgtgtacgaggaggataccttcgagtagtactaggtgccagcatcggaatgcgaccttatagtgatttgaaggtgaacaagaaggactttctaacaataccgaatgtcataacaataactcggattgcaaccacacctatgatagggtatttcttgctcaacaaccaattggtaccagcgttgtctttatttgcatactccagtatcacagactttctggatggttatattgcaaggagatataatatgaagtcggatgcagggacaatactcgatcccatggctgacaagttactcatgatcatcacaacggcagcactagcacttccgccaggtccgcaggtaattcccataggaatcgcgtccttgatattgggtcgggatattctgatgggttttagtgccattttcattagatacgcttcattgaaacagaaataccacttcgttacatggaagtccttctgggatttcttcaaatatccaagtgctgtagtgaagccactaactatttccaaatggaacacatttcttcaaatgatatacctgggcttagccgtgttcataatgatattggatcaatatgacacaaaagtacaggaggccaacgaacagaaagacactacactggatataaacaccctaaaaactgggtttagctggttgggatatattgttggtgctacaacagtaattagcggtacatcctatgtattcagcaaaagtgccgtcacatttattaaaaaaatctag

SEQ ID NO: 9453 - protein, 270 aa, Candida glabrata CBS 138
MSIPMLPAILSKNVGLRSIRCVRGGYLRVVLGASIGMRPYSDLKVNKKDFLTIPNVITITRIATTPMIGYFLLNNQLVPALSLFAYSSITDFLDGYIARRYNMKSDAGTILDPMADKLLMIITTAALALPPGPQVIPIGIASLILGRDILMGFSAIFIRYASLKQKYHFVTWKSFWDFFKYPSAVVKPLTISKWNTFLQMIYLGLAVFIMILDQYDTKVQEANEQKDTTLDINTLKTGFSWLGYIVGATTVISGTSYVFSKSAVTFIKKI

SEQ ID NO: 9454 - DNA, 897 bp, Kluyveromyces lactis NRRL Y-1140
  CDS (1)..(897)
atgattttgaacgttttaaccatttcgaagcaagtgaatggattgagaagaatcgtacagaaaaccaacggaataagctcaaacttgcagtttagccgaagcaaggctctgaaacaaattattggaatacggcctttccgtcactcccagcgcttctactcaactgacaatcgtgatttggtaaaggaaccagagaagaaacagcagcaacagcaacggacaaaaagcgcgataactaatggaatatggactttaccaaacgtgttaacgatgagtagaatagcgacaacgcccttgattggttactacatcttaactcagaaccttgcccccgcaatgtctttattcgtgtactcttgtgtcactgactttttagatgggtaccttgcgagatcgtacaagatgaaatctgtagctggaacagttcttgatccaatggcagataagatattaatgatgacaacgacagccgctttgtgcgtaccttctggcccccaaatcattccgttagcggttgctggacttattttcggaagagatctattgttggggttgagtgccatttatttcaggtatgcatcaatgaagcatcgttacggctctgttacatggaactcgtattgggatattttccattatccaagcgcagaggttaaaccaacgcaaatttcgaagtggaacactttcgtacaaatgatctatgtaggatttggtgttgtcctcttgatcataaataacactaaagatgaggaggaaggcaaagaaggtttgttgaaggaaaatagtcaatttgcgtttactttactgggctatttggtcagtgtaacgacagtatggagtggagcatcctacgtgttcaataaaaatgctgtccgttatctgagtaaattgaagtga

SEQ ID NO: 9455 - protein, 298 aa, Kluyveromyces lactis NRRL Y-1140
MILNVLTISKQVNGLRRIVQKTNGISSNLQFSRSKALKQIIGIRPFRHSQRFYSTDNRDLVKEPEKKQQQQQRTKSAITNGIWTLPNVLTMSRIATTPLIGYYILTQNLAPAMSLFVYSCVTDFLDGYLARSYKMKSVAGTVLDPMADKILMMTTTAALCVPSGPQIIPLAVAGLIFGRDLLLGLSAIYFRYASMKHRYGSVTWNSYWDIFHYPSAEVKPTQISKWNTFVQMIYVGFGVVLLIINNTKDEEEGKEGLLKENSQFAFTLLGYLVSVTTVWSGASYVFNKNAVRYLSKLK

SEQ ID NO: 9456 - DNA, 879 bp, Debaryomyces hansenii CBS767
  CDS (1)..(879)
atgactttgcgattgtataattaccaaggaatcattagatctatattgtatgctagatcaacgaattgcataagatctggtttttcactccccccaagacatatagcgaattcattcaacagtaataaacttcaattccatacattttcccgcatactacatgagactaaaaagacaaagttaagtgatttagagaagtcaccaaaaccatcatcaaagcccttaccaccattagaacccataagtccacttcaaccattattgcgtgaaaatatttatacgatacccaacattttaactgcaactagaattattactgctcctgctgtagggtactttctcataaatcaacaagctgggctagcgatgtcgatttttgtatattcatgcgtaactgattttattgacggatatattgccaggaaatataacatgaaatcaattattggatcaatattagatccaatggctgataaattattaatgactatatgtactgtatcattaagttatatttcgtccatgccattgtaccttgcatgcttaatcattggaagagatgtattgttgagttttatggcaatctattacagatatgtaactttaccaccaccgaaaacgtttaagaggcttattaatatttcgattcctacagtttctgttcatccgaacttattatccaaagtgaatacaggattacaaatgctctatattggaagcttggtattgcaacctgcaatcgaatcaataatggcagaaaattggattgaaccatttcattcaggattatacggctttgaattattagtagctacaacaacatttttaagtggttgcacgtatattttctcaaagaaggcgataaaacccgttagataa

SEQ ID NO: 9457 - protein, 292 aa, Debaryomyces hansenii CBS767
MTLRLYNYQGIIRSILYARSTNCIRSGFSLPPRHIANSFNSNKLQFHTFSRILHETKKTKLSDLEKSPKPSSKPLPPLEPISPLQPLLRENIYTIPNILTATRIITAPAVGYFLINQQAGLAMSIFVYSCVTDFIDGYIARKYNMKSIIGSILDPMADKLLMTICTVSLSYISSMPLYLACLIIGRDVLLSFMAIYYRYVTLPPPKTFKRLINISIPTVSVHPNLLSKVNTGLQMLYIGSLVLQPAIESIMAENWIEPFHSGLYGFELLVATTTFLSGCTYIFSKKAIKPVR

SEQ ID NO: 9458 - DNA, 888 bp, Yarrowia lipolytica CLIB122
  CDS (1)..(888)
atgatccggactcttcgacctcacataattgggcttccgcggtcccggattctccaggccacgttgcggcctcccttgcgggcaggcattcaacatcctgtagcaagatggaactcgtccaaaccgacacagaccgaggtgctcaagagcgacattaagagtcccgtgcttaagaaactcaacctggaccctctcaagcgacctgccactttgctcccgtcggaaatccacgagaatttgtacaccctgcccaacattctgaccttcactcggttgctgtctgctcctctgattggctactttgtgatccaacacgagcaggtgctggcgacgggtttgtttgtgtactcgtgtgtcacagacatgctggacggctacattgcccggaaattcgacatgaagagtgtggtgggatcggtcattgatcccctggcagacaagtttctcatgatcacactgacggtgtgtctggctgcagcgggagagatgcccgtctacctgacaaccctgattctcggccgagactttggcctcggactcagcgccttctactacagatacatttcgctgcctcctcccaagaccttcacccggttctgggacttttccatccccagtgccgaggtgaaccccaccaccatctccaagtacaacacggccttccagatgctgtacattggtctggtgatgagcaagccgatcattggcacctttgctgacatggctgcatttgatgttggcatgacctactacggctactttgtgggagccactactttcctttcaggaatgtcgtatgtcttttccaagacggccgtcaagattctgccttatccccagcaagccaagcccatggtttttgagggaaagaagttgaacgagaagtaa

SEQ ID NO: 9459 - protein, 295 aa, Yarrowia lipolytica CLIB122
MIRTLRPHIIGLPRSRILQATLRPPLRAGIQHPVARWNSSKPTQTEVLKSDIKSPVLKKLNLDPLKRPATLLPSEIHENLYTLPNILTFTRLLSAPLIGYFVIQHEQVLATGLFVYSCVTDMLDGYIARKFDMKSVVGSVIDPLADKFLMITLTVCLAAAGEMPVYLTTLILGRDFGLGLSAFYYRYISLPPPKTFTRFWDFSIPSAEVNPTTISKYNTAFQMLYIGLVMSKPIIGTFADMAAFDVGMTYYGYFVGATTFLSGMSYVFSKTAVKILPYPQQAKPMVFEGKKLNEK

SEQ ID NO: 9460 - DNA, 729 bp, Candida albicans SC5314
  CDS (1)..(729): transl_table=12
atgaaaaagaaaaaaaaattttttgcgtgtaattttttttttctttgttgttccacactcatgattagactttatccaggcataagacctttgcgtacaggggttgttcacttttccaccaaacaggctatacggtcatcgttgtggactataccgaatgtgttgacatatacacgtattattactacaccgtttattggatactatataactactggccagtctactgccgcgttgctgttgttcacgtactcgtgtgtcaccgactttgttgacgggtacattgctagaaagtacaacatgaagtcgattgtggggtcgattgttgatccgttggccgataagttgcttatgacggtgtgtacggtgtcgttggggtatgttcatgcgattcctccggtgatagcaagcataataattggccgcgatgtgatgttgagttttatgtcgttctactataggtacaagagcttgccggcgcccaagacgtttgataagtttattagcattggccagattccgactataagtgtgcaccccaatatgttgggcaagatcaatacggcgttgcagatggtgtacattgggagtttggtgtaccgcccgttggttgagtcggttgtttctggggccgtttatgatgggttggggttggttgtgggggcgaccacattggcgagtggggccaactacttgtttagcaaaagttcatggagatatgtaaaatga

SEQ ID NO: 9461 - protein, 242 aa, Candida albicans SC5314
MKKKKKFFACNFFFLCCSTLMIRLYPGIRPLRTGVVHFSTKQAIRSSLWTIPNVLTYTRIITTPFIGYYITTGQSTAALSLFTYSCVTDFVDGYIARKYNMKSIVGSIVDPLADKLLMTVCTVSLGYVHAIPPVIASIIIGRDVMLSFMSFYYRYKSLPAPKTFDKFISIGQIPTISVHPNMLGKINTALQMVYIGSLVYRPLVESVVSGAVYDGLGLVVGATTLASGANYLFSKSSWRYVK

SEQ ID NO: 9462 - DNA, 570 bp, Methylococcus capsulatus str. Bath
  CDS (1)..(570): transl_table=11
atgcacttcaacctgcccacttatctgacgctgctgaggatcgtcctcatcccggtcctcacggtggcgttctatctgccctggagcggcgcccacgtcgtcagcggcgtcattttcgcaatcgccgcgatcaccgactggttggatggttacctcgcgcggcgaatgggtctggccacccgcttcggagcattcctcgaccccgtggccgacaagctgatggtcgcggtcgcgctggtcctcatcgtacaggccgaaccccggccgctgatcgcactagcctccgccatcatcatcggcagggaaatcaccatcgcgtcgctgcgcgaatggatggcagaaatcgggcagcggaaacgggtcgaggtatcggccctgggcaaatggaaaaccaccttccagatgctggcgatcaccctcctgctgctcggtctggacataccgcacggcggggtcaagacgacgggcgaattgttgctagtggtttccgcgaccctcacgctgtggtcaatgatcgtgtacctccaggccgccatgcccgtgttcaaggcaggtgccgaggccgaatga

SEQ ID NO: 9463 - protein, 189 aa, Methylococcus capsulatus str. Bath
MHFNLPTYLTLLRIVLIPVLTVAFYLPWSGAHVVSGVIFAIAAITDWLDGYLARRMGLATRFGAFLDPVADKLMVAVALVLIVQAEPRPLIALASAIIIGREITIASLREWMAEIGQRKRVEVSALGKWKTTFQMLAITLLLLGLDIPHGGVKTTGELLLVVSATLTLWSMIVYLQAAMPVFKAGAEAE

SEQ ID NO: 9464 - DNA, 636 bp, Xylella fastidiosa Ann-1
  CDS (1)..(636): transl_table=11
atgaaattgaccgtccccacttggttaacgctgctacggatcgtgatgatccctgtgctcattgtggtgttctatctaccttatcaatggagcaatattgtcgccacgggagtgtttgcgatcgctgcaattaccgactggcttgatggatggatcgcacgtcgttacgcgcaacattcgttattgggtgcgtttttagacccagttgcggacaaattgatggtggccatcgcattatttctcattgtgcaaggtcacccgacaccgtcgatggcattttgggcagcagtgatcgtcagtcgtgaaattgcagtgtcagcattgcgtgagtggatggccgaaattggtcatcgtgccaaggtgcgtgtagctgtccttggcaaagtgaagactacggctcaaatgattgcggtactgtgtctgctctattcggtaacacccgagaagaaggctatccatcaaatatggtttggccacttgatcttccaagtcggttattggacattgctgatttccgcgttactgacactgtggtctggtttccagtatttgcgcgctgcctggcctagtttacgtaccggaaaacctgtggtgattaaaacgcacatcagcaagaaccgaaaaattaatagttga

SEQ ID NO: 9465 - protein, 211 aa, Xylella fastidiosa Ann-1
MKLTVPTWLTLLRIVMIPVLIVVFYLPYQWSNIVATGVFAIAAITDWLDGWIARRYAQHSLLGAFLDPVADKLMVAIALFLIVQGHPTPSMAFWAAVIVSREIAVSALREWMAEIGHRAKVRVAVLGKVKTTAQMIAVLCLLYSVTPEKKAIHQIWFGHLIFQVGYWTLLISALLTLWSGFQYLRAAWPSLRTGKPVVIKTHISKNRKINS

SEQ ID NO: 9466 - DNA, 1047 bp, Vitis vinifera
  CDS (1)..(1047)
atggcggtcttcagatccctcaataccctaatccgaagccctaactccaaacgcctacttcttactgtctcagcttcagcaaccccattccctcgtctctcctccattctctctccgctctctctctccttcgcctctcgcttcacttattctcactccagggttctctctcctctgtccatatctatcccttttcgtggtcctctcttcctctcttctccaccatggaagctgtcccagtccgccacgcctctgctcctccaaggggacgtcgttttacgaaacgtcgaggccttgaaacttcttcgaaatcggagcttcccgattaggttaggagggttcggatccgtttcggcgggtacgggcttgttgggtcggcttgacaagaagcaattgatcagcggcgatgtgggtgtggcctatggcgatttcgtcaaaagtttcatgaatttgccgaacttaatttcgtttagtcgattggcctctggtcctttgcttgcatggatgattttaaatgaatggtatctttctgcatttgtggggttggctatctctggagcaactgattggctagatggatacatggctaggaagatgggtattaattctgtaattggttcataccttgatcctttagcagataaggttctaattgggtgtgttgcattggcgatggtagataaggatcttctgcaccctggacttgttggactagtggtgctgcgagatgttgccctcattggtggtgcagtttataaaagggctagcagcttgggctgggagtggaaaagttggtttgatttcttcaacctagatggtacacatccccagaaggttgagcctctctttattagcaaggtcaatacggtgctccaactggctttagtcactgcagcccttcttcaaccagaatttggaacccaagaaacagagtcatacatcacatacttgagctggttggtggcttccacaacagtagcttccactgcagcatatggggcacaacacatgagaaacaggtccaagttaatcgcaggatcacgctag

SEQ ID NO: 9467 - protein, 348 aa, Vitis vinifera
MAVFRSLNTLIRSPNSKRLLLTVSASATPFPRLSSILSPLSLSFASRFTYSHSRVLSPLSISIPFRGPLFLSSPPWKLSQSATPLLLQGDVVLRNVEALKLLRNRSFPIRLGGFGSVSAGTGLLGRLDKKQLISGDVGVAYGDFVKSFMNLPNLISFSRLASGPLLAWMILNEWYLSAFVGLAISGATDWLDGYMARKMGINSVIGSYLDPLADKVLIGCVALAMVDKDLLHPGLVGLVVLRDVALIGGAVYKRASSLGWEWKSWFDFFNLDGTHPQKVEPLFISKVNTVLQLALVTAALLQPEFGTQETESYITYLSWLVASTTVASTAAYGAQHMRNRSKLIAGSR

SEQ ID NO: 9468 - DNA, 891 bp, Phaeosphaeria nodorum
  CDS (1)..(891)
atggtcttacagaatgagccaccaccatcaacaacagccaaacttgcaacaaccctcaagtcgacgcttaagctaaacaccacccgccatgagaacatttacaacctccccaacttcctgactctgacacgcctcatcgccacgcccatggttggatatctcatcatccacgaccagcacctctacgccttctccctcttcacttacgccgctgtctccgacctcctcgacgggtggatagcgcgaaaatggaaactccaaaccgtcgttggcagcgtcgtcgaccccatggccgacaagttcctgatgaccactctagtcacctgtctagccgtcaacgggagcttacccatgccgctctttgccctaattctgggacgtgatgtcagtcttgcggtctccgcgctgtactatcggtacgcctcgttgcctgcgcccaagactatggcgaggtactgggacttcagtcttccaagcgctgaggtacatcctacgggcatttcaaagttcaacacgttcttgcaattgactttgttgggtacgctgctgtgtacgaatttgctgcacgatccgtctgcgactcagtcggcggcgggcgggcttttgttgtcgattcaggatgcgcttggtggtgaggcgggtgtcaggactatggtgcaaggcatgtcggctattgttgctagtacgacgatttacagcgggctggagtacacttggtcaaagaaagcagtagtcattctcggcggcgatgaggcgctaaagaggaagcaaggtttcagaggcaggatgatcatggcgagcgggtttggatccttcattgcgctcgcggcgtggttgtggtacaatcagaacgcaagaaaaaatacagagaaggaaattgagcagaaataa

SEQ ID NO: 9469 - protein, 296 aa, Phaeosphaeria nodorum
MVLQNEPPPSTTAKLATTLKSTLKLNTTRHENIYNLPNFLTLTRLIATPMVGYLIIHDQHLYAFSLFTYAAVSDLLDGWIARKWKLQTVVGSVVDPMADKFLMTTLVTCLAVNGSLPMPLFALILGRDVSLAVSALYYRYASLPAPKTMARYWDFSLPSAEVHPTGISKFNTFLQLTLLGTLLCTNLLHDPSATQSAAGGLLLSIQDALGGEAGVRTMVQGMSAIVASTTIYSGLEYTWSKKAVVILGGDEALKRKQGFRGRMIMASGFGSFIALAAWLWYNQNARKNTEKEIEQK

SEQ ID NO: 9470 - DNA, 969 bp, Drosophila melanogaster
  CDS (1)..(969)
atgctgcccgccatcattttccggcaggtgcagcgcccactgcaccatggagccgccacattggagcacgttttgggagtcggcggaagcagcttcgtgaactgcctgaatcgctatgcggccgccacgggattcattcggatctcgtttctggacattaagcggcgcaggaactacgagttagccagacttcgcctctatgccgatgagaagaagcagtcgctccatttgcgcaccttgcagggacgccatctcctgcagggtgtcatcgaaaggaagaacttcctggtggatgacatccgggaggccaggcacaaagtccaggagcgggtgcgcgagaagatcgacgagatacgcgaagagcgagagaacattatgaccatacccaacatgctgaccatcagtcgtgccgtcctctcaccctacatcggatatgttatagtccagggcgatttcaccctgggcatgagccttctagcgttcgccggcatcacagatctgttggatggacagatcgcacgacggtggccttcgcaggcgagcaagttcggttccttcctggaccccatggctgataagttgctgatgggctcgctggtcatctcgctgtgctacacggacctgctgcccatgtggctcatgggcatcgtggtgttccgggatgtctttcttctaggagctggatttgttatacgctacataagtctgccaccgccgaaaaccttttcgcgctacttcgacgccacccatgttactgcccaactggagcccacgctgctcagcaagatcaacacgggcgtccagttggccaccattggactgagcctgggagctcccatttggaactatttggatcacccagctttgcagggactttggtatctgactggcctgactacggctgccactgccctcagctacgtcatgaatcggcataatacctttaagattatccaaaaaaagacgtag

SEQ ID NO: 9471 - protein, 322 aa, Drosophila melanogaster
MLPAIIFRQVQRPLHHGAATLEHVLGVGGSSFVNCLNRYAAATGFIRISFLDIKRRRNYELARLRLYADEKKQSLHLRTLQGRHLLQGVIERKNFLVDDIREARHKVQERVREKIDEIREERENIMTIPNMLTISRAVLSPYIGYVIVQGDFTLGMSLLAFAGITDLLDGQIARRWPSQASKFGSFLDPMADKLLMGSLVISLCYTDLLPMWLMGIVVFRDVFLLGAGFVIRYISLPPPKTFSRYFDATHVTAQLEPTLLSKINTGVQLATIGLSLGAPIWNYLDHPALQGLWYLTGLTTAATALSYVMNRHNTFKIIQKKT

SEQ ID NO: 9472 - DNA, 990 bp, Oryza sativa
  CDS (1)..(990)
atggcgttcctcaaaaccctgaaccctctcctccgcagaagccccaccccgatcccgaacccccgctccctcctttccctcgacgccttcctcgccgcctcctcccccaccgccgcctcccacgccaccgcgcccgcgcccttcgccgccgcggcgcaccaccacgtccccatccgctcggggggcccgctgttcctctcctcgccgccatggatgctctcccagtccgccacgccgctcaccgccgcggccgccgctctccgcgccaggctccggagggcccgcgcgctcgccggcggcggcgcccaggctgtcgcggacgccgtagggtgggagcccaggcggatctccagagatgagagcgaggtggcggaggcggtgacgggtggaagggagaggttcctgaatctgcccaatctggtgtcgattggacgcatggcgtcggggccggttattggatggatgattgtgaatgaatggtatcttcctgcttttggcacattggctttgtctggtgcaagtgattggttagatggctttttagcgagaaagatgggcatcaattctgtgtttggatcttatctggacccattagctgataaggtgttgattggctgtgttgccatagcaatggttgaaaaagacctcttacatcctgggcttgttggcttggttgttgtaagagacttgctccttgtgggtggtgctgtctacaaacgagcttccagtctgggatggaagtggaacagttggtcagactttgttaacttagatgcaattcaccgtgagaaggtcaaacctctttttatcagcaaggtgaacacagttttccaattgatgttggttgctgctgctctcctccagccagaatttggcacagaggagactcagaattatattacagtgttgagctggcttgtagcttctacaacaattgcatccacagtaggttatggtatcaaatatcgtcagattagaccaagaagatga

SEQ ID NO: 9473 - protein, 329 aa, Oryza sativa
MAFLKTLNPLLRRSPTPIPNPRSLLSLDAFLAASSPTAASHATAPAPFAAAAHHHVPIRSGGPLFLSSPPWMLSQSATPLTAAAAALRARLRRARALAGGGAQAVADAVGWEPRRISRDESEVAEAVTGGRERFLNLPNLVSIGRMASGPVIGWMIVNEWYLPAFGTLALSGASDWLDGFLARKMGINSVFGSYLDPLADKVLIGCVAIAMVEKDLLHPGLVGLVVVRDLLLVGGAVYKRASSLGWKWNSWSDFVNLDAIHREKVKPLFISKVNTVFQLMLVAAALLQPEFGTEETQNYITVLSWLVASTTIASTVGYGIKYRQIRPRR

SEQ ID NO: 9474 - DNA, 26 bp, Artificial sequence
  primer
atgattcaaatggtgcccatttattc

SEQ ID NO: 9475 - DNA, 28 bp, Artificial sequence
  primer
ctattttaaaagtttaaaagcgtttctc

SEQ ID NO: 9476 - protein, 253 aa, Artificial sequence
  consensus sequence
  Variant (3)..(7): Xaa in position 3 to 7 is any amino acid
  Variant (9)..(12): Xaa in position 9 to 12 is any amino acid
  Variant (14)..(26): Xaa in position 14 to 26 is any amino acid
  Variant (27)..(41): Xaa in position 27 to 41 is any or no amino acid
  Variant (43)..(52): Xaa in position 43 to 52 is any amino acid
  Variant (54)..(55): Xaa in position 54 to 55 is any amino acid
  Variant (58)..(59): Xaa in position 58 to 59 is any amino acid
  Variant (62)..(69): Xaa in position 62 to 69 is any amino acid
  Variant (70)..(70): Xaa in position 70 is any or no amino acid
  Variant (72)..(73): Xaa in position 72 to 73 is any amino acid
  Variant (77)..(77): Xaa in position 77 is any amino acid
  Variant (81)..(106): Xaa in position 81 to 106 is any amino acid
  Variant (107)..(116): Xaa in position 107 to 116 is any or no amino acid
  Variant (118)..(141): Xaa in position 118 to 141 is any amino acid
  Variant (142)..(184): Xaa in position 142 to 184 is any or no amino acid
  Variant (186)..(187): Xaa in position 186 to 187 is any amino acid
  Variant (189)..(190): Xaa in position 189 to 190 is any amino acid
  Variant (192)..(222): Xaa in position 192 to 222 is any amino acid
  Variant (223)..(245): Xaa in position 223 to 245 is any or no amino acid
  Variant (247)..(248): Xaa in position 247 to 248 is any amino acid
  Variant (250)..(252): Xaa in position 250 to 252 is any amino acid
PNXXXXXRXXXXPXXXXXXXXXXXXXXXXXXXXXXXXXXXXAXXXXXXXXXXDXXDGXXARXXXXXXXXXGXXLDPXADKXXXXXXXXXXXXXXXXXXXXXXXXXXXXXXXXXXXXRXXXXXXXXXXXXXXXXXXXXXXXXXXXXXXXXXXXXXXXXXXXXXXXXXXXXXXXXXXXXXXXXXXXKXXTXXQXXXXXXXXXXXXXXXXXXXXXXXXXXXXXXXXXXXXXXXXXXXXXXXXXXXXXXTXXSXXXY

SEQ ID NO: 9477 - protein, 21 aa, Artificial sequence
  protein pattern
  Variant (3)..(7): Xaa in position 3 to 7 is any amino acid
  Variant (8)..(8): Xaa in position 8 is Ser or Thr
  Variant (9)..(10): Xaa in position 9 to 10 is any amino acid
  Variant (12)..(12): Xaa in position 12 is Ala, Ser or Thr
  Variant (13)..(13): Xaa in position 13 is any amino acid
  Variant (14)..(14): Xaa in position 14 is Ile, Leu or Val
  Variant (17)..(17): Xaa in position 17 is Leu, Met or Val
  Variant (21)..(21): Xaa in position 21 is Phe, Ile, Leu, Met or Val
ARXXXXXXXXGXXXDPXADKX

SEQ ID NO: 9478 - protein, 19 aa, Artificial sequence
  protein pattern
  Variant (3)..(3): Xaa in position 3 is any amino acid
  Variant (4)..(4): Xaa in position 4 is Ile, Leu or Val
  Variant (5)..(5): Xaa in position 5 is Cys, Ser or Thr
  Variant (6)..(7): Xaa in position 6 to 7 is any amino acid
  Variant (9)..(12): Xaa in position 9 to 12 is any amino acid
  Variant (14)..(14): Xaa in position 14 is any amino acid
  Variant (15)..(15): Xaa in position 15 is Phe, Ile, Leu or Val
  Variant (16)..(18): Xaa in position 16 to 18 is any amino acid
  Variant (19)..(19): Xaa in position 19 is Phe, Ile, Leu or Val
PNXXXXXRXXXXPXXXXXX

SEQ ID NO: 9479 - DNA, 1605 bp, SACCHAROMYCES CEREVISIAE
  CDS (1)..(1605)
atgtacaccaattattcacttacaagcagtgacgcaatgccccgaacttacttggtcggcacagcctcaccagaaatgtctaagaaaaagcgccagtctgcaaattgtgacaagccaacgaggagggtgatccacatcatcgatactaatgagcactcagaagtcgacttgaaaaatgaactgccaataacatgcacgaatgaagacggtgagatgacatcaagctcatggacttcacaaaccgctaatgattttctcaaactggcatacgtaaacgcgaaattagacccgtctttgccatctcaatatttcaaacaagatatcataaatgttttacaaagcttggagattcctggatggtctgtgcccggctctaaagaatcctcgttgaataagaatttattaactttgacacaaatcaagggggcccttacaaatgttatttataagattcactatccaaacttaccccctttactgatgagaatttttggtgatagcatagattctgtaattgatagagagtatgaattaaaggttattgcgagattatcattttatgatttaggacccaaactagaagggttttttgaaaatggcagatttgaaaaatacattgagggttcgaggacatctactcaagccgactttatagatcgggatacttcaataaaaattgctaaaaaattgaaagagttgcattgtactgttccattaacgcataaagaaataacggatcaaccgtcatgctggacaacctttgatcagtggatcaaattaatagactcgcataaagagtgggtttccaataatgtaaatataagtgaaaatttacgctgttcaagttggaatttttttttaaagagtttcaaaaattataagcgttggttgtataatgattctgcttttacctcaaaattattaagagaggatgataaagatagtatgataaattctgggctaaaaatggtattttgccataacgacttacagcatggtaatttactttttaaaagtaagggtaaggatgacatctcagtgggcgatttaacaattattgactttgagtacgcaggccctaaccccgttgtatttgatttatcaaatcatttgaatgaatggatgcaagactataatgatgtgcagtctttcaagtctcatattgataagtatccaaaagaagaagatattttagtttttgcacaaagttatataaatcacatgaatgagaaccatgtcaaaattgcttctcaagaggttaggattctttacaatctaatcatcgaatggaggccttgtacacaattattctggtgcctttgggctcttttgcaaagcggaaggctaccacaacgaccactgatagaaggtgaaaaactaatgagcgaaaaggctggactaggtgatgaaacgcaccttatggagcacaaaaataaagagaatggaaaatacgattgttctgaagatgattcgttcaactatttaggattttgtaaagaaaaaatgtctgtcttttggggcgatttaattacattgggagttatcgacaaagactgcccagatattggaaaaacagattacttagacactaaacttattttttaa

SEQ ID NO: 9480 - protein, 534 aa, SACCHAROMYCES CEREVISIAE
MYTNYSLTSSDAMPRTYLVGTASPEMSKKKRQSANCDKPTRRVIHIIDTNEHSEVDLKNELPITCTNEDGEMTSSSWTSQTANDFLKLAYVNAKLDPSLPSQYFKQDIINVLQSLEIPGWSVPGSKESSLNKNLLTLTQIKGALTNVIYKIHYPNLPPLLMRIFGDSIDSVIDREYELKVIARLSFYDLGPKLEGFFENGRFEKYIEGSRTSTQADFIDRDTSIKIAKKLKELHCTVPLTHKEITDQPSCWTTFDQWIKLIDSHKEWVSNNVNISENLRCSSWNFFLKSFKNYKRWLYNDSAFTSKLLREDDKDSMINSGLKMVFCHNDLQHGNLLFKSKGKDDISVGDLTIIDFEYAGPNPVVFDLSNHLNEWMQDYNDVQSFKSHIDKYPKEEDILVFAQSYINHMNENHVKIASQEVRILYNLIIEWRPCTQLFWCLWALLQSGRLPQRPLIEGEKLMSEKAGLGDETHLMEHKNKENGKYDCSEDDSFNYLGFCKEKMSVFWGDLITLGVIDKDCPDIGKTDYLDTKLIF

SEQ ID NO: 9481 - DNA, 1611 bp, Saccharomyces pastorianus
  CDS (1)..(1611)
atgtatagcaattattcacttgcgagcaacgacgcaatgacccgagcttacctggttggcacagcctcacccaaaagatccaagaaaaagcaccagcaagcaaggtatagcaaatcgccaaaaagggcgacccatctcatcaatgctgataatatttcagtactcgagtataagaatgaattgtcgacaatttcctctaatggagatgatgacatggcttcaggctcgtggaattcacaagctcctaacgattttatcaaattagcatacgtaaacgcaaagctagacccatcattatcatcagaatattttaagcaagacattataaacatcctccagagtttagaaatccatgggtggtccattaacgagcctggatcttcgttgaacagagatttattaactttgacgaagatcaaaggtgctctaacaaacgtcatttataagatccattatccaaacttgccccctttattgatgaggatatttggtgacaacgtggattctgttattgatagagagtatgagttgaagattatttcaagattgtcattttataacttaggtcctaagttagaaggatatttccaaaatggtagatttgaaaaatatattgaaggctcaagaacatcaacacaagctgactttatagaccgggatacttcaatgaaaattgctagaaagtttaaagaattacattgtaccattcctctaacacctaccgagagatctgatgaaccatcgtgttggaagacctttgatcaatggatcaagttgatagatacacataaagaatgggtcagtgataaagagagtataattgaaaatctacgttgttcaagttgggaattttttttaaagagttttaaaagttataaacattggttatataatgattccacctttacatcgaaactattaagaggagacgataaagattgtatgataaatactggcttaaagatggtattctgtcataacgacttacagcatggaaacctactatttaccaacaaggacggtgacaaggtctcgatgaatgatctaacaattatagattttgagtacgcaagcgctaaccccgttgtttttgatttatcaaaccatttgaatgagtggatgcaagattataatgatatacattcgttcaaatctcatgttgataagtacccaaagcaagatgatattttagttttcgcccagaattatataaaccacatgaatgatgaacatgtggaaattgattcacaagctgttaagaccctctataacctcatcatagagtggagaccttgtgcacaactattttggtgtctttgggctctcttgcaaagcggtaagctttcccctcaaccaccaataaaagacaagcatttgatccacgaaaaaaaagtaccgtaccgtgaatcttgtattgttacaggtgataatgacgaagttaaagaagacggtagttacgatgattgccaagatgactcgtttaactatttagggttttgtaaagaaaagatgtctgttttttggggcgacttaattacgatggggattatcagcaaagactgtgcagatgtaggaaagactgactacttagatacaaagtttctgctttag

SEQ ID NO: 9482 - protein, 536 aa, Saccharomyces pastorianus
MYSNYSLASNDAMTRAYLVGTASPKRSKKKHQQARYSKSPKRATHLINADNISVLEYKNELSTISSNGDDDMASGSWNSQAPNDFIKLAYVNAKLDPSLSSEYFKQDIINILQSLEIHGWSINEPGSSLNRDLLTLTKIKGALTNVIYKIHYPNLPPLLMRIFGDNVDSVIDREYELKIISRLSFYNLGPKLEGYFQNGRFEKYIEGSRTSTQADFIDRDTSMKIARKFKELHCTIPLTPTERSDEPSCWKTFDQWIKLIDTHKEWVSDKESIIENLRCSSWEFFLKSFKSYKHWLYNDSTFTSKLLRGDDKDCMINTGLKMVFCHNDLQHGNLLFTNKDGDKVSMNDLTIIDFEYASANPVVFDLSNHLNEWMQDYNDIHSFKSHVDKYPKQDDILVFAQNYINHMNDEHVEIDSQAVKTLYNLIIEWRPCAQLFWCLWALLQSGKLSPQPPIKDKHLIHEKKVPYRESCIVTGDNDEVKEDGSYDDCQDDSFNYLGFCKEKMSVFWGDLITMGIISKDCADVGKTDYLDTKFLL

SEQ ID NO: 9483 - DNA, 1605 bp, Saccharomyces pastorianus
  CDS (1)..(1605)
atgtacaccaattattcacttacaagcagtgacgcaatgccccgaacttacttggtcggcacagcctcaccagaaatgtctaagaaaaagcgccagtctgcaaattgtgacaagccaacgaggagggtgatccacatcatcgatactaatgagcactcagaagtcgacttgaaaaatgaactgccaataacatgcacgaatgaagacggtgagatgacatcaagctcatggacttcacaaaccgctaatgattttctcaagctggcatacgtaaacgcgaaattagacccgtctttgccatctcaatatttcaaacaagatatcataaatgttttacaaagcttggagattcctggatggtctgtgcccggctctaaagaatcctcgttgaataagaatttattaactttgacacgaatcaagggggcccttacaaatgttatttataagattcactatccaaacttaccccctttactgatgagaatttttggtgatagcatagattctgtaattgatagagagtatgaattaaaggttattgcgagattatcattttatgatttaggacccaaactagaagggttttttgaaaatggcagatttgaaaaatacattgagggttcgaggacatctactcaagccgactttatagatcgggatacttcaataaaaattgctaaaaaattgaaagagttgcattgtactgttccattaacgcataaagaaataacggatcaaccgtcatgctggacaacctttgatcagtggatcaaattaatagactcgcataaagagtgggtttccaataatgtaaatataagtgaaaatttacgctgttcaagttggaatttttttttaaagagtttcaaaaattataagcgttggttgtataatgattctgcttttacctcaaaattattaagagaggatgataaagatagtatgataaattctgggctaaaaatggtattttgccataacgacttacagcatggtaatttactttttaaaagtaagggtaaggatgacatctcagtgggcgatttaacaattattgactttgagtacgcaggccctaaccccgttgtatttgatttatcaaatcatttgaatgaatggatgcaagactataatgatgtgcagtctttcaagtctcatattgataagtatccaaaagaagaagatattttagtttttgcacaaagttatataaatcacatgaatgagaaccatgtcaaaattgcttctcaagaggttaggattctttacaatctaatcatcgaatggaggccttgtacacaattattctggtgcctttgggctcttttgcaaagcggaaggctaccacaacgaccactgatagaaggtgaaaaactaatgagcgaaaaggctggactaggtgatgaaacgcaccttatggagcacaaaaataaagagaatggaaaatacgattgttctgaagatgattcgttcaactatttaggattttgtaaagaaaaaatgactgtcttttggggcgatttaattacattgggagttatcgacaaagactgcccagatattggaaaaacagattacttagacactaaacttattttttaa

SEQ ID NO: 9484 - protein, 534 aa, Saccharomyces pastorianus
MYTNYSLTSSDAMPRTYLVGTASPEMSKKKRQSANCDKPTRRVIHIIDTNEHSEVDLKNELPITCTNEDGEMTSSSWTSQTANDFLKLAYVNAKLDPSLPSQYFKQDIINVLQSLEIPGWSVPGSKESSLNKNLLTLTRIKGALTNVIYKIHYPNLPPLLMRIFGDSIDSVIDREYELKVIARLSFYDLGPKLEGFFENGRFEKYIEGSRTSTQADFIDRDTSIKIAKKLKELHCTVPLTHKEITDQPSCWTTFDQWIKLIDSHKEWVSNNVNISENLRCSSWNFFLKSFKNYKRWLYNDSAFTSKLLREDDKDSMINSGLKMVFCHNDLQHGNLLFKSKGKDDISVGDLTIIDFEYAGPNPVVFDLSNHLNEWMQDYNDVQSFKSHIDKYPKEEDILVFAQSYINHMNENHVKIASQEVRILYNLIIEWRPCTQLFWCLWALLQSGRLPQRPLIEGEKLMSEKAGLGDETHLMEHKNKENGKYDCSEDDSFNYLGFCKEKMTVFWGDLITLGVIDKDCPDIGKTDYLDTKLIF

SEQ ID NO: 9485 - DNA, 1749 bp, Saccharomyces cerevisiae
  CDS (1)..(1749)
atggtacaagaatcacgtccagggagtgtaagaagttactcggtcggttaccaagcaaggtccagatcgagttctcaaagaagacattcgttaacacgccaacgttcctcgcaaagactgattagaaccatcagtatcgagtctgatgtgtctaatattactgacgatgacgatttgagagctgtcaatgagggagtagcgggtgtgcaactggacgtctctgaaaccgcaaataagggaccaagaagagcatcagcaactgatgtcacagatagtttgggttcgacttcgtcggaatatattgagattccctttgttaaggaaacattggatgcaagtttaccttcggattatctgaagcaggacatattaaatctcattcagagtttgaagatatccaaatggtataacaacaagaaaatccaaccggtagcacaagatatgaacttagtcaagatctctggtgcgatgacaaacgcaattttcaaagttgaataccctaagttaccatcgttgctattgagaatatacggaccgaatattgataatatcattgacagggaatatgaattgcagattttggctaggctttcattgaaaaatataggtccttccctttacggctgttttgtaaacggtagatttgagcagtttctggagaattctaagactttaacaaaagacgacattagaaactggaagaactctcaaaggattgcaaggagaatgaaggagttacatgtaggtgttcctctcttgagttcagaaaggaagaacgggtcggcttgttggcaaaagattaaccagtggttgcgcacgattgagaaagtcgaccaatgggtgggggatcctaaaaacattgaaaactctttattatgtgagaattggtccaagtttatggatattgtcgatagatatcacaagtggcttatttctcaagaacagggtatagagcaagtcaacaaaaatcttatattctgccataatgatgcccaatacggcaatttacttttcactgctcctgtgatgaacacaccgagcctatacactgcaccttcgtctacatcattgacttcccaatcaagttccttatttccttcgagctccaatgtcattgtagatgatataatcaacccgccaaagcaggagcaaagccaagattccaaattggtcgtcattgattttgaatatgcaggtgccaatcccgccgcatatgatttagcgaatcatctttccgagtggatgtatgattacaacaatgctaaggccccacatcagtgccacgctgatagatatcccgataaagaacaggttttgaatttcttatactcttatgtttcgcatctaaggggtggtgctaaggaacccatagatgaagaggttcaaagactctataagtcaatcattcaatggagacccactgtacaactattttggtcgctctgggccatcctacaaagtggtaaattagagaaaaaagaagcctccactgccatcactagagaagaaattggacccaatggaaaaaaatatatcatcaagactgaacccgaatcccctgaagaagactttgttgaaaatgacgacgagcctgaagctggcgtcagcattgacacgttcgattatatggcttatggtcgtgacaagattgcggtcttttggggcgacctcattggcttaggcataatcaccgaagaagaatgcaaaaatttcagctctttcaagttcctcgatactagttatttgtaa

SEQ ID NO: 9486 - protein, 582 aa, Saccharomyces cerevisiae
MVQESRPGSVRSYSVGYQARSRSSSQRRHSLTRQRSSQRLIRTISIESDVSNITDDDDLRAVNEGVAGVQLDVSETANKGPRRASATDVTDSLGSTSSEYIEIPFVKETLDASLPSDYLKQDILNLIQSLKISKWYNNKKIQPVAQDMNLVKISGAMTNAIFKVEYPKLPSLLLRIYGPNIDNIIDREYELQILARLSLKNIGPSLYGCFVNGRFEQFLENSKTLTKDDIRNWKNSQRIARRMKELHVGVPLLSSERKNGSACWQKINQWLRTIEKVDQWVGDPKNIENSLLCENWSKFMDIVDRYHKWLISQEQGIEQVNKNLIFCHNDAQYGNLLFTAPVMNTPSLYTAPSSTSLTSQSSSLFPSSSNVIVDDIINPPKQEQSQDSKLVVIDFEYAGANPAAYDLANHLSEWMYDYNNAKAPHQCHADRYPDKEQVLNFLYSYVSHLRGGAKEPIDEEVQRLYKSIIQWRPTVQLFWSLWAILQSGKLEKKEASTAITREEIGPNGKKYIIKTEPESPEEDFVENDDEPEAGVSIDTFDYMAYGRDKIAVFWGDLIGLGIITEEECKNFSSFKFLDTSYL

SEQ ID NO: 9487 - DNA, 26 bp, Artificial sequence
  primer
atgtacaccaattattcacttacaag

SEQ ID NO: 9488 - DNA, 29 bp, Artificial sequence
  primer
ttaaaaaataagtttagtgtctaagtaat

SEQ ID NO: 9489 - protein, 579 aa, Artificial sequence
  consensus sequence
  Variant (2)..(6): Xaa in position 2 to 6 is any amino acid
  Variant (8)..(8): Xaa in position 8 is any amino acid
  Variant (10)..(10): Xaa in position 10 is any amino acid
  Variant (13)..(13): Xaa in position 13 is any amino acid
  Variant (14)..(14): Xaa in position 14 is any or no amino acid
  Variant (16)..(19): Xaa in position 16 to 19 is any amino acid
  Variant (21)..(34): Xaa in position 21 to 34 is any amino acid
  Variant (36)..(39): Xaa in position 36 to 39 is any amino acid
  Variant (41)..(45): Xaa in position 41 to 45 is any amino acid
  Variant (46)..(46): Xaa in position 46 is any or no amino acid
  Variant (48)..(54): Xaa in position 48 to 54 is any amino acid
  Variant (56)..(69): Xaa in position 56 to 69 is any amino acid
  Variant (71)..(84): Xaa in position 71 to 84 is any amino acid
  Variant (85)..(101): Xaa in position 85 to 101 is any or no amino acid
  Variant (103)..(105): Xaa in position 103 to 105 is any amino acid
  Variant (108)..(108): Xaa in position 108 is any amino acid
  Variant (111)..(111): Xaa in position 111 is any amino acid
  Variant (113)..(113): Xaa in position 113 is any amino acid
  Variant (115)..(115): Xaa in position 115 is any amino acid
  Variant (120)..(120): Xaa in position 120 is any amino acid
  Variant (122)..(123): Xaa in position 122 to 123 is any amino acid
  Variant (127)..(127): Xaa in position 127 is any amino acid
  Variant (129)..(130): Xaa in position 129 to 130 is any amino acid
  Variant (132)..(145): Xaa in position 132 to 145 is any amino acid
  Variant (146)..(147): Xaa in position 146 to 147 is any or no amino acid
  Variant (149)..(150): Xaa in position 149 to 150 is any amino acid
  Variant (152)..(152): Xaa in position 152 is any amino acid
  Variant (155)..(155): Xaa in position 155 is any amino acid
  Variant (158)..(158): Xaa in position 158 is any amino acid
  Variant (160)..(160): Xaa in position 160 is any amino acid
  Variant (162)..(163): Xaa in position 162 to 163 is any amino acid
  Variant (166)..(166): Xaa in position 166 is any amino acid
  Variant (169)..(169): Xaa in position 169 is any amino acid
  Variant (172)..(172): Xaa in position 172 is any amino acid
  Variant (175)..(175): Xaa in position 175 is any amino acid
  Variant (177)..(179): Xaa in position 177 to 179 is any amino acid
  Variant (181)..(182): Xaa in position 181 to 182 is any amino acid
  Variant (190)..(193): Xaa in position 190 to 193 is any amino acid
  Variant (197)..(200): Xaa in position 197 to 200 is any amino acid
  Variant (203)..(203): Xaa in position 203 is any amino acid
  Variant (205)..(205): Xaa in position 205 is any amino acid
  Variant (207)..(207): Xaa in position 207 is any amino acid
  Variant (209)..(209): Xaa in position 209 is any amino acid
  Variant (215)..(217): Xaa in position 215 to 217 is any amino acid
  Variant (219)..(219): Xaa in position 219 is any amino acid
  Variant (221)..(221): Xaa in position 221 is any amino acid
  Variant (223)..(223): Xaa in position 223 is any amino acid
  Variant (225)..(226): Xaa in position 225 to 226 is any amino acid
  Variant (228)..(233): Xaa in position 228 to 233 is any amino acid
  Variant (235)..(236): Xaa in position 235 to 236 is any amino acid
  Variant (239)..(241): Xaa in position 239 to 241 is any amino acid
  Variant (246)..(248): Xaa in position 246 to 248 is any amino acid
  Variant (251)..(253): Xaa in position 251 to 253 is any amino acid
  Variant (255)..(260): Xaa in position 255 to 260 is any amino acid
  Variant (263)..(266): Xaa in position 263 to 266 is any amino acid
  Variant (269)..(271): Xaa in position 269 to 271 is any amino acid
  Variant (273)..(277): Xaa in position 273 to 277 is any amino acid
  Variant (280)..(284): Xaa in position 280 to 284 is any amino acid
  Variant (286)..(288): Xaa in position 286 to 288 is any amino acid
  Variant (290)..(290): Xaa in position 290 is any amino acid
  Variant (292)..(293): Xaa in position 292 to 293 is any amino acid
  Variant (295)..(296): Xaa in position 295 to 296 is any amino acid
  Variant (298)..(303): Xaa in position 298 to 303 is any amino acid
  Variant (305)..(306): Xaa in position 305 to 306 is any amino acid
  Variant (309)..(322): Xaa in position 309 to 322 is any amino acid
  Variant (323)..(327): Xaa in position 323 to 327 is any or no amino acid
  Variant (329)..(331): Xaa in position 329 to 331 is any amino acid
  Variant (332)..(340): Xaa in position 332 to 340 is any or no amino acid
  Variant (342)..(345): Xaa in position 342 to 345 is any amino acid
  Variant (347)..(354): Xaa in position 347 to 354 is any amino acid
  Variant (356)..(360): Xaa in position 356 to 360 is any amino acid
  Variant (361)..(361): Xaa in position 361 is any or no amino acid
  Variant (364)..(375): Xaa in position 364 to 375 is any amino acid
  Variant (376)..(387): Xaa in position 376 to 387 is any or no amino acid
  Variant (389)..(390): Xaa in position 389 to 390 is any amino acid
  Variant (397)..(398): Xaa in position 397 to 398 is any amino acid
  Variant (401)..(403): Xaa in position 401 to 403 is any amino acid
  Variant (406)..(406): Xaa in position 406 is any amino acid
  Variant (410)..(410): Xaa in position 410 is any amino acid
  Variant (414)..(414): Xaa in position 414 is any amino acid
  Variant (418)..(424): Xaa in position 418 to 424 is any amino acid
  Variant (425)..(425): Xaa in position 425 is any or no amino acid
  Variant (427)..(427): Xaa in position 427 is any amino acid
  Variant (429)..(429): Xaa in position 429 is any amino acid
  Variant (432)..(436): Xaa in position 432 to 436 is any amino acid
  Variant (438)..(438): Xaa in position 438 is any amino acid
  Variant (440)..(442): Xaa in position 440 to 442 is any amino acid
  Variant (444)..(445): Xaa in position 444 to 445 is any amino acid
  Variant (447)..(458): Xaa in position 447 to 458 is any amino acid
  Variant (460)..(461): Xaa in position 460 to 461 is any amino acid
  Variant (464)..(465): Xaa in position 464 to 465 is any amino acid
  Variant (468)..(468): Xaa in position 468 is any amino acid
  Variant (472)..(473): Xaa in position 472 to 473 is any amino acid
  Variant (478)..(478): Xaa in position 478 is any amino acid
  Variant (482)..(482): Xaa in position 482 is any amino acid
  Variant (487)..(487): Xaa in position 487 is any amino acid
  Variant (489)..(499): Xaa in position 489 to 499 is any amino acid
  Variant (500)..(501): Xaa in position 500 to 501 is any or no amino acid
  Variant (503)..(518): Xaa in position 503 to 518 is any amino acid
  Variant (519)..(521): Xaa in position 519 to 521 is any or no amino acid
  Variant (523)..(531): Xaa in position 523 to 531 is any amino acid
  Variant (532)..(537): Xaa in position 532 to 537 is any or no amino acid
  Variant (539)..(539): Xaa in position 539 is any amino acid
  Variant (541)..(541): Xaa in position 541 is any amino acid
  Variant (543)..(548): Xaa in position 543 to 548 is any amino acid
  Variant (550)..(551): Xaa in position 550 to 551 is any amino acid
  Variant (559)..(560): Xaa in position 559 to 560 is any amino acid
  Variant (562)..(562): Xaa in position 562 is any amino acid
  Variant (564)..(566): Xaa in position 564 to 566 is any amino acid
  Variant (567)..(567): Xaa in position 567 is any or no amino acid
  Variant (569)..(576): Xaa in position 569 to 576 is any amino acid
SXXXXXRXYXVGXXAXXXXSXXXXXXXXXXXXXXRXXXXIXXXXXXSXXXXXXXLXXXXXXXXXXXXXXSXXXXXXXXXXXXXXXXXXXXXXXXXXXXXXXVXXXLDXSLXSXYXKQDIXNXXQSLXIXXWXXXXXXXXXXXXXXXXLXXIXGAXTNXIXKXXYPXLPXLLXRIXGXXXDXXIDREYELXXXXRLSXXXXGPXLXGXFXNGRFEXXXEXSXTXTXXDXXXXXXSXXIAXXXKELHXXXPLXXXEXXXXXXCWXXXXQWXXXIXXXXXWVXXXXXIXXXLXCXXWXXFXXXXXXYXXWLXXXXXXXXXXXXXXXXXXXDXXXXXXXXXXXXMXXXXLXXXXXXXXLXXXXXXLFXXXXXXXXXXXXXXXXXXXXXXXXLXXIDFEYAXXNPXXXDLXNHLXEWMXDYNXXXXXXXXHXDXYPXXXXXLXFXXXYXXHXXXXXXXXXXXXVXXLYXXIIXWRPXXQLFWXLWAXLQSGXLXXXXXXXXXXXXXEXXXXXXXXXXXXXXXXXXXEXXXXXXXXXXXXXXXDXFXYXXXXXXKXXVFWGDLIXXGXIXXXXCXXXXXXXXLDT

SEQ ID NO: 9490 - protein, 55 aa, Artificial sequence
  protein pattern
  Variant (2)..(2): Xaa in position 2 is any amino acid
  Variant (4)..(4): Xaa in position 4 is Ile or Val
  Variant (5)..(5): Xaa in position 5 is Glu or His
  Variant (8)..(8): Xaa in position 8 is any amino acid
  Variant (11)..(11): Xaa in position 11 is Pro or Ser
  Variant (14)..(14): Xaa in position 14 is Leu or Met
  Variant (17)..(17): Xaa in position 17 is Phe or Tyr
  Variant (19)..(19): Xaa in position 19 is Asp or Pro
  Variant (20)..(20): Xaa in position 20 is Asn or Ser
  Variant (21)..(21): Xaa in position 21 is Ile or Val
  Variant (23)..(23): Xaa in position 23 is Asn or Ser
  Variant (24)..(24): Xaa in position 24 is Ile or Val
  Variant (32)..(32): Xaa in position 32 is any amino acid
  Variant (33)..(33): Xaa in position 33 is Ile or Val
  Variant (34)..(34): Xaa in position 34 is Ile or Leu
  Variant (35)..(35): Xaa in position 35 is Ala or Ser
  Variant (39)..(39): Xaa in position 39 is Phe or Leu
  Variant (40)..(40): Xaa in position 40 is any amino acid
  Variant (41)..(41): Xaa in position 41 is Asp or Asn
  Variant (42)..(42): Xaa in position 42 is Ile or Leu
  Variant (45)..(45): Xaa in position 45 is any amino acid
  Variant (47)..(47): Xaa in position 47 is any amino acid
  Variant (49)..(49): Xaa in position 49 is any amino acid
  Variant (51)..(51): Xaa in position 51 is any amino acid
IXKXXYPXLPXLLXRIXGXXXDXXIDREYELXXXXRLSXXXXGPXLXGXFXNGRF

SEQ ID NO: 9491 - protein, 57 aa, Artificial sequence
  protein pattern
  Variant (2)..(5): Xaa in position 2 to 5 is any amino acid
  Variant (6)..(7): Xaa in position 6 to 7 is any or no amino acid
  Variant (9)..(10): Xaa in position 9 to 10 is any or no amino acid
  Variant (12)..(12): Xaa in position 12 is Ala or Leu
  Variant (13)..(13): Xaa in position 13 is any amino acid
  Variant (14)..(14): Xaa in position 14 is Asn or Ser
  Variant (16)..(16): Xaa in position 16 is Ile or Val
  Variant (17)..(17): Xaa in position 17 is Asn or Ser
  Variant (19)..(19): Xaa in position 19 is Leu or Met
  Variant (20)..(20): Xaa in position 20 is Asn or Arg
  Variant (21)..(21): Xaa in position 21 is Asp, Glu or Gly
  Variant (22)..(22): Xaa in position 22 is Glu, Gly or Asn
  Variant (23)..(24): Xaa in position 23 to 24 is any amino acid
  Variant (25)..(25): Xaa in position 25 is Glu or Lys
  Variant (26)..(26): Xaa in position 26 is Ile or Pro
  Variant (27)..(27): Xaa in position 27 is any amino acid
  Variant (28)..(28): Xaa in position 28 is Asp or Ser
  Variant (29)..(29): Xaa in position 29 is Glu or Gln
  Variant (30)..(30): Xaa in position 30 is Ala or Glu
  Variant (32)..(33): Xaa in position 32 to 33 is any amino acid
  Variant (36)..(37): Xaa in position 36 to 37 is any amino acid
  Variant (40)..(40): Xaa in position 40 is Glu or Gln
  Variant (44)..(44): Xaa in position 44 is Cys or Thr
  Variant (45)..(45): Xaa in position 45 is Ala, Thr or Val
  Variant (50)..(50): Xaa in position 50 is Cys or Ser
  Variant (54)..(54): Xaa in position 54 is Ile or Leu
PXXXXXXVXXFXXXYXXHXXXXXXXXXXXXVXXLYXXIIXWRPXXQLFWXLWAXLQS

SEQ ID NO: 9492 - protein, 62 aa, Artificial sequence
  protein pattern
  Variant (2)..(2): Xaa in position 2 is Lys or Arg
  Variant (4)..(4): Xaa in position 4 is any amino acid
  Variant (6)..(6): Xaa in position 6 is any amino acid
  Variant (7)..(7): Xaa in position 7 is Ala or Asp
  Variant (9)..(9): Xaa in position 9 is Phe or Ile
  Variant (10)..(10): Xaa in position 10 is any amino acid
  Variant (11)..(11): Xaa in position 11 is Asp or Asn
  Variant (12)..(12): Xaa in position 12 is any amino acid
  Variant (13)..(13): Xaa in position 13 is Asp or Lys
  Variant (14)..(14): Xaa in position 14 is Asn or Thr
  Variant (16)..(17): Xaa in position 16 to 17 is any or no amino acid
  Variant (19)..(20): Xaa in position 19 to 20 is any or no amino acid
  Variant (22)..(23): Xaa in position 22 to 23 is Lys or Arg
  Variant (24)..(24): Xaa in position 24 is Phe, Leu or Met
  Variant (29)..(29): Xaa in position 29 is Cys or Val
  Variant (30)..(30): Xaa in position 30 is Gly or Thr
  Variant (31)..(31): Xaa in position 31 is Ile or Val
  Variant (34)..(36): Xaa in position 34 to 36 is any amino acid
  Variant (38)..(39): Xaa in position 38 to 39 is any amino acid
  Variant (40)..(40): Xaa in position 40 is Asp or Asn
  Variant (41)..(41): Xaa in position 41 is Glu, Gly or Gln
  Variant (42)..(42): Xaa in position 42 is Pro or Ser
  Variant (43)..(43): Xaa in position 43 is Ala or Ser
  Variant (46)..(47): Xaa in position 46 to 47 is any amino acid
  Variant (48)..(48): Xaa in position 48 is Phe or Ile
  Variant (49)..(49): Xaa in position 49 is Asp or Asn
  Variant (52)..(52): Xaa in position 52 is Ile or Leu
  Variant (53)..(53): Xaa in position 53 is Lys or Arg
  Variant (54)..(54): Xaa in position 54 is any amino acid
  Variant (56)..(56): Xaa in position 56 is Asp or Glu
  Variant (57)..(58): Xaa in position 57 to 58 is any amino acid
  Variant (59)..(59): Xaa in position 59 is Asp or Lys
  Variant (60)..(60): Xaa in position 60 is Glu or Gln
SXTXTXXDXXXXXXSXXIXXAXXXKELHXXXPLXXXEXXXXXXCWXXXXQWXXXIXXXXXWV

SEQ ID NO: 9493 - protein, 38 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any or no amino acid
  Variant (11)..(11): Xaa in position 11 is Gly or Ser
  Variant (12)..(12): Xaa in position 12 is Ala or Pro
  Variant (15)..(16): Xaa in position 15 to 16 is Ala or Val
  Variant (17)..(17): Xaa in position 17 is Phe or Tyr
  Variant (20)..(20): Xaa in position 20 is Ala or Ser
  Variant (24)..(24): Xaa in position 24 is Asn or Ser
  Variant (28)..(28): Xaa in position 28 is any amino acid
  Variant (32)..(32): Xaa in position 32 is Asp or Asn
  Variant (33)..(33): Xaa in position 33 is Ala, Ile or Val
  Variant (34)..(34): Xaa in position 34 is any amino acid
  Variant (35)..(35): Xaa in position 35 is Ala or Ser
  Variant (36)..(36): Xaa in position 36 is any amino acid
  Variant (37)..(37): Xaa in position 37 is His or Lys
  Variant (38)..(38): Xaa in position 38 is Gln or Ser
LXXIXDFEYAXXNPXXXDLXNHLXEWMXDYNXXXXXXX

SEQ ID NO: 9494 - protein, 28 aa, Artificial sequence
  protein pattern
  Variant (2)..(2): Xaa in position 2 is Ser or Thr
  Variant (4)..(4): Xaa in position 4 is Asp or Asn
  Variant (6)..(6): Xaa in position 6 is any amino acid
  Variant (7)..(8): Xaa in position 7 to 8 is any or no amino acid
  Variant (10)..(10): Xaa in position 10 is any amino acid
  Variant (11)..(11): Xaa in position 11 is Cys or Asp
  Variant (13)..(14): Xaa in position 13 to 14 is any amino acid
  Variant (15)..(16): Xaa in position 15 to 16 is any or no amino acid
  Variant (24)..(24): Xaa in position 24 is Gly or Thr
  Variant (25)..(25): Xaa in position 25 is Leu or Met
  Variant (27)..(27): Xaa in position 27 is Ile or Val
DXFXYXXXGXXKXXXXVFWGDLIXXGXI

SEQ ID NO: 9495 - protein, 22 aa, Artificial sequence
  protein pattern
  Variant (2)..(2): Xaa in position 2 is Glu or Asn
  Variant (3)..(3): Xaa in position 3 is Gln, Ser or Thr
  Variant (4)..(4): Xaa in position 4 is Gly or Val
  Variant (5)..(5): Xaa in position 5 is any amino acid
  Variant (7)..(8): Xaa in position 7 to 8 is any amino acid
  Variant (9)..(9): Xaa in position 9 is any or no amino acid
  Variant (15)..(15): Xaa in position 15 is Ala or Leu
  Variant (17)..(17): Xaa in position 17 is His or Tyr
IXXXXKXXXFCHNDXQXGNLLF

SEQ ID NO: 9496 - protein, 47 aa, Artificial sequence
  protein pattern
  Variant (2)..(2): Xaa in position 2 is any amino acid
  Variant (3)..(3): Xaa in position 3 is Ala, Gly or Thr
  Variant (4)..(4): Xaa in position 4 is Ala, Pro or Ser
  Variant (5)..(5): Xaa in position 5 is Asn or Thr
  Variant (6)..(6): Xaa in position 6 is Asp or Ser
  Variant (7)..(9): Xaa in position 7 to 9 is any amino acid
  Variant (10)..(10): Xaa in position 10 is Ile or Leu
  Variant (11)..(11): Xaa in position 11 is Ala or Glu
  Variant (12)..(12): Xaa in position 12 is any amino acid
  Variant (13)..(13): Xaa in position 13 is Pro or Val
  Variant (14)..(14): Xaa in position 14 is any amino acid
  Variant (15)..(15): Xaa in position 15 is Ala or Val
  Variant (17)..(18): Xaa in position 17 to 18 is any or no amino acid
  Variant (21)..(21): Xaa in position 21 is Ala or Pro
  Variant (24)..(24): Xaa in position 24 is Pro or Ser
  Variant (26)..(26): Xaa in position 26 is Asp, Glu or Gln
  Variant (28)..(28): Xaa in position 28 is Phe or Leu
  Variant (33)..(33): Xaa in position 33 is Ile or Leu
  Variant (35)..(35): Xaa in position 35 is any or no amino acid
  Variant (37)..(37): Xaa in position 37 is any amino acid
  Variant (38)..(38): Xaa in position 38 is Gln or Ser
  Variant (39)..(42): Xaa in position 39 to 42 is any amino acid
  Variant (43)..(43): Xaa in position 43 is Gly or Ser
  Variant (44)..(46): Xaa in position 44 to 46 is any amino acid
  Variant (47)..(47): Xaa in position 47 is Asn or Pro
SXXXXXXXXXXXXXXKXXLDXSLXSXYXKQDIXNXLXXXXXXXXXXX

SEQ ID NO: 9497 - protein, 24 aa, Artificial sequence
  protein pattern
  Variant (2)..(2): Xaa in position 2 is Asn, Arg or Ser
  Variant (3)..(3): Xaa in position 3 is Asp or Pro
  Variant (4)..(4): Xaa in position 4 is Ala or Gly
  Variant (5)..(5): Xaa in position 5 is any amino acid
  Variant (6)..(6): Xaa in position 6 is Pro, Thr or Val
  Variant (8)..(8): Xaa in position 8 is Ala, Ser or Thr
  Variant (10)..(10): Xaa in position 10 is any amino acid
  Variant (13)..(13): Xaa in position 13 is any amino acid
  Variant (14)..(14): Xaa in position 14 is any or no amino acid
  Variant (16)..(16): Xaa in position 16 is any or no amino acid
  Variant (18)..(20): Xaa in position 18 to 20 is any amino acid
  Variant (22)..(22): Xaa in position 22 is any amino acid
  Variant (23)..(24): Xaa in position 23 to 24 is Lys or Arg
SXXXXXRXYXVGXXAXSXXXSXXX

SEQ ID NO: 9498 - protein, 18 aa, Artificial sequence
  protein pattern
  Variant (2)..(2): Xaa in position 2 is Glu or Ser
  Variant (3)..(3): Xaa in position 3 is Asn or Ser
  Variant (5)..(5): Xaa in position 5 is Glu, Asn or Ser
  Variant (6)..(6): Xaa in position 6 is any amino acid
  Variant (8)..(8): Xaa in position 8 is Leu or Met
  Variant (9)..(9): Xaa in position 9 is Asp or Lys
  Variant (10)..(10): Xaa in position 10 is any amino acid
  Variant (11)..(11): Xaa in position 11 is Phe or Val
  Variant (12)..(12): Xaa in position 12 is Asp or Lys
  Variant (13)..(13): Xaa in position 13 is Asn, Arg or Ser
  Variant (15)..(15): Xaa in position 15 is any or no amino acid
  Variant (17)..(17): Xaa in position 17 is any or no amino acid
CXXWXXFXXXXXXYXKXW

SEQ ID NO: 9499 - protein, 12 aa, Artificial sequence
  protein pattern
  Variant (2)..(2): Xaa in position 2 is any amino acid
  Variant (3)..(3): Xaa in position 3 is Asp or Asn
  Variant (4)..(4): Xaa in position 4 is Phe, Ile or Val
  Variant (5)..(5): Xaa in position 5 is Gly or Ser
  Variant (6)..(7): Xaa in position 6 to 7 is any amino acid
  Variant (8)..(8): Xaa in position 8 is Asp or Lys
  Variant (9)..(9): Xaa in position 9 is Phe or Tyr
CXXXXXXXXLDT

SEQ ID NO: 9500 - DNA, 843 bp, SACCHAROMYCES CEREVISIAE
  CDS (1)..(843)
atgtcgcaagaaattaggcaaaatgagaaaatcagttatcgtattgaaggaccattcttcattattcacttaatgaaccctgacaatttgaatgcactagaaggtgaagactatatttatttaggagagttactagaactagcggacagaaatcgtgatgtatattttacaattatacaaagcagtggtagatttttttccagtggtgctgatttcaagggtattgcaaaagcccaagggaatgataccaataaatatccttcggaaacaagcaagtgggtgtcaaattttgtcgctagaaatgtttatgtcactgatgccttcatcaagcattccaaagttttaatttgctgtttgaatggaccagcaatagggttgagcgcggcactggtagcgttatgtgacattgtgtacagtataaatgacaaggtttatttgctatacccctttgctaacttaggactaattaccgaaggtggtacaacggtctctttgccattgaagtttggcacaaatacgacgtatgaatgcctcatgttcaacaaaccattcaagtacgatataatgtgcgagaacggatttataagcaagaattttaacatgccatcttcaaacgctgaagcgttcaatgcaaaggtcttagaagaattgagggagaaagtgaaagggctatacctgcccagttgcttagggatgaaaaaattgctgaaatcgaaccacatcgatgcattcaataaggctaactcagtggaagtaaatgaatctctcaagtattgggtagatggagagcccttaaaaagatttaggcagctgggctcgaaacaaaggaagcatcgtttatga

SEQ ID NO: 9501 - protein, 280 aa, SACCHAROMYCES CEREVISIAE
MSQEIRQNEKISYRIEGPFFIIHLMNPDNLNALEGEDYIYLGELLELADRNRDVYFTIIQSSGRFFSSGADFKGIAKAQGNDTNKYPSETSKWVSNFVARNVYVTDAFIKHSKVLICCLNGPAIGLSAALVALCDIVYSINDKVYLLYPFANLGLITEGGTTVSLPLKFGTNTTYECLMFNKPFKYDIMCENGFISKNFNMPSSNAEAFNAKVLEELREKVKGLYLPSCLGMKKLLKSNHIDAFNKANSVEVNESLKYWVDGEPLKRFRQLGSKQRKHRL

SEQ ID NO: 9502 - DNA, 774 bp, Pseudomonas aeruginosa PAO1
  CDS (1)..(774): transl_table=11
atgagcgagctgattcgggtcgaacgcgaaacggggctgctgaccctgcgcctggaccgccaggacaagaagaacgcgctgacccgcgcgatgtacagccggatggccgaggcgctgctggaggcgcaggccgatacggctgtgcgggtggtgctgatcactggcggcgacgcctgcttcaccagcggcaacgacatcctcgacttcctcgagcaaccgccatccctgcgcgacagcccggtcggccgcttcatgagcgccctgctggaattccccaagccggtgatcgccgcggtgaacggaccggcggtgggtatcggcaccaccctgctgctgcattgcgatctggtcttcgttggtcgcaacgcgcgattgaagatgccgttcgtcaacctcggcctgacaccggagttcggctcgagcctgatcctgccgcgcatgctcggtcatgccaaggctgcggaattgctgatgctcggccaggacttcagcggcgagcaggcggcggcctggggcctggccaatgcggcgctggaggatggcgccacggtgctggagcacgcccgcgatgcggcccggcgcttcctgcacctggcgccctcggcggtagtggagagcaagcgcctgatgaaagcgccgtttatcgaggagcttcgccgggtgatcgccgaggaaggcgatatcttcagcacccgtctgcgctcgcccgaggcgatcgaggcgctcagcgccttcatgcaccggcgccagccggatttctccaggttcgcctga

SEQ ID NO: 9503 - protein, 257 aa, Pseudomonas aeruginosa PAO1
MSELIRVERETGLLTLRLDRQDKKNALTRAMYSRMAEALLEAQADTAVRVVLITGGDACFTSGNDILDFLEQPPSLRDSPVGRFMSALLEFPKPVIAAVNGPAVGIGTTLLLHCDLVFVGRNARLKMPFVNLGLTPEFGSSLILPRMLGHAKAAELLMLGQDFSGEQAAAWGLANAALEDGATVLEHARDAARRFLHLAPSAVVESKRLMKAPFIEELRRVIAEEGDIFSTRLRSPEAIEALSAFMHRRQPDFSRFA

SEQ ID NO: 9504 - DNA, 801 bp, Bordetella bronchiseptica RB50
  CDS (1)..(801): transl_table=11
atgtccgaattcacgcccaagaccatcctggtggaagtccgcgaccacgtcgcgtggatcaccatcaaccgccccgacgccatgaacgccctggcgcgcgaaaccgtcatcgagatcgaccaggcgctgcagctgctcgaggcgcgcgccgacgtccatgcgctggtgttcaccggccagggccgcgccttctgcgccggcggcgacctgaagtacttcaaggaaaccgtgggcagcggcgacatgaacaagttccgcgcctacctgaacctctgccagaacatgtaccgccgcgtcgagaacttcccgcacccgaccatcgcggccgtcaatggcgtggcggtggccggcggcatggaactgatcatttcctgcgacctggtcatcgccgccgagtcggccaagatcggcgacgggcacgccaacttcggcatcatcccgggcggcggcggggcgatccgcctgccgcgcaagatccccatggccctggccaagcgcctgctgttcaccggcaacctgctgcccgcccgggagctggccgagtacggcctggtgaaccaggtggtcccggacgaacagttgaccgaggccgtccaggccttgctagcccagatcaccaagaattcgccgctgggcgtgcgcctgatcaagcagctgatcaacgacggctacgagcagcccctggacacggcgctgcggctcgaagtggtggcctgggaaagctatggcctgagcaacgacatcaaggaagggctgcaggccttccaggacaagcgcaagcccaggttctccggaacctga

SEQ ID NO: 9505 - protein, 266 aa, Bordetella bronchiseptica RB50
MSEFTPKTILVEVRDHVAWITINRPDAMNALARETVIEIDQALQLLEARADVHALVFTGQGRAFCAGGDLKYFKETVGSGDMNKFRAYLNLCQNMYRRVENFPHPTIAAVNGVAVAGGMELIISCDLVIAAESAKIGDGHANFGIIPGGGGAIRLPRKIPMALAKRLLFTGNLLPARELAEYGLVNQVVPDEQLTEAVQALLAQITKNSPLGVRLIKQLINDGYEQPLDTALRLEVVAWESYGLSNDIKEGLQAFQDKRKPRFSGT

SEQ ID NO: 9506 - DNA, 774 bp, Nasonia vitripennis
  CDS (1)..(774)
atggaaaataaacaagacgatttgatattaacgagtattgaaaatggagtacagaaggttttttttaataggccgacaaagaaaaatgctctcactagagagatgtataccagagtgatagagatcctaaatgagtcagcaaataacaaagaagtcacagtgcttgtgttcacaggaattggtgatttttacagcagtggaaacgattttattagctatctcacagatgaatccgtagattcgagtgttgaaacagtcagacttcagaaatttattgacttgcttataacatacccaaaacttttgattgctattgctaatggaccagctattggaatagccgctactacattggcactttttgatattgtttatgcatccgaaactgcttattttatgacaccattctgtaaactgggactatctccagaaggttgctcttcgtacacttttccaagaatcatgggcccatctaaggctggagagatgctattttttggagaaaaactgactgcaaataaagctgccagggttggatttgtgagtaaagtttacaaagctggtgcaattgatgaagtgtggacacacataggaaagattgctaatctttctaaagagagtatggcctcaaccaaaaggctactcagccagtggaacaaaaacttactcatggaagtaaacaatcaagaattaatagaacttagaaaagtctatgcttccccaagtttcgcagaaaacatggtgaagtttatgtcaagaaaaagcaaaatgtga

SEQ ID NO: 9507 - protein, 257 aa, Nasonia vitripennis
MENKQDDLILTSIENGVQKVFFNRPTKKNALTREMYTRVIEILNESANNKEVTVLVFTGIGDFYSSGNDFISYLTDESVDSSVETVRLQKFIDLLITYPKLLIAIANGPAIGIAATTLALFDIVYASETAYFMTPFCKLGLSPEGCSSYTFPRIMGPSKAGEMLFFGEKLTANKAARVGFVSKVYKAGAIDEVWTHIGKIANLSKESMASTKRLLSQWNKNLLMEVNNQELIELRKVYASPSFAENMVKFMSRKSKM

SEQ ID NO: 9508 - DNA, 843 bp, Magnaporthe grisea 70-15
  CDS (1)..(843)
atgtccggagtcacaaccgtcgaatacaggggccgggtggctgtcatcaccatctgcaacgagcgcaagctcaacgccctcgacctacatggctactatgagctgtcggagaggatgcgcgaggtggccacccacgacgaggtctacgtgaccttgttgacggccaagggccgttttttctcggccggcgccgatgtatccaccatccgcgaccctcccaccacaggcgaggacgacagcggcatcgccgacggtggccgccgccagtggctgcagagctttgtggccttcaacctcaacatcactcaggccttctattcgcaccccaagatcctggtcgtggggctcaacgggcccgtcgtcggcctgtcggccgcgctcgtttcctttgccgacttcatctacgccacgccgtctacctttctgctgacgccgttttcgtcccttggcctggtcgcagagggcggcgcgtcgcgcgccctggtgcagcgcctcggcgttagcaaggccaacgaggccctgctcatgagccgccgcgtccccgccgacgagctgctgcagaccggcttcgtcaacaaggtctttaccgagctcaagggcgccaaggacgacgacgtccggttcaaggagcttgtcctggccgagattgacgacaagctgggcgaccacctcgtgggcgacagcctgatcggcatcaaggagctgatccgccggcccgagatcgatgtgctcgagggccagaacgcgagggaggtctttgccgggcttgggaggtttatgagcggcgtgccgcagcgcgagtttttgaagcttgcctcgggcgagaagcgacacaagctataa

SEQ ID NO: 9509 - protein, 280 aa, Magnaporthe grisea 70-15
MSGVTTVEYRGRVAVITICNERKLNALDLHGYYELSERMREVATHDEVYVTLLTAKGRFFSAGADVSTIRDPPTTGEDDSGIADGGRRQWLQSFVAFNLNITQAFYSHPKILVVGLNGPVVGLSAALVSFADFIYATPSTFLLTPFSSLGLVAEGGASRALVQRLGVSKANEALLMSRRVPADELLQTGFVNKVFTELKGAKDDDVRFKELVLAEIDDKLGDHLVGDSLIGIKELIRRPEIDVLEGQNAREVFAGLGRFMSGVPQREFLKLASGEKRHKL

SEQ ID NO: 9510 - DNA, 813 bp, Gibberella zeae PH-1
  CDS (1)..(813)
atggcagaagaatctattctcgatctcgaatatcgcggccgcacagccattttgacgatccataacgagcgaaagctcaacgctttcactggcgcgcagtactacgaccttgctcagaaactacgagagattgccactcatgatgaggtgttcactacagtaattttgggaaaggggcgcttcttttcagcgggagctgatgtgggaattactcgaaaagcacccggagaagacaaggactcgcataaacaactgctgcaaagctttgtcgccaacaatctaaacatcacccacgcttttgcaacccaccccaaggttctcgtcgttggtctcaatggccccgtcataggcctcacagctgcgctggtcgcctttgccgactttatctactgcgctccttcaacctttcttctcacaccattctcatctatcggtcttgtcgccgagggcggtgcgtcacgggctctggcactgcgtctcggacctgcgagagcgaacgaagcactgctcatgagtcgccgcatcggatctcaagaactggagcgctgtggatttgtcaatgccatatatgacgagggcgacgacgccaagtttagggcgagggtgttgcatgaggtggaggagaggctgggagatcatctcaacggcgacagcttgattgggatcaagaagctacttaggaagccggagatggatatcatgcatacgcagaatgtacatgaagtatttgcaggcctggagagattcttgaccggagtaccgcaggaggagtttgcaaagcttgcaagtggtgccaaacgccacaagctataa

SEQ ID NO: 9511 - protein, 270 aa, Gibberella zeae PH-1
MAEESILDLEYRGRTAILTIHNERKLNAFTGAQYYDLAQKLREIATHDEVFTTVILGKGRFFSAGADVGITRKAPGEDKDSHKQLLQSFVANNLNITHAFATHPKVLVVGLNGPVIGLTAALVAFADFIYCAPSTFLLTPFSSIGLVAEGGASRALALRLGPARANEALLMSRRIGSQELERCGFVNAIYDEGDDAKFRARVLHEVEERLGDHLNGDSLIGIKKLLRKPEMDIMHTQNVHEVFAGLERFLTGVPQEEFAKLASGAKRHKL

SEQ ID NO: 9512 - DNA, 798 bp, Gibberella zeae PH-1
  CDS (1)..(798)
atggcagtgattgaggttgaatacagcggtgccattgcggtcatcgtacttaacaaacccaacaagctgaatgctctgactaaagacgagttctacgagcttgcacgcacacttcaggatgtcggcaaccatgacgaagtggtagcgactgtattgacaggcactggaaggttcttctcagccggcgcagacgtgtcggtttccagacagacgcctgagggcacagatttgtatcgacacaacttgaccgtcacggtagccagcaacatgaatcttgcacgggcgttctatacacaccccaagatcttggtagtagcactcaatggccctgtggttggcatggctgctgcgctgattgcttttgccgattttatttattgcaccccggaaacttatctcttgacaccgttcgctagcttgggcctgataagcgaaggtgtctcatcgatagctttcgcagagcgcatgggaatctcgaaagcaaacgaagctctgattctgtcgaagagaatctccagcaaggagttgcttcaagcaggtttcgtgaaccagatattcgattgtcccgcgcagtcatttcggactgaagtgctcaaggaggtcaaagaaaggtttcatgacggtctgaatgcttcaagcattttgcagattaagaagatgatcagacagagatcaagacgggaattagacgcacagaatgttgatgaagtgtttggagcattggagagaaacgttcaagggattccccagaaggagtttgagaaactgaggagagatgtacagtatctaatgaactaa

SEQ ID NO: 9513 - protein, 265 aa, Gibberella zeae PH-1
MAVIEVEYSGAIAVIVLNKPNKLNALTKDEFYELARTLQDVGNHDEVVATVLTGTGRFFSAGADVSVSRQTPEGTDLYRHNLTVTVASNMNLARAFYTHPKILVVALNGPVVGMAAALIAFADFIYCTPETYLLTPFASLGLISEGVSSIAFAERMGISKANEALILSKRISSKELLQAGFVNQIFDCPAQSFRTEVLKEVKERFHDGLNASSILQIKKMIRQRSRRELDAQNVDEVFGALERNVQGIPQKEFEKLRRDVQYLMN

SEQ ID NO: 9514 - DNA, 861 bp, Candida glabrata CBS 138
  CDS (1)..(861)
atgaaatacgatgaaaagataacttatgtcaaagacggtccatttttcattattaaattcaattctccatcaacactcaattcattaactggtgatgattacatttatattgctgaattgttagggttggcagatgaggacaaggatatttacttcactgtgctacaaagtacgggcagattcttttcaagtggtgcggattttaagagtattgcgatcgctgagcaacatgaagctgcatctaagaagccaaccactactccaaatgaagttgccaggcatcatgatgaattacagaaatggctagcgtatttctcatcaagaaatgttaatgttacgaatgcattcaaccagcatagtaaagttcttgtatgctgtttgaatggacccgtgattgggttctcagcggcgatatgttgtttgtgtgatttggtgtatgtaatgaatgagaaagtgtacatgcttttcccttttgctaaccttggtcttgttactgaaggtgccgtggcaagtaccttacctcgattagttggctctcggagtagttttgaatcgctattgtttgcaaaacctgtcacattccctgaaatgtcaagggcagggttggttaataagaactactcactaaacgacacagacaagttcaatgaccaagtgttagcagaacttaaagaaaagatcgatggcctgcatttaccaagttgtctgggcataaagaaactcatgaagttggaatgggaggatcgcattgaaagaatcaattcacttgaggttaatgatggtgtgaaatattgggtgaaaggtgaacctcagaagaggttcagacaggttggatctaaacagcggaagcataagctttag

SEQ ID NO: 9515 - protein, 286 aa, Candida glabrata CBS 138
MKYDEKITYVKDGPFFIIKFNSPSTLNSLTGDDYIYIAELLGLADEDKDIYFTVLQSTGRFFSSGADFKSIAIAEQHEAASKKPTTTPNEVARHHDELQKWLAYFSSRNVNVTNAFNQHSKVLVCCLNGPVIGFSAAICCLCDLVYVMNEKVYMLFPFANLGLVTEGAVASTLPRLVGSRSSFESLLFAKPVTFPEMSRAGLVNKNYSLNDTDKFNDQVLAELKEKIDGLHLPSCLGIKKLMKLEWEDRIERINSLEVNDGVKYWVKGEPQKRFRQVGSKQRKHKL

SEQ ID NO: 9516 - DNA, 834 bp, Kluyveromyces lactis NRRL Y-1140
  CDS (1)..(834)
atggttgttatagctaaaagtcctaggattgagtatagaaaagagggtattttcttcatcatacaatttactgatcaaaagaagttgaatgccctagatggtaatgattatttatacttagcccatttgttagtagaaaacgataaggatcctgagactgcatttacagttttacagagttccggacggttcttcagcgcaggtgctgatttctcttccataagaaaagagaatacacacaattctgatggtactctacctaagtgggcttctgctttcctaagtagaaatacttatgtcacaaatgctttcattgtgcattccaaacctatcatctgttgtctaaatggacctgcagtagggctaagtgccgcaatcgtgatgatatgtgacattgtatactgtatgaacgataaagtttatttacaattcccatttgctaagattggacttgtcactgagggttcaacctctataactttacccttaaaaattgggtacgcaagagctcaaaacacgctattcttcaataagcctttgacgtacgatattttggaggattcggtttcactgagaaattatcaactagatgattggaaacagtttaatgaacaggcgctatcagatttgaagaaagatgtgaaaggcttaaatctgacaagcataattgttatgaagaaattgattaaggaaacttggatgcagcatttgctccgggcaaatgcctctgaagtaactgatgctatgcctttctggattgatggtatccctcaaagtaactttctgaagatgttgaaaagggcagaagctaatagatccaaatcaagattatga

SEQ ID NO: 9517 - protein, 277 aa, Kluyveromyces lactis NRRL Y-1140
MVVIAKSPRIEYRKEGIFFIIQFTDQKKLNALDGNDYLYLAHLLVENDKDPETAFTVLQSSGRFFSAGADFSSIRKENTHNSDGTLPKWASAFLSRNTYVTNAFIVHSKPIICCLNGPAVGLSAAIVMICDIVYCMNDKVYLQFPFAKIGLVTEGSTSITLPLKIGYARAQNTLFFNKPLTYDILEDSVSLRNYQLDDWKQFNEQALSDLKKDVKGLNLTSIIVMKKLIKETWMQHLLRANASEVTDAMPFWIDGIPQSNFLKMLKRAEANRSKSRL

SEQ ID NO: 9518 - DNA, 939 bp, Debaryomyces hansenii CBS767
  CDS (1)..(939)
atgtctataagacgatcgaggctagtcagctatcaatttatatgccaacgctttggctcacataaaattgaaacctcgcctcttacggaagcttacattgatttaataatgtcggaaggtaaagatattctctatgaggtcagagagaaagtaacaattataactttgaataaccccaaaaaattgaattccttggataaacctcaatatatcttattagctaaattgatggagaaggctgataaggaagaaggcacggtattaaccattcttcaatcaacaggaagatattttagtgcaggggctcagcttggaggtaaagacatgcttaatttagacccgtcggttttgttgagccatgagtattggttaaatgaatttgtatcgaaaaatgtctttttgactgatgtatttcacaaccatacaaaggtattagctgctgcggtaaacggtcctataattggtgtgagtgcagcaatggtagcattgtgcgacttagtgtatgttatggatgaaaccaaaatgcacatcataaccccatttacagctttaggattagttgcagaaggagctagtagttccacatttttcttgcgtttaggttggtctaaggctgcggaagcaataattttagcgaaaccaataccaggtacagaattgaataagttaggattcattaacaaatcgtatcatgagaccaattttgactctgtagaacaatttaatcagaaggttcacgatgatttagtttctcaattcagtggtttgtatgagccatccatattagctaacaaacagttgttaaaggccaatagagaccaattgattaatagtgctagttctagagaagtaatcaaaactttcaataattttgtgcagggaattcctcaactgaggttcatggaaaaaatgcaacaagctagagagaacaaaatgtaa

SEQ ID NO: 9519 - protein, 312 aa, Debaryomyces hansenii CBS767
MSIRRSRLVSYQFICQRFGSHKIETSPLTEAYIDLIMSEGKDILYEVREKVTIITLNNPKKLNSLDKPQYILLAKLMEKADKEEGTVLTILQSTGRYFSAGAQLGGKDMLNLDPSVLLSHEYWLNEFVSKNVFLTDVFHNHTKVLAAAVNGPIIGVSAAMVALCDLVYVMDETKMHIITPFTALGLVAEGASSSTFFLRLGWSKAAEAIILAKPIPGTELNKLGFINKSYHETNFDSVEQFNQKVHDDLVSQFSGLYEPSILANKQLLKANRDQLINSASSREVIKTFNNFVQGIPQLRFMEKMQQARENKM

SEQ ID NO: 9520 - DNA, 831 bp, Debaryomyces hansenii CBS767
  CDS (1)..(831)
atgtccgaaggagaagatattttatacgaagttagagagaaagttaccatcatcactttcaatattccaaagaagttgaatgcattgaacggtgaccagtatttgttgttagccaaattggttgaaagagcagacagggaagaagatactgttatgacattaatacaatcgacaggaagatatttcagtgccggagctaatattgctgacaagggtttgtcgaacgtggatccggagcatcttttcagtcatgaatactggttagataagtttgtggccagaaacgtgtatttgaccgatttattccacaatcatacgaagattttagctgctgcagtcaatgggcctgtaattgggttatctgccgccatgttagccttgtgtgacttggtttatgtcatggatgaaactaagttcttcttgttagcaccattttccaatttgggattggttgctgaaggtgctgccagtgcaacattatttttgagattgggctggtccaagtctgctgaagctttattattggcaagaccaattccaggtaccgaattgaacaagttaggattcatcaacaagaattacggtgatgttaagttcgattctgtcgagcaattcaataaaagagtgcacgatgacttggtcagtcaattccaaggtttatacgaaccctccatatttgctaacaaacaattgttgaaggctaatagagaccaattaatcaacagtgccaactctagagaagtcattaagggtttcaatagatgggtaaagggtgttcctcaagaaagatttatgaaattgtatcaaaaggatatccaacacaagatgtaa

SEQ ID NO: 9521 - protein, 276 aa, Debaryomyces hansenii CBS767
MSEGEDILYEVREKVTIITFNIPKKLNALNGDQYLLLAKLVERADREEDTVMTLIQSTGRYFSAGANIADKGLSNVDPEHLFSHEYWLDKFVARNVYLTDLFHNHTKILAAAVNGPVIGLSAAMLALCDLVYVMDETKFFLLAPFSNLGLVAEGAASATLFLRLGWSKSAEALLLARPIPGTELNKLGFINKNYGDVKFDSVEQFNKRVHDDLVSQFQGLYEPSIFANKQLLKANRDQLINSANSREVIKGFNRWVKGVPQERFMKLYQKDIQHKM

SEQ ID NO: 9522 - DNA, 804 bp, Aspergillus nidulans FGSC A4
  CDS (1)..(804)
atggctgaggaagatcttgttcgccttgatatcaatggcatttttgccgtcatcacgttgaacaaccctagaaagttcaatgccttgacacagagtctatactatcgtcttgcaagcttgcttcgagctgccgaggagaatccagacgtctatgttactgtgctaatcggcgagggcccctttttctccgcaggggctgacctcaaagggaagccaccatctatggaggagatgttgtctcgcccttactggcttccgaaattggtgaataacaacgtcgacgtggcgagagcgttctacagccattcgaagattctggttacggcgctgaacggacctgtcatcgggctttctgcggccttgatatctcactcagactttatctacgcggtatccaacgcctatttgatgactcctttcacctctcttggtcttgttgccgaaggcggctccagtgtcgcatttgtgcagcggatgggccaaggtaaggcaaacgaggcactcctcctcggcaggaagattcctgtcagcgagttggctcaggtcggctttgtgaacaaggtctttgaagacaaaggcaacttccgtgagcaggtgatgggatacctgcagcagatattcggcgaacatttggtgaagtcgagccttctggagacaaaggctctcatgcgtcgtcgcttggttagggagcaggacgaacaagcgccgctagaaatgtttggtggcctcgaccgtttctgccagggcgttccacaggccaagatgggagaggctctttctaagagcaagtcgtctcgactctga

SEQ ID NO: 9523 - protein, 267 aa, Aspergillus nidulans FGSC A4
MAEEDLVRLDINGIFAVITLNNPRKFNALTQSLYYRLASLLRAAEENPDVYVTVLIGEGPFFSAGADLKGKPPSMEEMLSRPYWLPKLVNNNVDVARAFYSHSKILVTALNGPVIGLSAALISHSDFIYAVSNAYLMTPFTSLGLVAEGGSSVAFVQRMGQGKANEALLLGRKIPVSELAQVGFVNKVFEDKGNFREQVMGYLQQIFGEHLVKSSLLETKALMRRRLVREQDEQAPLEMFGGLDRFCQGVPQAKMGEALSKSKSSRL

SEQ ID NO: 9524 - DNA, 804 bp, Candida albicans SC5314
  CDS (1)..(804): transl_table=12
atgtcagacccaatcacttatgaagtcaaagacagagcagtattgattactttgaacaatccaaaaaaactcaactccttaaccataccacaatatgatatactttgcaaattcttagaaagagcaaacaacgaagagggcactatcatcactttgattcaatctacaggcagggtcttctctgcaggtgccaatgctgattttgttacctcccaagataccgaacttgacacttggttgaacttgtcagtggcaaagcaaacatttttggtgcaaacgtttcttgcccacaaaaagatccttgcagtcgctttgaatggacctgctataggattatcagcatcctttgtggcactttgtgatttggtctatgtcaatgacttgtcaaaaacattctttttaactccctttgcaaatattggtattctcgctgaaggtggtacatcggccacacttccaattcgtttaggctggtccaaagctgccgaagcattgttgttgtccaagagaatctctggtcaagatttacaaaatgctgggctcgtaaacaaacactatggagggaaatttaaaacagctgaagagttcaattccaccgtcttgggcgagttgctcgacgctacagaaaacttgcatgttgactcgattttgcaaaataaggaattgttgaaacagatttacaagccagccattagtatggttaactctcaagaagtctccagaggagtttataaatggacttcgggaatccctaaagatagattcaagaaacttgccagtggcgagttaaaacacaagttgtag

SEQ ID NO: 9525 - protein, 267 aa, Candida albicans SC5314
MSDPITYEVKDRAVLITLNNPKKLNSLTIPQYDILCKFLERANNEEGTIITLIQSTGRVFSAGANADFVTSQDTELDTWLNLSVAKQTFLVQTFLAHKKILAVALNGPAIGLSASFVALCDLVYVNDLSKTFFLTPFANIGILAEGGTSATLPIRLGWSKAAEALLLSKRISGQDLQNAGLVNKHYGGKFKTAEEFNSTVLGELLDATENLHVDSILQNKELLKQIYKPAISMVNSQEVSRGVYKWTSGIPKDRFKKLASGELKHKL

SEQ ID NO: 9526 - DNA, 918 bp, Candida albicans SC5314
  CDS (1)..(918): transl_table=12
atgaaaaaaaaaatatatataaactccatgtcttatctctatttttctttatcaaattcacctaaagtatcaaaactattatacacaatgtccgacgaagaagccgatgtcttgtacgaagtcagagatagaactgctatcatcaccttcaatattccttccaaattaaatgccttaaatggtgaacaatatttaaagttgggtaaattcatggaaagggccaacgaagaagaaggcacagtcatgactttgattcaatctacaggtagatttttctctgctggtgccaactttgccgacaacggattgatggatgttgacccccaattgttatttactcacgaatattggttgggaaaatttgttgctagaaacgtttggttgaccaacttgttcaatgaccacaagaagattttggttgctgcagtcaacggtccttccattgggttgagtactgggttgttgatgttggtcgatttggtttacgtccacgatttgagcaaattctatttattggcaccatttgccaacttgggtttggttgctgaaggtgctgcctctgccaccttgtttgccaggttaggatggtccaaagcttcagaagctttattgttggccaagccaattagtggtgctgactgctacaatgttgggttgatcaacaaacactacgacggtaagttcaagtccacagaagaattcaaccaacaggtgtacaaggaagtgaccgatgcatttgaaaacttgcacgaagattcaattcttcaaaacaagcaattgttaaagttgaacagagatcaatacataaaccacgccaactcacaagaagtcatgagaggtttgggtaaatggttagaaggtgttccacaaacaagatttgttcaattggcaaacaaagatgttaaacacaagatttag

SEQ ID NO: 9527 - protein, 305 aa, Candida albicans SC5314
MKKKIYINSMSYLYFSLSNSPKVSKLLYTMSDEEADVLYEVRDRTAIITFNIPSKLNALNGEQYLKLGKFMERANEEEGTVMTLIQSTGRFFSAGANFADNGLMDVDPQLLFTHEYWLGKFVARNVWLTNLFNDHKKILVAAVNGPSIGLSTGLLMLVDLVYVHDLSKFYLLAPFANLGLVAEGAASATLFARLGWSKASEALLLAKPISGADCYNVGLINKHYDGKFKSTEEFNQQVYKEVTDAFENLHEDSILQNKQLLKLNRDQYINHANSQEVMRGLGKWLEGVPQTRFVQLANKDVKHKI

SEQ ID NO: 9528 - DNA, 930 bp, Ustilago maydis 521
  CDS (1)..(930)
atgtcttcggccaagttcacctcacccccacccgttcaacccgactctgtacctgttgccctgtcgttcgcgcacaactgcgacaaccgagtcgccgtaattacgctgaacgccccggaaaagctcaacgctctgggctgggctgactacaaatgtatcacgcaatgcttggaatggatcgctttgcaaccggatatcctcgtcacgattttcactggcaagggacgatacttttccgcaggagccaacgtcaaggatccctcacgcactctgccggaccacgtggcgaaagcggacaccaacacggcgcatggcaaagcgactgtagccgatttttacggcgcacgtgcacaagctggtcaaggtagactggcactggcgctgcgaaagcatcccaagatcttgatcgccgctctgaatggacccgctgtgggactgtcagcggcaatcttgagtcactgtgacctggtgtatgcgtacgacgactttttcttgttcacaccgttcatgtcgctcgctctcgtagctgagggcttgacgtcggtcacttttatcaaaaagatgggccttggtagagcaacagaagcgctgttggaaggccgaagaatgacagcaagtgatctcgagcaaagtggattcatcaccaggctgtactcgaagccagctggatttcatgccaaagacaagcttgctactccacccatcctggaccatgtgctgcagcatgtgagggacaagttcttgtttcccaactacagcgcgttttccctgctgtacacgaaaaaactgctcaacgatgcagcgtatgcttacaccggtctcgacgccgtcaatcaggctgaactcagaggtgcagaatccgtgtttgcatcaggagctcctcagaaacgattcgaaaacatcgccgctggcgcacgtcacaagctctga

SEQ ID NO: 9529 - protein, 309 aa, Ustilago maydis 521
MSSAKFTSPPPVQPDSVPVALSFAHNCDNRVAVITLNAPEKLNALGWADYKCITQCLEWIALQPDILVTIFTGKGRYFSAGANVKDPSRTLPDHVAKADTNTAHGKATVADFYGARAQAGQGRLALALRKHPKILIAALNGPAVGLSAAILSHCDLVYAYDDFFLFTPFMSLALVAEGLTSVTFIKKMGLGRATEALLEGRRMTASDLEQSGFITRLYSKPAGFHAKDKLATPPILDHVLQHVRDKFLFPNYSAFSLLYTKKLLNDAAYAYTGLDAVNQAELRGAESVFASGAPQKRFENIAAGARHKL

SEQ ID NO: 9530 - DNA, 768 bp, Tribolium castaneum
  CDS (1)..(768)
atgtcttcaagggaaataatcctcacccttaaggacggagtccgggtgatccgcatcaaccggcccaaaacaaaaaacgcatttgactcaaacgtctacacaacaatcaccaacacattaactgaagacgcccaaaacgacaacgtggtggtgaccatcatcacgggcacaggggaatattacagcagcggtttcgacattaaaagcgccatgagcaagttcgggggcggcgataccagaggggtagacgagctgaaagccatgattaacgccttcatcatttaccccaaactgttaatcgctctagtcaatggtcctgcaattggcattgcagtcacaactgcagccttgtgcgatatcgtgtacgcgtccgaaagggcaacttttgagacacccttccttcggataggactgtgtgccgagggatgctcaagctacaacttcccgaatatcttgggtcggagcaaggcctcggagatgctctttctggggaagaaaatgacggcgcaggaagcgtatcagtttggatttgttgctgaagtcattccgcatgaacaactggaccagtttgcacacaaactgatgacgcttgggaaggaattatcagtgaatggagtcaaaatcaccaaaaagttgattcttaataattacagaaacgtgctgtgtgaatgtaacgaaagggagttggatcagttggttgaatgttttggctcggaggagttttccgagggcattatgaaatttatgtctcggaaaagtaaattgtag

SEQ ID NO: 9531 - protein, 255 aa, Tribolium castaneum
MSSREIILTLKDGVRVIRINRPKTKNAFDSNVYTTITNTLTEDAQNDNVVVTIITGTGEYYSSGFDIKSAMSKFGGGDTRGVDELKAMINAFIIYPKLLIALVNGPAIGIAVTTAALCDIVYASERATFETPFLRIGLCAEGCSSYNFPNILGRSKASEMLFLGKKMTAQEAYQFGFVAEVIPHEQLDQFAHKLMTLGKELSVNGVKITKKLILNNYRNVLCECNERELDQLVECFGSEEFSEGIMKFMSRKSKL

SEQ ID NO: 9532 - DNA, 777 bp, Ralstonia eutropha JMP134
  CDS (1)..(777): transl_table=11
atgtcttccgaaatccgcaccgaactcgaccacggcatccagacgattacgctttcccgcccggacaagatgaacgctctcacgaacgacatgtacggcacactcgccgatacgatcgagcgcgcacagcaggaccgcaatatccgggtattgctgctgcaggctgatggggacagcttcacggcgggcaacgatttgggcgagttcgcggcgattgctgccggcaagggcccgagcgaacgtcatgtccatcgctttctgcgcgccctggccaattcgaccgtgccggtcgtggtcgcggtgcacggcaatgccgtgggcgtgggcaccaccatgctgctgcattgcgactacgtcgtgcttggcgaagatgccagactggtcacgccgttcgtcaacctcgcgctggttcccgaagcggcttcgagctacctgctgccgctgcgcatcggccacgcacgggcgttccagatgttcgcgctgggcgagtcgcttgatgcgcaaaccgccgtggcatggggcattgccaacaaggtcagcgccagcggcgagttgcgtgcagacgcgcggcgaatggccgagaagcttgccagcaaacccgccggttcactgagcgccatgaagacactcatgcgcgacgcagaaaaactggtcgcgcagatgaccagcgaaagcgcccaattcgaagcacggctggccagcgccgaagcgcgcgaggcattctccgcgttcgccgagaagcgcaagccggacttcgtcaagatcgcccagcaataa

SEQ ID NO: 9533 - protein, 258 aa, Ralstonia eutropha JMP134
MSSEIRTELDHGIQTITLSRPDKMNALTNDMYGTLADTIERAQQDRNIRVLLLQADGDSFTAGNDLGEFAAIAAGKGPSERHVHRFLRALANSTVPVVVAVHGNAVGVGTTMLLHCDYVVLGEDARLVTPFVNLALVPEAASSYLLPLRIGHARAFQMFALGESLDAQTAVAWGIANKVSASGELRADARRMAEKLASKPAGSLSAMKTLMRDAEKLVAQMTSESAQFEARLASAEAREAFSAFAEKRKPDFVKIAQQ

SEQ ID NO: 9534 - DNA, 825 bp, Coprinopsis cinerea okayama7
  CDS (1)..(825)
atggcaagtcctatcattgtccaggtggcagacaagattgcgaccatcaccttggatcggccgcggactctcaatgctctcactcctgaagattatgacaagctcgcgaattcccttcgggaaatagacgctcgagacgacgtcttggtgaccatcctgcaaggaaatggatcgtggttctgcgcaggaacagacgttagaggatcggcagatggagctgttctgagagaggacgggccaaagcaaactgtccgagattctctcaaagccggcgtagtgaatacgaccatggatgttggtcaggctctatactcgcacagaaagatattggtcgctgcgctgaacggacctgtcatgggtattatggccgccttcctcgggtactttgacttcatttatgcactcccaagcgtgtggctgtcctgcccctttaccttcatcggtatcgttgcggaaggtggtgcaagtgtatcatttgtcaatcgaatgggactgggcatggcgaaagaggtgttgatctggggaaagaagaagaacgcacagcaattactcgacgttggtttcatcaacaaaatcttccccacagagtcgaccgagagcttccaccgaactgttcgacaggaggttttgaatgaacttgaagggttggaccctagcgccgttttgacgatgaaggccttgatccaggctggtttgaatgaaaagaataatatggatggcgttaatttgagagaaagctacgcccaagcagcccgctttgcaactggaattccggcgaagcaatttggaaggattgccaggaaggaaatcaaacataagctttga

SEQ ID NO: 9535 - protein, 274 aa, Coprinopsis cinerea okayama7
MASPIIVQVADKIATITLDRPRTLNALTPEDYDKLANSLREIDARDDVLVTILQGNGSWFCAGTDVRGSADGAVLREDGPKQTVRDSLKAGVVNTTMDVGQALYSHRKILVAALNGPVMGIMAAFLGYFDFIYALPSVWLSCPFTFIGIVAEGGASVSFVNRMGLGMAKEVLIWGKKKNAQQLLDVGFINKIFPTESTESFHRTVRQEVLNELEGLDPSAVLTMKALIQAGLNEKNNMDGVNLRESYAQAARFATGIPAKQFGRIARKEIKHKL

SEQ ID NO: 9536 - DNA, 798 bp, Phaeosphaeria nodorum
  CDS (1)..(798)
atgtcatcccaatcctaccccgacattgacttcaccatcaaaggcaaaatcggaataatcaagttcaaccgccccaagtctctcaactccttcggcggctccctcatcccctcgaccatcgccgccctgcgcgtcctcaactcgcatccagagacaattttcacggtgctcacaggcgaagggcgctttttctccgccggtgcggatgtcaaaggtatcgctggtgggaatgacggcgatgccaatgccagcgatgccgagaagaagttgggatttctcgggcggtttagctatgcccaggaactacttcgcagcatgatcgatcataccaaagtgctcattctcgcgctcaacgggcctgcggtcggtggcggtgccgcctggttccccggcatcgcagacatcgtcctggcctccaacaccgcatggcttcaatgccccttctccgctctaggccttgtgccagagaacggctccgccctctcctttgcgcaatccatcggcatccaccgcacaaacgacttcctcatgtacaactacgtctgggacgccacaggcgacgcgttccagcaaaaggttgtatcctttcttgaagagcaattggcagataaagatggcaagagcatgattgaaatgaagcgcctgcaaaacgcgccgattagggatcagaggatgatagcggtagtgaatgccgtggacgcgttggtcgagcgcttcgtcgagggcgcgccgaaggagcggtttgaaatcaagaagaaagagctcgaggagaagagtaaggcgagggcgaagatttga

SEQ ID NO: 9537 - protein, 265 aa, Phaeosphaeria nodorum
MSSQSYPDIDFTIKGKIGIIKFNRPKSLNSFGGSLIPSTIAALRVLNSHPETIFTVLTGEGRFFSAGADVKGIAGGNDGDANASDAEKKLGFLGRFSYAQELLRSMIDHTKVLILALNGPAVGGGAAWFPGIADIVLASNTAWLQCPFSALGLVPENGSALSFAQSIGIHRTNDFLMYNYVWDATGDAFQQKVVSFLEEQLADKDGKSMIEMKRLQNAPIRDQRMIAVVNAVDALVERFVEGAPKERFEIKKKELEEKSKARAKI

SEQ ID NO: 9538 - DNA, 828 bp, Aspergillus oryzae
  CDS (1)..(828)
atggcaaccgaagaccttgtcaagcttacttaccaagaccgaattgcaatcatcacattcaacagaccggagaagctcaatgccctcaaccaagacctctattacctacttggggaacgtcttcgggaaatcgacaagcgcgaggacatcttcatcaccatcctgaccggcaaaggacgattcttctcagccggagcagatgttacatcgacccgtccaagcggcgacctgagcagcaatgtccgccgcgagctcacgcggtcctttgtcgtcaacaacatcgacatcacgaacaccgtggcccaccactccaagatcctggtagctgctttgaacggccctgcggtcggtctttccgctgcactggtcgccatggccgacttcatctacgccacgccgcataccttcctgctcaccccgttctcctctcttggtcttgtcgccgagggtggctcttcgcgcgctcttgtcgagcgccttggcatctctaaggctaatgaggccctcatcatgagcaagaagattacctgtgaggagcttgtggcgactgggttcgtgaacaaggttatctctgcgccgtcgggcaggaaggatgattcggatggtttcctggagaaggtccttgaggaagttgaggatcgtcttggcactcacctgagccagtctagtctcctggggattaaggagttgatccgcagaccagagcgggagattctggaccgtcagaattaccttgaggtgtttgctgggttgcagaggttcctgaaaggtataccccaggaggagttccggcggttggcttcgggagagaagaagcataagctgtag

SEQ ID NO: 9539 - protein, 275 aa, Aspergillus oryzae
MATEDLVKLTYQDRIAIITFNRPEKLNALNQDLYYLLGERLREIDKREDIFITILTGKGRFFSAGADVTSTRPSGDLSSNVRRELTRSFVVNNIDITNTVAHHSKILVAALNGPAVGLSAALVAMADFIYATPHTFLLTPFSSLGLVAEGGSSRALVERLGISKANEALIMSKKITCEELVATGFVNKVISAPSGRKDDSDGFLEKVLEEVEDRLGTHLSQSSLLGIKELIRRPEREILDRQNYLEVFAGLQRFLKGIPQEEFRRLASGEKKHKL

SEQ ID NO: 9540 - DNA, 813 bp, Aspergillus oryzae
  CDS (1)..(813)
atggcagcaccccaaaccgtcacagtcgaatacaacgacaacctcgccatcgtaactctcaacaaccaagagaagctcaatgccctgagtcaagaagactactacaaactagccaccacgctgcgagaaatcgcccagcacgacgaagtcctggtcacgctgttaatcggcaaaggccgcttcttctccgcaggcgcagacgtaacccgcccaccacccgacgccaaaaaaaccccaccccgccagtactggctccgcgccctggtcctcaacaacatcgacctagccgatgccttctacacccatcccaagatcctagtgacagccctgaacggccccgtgataggcctctcagcggcagtcatcgcgcattcggacttcatcttcgcaacaccgaacgcatacctccttaccccgttttcgtcgctcgggcttgtcaccgagggcggggccagtctcgcctttgtgcgccgtcttgggattagcaaggctaaggaggcgttgctttccagccggaggattccggttgaggagttgcagcaggttgggtttgtgaatcaggtgttggatgctggtggagacgaggagaggtttagggagatggtgttgggtgagattcggggtcggtttggggatcatttggtgggttcgagtgttttggagattaagaggttgcttcgggagcctggggatagggagtttggctctcaggcggtgcaggaggtttttggggggttgaggaggtttgtggatgggattcctcaggcggagttcaggaagattgctactggggagaagagacataagctttag

SEQ ID NO: 9541 - protein, 270 aa, Aspergillus oryzae
MAAPQTVTVEYNDNLAIVTLNNQEKLNALSQEDYYKLATTLREIAQHDEVLVTLLIGKGRFFSAGADVTRPPPDAKKTPPRQYWLRALVLNNIDLADAFYTHPKILVTALNGPVIGLSAAVIAHSDFIFATPNAYLLTPFSSLGLVTEGGASLAFVRRLGISKAKEALLSSRRIPVEELQQVGFVNQVLDAGGDEERFREMVLGEIRGRFGDHLVGSSVLEIKRLLREPGDREFGSQAVQEVFGGLRRFVDGIPQAEFRKIATGEKRHKL

SEQ ID NO: 9542 - DNA, 804 bp, Aspergillus oryzae
  CDS (1)..(804)
atggctgaagaggatcttgttcgcctggacatcaacggcatctttgccgtcatcacattgaacaacccaaaaaagtccaacgccttgacgcagagcctgtattatcgcctcgcaagcttgcttcgagaggctgaagataactcagacgtttatgtcaccgtcttaattggcgagggcgcctttttctccgcaggggccgacctcaagggaaagccaccatctatggaggacatgttgtctcgccctcactggcttcctaaattagtgaataacaacatcgacgtggcgagagcgttctacagtcattcgaagattctggtcacggcgctgaatggaccggtcatagggctttctgccgcgttgatatcgcactcggatttcatctacgcggtattcgatgcttggctgatgactcctttcacctctctcggcctcgttgccgagggcggctctagtgtcgcctttgtgcagcggatgggtcagggaaaagcaaacgaggcactccttctcggcaggaagattcccgtcagtgagttggctcaggttggttttgtgaacaaggtcttcgaaagcaaaggcaacttccgtgagcaggtgatggggtacctgcagcagacgttcggcgaacatttggtgaagtcgagtcttctggggacaaaggctttgatgcgtcgtcgcttggttcgggagcaggacgaacaagcgccgctcgagatgtttggtggcctcgaccgtttcttccagggtatcccgcaggcaaagatgggagaggctctgtccaagagcaagacttatcgactttga

SEQ ID NO: 9543 - protein, 267 aa, Aspergillus oryzae
MAEEDLVRLDINGIFAVITLNNPKKSNALTQSLYYRLASLLREAEDNSDVYVTVLIGEGAFFSAGADLKGKPPSMEDMLSRPHWLPKLVNNNIDVARAFYSHSKILVTALNGPVIGLSAALISHSDFIYAVFDAWLMTPFTSLGLVAEGGSSVAFVQRMGQGKANEALLLGRKIPVSELAQVGFVNKVFESKGNFREQVMGYLQQTFGEHLVKSSLLGTKALMRRRLVREQDEQAPLEMFGGLDRFFQGIPQAKMGEALSKSKTYRL

SEQ ID NO: 9544 - DNA, 816 bp, Saccharomyces cerevisiae
  CDS (1)..(816)
atgagcagtcgtgtgtgctaccatattaatggtccctttttcataatcaaattaattgatccaaaacatttgaactctttaactttcgaggattttgtatacattgcactattactgcataaggcaaacgatattgattctgttttgtttactgttctacaaagctcaggcaagtatttctcctcgggaggtaagttttcagcagttaacaagctaaacgatggagacgttacaagcgaagtggagaaagtctcaaagctggtatctgctataagctctcctaacatatttgtggcgaacgcatttgcaatccataaaaaggttctggtgtgctgtttgaatggaccggccatcggacttagcgcatcgctagttgctctttgtgacattgtttactcgcaaaacgattcagtatttcttctttttcccttcagcaatctcggttttgtcgcagaagtgggaacttctgttaccttaactcaaaaactgggtataaattctgcaaacgaacatatgattttcagcacaccagttctatttaaagaattgataggaactattattacaaaaaattatcaattgacaaatactgaaacattcaatgaaaaagttcttcaggacataaagcagaatttagaagggctttatccgaaaagtgtactaggtatgaaagaattgttacacagtgaaatgaaacagaagcttatcaaagcacaagcaatggagactaacggaaccttgcctttttgggcaagcggcgagccattcaaaagatttaaacagcttcaagagggaaacaggcgccacaagttataa

SEQ ID NO: 9545 - protein, 271 aa, Saccharomyces cerevisiae
MSSRVCYHINGPFFIIKLIDPKHLNSLTFEDFVYIALLLHKANDIDSVLFTVLQSSGKYFSSGGKFSAVNKLNDGDVTSEVEKVSKLVSAISSPNIFVANAFAIHKKVLVCCLNGPAIGLSASLVALCDIVYSQNDSVFLLFPFSNLGFVAEVGTSVTLTQKLGINSANEHMIFSTPVLFKELIGTIITKNYQLTNTETFNEKVLQDIKQNLEGLYPKSVLGMKELLHSEMKQKLIKAQAMETNGTLPFWASGEPFKRFKQLQEGNRRHKL

SEQ ID NO: 9546 - DNA, 843 bp, SACCHAROMYCES CEREVISIAE
  CDS (1)..(843)
atgtcgcaagaaattaggcaaaatgagaaaatcagttatcgtattgaaggaccattcttcattattcacttaatgaaccctgacaatttgaatgcactagaaggtgaagactatatttatttaggagagttactagaactagcggacagaaatcgtgatgtatattttacaattatacaaagcagtggtagatttttttccagtggtgctgatttcaagggtattgcaaaagcccaaggggatgataccaataaatatccttcggaaacaagcaagtgggtgtcaaattttgtcgctagaaatgtttatgtcactgatgccttcatcaagcattccaaagttttaatttgctgtttgaatggaccagcaatagggttgagcgcggcactggtagcgttatgtgacattgtgtacagtataaatgacaaggtttatttgctatacccctttgctaacttaggactaattaccgaaggtggtacaacggtctctttgccattgaagtttggcacaaatacgacgtatgaatgcctcatgttcaacaaaccattcaagtacgatataatgtgcgagaacggatttataagcaagaattttaacatgccatcttcaaacgctgaagcgttcaatgcaaaggtcttagaagaattgagggagaaagtgaaagggctatacctgcccagttgcttagggatgaaaaaattgctgaaatcgaaccacatcgatgcattcaataaggctaactcagtggaagtaaatgaatctctcaagtattgggtagatggagagcccttaaaaagatttaggcagctgggctcgaaacaaaggaagcatcgtttatga

SEQ ID NO: 9547 - protein, 280 aa, SACCHAROMYCES CEREVISIAE
MSQEIRQNEKISYRIEGPFFIIHLMNPDNLNALEGEDYIYLGELLELADRNRDVYFTIIQSSGRFFSSGADFKGIAKAQGDDTNKYPSETSKWVSNFVARNVYVTDAFIKHSKVLICCLNGPAIGLSAALVALCDIVYSINDKVYLLYPFANLGLITEGGTTVSLPLKFGTNTTYECLMFNKPFKYDIMCENGFISKNFNMPSSNAEAFNAKVLEELREKVKGLYLPSCLGMKKLLKSNHIDAFNKANSVEVNESLKYWVDGEPLKRFRQLGSKQRKHRL

SEQ ID NO: 9548 - DNA, 25 bp, Artificial sequence
  primer
atgtcgcaagaaattaggcaaaatg

SEQ ID NO: 9549 - DNA, 25 bp, Artificial sequence
  primer
tcataaacgatgcttcctttgtttc

SEQ ID NO: 9550 - protein, 274 aa, Artificial sequence
  consensus sequence
  Variant (2)..(9): Xaa in position 2 to 9 is any amino acid
  Variant (11)..(11): Xaa in position 11 is any amino acid
  Variant (13)..(16): Xaa in position 13 to 16 is any amino acid
  Variant (18)..(35): Xaa in position 18 to 35 is any amino acid
  Variant (37)..(41): Xaa in position 37 to 41 is any amino acid
  Variant (43)..(44): Xaa in position 43 to 44 is any amino acid
  Variant (47)..(47): Xaa in position 47 is any amino acid
  Variant (49)..(77): Xaa in position 49 to 77 is any amino acid
  Variant (78)..(103): Xaa in position 78 to 103 is any or no amino acid
  Variant (105)..(105): Xaa in position 105 is any amino acid
  Variant (107)..(110): Xaa in position 107 to 110 is any amino acid
  Variant (114)..(115): Xaa in position 114 to 115 is any amino acid
  Variant (117)..(125): Xaa in position 117 to 125 is any amino acid
  Variant (126)..(126): Xaa in position 126 is any or no amino acid
  Variant (128)..(139): Xaa in position 128 to 139 is any amino acid
  Variant (140)..(141): Xaa in position 140 to 141 is any or no amino acid
  Variant (144)..(146): Xaa in position 144 to 146 is any amino acid
  Variant (149)..(150): Xaa in position 149 to 150 is any amino acid
  Variant (153)..(154): Xaa in position 153 to 154 is any amino acid
  Variant (156)..(162): Xaa in position 156 to 162 is any amino acid
  Variant (164)..(166): Xaa in position 164 to 166 is any amino acid
  Variant (168)..(168): Xaa in position 168 is any amino acid
  Variant (170)..(170): Xaa in position 170 is any amino acid
  Variant (172)..(180): Xaa in position 172 to 180 is any amino acid
  Variant (181)..(185): Xaa in position 181 to 185 is any or no amino acid
  Variant (187)..(204): Xaa in position 187 to 204 is any amino acid
  Variant (205)..(225): Xaa in position 205 to 225 is any or no amino acid
  Variant (227)..(229): Xaa in position 227 to 229 is any amino acid
  Variant (231)..(234): Xaa in position 231 to 234 is any amino acid
  Variant (236)..(236): Xaa in position 236 is any amino acid
  Variant (238)..(269): Xaa in position 238 to 269 is any amino acid
  Variant (270)..(273): Xaa in position 270 to 273 is any or no amino acid
IXXXXXXXXNXLXXXXYXXXXXXXXXXXXXXXXXXTXXXXXGXXFSXGXXXXXXXXXXXXXXXXXXXXXXXXXXXXXXXXXXXXXXXXXXXXXXXXXXXXXXXKXLXXXXNGPXXGXXXXXXXXXXDXXXXXXXXXXXXXXPFXXXGLXXEGXXSXXXXXXXGXXXAXEXLXXXXXXXXXXXXXXGXXXXXXXXXXXXXXXXXXXXXXXXXXXXXXXXXXXXXXXLXXXSXXXXKXLXXXXXXXXXXXXXXXXXXXXXXXXXXXXXXXXXXXXF

SEQ ID NO: 9551 - protein, 17 aa, Artificial sequence
  protein pattern
  Variant (2)..(2): Xaa in position 2 is Ile, Leu, Pro or Val
  Variant (3)..(3): Xaa in position 3 is Ile or Leu
  Variant (4)..(4): Xaa in position 4 is Ala, Ile or Val
  Variant (5)..(6): Xaa in position 5 to 6 is any amino acid
  Variant (7)..(7): Xaa in position 7 is Ala, Leu or Val
  Variant (11)..(11): Xaa in position 11 is Ala, Ile or Val
  Variant (12)..(12): Xaa in position 12 is Ile, Met or Val
  Variant (14)..(14): Xaa in position 14 is any amino acid
  Variant (15)..(15): Xaa in position 15 is any or no amino acid
  Variant (17)..(17): Xaa in position 17 is Ala, Ser or Val
KXXXXXXNGPXXGXXAX

SEQ ID NO: 9552 - protein, 27 aa, Artificial sequence
  protein pattern
  Variant (2)..(4): Xaa in position 2 to 4 is any amino acid
  Variant (6)..(8): Xaa in position 6 to 8 is any amino acid
  Variant (10)..(10): Xaa in position 10 is Gly, Asn or Val
  Variant (11)..(11): Xaa in position 11 is Ala, Cys, Gly, Ser or Val
  Variant (12)..(12): Xaa in position 12 is Ala, Ser, Thr or Val
  Variant (13)..(13): Xaa in position 13 is Ala, Ser or Thr
  Variant (14)..(14): Xaa in position 14 is any amino acid
  Variant (15)..(15): Xaa in position 15 is Ala, Asn, Ser or Thr
  Variant (16)..(16): Xaa in position 16 is Phe or Leu
  Variant (17)..(19): Xaa in position 17 to 19 is any amino acid
  Variant (20)..(20): Xaa in position 20 is Phe, Ile, Leu, Met or Val
  Variant (22)..(24): Xaa in position 22 to 24 is any amino acid
  Variant (25)..(25): Xaa in position 25 is Ala, Ser or Thr
  Variant (26)..(26): Xaa in position 26 is any amino acid
  Variant (27)..(27): Xaa in position 27 is Asp, Glu or Asn
FXXXGXXXEXXXXXXXXXXXGXXXXXX

SEQ ID NO: 9553 - DNA, 534 bp, SACCHAROMYCES CEREVISIAE
  CDS (1)..(534)
atgcctccagtgatgagttttgcatcgaggaatattggacgtaagatagcaggagtgggagttgacattgtatacttgccaagatttgcacatatactagagaaatattccccattcgacccatgtggccgttctaccttgaataaaataacacggaagttcatgcatgaaaaggaaagatttcatttcagtaatcttctcatcgaagaaaactgcttaactccacgattgcatgaatatatagcgggagtttgggctttgaaggaatgctcattgaaagcgttgtgttgctgtgtttcaaagcatgatctacctcctgcccaagtactgtacgctggaatgctatataaaacacaaaccgatacaggtgtacctcagttagagtttgataagatgtttggaaaaaagtatccaaagtatcaacagctctcgaaaaactacgattctctcttttccactcatgagtttttagtttcgctatcccatgataaagattatttaattgcagtaacaaacttggtagaaagagagtaa

SEQ ID NO: 9554 - protein, 177 aa, SACCHAROMYCES CEREVISIAE
MPPVMSFASRNIGRKIAGVGVDIVYLPRFAHILEKYSPFDPCGRSTLNKITRKFMHEKERFHFSNLLIEENCLTPRLHEYIAGVWALKECSLKALCCCVSKHDLPPAQVLYAGMLYKTQTDTGVPQLEFDKMFGKKYPKYQQLSKNYDSLFSTHEFLVSLSHDKDYLIAVTNLVERE

SEQ ID NO: 9555 - DNA, 519 bp, Saccharomyces pastorianus
  CDS (1)..(519)
atgaatatcgtatcggaacacatcgggcgtaagatagttggagtgggggttgatattgtgcatttgccaagattcgctcgcctgctagaaaaatattctccattggacccagctggccgtttgactttcaaaaagatcgcacaaaagttcatgcatgagaaggagagggctcaccttagaaatcttctcaatgaagaacaacatctgagtccaagcttgtacaggtatatggcgggtatttgggctttgaaggagtgttcattgaaggctttgtgctgtcatatttcgaagcacgatctgcctcctgctcaagtagtatattccagaatgttatataaaacgcagaacagtgcgggcgtcccgaaattagagtatgacaaaatgtttgagcaagagtatccaaaatatcaacagttctccaaaaaatatggctcctttttttctacacatgaatttcttgtatcattgtcccatgataaagactacttaatagcaatagtaaatttggtggaaagataa

SEQ ID NO: 9556 - protein, 172 aa, Saccharomyces pastorianus
MNIVSEHIGRKIVGVGVDIVHLPRFARLLEKYSPLDPAGRLTFKKIAQKFMHEKERAHLRNLLNEEQHLSPSLYRYMAGIWALKECSLKALCCHISKHDLPPAQVVYSRMLYKTQNSAGVPKLEYDKMFEQEYPKYQQFSKKYGSFFSTHEFLVSLSHDKDYLIAIVNLVER

SEQ ID NO: 9557 - DNA, 534 bp, Saccharomyces pastorianus
  CDS (1)..(534)
atgcctccagtgatgagttttgcatcgaggaatattggacgtaagatagcaggagtgggagttgacattgtatacttgccaagatttgcacatatactagagaaatattccccattcgacccatgtggccgttctaccttgaataaaataacacggaagttcatgcatgaaaaggaaagatttcatttcagtaatcttctcatcgaagaaaactgcttaactccacgattgcatgaatatatagcgggagtttgggctttgaaggaatgctcattgaaagcgttgtgttgctgtgttccaaagcatgatctacctcctgcccaagtactgtacgctggaatgctatataaaacacaaaccgatacaggtgtacctcagttagagtttgataagatgtttggaaaaaagtatccaaagtatcaacagctctcgaaaaactacgattctctcttttccactcatgagtttttagtttcgctatcccatgataaagattatttaattgcagtaacaaacttggtagaaagagagtaa

SEQ ID NO: 9558 - protein, 177 aa, Saccharomyces pastorianus
MPPVMSFASRNIGRKIAGVGVDIVYLPRFAHILEKYSPFDPCGRSTLNKITRKFMHEKERFHFSNLLIEENCLTPRLHEYIAGVWALKECSLKALCCCVPKHDLPPAQVLYAGMLYKTQTDTGVPQLEFDKMFGKKYPKYQQLSKNYDSLFSTHEFLVSLSHDKDYLIAVTNLVERE

SEQ ID NO: 9559 - DNA, 507 bp, Kluyveromyces lactis NRRL Y-1140
  CDS (1)..(507)
atgatattaccacatatattccttaaaaacacaaatgtgatatctgcagccacagatatcgtatttctgccgagggtagagaaattgttacaacgaaacagctcatctcgattacaccgaatactcaagaagttcatgcatccttacgaaataaaacagttcgagacgctagtaaacagcggctcatcgctaaaacataaatcaatatacatagctggagtatgggcttcaaaggaatcattattcaaaaccctgcctcattcatccgaccgaccttctgccattgatatctatactaagctagcattcaaatcaaatgatccggatgggaaacctaatttgaacctggaccaaaaaaggttttcaaccggggaacataatattacgtactggaatgaatatttgcattcaacaaggtacgaaatatcaatttcccacgatcaagattacttaatttgtattcttcttcatcttcgagatgccaaccttaataaatggtcggtttaa

SEQ ID NO: 9560 - protein, 168 aa, Kluyveromyces lactis NRRL Y-1140
MILPHIFLKNTNVISAATDIVFLPRVEKLLQRNSSSRLHRILKKFMHPYEIKQFETLVNSGSSLKHKSIYIAGVWASKESLFKTLPHSSDRPSAIDIYTKLAFKSNDPDGKPNLNLDQKRFSTGEHNITYWNEYLHSTRYEISISHDQDYLICILLHLRDANLNKWSV

SEQ ID NO: 9561 - DNA, 525 bp, Ashbya gossypii
  CDS (1)..(525)
atgcttgttcctcacgaccgaatggttggcaacaagcggcgtgggaccatgcgagtgctgggcatcggcacagaccttgtatacatgccgcgcgttgtggagctgctgcaacggatgcccgcaggatcgggcgcgcatgcgcggttcgcgggcaaattcatgcacgcgcgtgagcgcgccggtgccctcggggccaaagaccaggctcgctacgtggcgggggtgtgggcggccaaggaggcactgtacaaggcggtggcaggcgcagacgcgccgccagccgcgacgctgtaccgcgcgtgctataaggaggccgacgccgttggacgcccgacgctgcaggtggacgcgggagagctgcagcgggcgggtcacatgcgtttctgggaggagcggcttgcgggaacgcgatttctactgagcgtttctcacgatgaggactacttggtggcctttgtctgccacgtcgccgacgaaacttttcgagcgcccgatgaacgccagcggatcacaaagaacagctag

SEQ ID NO: 9562 - protein, 174 aa, Ashbya gossypii
MLVPHDRMVGNKRRGTMRVLGIGTDLVYMPRVVELLQRMPAGSGAHARFAGKFMHARERAGALGAKDQARYVAGVWAAKEALYKAVAGADAPPAATLYRACYKEADAVGRPTLQVDAGELQRAGHMRFWEERLAGTRFLLSVSHDEDYLVAFVCHVADETFRAPDERQRITKNS

SEQ ID NO: 9563 - DNA, 459 bp, Candida glabrata
  CDS (1)..(459)
atgagcgttcttggagtagggtgcgacgtcgtgcatctgccgcgtatgcatcggctgctgacgaagtatgatgcgggctcgagagggttccaacgtgtcgtatcgaagttcatgcacccaaccgagcgtattgcgttgggtgtggacggtgcctctctgtcagcgggtcagataaggtacatagccggcacatgggctttgaaagaggccgcgctcaaagcgctgcattgcgcagcgcctctacacacggttctgccacctgcaatgttcatatatacaaagctgctctatcgacaacggcgtagcaatggtgtgccacagcttctgcttgataacgaggccttgcgactggatcaattgcaattcctcagacaggcaaagttcctatcgactttgtcgcacgataacgaatacctggtagcgtatacaacactaatagataccaaaaaccttgtatag

SEQ ID NO: 9564 - protein, 152 aa, Candida glabrata
MSVLGVGCDVVHLPRMHRLLTKYDAGSRGFQRVVSKFMHPTERIALGVDGASLSAGQIRYIAGTWALKEAALKALHCAAPLHTVLPPAMFIYTKLLYRQRRSNGVPQLLLDNEALRLDQLQFLRQAKFLSTLSHDNEYLVAYTTLIDTKNLV

SEQ ID NO: 9565 - DNA, 534 bp, Saccharomyces cerevisiae; identical to SEQ ID NO: 9553
  CDS (13)..(534)

SEQ ID NO: 9566 - protein, 173 aa, Saccharomyces cerevisiae
MSFASRNIGRKIAGVGVDIVYLPRFAHILEKYSPFDPCGRSTLNKITRKFMHEKERFHFSNLLIEENCLTPRLHEYIAGVWALKECSLKALCCCVSKHDLPPAQVLYAGMLYKTQTDTGVPQLEFDKMFGKKYPKYQQLSKNYDSLFSTHEFLVSLSHDKDYLIAVTNLVERE

SEQ ID NO: 9567 - DNA, 24 bp, Artificial sequence
  primer
atgcctccagtgatgagttttgca

SEQ ID NO: 9568 - DNA, 26 bp, Artificial sequence
  primer
ttactctctttctaccaagtttgtta

SEQ ID NO: 9569 - protein, 153 aa, Artificial sequence
  consensus sequence
  Variant (2)..(2): Xaa in position 2 is any amino acid
  Variant (4)..(4): Xaa in position 4 is any amino acid
  Variant (6)..(6): Xaa in position 6 is any amino acid
  Variant (8)..(8): Xaa in position 8 is any amino acid
  Variant (12)..(15): Xaa in position 12 to 15 is any amino acid
  Variant (17)..(20): Xaa in position 17 to 20 is any amino acid
  Variant (21)..(25): Xaa in position 21 to 25 is any or no amino acid
  Variant (27)..(35): Xaa in position 27 to 35 is any amino acid
  Variant (40)..(41): Xaa in position 40 to 41 is any amino acid
  Variant (44)..(47): Xaa in position 44 to 47 is any amino acid
  Variant (48)..(55): Xaa in position 48 to 55 is any or no amino acid
  Variant (57)..(61): Xaa in position 57 to 61 is any amino acid
  Variant (62)..(62): Xaa in position 62 is any or no amino acid
  Variant (64)..(64): Xaa in position 64 is any amino acid
  Variant (67)..(67): Xaa in position 67 is any amino acid
  Variant (70)..(70): Xaa in position 70 is any amino acid
  Variant (73)..(75): Xaa in position 73 to 75 is any amino acid
  Variant (79)..(83): Xaa in position 79 to 83 is any amino acid
  Variant (84)..(88): Xaa in position 84 to 88 is any or no amino acid
  Variant (92)..(94): Xaa in position 92 to 94 is any amino acid
  Variant (96)..(98): Xaa in position 96 to 98 is any amino acid
  Variant (99)..(99): Xaa in position 99 is any or no amino acid
  Variant (102)..(106): Xaa in position 102 to 106 is any amino acid
  Variant (108)..(108): Xaa in position 108 is any amino acid
  Variant (110)..(110): Xaa in position 110 is any amino acid
  Variant (112)..(113): Xaa in position 112 to 113 is any amino acid
  Variant (115)..(130): Xaa in position 115 to 130 is any amino acid
  Variant (131)..(139): Xaa in position 131 to 139 is any or no amino acid
  Variant (142)..(142): Xaa in position 142 is any amino acid
  Variant (144)..(144): Xaa in position 144 is any amino acid
  Variant (148)..(148): Xaa in position 148 is any amino acid
  Variant (152)..(152): Xaa in position 152 is any amino acid
GXGXDXVXLPRXXXXLXXXXXXXXXGXXXXXXXXXKFMHXXERXXXXXXXXXXXXLXXXXXXYXAGXWAXKEXXXKALXXXXXXXXXXPPAXXXYXXXXYKXXXXXGXPXLXXDXXXXXXXXXXXXXXXXXXXXXXXXXFLXSXSHDXDYLXA

SEQ ID NO: 9570 - protein, 16 aa, Artificial sequence
  protein pattern
  Variant (2)..(2): Xaa in position 2 is any amino acid
  Variant (5)..(5): Xaa in position 5 is Ala or Leu
  Variant (8)..(8): Xaa in position 8 is any amino acid
  Variant (9)..(9): Xaa in position 9 is any or no amino acid
  Variant (11)..(11): Xaa in position 11 is any or no amino acid
  Variant (14)..(14): Xaa in position 14 is Leu or Val
  Variant (15)..(15): Xaa in position 15 is any amino acid
  Variant (16)..(16): Xaa in position 16 is Cys or Gly
GXWAXKEXXLXKAXXX

SEQ ID NO: 9571 - protein, 21 aa, Artificial sequence
  protein pattern
  Variant (3)..(3): Xaa in position 3 is any or no amino acid
  Variant (5)..(5): Xaa in position 5 is any amino acid
  Variant (6)..(6): Xaa in position 6 is any or no amino acid
  Variant (10)..(10): Xaa in position 10 is any amino acid
  Variant (11)..(11): Xaa in position 11 is Asp or Glu
  Variant (14)..(14): Xaa in position 14 is Ile or Val
  Variant (16)..(16): Xaa in position 16 is any amino acid
  Variant (17)..(17): Xaa in position 17 is Thr or Val
  Variant (18)..(18): Xaa in position 18 is Cys, Asn or Thr
  Variant (19)..(19): Xaa in position 19 is any amino acid
  Variant (20)..(20): Xaa in position 20 is Ile or Val
  Variant (21)..(21): Xaa in position 21 is Ala, Asp or Glu
FLXSXXSHDXXYLXAXXXXXX

SEQ ID NO: 9572 - protein, 27 aa, Artificial sequence
  protein pattern
  Variant (2)..(2): Xaa in position 2 is any or no amino acid
  Variant (4)..(4): Xaa in position 4 is any amino acid
  Variant (5)..(6): Xaa in position 5 to 6 is any or no amino acid
  Variant (8)..(8): Xaa in position 8 is Ile, Leu or Val
  Variant (10)..(10): Xaa in position 10 is His or Tyr
  Variant (11)..(11): Xaa in position 11 is Leu or Met
  Variant (14)..(14): Xaa in position 14 is Phe, Met or Val
  Variant (15)..(15): Xaa in position 15 is any amino acid
  Variant (16)..(16): Xaa in position 16 is Glu, His or Arg
  Variant (17)..(17): Xaa in position 17 is Ile or Leu
  Variant (19)..(19): Xaa in position 19 is Glu, Gln or Thr
  Variant (20)..(20): Xaa in position 20 is Lys or Arg
  Variant (21)..(21): Xaa in position 21 is any amino acid
  Variant (22)..(22): Xaa in position 22 is Asp, Pro or Ser
  Variant (23)..(23): Xaa in position 23 is Ala or Pro
  Variant (24)..(24): Xaa in position 24 is any amino acid
  Variant (25)..(25): Xaa in position 25 is Asp or Ser
  Variant (26)..(26): Xaa in position 26 is any amino acid
  Variant (27)..(27): Xaa in position 27 is Ala, Cys or Gly
VXGXXXDXVXXPRXXXXLXXXXXXXXX

SEQ ID NO: 9573 - protein, 17 aa, Artificial sequence
  protein pattern
  Variant (5)..(6): Xaa in position 5 to 6 is any or no amino acid
  Variant (8)..(12): Xaa in position 8 to 12 is any amino acid
  Variant (13)..(13): Xaa in position 13 is Gly, Asn or Thr
  Variant (14)..(14): Xaa in position 14 is Ala or Leu
  Variant (15)..(16): Xaa in position 15 to 16 is any amino acid
  Variant (17)..(17): Xaa in position 17 is Glu, Gln or Ser
KFMHXXEXXXXXXXXXX

SEQ ID NO: 9574 - DNA, 2043 bp, SACCHAROMYCES CEREVISIAE
  CDS (1)..(2043)
atgactcaattcactgacattgataagctagccgtctccaccataagaattttggctgtggacaccgtatccaaggccaactcaggtcacccaggtgctccattgggtatggcaccagctgcacacgttctatggagtcaaatgcgcatgaacccaaccaacccagactggatcaacagagatagatttgtcttgtctaacggtcacgcggtcgctttgttgtattctatgctacatttgactggttacgatctgtctattgaagacttgaaacagttcagacagttgggttccagaacaccaggtcatcctgaatttgagttgccaggtgttgaagttactaccggtccattaggtcaaggtatctccaacgctgttggtatggccatggctcaagctaacctggctgccacttacaacaagccgggctttaccttgtctgacaactacacctatgttttcttgggtgacggttgtttgcaagaaggtatttcttcagaagcttcctccttggctggtcatttgaaattgggtaacttgattgccatctacgatgacaacaagatcactatcgatggtgctaccagtatctcattcgatgaagatgttgctaagagatacgaagcctacggttgggaagttttgtacgtagaaaatggtaacgaagatctagccggtattgccaaggctattgctcaagctaagttatccaaggacaaaccaactttgatcaaaatgaccacaaccattggttacggttccttgcatgccggctctcactctgtgcacggtgccccattgaaagcagatgatgttaaacaactaaagagcaaattcggtttcaacccagacaagtcctttgttgttccacaagaagtttacgaccactaccaaaagacaattttaaagccaggtgtcgaagccaacaacaagtggaacaagttgttcagcgaataccaaaagaaattcccagaattaggtgctgaattggctagaagattgagcggccaactacccgcaaattgggaatctaagttgccaacttacaccgccaaggactctgccgtggccactagaaaattatcagaaactgttcttgaggatgtttacaatcaattgccagagttgattggtggttctgccgatttaacaccttctaacttgaccagatggaaggaagcccttgacttccaacctccttcttccggttcaggtaactactctggtagatacattaggtacggtattagagaacacgctatgggtgccataatgaacggtatttcagctttcggtgccaactacaaaccatacggtggtactttcttgaacttcgtttcttatgctgctggtgccgttagattgtccgctttgtctggccacccagttatttgggttgctacacatgactctatcggtgtcggtgaagatggtccaacacatcaacctattgaaactttagcacacttcagatccctaccaaacattcaagtttggagaccagctgatggtaacgaagtttctgccgcctacaagaactctttagaatccaagcatactccaagtatcattgctttgtccagacaaaacttgccacaattggaaggtagctctattgaaagcgcttctaagggtggttacgtactacaagatgttgctaacccagatattattttagtggctactggttccgaagtgtctttgagtgttgaagctgctaagactttggccgcaaagaacatcaaggctcgtgttgtttctctaccagatttcttcacttttgacaaacaacccctagaatacagactatcagtcttaccagacaacgttccaatcatgtctgttgaagttttggctaccacatgttggggcaaatacgctcatcaatccttcggtattgacagatttggtgcctccggtaaggcaccagaagtcttcaagttcttcggtttcaccccagaaggtgttgctgaaagagctcaaaagaccattgcattctataagggtgacaagctaatttctcctttgaaaaaagctttctaa

SEQ ID NO: 9575 - protein, 680 aa, SACCHAROMYCES CEREVISIAE
MTQFTDIDKLAVSTIRILAVDTVSKANSGHPGAPLGMAPAAHVLWSQMRMNPTNPDWINRDRFVLSNGHAVALLYSMLHLTGYDLSIEDLKQFRQLGSRTPGHPEFELPGVEVTTGPLGQGISNAVGMAMAQANLAATYNKPGFTLSDNYTYVFLGDGCLQEGISSEASSLAGHLKLGNLIAIYDDNKITIDGATSISFDEDVAKRYEAYGWEVLYVENGNEDLAGIAKAIAQAKLSKDKPTLIKMTTTIGYGSLHAGSHSVHGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLTPSNLTRWKEALDFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSRQNLPQLEGSSIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGASGKAPEVFKFFGFTPEGVAERAQKTIAFYKGDKLISPLKKAF

SEQ ID NO: 9576 - DNA, 3311 bp, Zea mays
  CDS (378)..(2588)
gtaaaagatgaagtgatgcttatttactcttatattatctgagccacccttaccaaaatcaatgtcatgagcatatctttgcatactaaattgctaagttccaacttgaattttaaatttcaaaggcataggcgtctgggcagagcggcagaccatttgtctgcctttgtaacaggggcggggggggggcaccggctccgtgctcgagatcgcggacaacgcgtctcgaggggggggaaggcttttttccctcggcccctttctcttttccgccctccctcgcgagctctccccctccgaccctcctcggcggcggcggcggcgatgcagatggcggccaccaccgagtcccaaccggccgtgccacaccctcacccatggctacgcactcggtcgccgccgcgcacgccaccatcgccgcgcgcgcgggcgccgccggggcgccggccccggccgagcgcctgggcttccgccttctgggctcgcccgccggcggcctgcgctccgcccgccgcgcgccgcccgcggccgcctcccgccgccataattccgcgcgcgccgccgccgtcgagacgctccagggcaaggccgccaccggcgagctgctcgagaagtcggtcaacacgatccggttcctggccatcgacgccgtcgagaaggccaactccggccacccgggcctccccatgggctgcgcgcccatgggccacgtcctctacgacgaggtcatgcgctacaaccccaagaacccctactggttcaaccgcgaccgcttcgtcctctccgccggccacggctgcatgctccagtacgccctcctccacctcgccggatacgacagcgttaaggaggaggacttgaagcagttcaggcaatggggaagcagaacaccgggccaccctgagaactttgagactccaggagttgaagttaccaccgggcctcttggtcagggtatcgccaatgccgttgggttggcacttgctgagaagcacctggctgcccgcttcaacaagcctgacagtgagatcgtcgaccactacacgtacgttattttgggagatggctgccaaatggagggtattgctaatgaagcttgctccttggctggacactggggtcttggcaagctgattgctttctacgatgacaaccacatttccatcgacggagacacggagattgcattcacagaggacgtgagcacccgcttcgaggctcttgggtggcacacgatctgggttaagaatgggaacaccggatatgatgacatccgcgcagccattaaggaggcgaaggcagttactgacaagcccaccttgatcaaggtgactaccacgatcggttttggatctcccaacaaggccaactcatacagtgttcatggaagtgcactgggtgccaaagaggttgaagcaaccaggcagaaccttggatggccctatgacacattctttgtaccagaggacgtcaagagtcactggagccgccacacacccgaaggtgctgcacttgaggctgattggaacgctaagtttgcagagtacgagaagaagtatgcagatgatgcagcaaccttgaaaagtatcatcacgggggagttacccactggctgggttgatgctcttcctaaatacactccagagagcccaggagatgccaccaggaacctctcccagcagtgcctgaacgcgcttgctaatgttgtgcctggtcttattggaggcagtgctgatcttgcatcctccaacatgactctgctgaagatgtttggtgacttccagaaggatacagctgaagagcgcaatgtccgctttggagtcagagagcacggaatgggcgccatttgcaacggcattgctctgcacagcccagggtttgttccgtactgtgctacattctttgtcttcactgattacatgagaggtgccatgaggatctcggccctgtctgaagccggagtcatctatgtcatgacccacgactctattggtctcggagaagatggcccgacccatcagcccatcgagcacctggtgagcttccgtgcgatgccgaacatactgatgctccgccctgctgatggcaacgagactgccggagcatacaaagtcgcggtcctcaacaggaagaggccgtccatcctcgctctctccaggcaaaagctccctcacctgcctggcacctcgatcgagggcgtggagaagggcgggtacaccatctccgacaactcgaccggcaacaagcctgacctcattgtgatgggcaccggctccgagctggagatcgcggccaaggccgccgacgagctgaggaaggagggcaagacggtccgcgtcgtctcgttcgtctcctgggaactctttgatgagcagtcggatgagtacaaggagagcgtcctccctgccgccgtcacagcgaggatcagcatcgaggccgggtccactctcggctggcagaagtacgtcggagcccagggcaaggccattggcatcgacaagttcggcgcgagtgctcctgccgggacgatctacaaggagtacggcatcaccgtggagagcatcattgcagctgccaagagcttttaagagctaacaacggtctgagttttttttattgtcgtcgttgatgccaaaggaacactgtacctagaggacagtcctatgcctcggagcttggaataatgatgatggagggagcggaaggatgcctgccatttgttggagcgtgcgtggtagtatttctaggcctgtaataaacaatgcctttttccatttacgttgttggttttatccggtgaccctcacacgattcatcaaggtggtgagcctggctattaaatcgggtgctgttttttttgggtaaacattggcaatggccttactgtcttgcagcagtgcttcttcgtttgctggattgtgggtttaagatgctgcattttggctcttttgttgatacattttcccattggcttttgtttgtgatacatacatagcatttatatattaagctcaataatgtgacgttttattgaaaaaaaaaaaaaaaaaagcggccaattataatgcagggagcggaaggatgccttccatttgttggagcgtgggtggtagtatttttaggcccgtaataaacaacgcccttttccatttacgttggtggttttaaccggtggccctcacccgtttcatcaggtggtgagcctgggtattcaaccgggggttgttttttttgggtaaacattggcaaaggccttgctgtctttcagcagggcttcgttggtttggtggattgtgggtttaagcagcggc

SEQ ID NO: 9577 - protein, 736 aa, Zea mays
MATHSVAAAHATIAARAGAAGAPAPAERLGFRLLGSPAGGLRSARRAPPAAASRRHNSARAAAVETLQGKAATGELLEKSVNTIRFLAIDAVEKANSGHPGLPMGCAPMGHVLYDEVMRYNPKNPYWFNRDRFVLSAGHGCMLQYALLHLAGYDSVKEEDLKQFRQWGSRTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNTGYDDIRAAIKEAKAVTDKPTLIKVTTTIGFGSPNKANSYSVHGSALGAKEVEATRQNLGWPYDTFFVPEDVKSHWSRHTPEGAALEADWNAKFAEYEKKYADDAATLKSIITGELPTGWVDALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDLIVMGTGSELEIAAKAADELRKEGKTVRVVSFVSWELFDEQSDEYKESVLPAAVTARISIEAGSTLGWQKYVGAQGKAIGIDKFGASAPAGTIYKEYGITVESIIAAAKSF

SEQ ID NO: 9578 - DNA, 2729 bp, Triticum aestivum
  CDS (44)..(2281)
cggcacgagcatctccgccgtcctccgccacacaccccacaccatggcagcgcactccgtcgccgccgcgcacgccaccatcgcggcccgcgcgggcgccgccccctcctccccggcggccgccccggccgagcgcctgggcttccgcctcagctcgctcgccggccgcgccctccgctcgccgctcccggcgcgccgggccgcggccgccgcctcctcctcccgcaggagcggcagccagcgcgtgcgcgcctccgcggccgtcgagaccgtcgaggccgccgccacgggcgagctgctcgacaagtcggtcaacgcgatccggttcctggccatcgacgccgtcgagaaggccgtgtccggccaccccggcctccccatggggtgcgcgcccatgggccacatcttgtatgacgaggtcatgcgctacaaccccaagaacccctactggttcaaccgcgaccgcttcgtcctctccgccggccacggctgcatgctccagtacgccctcctccacctcgccggctacgacgccgtcaaggaagaggacctgaagcagttcagacagtggggaagctccacccccggccaccctgagaacttcgagactcctggagttgaagtcaccactggtcctcttggccagggtatcgcgaatgccgtcgggttggcgcttgctgagaagcacctggctgctcgtttcaacaagcccgacagtgaaatcgttgaccactacacgtactgtattgtgggagatgggtgcaacatggagggtatcttgactgaagcttgctctttggctgggcattggggtcttggcaagctaattgttttctacgacgacaaccacatctccattgacggagacacggagattgcttttacagaggatgtgagtggccgctttgaggctcttgggtggcacaccctctgggttaagaatggcaacgatggttatgacgagatccgtaaagccattcaggaagcaaaatcagttactgacaagcccacaatgatcaaggtgactaccacaatcggttttggatctcccaacaaggccaactcatacgctgtgcacggagctgcattgggcaccagcgaggtcgaagcaaccagggcaaaccttggatggccatatgagccattctttgtgcccgaggatgtcaagagccactggagccgccatattccccaaggtgccgctcttgaggctgactgggatgctaagtttgcacagtacgagcagaagtacccagaagatgccgccaccttgaaaagcatcatcacaggagagttgcccgctggctgggccgatgctcttcctcaatacaccacagagagcccagcagacgccaccaggaatctctcccagcaatgcttgaatgcacttgctaaagttgtgcctggtcttattggaggcagtgctgatcttgcgtcctccaacatgacattgcttaagatgtttggcgacttccagaaggatacccctgaggagcgcaatgtccgctttggagtcagggagcacggaatgggcgccatttgcaacggcattgcgctgcacaccccagggctcattccatactgtgcaaccttctttgttttcactgactacatgagaggtgccatgaggatctcagccttgtctgaagctggagttatctatgtcatgacccatgactctattggtctgggtgaagacggtccgacccatcaacccattgagcacttggtgagcttccgcgcaatgccaaacatgctgatgttccgtcctgctgatggcaaggagactgccggggcatacaaggtggctgtcctcaacaggaagaggccatctattctggctctctccaggcaaaagcttcctcatctgcctggtacctcaattgagggcgttgcgaagggtggatacaccatctctgacaactcgaccgacaacaagcctgactacatcataatgagcactggttctgaggtagagattgctgtgaaggctgccgaagagttgacgaaggaggggaagaccgtccgtgttgtgtcatttgtttgctgggaactcttcgacgagcagtcagatgagtacaaggagagcgtgctccctgaggccgtcaccgcaaggatcagcattgaggctggctctaccctcggatggcaaaagtatgtcggatccaagggcaagaccatcggcatcgacaagttcggcgccagcgctcccgccccgaagatctacaaggagtacggcatcaccgcggagaacgtcatcgccgcagccaagagcctgtaagatcagcacactcgtcgaggttctgtcatcgttgatgccaaagaacaaacgacaccacacttgaaggtctcgtgcccagaagcttggaataacggagggagaggaggatatgcctgcgtcggagcgtgagtggtatttttaggcctgtaataaacaatgccttttccatttgcgttgtcttacattcgatatatatcgccccccttagatgaattcgcggagggggcgagcctgatcaaattggggactggttttttgtatttgtttacatcgaactgatggtcgtgcttgcgatgcttctttctctccccgagatcgtcgcctccatgggttttatgctttgatgcgcccttttagtccttggtagtttgctcatcttccccttcccccatacaaacggtttgatgcatagtatcatcagtgcaataaacatagagtgttttccatc

SEQ ID NO: 9579 - protein, 745 aa, Triticum aestivum
MAAHSVAAAHATIAARAGAAPSSPAAAPAERLGFRLSSLAGRALRSPLPARRAAAAASSSRRSGSQRVRASAAVETVEAAATGELLDKSVNAIRFLAIDAVEKAVSGHPGLPMGCAPMGHILYDEVMRYNPKNPYWFNRDRFVLSAGHGCMLQYALLHLAGYDAVKEEDLKQFRQWGSSTPGHPENFETPGVEVTTGPLGQGIANAVGLALAEKHLAARFNKPDSEIVDHYTYCIVGDGCNMEGILTEACSLAGHWGLGKLIVFYDDNHISIDGDTEIAFTEDVSGRFEALGWHTLWVKNGNDGYDEIRKAIQEAKSVTDKPTMIKVTTTIGFGSPNKANSYAVHGAALGTSEVEATRANLGWPYEPFFVPEDVKSHWSRHIPQGAALEADWDAKFAQYEQKYPEDAATLKSIITGELPAGWADALPQYTTESPADATRNLSQQCLNALAKVVPGLIGGSADLASSNMTLLKMFGDFQKDTPEERNVRFGVREHGMGAICNGIALHTPGLIPYCATFFVFTDYMRGAMRISALSEAGVIYVMTHDSIGLGEDGPTHQPIEHLVSFRAMPNMLMFRPADGKETAGAYKVAVLNRKRPSILALSRQKLPHLPGTSIEGVAKGGYTISDNSTDNKPDYIIMSTGSEVEIAVKAAEELTKEGKTVRVVSFVCWELFDEQSDEYKESVLPEAVTARISIEAGSTLGWQKYVGSKGKTIGIDKFGASAPAPKIYKEYGITAENVIAAAKSL

SEQ ID NO: 9580 - DNA, 2629 bp, Nicotiana tabacum
  CDS (60)..(2291)
ctcctcttcactctcttttctctttgagacaaaacatcaaacaccttactggtaaagccatggcgtcttcttcttctctcactctctctcaagctatcctctctcgttctgtccctcgccatggctctgcctcttcttctcaactttccccttcttctctcactttttccggccttaaatccaatcccaatatcaccacctcccgccgccgtactccttcctccgccgccgccgccgccgtcgtaaggtcaccggcgattcgtgcctcagctgcaaccgaaaccatagagaaaactgagactgcgcttgttgacaaatctgtaaacacgattcgatttttggctattgatgctgttgaaaggcaaattcgggtcacccggtttgccatgggttgtgctccgatgggtcatatattgtacgatgaggttatgaggtataacccgaaaaacccgtattggtttaatcgggatcggtttgttctatcagctggacatggttgtatgcttcagtatgctttgcttcatctagctggctatgatgctgtcagggaagaggacttgaagagcttccgtcagtggggaaccaaaacccctggacaccctgaaaactttgagacacctggtgttgaagtcaccaccgggcctctgggacaaggtattgccaacgccgttggcttggctcttgtggagaaacacttggctgctcgtttcaataagcctgacgctgagattgtagaccactacacatatgttattctcggtgatggttgccagatggagggtatttcacaagaagcttgttcccttgctggacactggggacttggaaagctgattgctttctatgatgacaaccacatctcaattgatggtgacacagaaatcgctttcactgaggatgttggtgcccgttttgaggctcttgggtggcacgtaatctgggtgaagaacggtaacactggttatgatgagattcgtgctgctattaaggaagcaaaaactgtcacagacaaacccactatgatcaaggtgactacaaccattggttttggctcgcccaacaaggcaaacagttacagtgtacatggaagtgcacttggagctaaggaagtagaggccaccaggagtaacttgggatggccttatgagcctttccatgtgcctgaagatgtcaagagccattggagtcgtcatgttcccgagggtgctgctcttgaagctgggtggaataccaagtttgctgaatatgagaagaagtacccagaggaagctgcagaactcaaatccattactactggtgaactacctgctggctgggagaaagctcttcctacctacacacctgaaagtccagcggatgccaccagaaacctgtcccaacaaaacctgaatgctcttgccaaggttcttcctggtttccttggtggtagtgctgatcttgcctcatcaaacatgaccctcatgaaaatgtttggtgacttccaaaagaacaccccagaggagcgtaatctaaggtttggtgttcgtgaacatggtatgggagccatatgtaatggtaatgctctacacagccctggcttgattccctactgtgctactttctttgtgttcaccgactacatgagaggagctatgagaatttcagccttgtctgaggctggagttatttatgttatgacccacgattcaattggtctaggagaagatgggcctacccatcaacccattgagcacttgccaagtttccgtgcaatgcccaacattctgatgttccgtccagcagatggcaaggagacagcgggagcttacaaggtggctgtcctcaagaggaagacaccatcaatccttgccctctctcggcaaaagttgccacaacttgctggaagttctattgaaggagcagcaaagcgtggctacattttatcagacaattcttctggcaacaaacctgatgtcattttgattggtactggctcagagttagaaattgctgtcaaggctgctgatgaactcaggaaagaaggaaaagcagtgagagttgtttcctttgtttgttgggagctttttgaagaacaatcagccgactacaaggaaagtgtccttccatcatctgttacagctagagttagcattgaggccggatccacatttgggtgggagaaatatgtcggatcaaaggggaaggccatcggaattgacagatggggtgccagtgcccctgctggaaaaatatacaaggagtacggaattacagcagaggctgttgtagctgcagctaaacaagtttcttaggctttattacttacccttggttgctggtgtctaccaaatttgttttcattttgaaactgaggttggagataacggtggaaaccaataccaaacggactcggcagttcactgttgcctggtattttcaataaaaactatttcttcatctgtcctttgttttcttcagttttagtagcggagcggccaaaatgaatccaagatgaggatagaaataggattatggatgctcctgaccatgtacacttaaaacatatctgtgagttttgtaattttatttggtcgagtgataccaagatctcattttcaattggaaaaaaaaaaaaaaaaaaaaaaaaaaa

SEQ ID NO: 9581 - protein, 743 aa, Nicotiana tabacum
MASSSSLTLSQAILSRSVPRHGSASSSQLSPSSLTFSGLKSNPNITTSRRRTPSSAAAAAVVRSPAIRASAATETIEKTETALVDKSVNTIRFLAIDAVERQIRVTRFAMGCAPMGHILYDEVMRYNPKNPYWFNRDRFVLSAGHGCMLQYALLHLAGYDAVREEDLKSFRQWGTKTPGHPENFETPGVEVTTGPLGQGIANAVGLALVEKHLAARFNKPDAEIVDHYTYVILGDGCQMEGISQEACSLAGHWGLGKLIAFYDDNHISIDGDTEIAFTEDVGARFEALGWHVIWVKNGNTGYDEIRAAIKEAKTVTDKPTMIKVTTTIGFGSPNKANSYSVHGSALGAKEVEATRSNLGWPYEPFHVPEDVKSHWSRHVPEGAALEAGWNTKFAEYEKKYPEEAAELKSITTGELPAGWEKALPTYTPESPADATRNLSQQNLNALAKVLPGFLGGSADLASSNMTLMKMFGDFQKNTPEERNLRFGVREHGMGAICNGNALHSPGLIPYCATFFVFTDYMRGAMRISALSEAGVIYVMTHDSIGLGEDGPTHQPIEHLPSFRAMPNILMFRPADGKETAGAYKVAVLKRKTPSILALSRQKLPQLAGSSIEGAAKRGYILSDNSSGNKPDVILIGTGSELEIAVKAADELRKEGKAVRVVSFVCWELFEEQSADYKESVLPSSVTARVSIEAGSTFGWEKYVGSKGKAIGIDRWGASAPAGKIYKEYGITAEAVVAAAKQVS

SEQ ID NO: 9582 - DNA, 2614 bp, Magnoliophyta
  CDS (297)..(2363)
ttgattggctaaaaatcaacacactgataaaataagagttgcagagagagtctctcatcttcttcatttcttcaccaccatcatcacacaccttcttcttcttcttcttctctctctatcacaagagagtcaaatccatggcttctacttcttccctcgctctctctcaagctctcctagctcgtgcaatctctcaccatggttctgaccaacgtggatctttaccagctttctctggactcaaatccaccggttcacgcgcctcagcttcgtctcgtcgacgtatcgctcaatccatgaccaaaaaccgatctctccgtcctcttgttcgcgctgcagctgttgagactgttgagccaaccactgattcgtcgattgtggacaaatcggtcaactcgattaggtttttggctatcgatgcggtggagaaggccaaatcaggtcatcctggtcttcctatgggttgtgctccgatggctcacattttgtatgatgaggtcatgaggtataaccccaagaacccttattggttcaaccgtgaccgattcgttctatctgctggacatggatgtatgttgctctacgcgttgcttcatcttgccggctacgacagcgtccaggaggaagatttgaagcagttccgtcaatggggaagcaagacaccaggacatcctgagaatttcgagactcctggaattgaagtcactactggtcctcttggacaaggaatcgctaatgctgttggtttagctcttgctgagaagcatttggctgctagattcaacaaacctgatgctgaagtagtcgaccactacacatatgcgatccttggagatggttgtcagatggagggtatttctaatgaagcttgctctctagctggccattggggacttggaaagctcattgctttctacgatgacaatcacatttctatagatggagacacagaaattgccttcactgagaacgtggaccagctatttgaagcccttggatggcatgttatctgggtgaagaatggaaacactgggtatgacgagatccgtgctgccattaaggaagctaaaactgttactgacaagcctactttgatcaaggtcactactaccattggttatgggtctcccaacaaggcgaactcatacagtgtccatggagctgcacttggcgagaaggaagttgaggctaccagaaataaccttggatggccgtatgagccgttccaggtacctgacgatgtaaaaagccactggagtcgtcatacacctgaaggagctactcttgaatctgactggagtgcaaagtttgcagcatatgaaaagaagtacccagaggaagcttctgagttgaaatctattatcactggtgaattacctgctggctgggagaaggctctacctacatacacaccagagtctccaggtgatgccaccagaaacctgtcacagcaatgtcttaacgcccttgctaaagttgttcccggtttccttggtggaagtgctgaccttgcatcatccaacatgacattgctgaaagcctttggcgacttccaaaaggccacacctgaagaaagaaatcttaggtttggtgttagggagcacggaatgggagccatctgcaatggcattgcccttcacagccccggtcttatcccttactgtgcgacgttctttgtcttcaccgactacatgagaggtgccatgagaatctcagctttgtctgaggctggtgttatctatgttatgacccatgattccattggtcttggagaagatggaccaacccatcagcccattgagcacattgcaagtttccgtgctatgcccaacactctaatgttccgtcctgctgatggaaatgaaacagccggtgcatacaagatcgctgtcaccaagcgcaagacaccatctatcttagctctgtctaggcaaaagctgcctcatcttccaggtacatccatcgaaggagtggaaaagggtggatatacaatttctgacgactcttcaggcaacaaacccgatgtgatcttgattggaactggttctgagctagagattgctgcacaggctgcggaggtgctcaggaaagacggcaaaaccgttagagttgtttctttcgtgtgctgggaactatttgacgagcaatcagatgaatacaaggagagtgtgttgccatcggatgtatcagctagagttagcattgaagcagcttcgactttcggatggggaaagattgttggaggcaaaggaaagtccattggtattaattcattcggagccagcgcaccagcacccttactctacaaggagtttggtatcaccgttgaagctgttgttgatgcggccaagtcattcttctaagagatttaagatcggaccattctctctgagggggttttgtctgaaacttgatttggaaacaaggctattcacaacattgtctcatatctcgaaataaagtgcaacaagacacaaagactttcactttcttttttgtttttgttttttgtacttcaggtcaagataggttttcggtttgagaagagaaacaaattagaaagacaatgtaaaactcccatgatcattcgtgtaatgctaaatgcttgaatttc

SEQ ID NO: 9583 - protein, 688 aa, Magnoliophyta
MTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQLFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 9584 - DNA, 2193 bp, Glycine max
  CDS (1)..(2193)
atggcatcctcatcctctctgcatctatctcaggcccttctggcacgtgctgtgtaccttcatggctcttcttcttctgaccgtgtctcactctccttcccatcattctctggcctcaagtcacattctacatgcaaagcagcagcagccacgtcctcgcgtagaaggggtgcttgtccatccaccaacgttgttcgagccgctgcggttgagacactcgaccaaaccaccgaggtttctctggtggagaaatccgtcaacaccattcggtttttggccattgatgcagttgagaaggccaactctggtcaccctggtctccccatggggtgtgctccaatgggtcacattctctacgatgagataatgaggtacaatcctaagaaccccgcttggttcaaccgtgaccgtttcgttctctctgctggacatggctgcatgctccaatatgctctccttcaccttgctggctatgacactgttcaggaacaagaccttaaggaattccgacaatggggaagcagaactcctggacatcctgagaactttgagacccttggagttgaagtgaccacaggtcctcttggtcagggcattgccaatgctgttggattagcactagctgagaagcacttggctgcacgatttaacaagcctgacaatgagattgttgaccattacacatatgttatattgggtgatggttgtcaaatggagggaatttcaaatgaagcatgctcacttgccggtcactggggtctaggaaagctcattgctttatatgatgacaatcacatttccattgatggtgacactgagattgcattcactgagaatgttgatcagcgttttgaagcacttggatggcatgtaatttgggtgaagaatggaaatactggatatgatgaaattcgtgcagccattaaagaagcaaaggctgtcaaagacaaacccactttgatcaagggaaattcctacagtgttcatgggagtgcattaggtgctaaagaagtggatgctacaaggaagaatcttggatggccatacgagcctttccatgtgccagaagatgtcaagaagcattggagtcgccatacacctgagggtgctaaacttgaagctgagtggaatgccaagtttgtggaatatgagaagcaatacagtgaggaagctgcagagctgaaggctattattactggcgaattaccagctggttgggagaaagcacttccgacatacacaccagaaagccctgctgatgctacaagaaatctgtctcagcaaaatctaaatgcccttgttaaggttcttcctggtctacttggtggtagtgcagatcttgcctcttccaacatgaccttattgaaatcgtatggggatttccaaaagaatactcccgaagagcgcaatgttaggtttggtgttagagaacatggaatgggagcaatctgtaacggtattgctcttcatagccccggattcattccatactgtgcaactttctttgtcttcactgactatatgagagctgccataaggatttctgcactgtgtgaagctggagttatttatgtgatgactcatgattcgattggacttggagaggatggaccaactcatcagccaatagagcatttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacaccatttcagacaactcatcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaggagagtgttctacctgcttcagtaacagctagagttagcattgaggcaggatcaacatttggttggcacaagattgttggaagcaaaggaaaggccataggcattgatcgatttggagcaagtgctccagctggaaaaatatacaaggagtttggtatcaccaaggaagctgttattgctgctgccaaagaactttcgtag

SEQ ID NO: 9585 - protein, 730 aa, Glycine max
MASSSSLHLSQALLARAVYLHGSSSSDRVSLSFPSFSGLKSHSTCKAAAATSSRRRGACPSTNVVRAAAVETLDQTTEVSLVEKSVNTIRFLAIDAVEKANSGHPGLPMGCAPMGHILYDEIMRYNPKNPAWFNRDRFVLSAGHGCMLQYALLHLAGYDTVQEQDLKEFRQWGSRTPGHPENFETLGVEVTTGPLGQGIANAVGLALAEKHLAARFNKPDNEIVDHYTYVILGDGCQMEGISNEACSLAGHWGLGKLIALYDDNHISIDGDTEIAFTENVDQRFEALGWHVIWVKNGNTGYDEIRAAIKEAKAVKDKPTLIKGNSYSVHGSALGAKEVDATRKNLGWPYEPFHVPEDVKKHWSRHTPEGAKLEAEWNAKFVEYEKQYSEEAAELKAIITGELPAGWEKALPTYTPESPADATRNLSQQNLNALVKVLPGLLGGSADLASSNMTLLKSYGDFQKNTPEERNVRFGVREHGMGAICNGIALHSPGFIPYCATFFVFTDYMRAAIRISALCEAGVIYVMTHDSIGLGEDGPTHQPIEHLASFRAMPNTLMLRPADGNETAGSYKVAVVNRKRPSILALSRQKLTQLPGTSIEGVEKGGYTISDNSSGNKPDVILIGTGSELEIAAAAAEDLRKEGKAVRVVSFVSWELFDEQSDEYKESVLPASVTARVSIEAGSTFGWHKIVGSKGKAIGIDRFGASAPAGKIYKEFGITKEAVIAAAKELS

SEQ ID NO: 9586 - DNA, 2223 bp, Glycine max
  CDS (1)..(2223)
atggcatccacatcctctctgcatctatctcaggcccttctggcacgtgctgtgtaccttcatggctcttcttctgaccgtgtctcactctccttcccatcattctctggcctcaagtcacattctccatgcaaagcagcagccacgtcctcacgtagaaggggtgcttgcgcttccaccagcgttgttcgagccgctgcggttgagacactggaccagaccactgaggtttctctggtggagaaatccgtcaacaccattcggtttttggccattgatgctgttgagaaggccaactctggtcaccctggtctccccatggggtgtgctccaatgggtcacattctctacgatgaggtcatgaggtacaatcccaagaatcccacttggttcaaccgtgaccgtttcattctctctgctggacatggctgcatgctccaatatgctctccttcaccttgcaggctatgacagtgttctggaagaagacctgaaggaattccgacaatgggggagcaggactcctggacatcctgagaactttgagacagttggaattgaagtgactacaggtcctcttggtcagggcattgccaatgctgttgggttagcactagctgagaaacacttggctgcacgatttaacaagcctgacaatgagattgttgaccattacacatatgttatattgggtgatggttgtcaaatggagggaatttcaaatgaagcatgctcacttgccggtcactggggtctagggaagcttattgctttatatgatgacaaccacatttccattgatggggacactgagattgcattcactgagaatgttgatcaacgttttgaggcacttgggtggcatgtaatttgggtgaagaatggaaatactggatatgatgaaattcgtgcagccattaaggaagcaaaggctgtcaaagacaaacccactatgatcaaggtaaccactaccattggatttggttctccaaacaaggctaactcctacagtgttcatggaagtgcattaggtactaaagaagtggatgctacaaggaagaatcttggatggccatacgagcctttccatgtgccagaagatgttaaaaagcattggagtcgccatacccctgagggtgctaaacttgaagctgagtggaatgccaagtttgcagaatatgagaagaaatacagtgaggaagctgcagagctgaaggctattattactggtgaattaccagctggttgggagaaagcacttccgacatacactccagaaagccctgctgatgctacaagaaatctgtctcagcaaaatctaaatgcccttgttaaggttcttcctggtctacttggtggcagtgcagatcttgcctcttccaacatgaccttgttgaaatcatacggagatttccaaaagaatactcccgaagagcgcaatgttagatttggtgttagagaacatggaatgggagcaatctgtaatggtattgctcttcatagccccggattcattccatactgtgcaactttctttgtcttcactgactacatgagagctgccataaggatttctgcactgtgtgaagctggagttatttatgtgatgactcatgattcgattggacttggagaggatggaccaactcatcagccaatagagcacttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaacttccaggaacttctattgagggagttgaaaagggtggctacattatttcagacaactcgtcaggtaacaagcctgatgttattttgattggaactggttctgagttggaaattgctgctgctgctgctgaggatctaaggaaggaaggaaaagctgttagagttgtttcttttgttagctgggaactttttgatgagcagtcagatgaatacaaagagagtgttctccctgcttcggtaacagttagagttagcattgaggcaggatcaacatttggttggcaaaagattgttggaagccaaggaaaggccataggcattgatcgatttggagcaagtgctccagcaggaaaaatatacaaggagtttggtatcaccaaggaagctgttattgctgctgccaaagaactttcgtag

SEQ ID NO: 9587 - protein, 740 aa, Glycine max
MASTSSLHLSQALLARAVYLHGSSSDRVSLSFPSFSGLKSHSPCKAAATSSRRRGACASTSVVRAAAVETLDQTTEVSLVEKSVNTIRFLAIDAVEKANSGHPGLPMGCAPMGHILYDEVMRYNPKNPTWFNRDRFILSAGHGCMLQYALLHLAGYDSVLEEDLKEFRQWGSRTPGHPENFETVGIEVTTGPLGQGIANAVGLALAEKHLAARFNKPDNEIVDHYTYVILGDGCQMEGISNEACSLAGHWGLGKLIALYDDNHISIDGDTEIAFTENVDQRFEALGWHVIWVKNGNTGYDEIRAAIKEAKAVKDKPTMIKVTTTIGFGSPNKANSYSVHGSALGTKEVDATRKNLGWPYEPFHVPEDVKKHWSRHTPEGAKLEAEWNAKFAEYEKKYSEEAAELKAIITGELPAGWEKALPTYTPESPADATRNLSQQNLNALVKVLPGLLGGSADLASSNMTLLKSYGDFQKNTPEERNVRFGVREHGMGAICNGIALHSPGFIPYCATFFVFTDYMRAAIRISALCEAGVIYVMTHDSIGLGEDGPTHQPIEHLASFRAMPNTLMLRPADGNETAGSYKVAVVNRKRPSILALSRQKLTQLPGTSIEGVEKGGYIISDNSSGNKPDVILIGTGSELEIAAAAAEDLRKEGKAVRVVSFVSWELFDEQSDEYKESVLPASVTVRVSIEAGSTFGWQKIVGSQGKAIGIDRFGASAPAGKIYKEFGITKEAVIAAAKELS

SEQ ID NO: 9588 - DNA, 2196 bp, Glycine max
  CDS (1)..(2196)
atggcttcttccacttcctctatctctctctcccaagccctcctccgccccaccaccacctctctcccctcctcctcctcctccctccgcctcacccccactctccgccctaccccacccgccctctccctccgccgccgcctcaccacctccatccgcgccgccgcctccgtcaaaaccgtcgagaaggcaaccgcggacgccgcgctggtcgaaaaatccgtcaacacgatccgcttcctcgccatcgacgccgtcgagaaggcgaattcgggtcacccggggctccccatgggatgcgctccgatgggtcacgtgctatatgatgaaaccatgaagtataaccctaagaaccctttctggttcaaccgcgatcgcttcgttctctccgctgggcacgggtgcatgcttcagtacgcgcttctgcacctcgctgggttcgatagcgtcaaggaagaggatttgagggaatttcgccaatgggggagcagaactccgggacaccctgagaattttgagactccgggaattgaagttacaacaggtcctcttggtcaggggattgccaatgctgttggtttggcccttgcagagaagcacttggctgcaagatacaacaagcctgacaatgagattgttgaccattacacgtatgctattctgggtgatggttgtcaaatggagggaattgcaaatgaagcatgctcacttgctggccactggggactggggaagctgatagcattttatgatgacaatcatatttctattgatggtaacacagagattgcgttcaccgagagtgttgatagtcgttttgagggacttgggtggcatgttatttgggtaaagaatggaaataatggctatgatgatattcgtgctgccattaaggaagcaaaagctgtcaaagacaaacccacattaatcaaggtcacaacaaccattggttatggttctcctaacaaggctaactcctacagtgtgcatggaagtgcactgggtgccaaagaagttgatgccaccaggcagaaccttggatggtcacatgagccattccacgtgcctgaggatgtcaaaaagcattggagtcgccacacccctgagggtgctgcacttgaagctgagtggaatgctaagtttgctgagtatgaaaagaaatacaaggaggaggctgcagaattgaaatctattatcaatggtgaattccctgctggttgggagaaagcacttccgacatacactccagagagcccagcggatgccaccagaaacctgtctcaaacaaaccttaatgcccttgcaaaggttcttcccggtctgcttggtggcagtgcagatcttgcttcttccaacatgaccttgctcaaaatgttcggggacttccaaaaggatactccagcagagcgtaatgttagattcggtgttagagaacacggaatgggagctatctgcaacggcattgctcttcacagccctggactgattccatattgtgcaaccttctttgtattcactgactacatgagaggtgccataaggctttctgcgctgtctgaggctggggttatttatgtcatgacccatgattcaataggacttggagaagatgggccaacccaccagccaattgagcacctagcaagcttccgggcaatgccaaacattttgatgcttcgtcccgccgacggtaacgaaacagccggagcatacaaagtggccgtgctcaacaggaagagaccctccattcttgccctatccaggcaaaaactgccccagcttcccggaacttccattgaaggagttgaaaagggtggttacaccatttcggacaactccactggcaacaagcctgatgtcattttgatcggaactggttcggaattggaaatcgctgccaaagctgctgatgacctaaggaaggaagggaaggctgttagagttgtttcccttgtttcttgggaactttttgatgagcaatcagaagcctacaaggagagtgttttccctgctgctgtttcagccagagttagcattgaggcaggatcaacatttgggtgggagaaaattgttggagcaaagggaaaagcaataggcattgatcgttttggagctagtgctccagctggaagaatatacaaagaatttggtatcactaaggaagctgttgttgctgcagctaaagagcttatctag

SEQ ID NO: 9589 - protein, 731 aa, Glycine max
MASSTSSISLSQALLRPTTTSLPSSSSSLRLTPTLRPTPPALSLRRRLTTSIRAAASVKTVEKATADAALVEKSVNTIRFLAIDAVEKANSGHPGLPMGCAPMGHVLYDETMKYNPKNPFWFNRDRFVLSAGHGCMLQYALLHLAGFDSVKEEDLREFRQWGSRTPGHPENFETPGIEVTTGPLGQGIANAVGLALAEKHLAARYNKPDNEIVDHYTYAILGDGCQMEGIANEACSLAGHWGLGKLIAFYDDNHISIDGNTEIAFTESVDSRFEGLGWHVIWVKNGNNGYDDIRAAIKEAKAVKDKPTLIKVTTTIGYGSPNKANSYSVHGSALGAKEVDATRQNLGWSHEPFHVPEDVKKHWSRHTPEGAALEAEWNAKFAEYEKKYKEEAAELKSIINGEFPAGWEKALPTYTPESPADATRNLSQTNLNALAKVLPGLLGGSADLASSNMTLLKMFGDFQKDTPAERNVRFGVREHGMGAICNGIALHSPGLIPYCATFFVFTDYMRGAIRLSALSEAGVIYVMTHDSIGLGEDGPTHQPIEHLASFRAMPNILMLRPADGNETAGAYKVAVLNRKRPSILALSRQKLPQLPGTSIEGVEKGGYTISDNSTGNKPDVILIGTGSELEIAAKAADDLRKEGKAVRVVSLVSWELFDEQSEAYKESVFPAAVSARVSIEAGSTFGWEKIVGAKGKAIGIDRFGASAPAGRIYKEFGITKEAVVAAAKELI

SEQ ID NO: 9590 - DNA, 1911 bp, Physcomitrella patens subsp. patens
  CDS (1)..(1911)
atgggatgtgctcccatgggccacattttgtacgacgaggtgatgaagtacaacccgaagaacccatactggttcaacagggatcgattcgttctgtccgccggtcacggttgtatgctccagtatgcccttcttcacctggcaggatacgacagtgtcacgactgaggacttaaagcaatttaggcagtggggcagcaagacgcctggacaccccgagaattttgagaccccaggagtggaggtgaccaccggccctcttggaatgggaattgccaacgccgtcggtttggctttggctgaatctaatttggccgcccgtttcaacaagcctgacgcaaagatcgttgaccactacacatactgtatccttggagacggttgcaacatggaaggtatctccaacgaggctgcttcattggcaggtcattggggtttgggaaagctcatctgtttgtacgatgacaaccacatttccattgacggagacactgatatcgccttcacggaaagcgtagaccgcagatttgatgcactcggatggcacactatctgggtccagaatggaaacgatgactacgatgctatccgagctgccatcgaggaggcgaagtcagtaactgataagcccacaatgatcaaggtgacaaccacaatcggatatggttcaccaaacaaggccaactcatacgctgtgcatggtgccgctctgggaacaaaagaagtagatgcaacccgccaaaaccttaaatgggaccatgagcctttcttcgttcccgaggaggtcaagagtcactggagcaagcacatcgatcttggatccaagctggaatctgactgggaagctgcccttgaggcgtactcgaagtcataccccgaagaggctgcagagtttaaacagctgattagcttggaattgccagcgggctgggacacttctctccctgccttcacccctgaagacgctggcgatgctacccgtaacttgtctcaaaggtgtttgaacgccttggcaaggacattgcctggtcttattggaggaagtgctgatttggcgtcatcaaacatgactttgatgaagatgttcggggactaccagaagagcacgccaggtgaacgcaatgttagattcggagttagggagcaagccatgggcgccatctgcaacggcattctcttgcacaggagcggattgatcccttactgcgcaaccttcttcatctttaccgactatctgagatcggcaatgagaatttctgctctgtccgaggcgggtgtgatttacgtcatgacccacgattccatcggcctgggtgaagatggacctacccatcagcctatcgagcatttggccagtttcagggccatgccccagatgttgatgttcaggccagctgatggaaatgaaacgtcaggcgcttacaaggtggccgtgcagaacaggaccaggccttccacgttggccctctccaggcagaaactgccaaatcttgctggaacctccatcgacaacgttgccttgggaggttataagctgtcttgcaactctacagacaacaagcccgacctcatcatcttggccacgggttcagagcttgagatcgcagcgaaggccgcggacatcatccgtggggaaggcaagacggtgcgagtggtgtcgtttgtgtgctgggagttgtacgaggagcagagtgcggagtacaaggagagtgttttgccgaaggcagtgactgccagggtgtcgatcgaggctggatcaacctttgggtgggagagatacgttggcctcaagggcaaaagcattggtatcgaccgcttcggagccagtgcccctgctggcaccctgtacaaggagttcggattcaccgtagagaatctcctggcgaaggcgaaagaagtgatgggtgcttaa

SEQ ID NO: 9591 - protein, 636 aa, Physcomitrella patens subsp. patens
MGCAPMGHILYDEVMKYNPKNPYWFNRDRFVLSAGHGCMLQYALLHLAGYDSVTTEDLKQFRQWGSKTPGHPENFETPGVEVTTGPLGMGIANAVGLALAESNLAARFNKPDAKIVDHYTYCILGDGCNMEGISNEAASLAGHWGLGKLICLYDDNHISIDGDTDIAFTESVDRRFDALGWHTIWVQNGNDDYDAIRAAIEEAKSVTDKPTMIKVTTTIGYGSPNKANSYAVHGAALGTKEVDATRQNLKWDHEPFFVPEEVKSHWSKHIDLGSKLESDWEAALEAYSKSYPEEAAEFKQLISLELPAGWDTSLPAFTPEDAGDATRNLSQRCLNALARTLPGLIGGSADLASSNMTLMKMFGDYQKSTPGERNVRFGVREQAMGAICNGILLHRSGLIPYCATFFIFTDYLRSAMRISALSEAGVIYVMTHDSIGLGEDGPTHQPIEHLASFRAMPQMLMFRPADGNETSGAYKVAVQNRTRPSTLALSRQKLPNLAGTSIDNVALGGYKLSCNSTDNKPDLIILATGSELEIAAKAADIIRGEGKTVRVVSFVCWELYEEQSAEYKESVLPKAVTARVSIEAGSTFGWERYVGLKGKSIGIDRFGASAPAGTLYKEFGFTVENLLAKAKEVMGA

SEQ ID NO: 9592 - DNA, 2079 bp, Physcomitrella patens subsp. patens
  CDS (1)..(2079)
atgcctgctcggaatgcgcgcagggggaagcaggtgtccgtgcgcgcgaccgccgctgtggagattgcccagaagactgatgacgccttggtggagaagtcggtgaacaccatccgatttttggctatcgatgctgtggagaaggcgaattcgggtcaccctggtctgccaatgggatgtgcccccatgggacacattttgtacgatgaggtgatgaagtataacccgaagaacccgtactggttcaacagggaccgattcgtattgtctgctggccacggatgcatgctccagtatgctctcctccacctcgccgggtacgacagcgttaagcaagaggacttgaagcagtttaggcagtggggaagcagaacccctgggcaccccgagaattttgagacccccggtattgaggtgaccaccggtcctctcggccagggtatcgctaacgccgttggtttggccttggccgaagcccatttggctgcccgtttcaacaagcctgacgccaagatcgtggaccactacacttactgtattgtgggagatggttgcaacatggagggcatctccaacgaggcggcttcgctggcgggtcactgggggcttggcaagttgatctgtttgtacgacgacaaccatatctcgatcgacggagacaccgagatcgctttcacggagaacgtggacgctcgctttgaggccctgggatggcacacgatctgggtgaaaaacggcaacaccggctacgacgagatccgtgccgcaattgaagaggccaagtccgtgacagacaagccaacgatgattaaggtgacgaccaccatcggtttcgggtcgccgaataaggcgaactcgtatgctgtgcacggtgcagcgttgggaggcaaggaggtggaggcgactcggcagaacctgggatggccatatgagcccttccacgtgcccgacgaggtcaagagccactggagcaagcacactgacctgggaaccaagtaccagagcgagtgggaagctgctgtggaggagtacgcacagaagtaccctgaggagggtgccgagttcaagcagttgatcagcggtgaattgcccgatggctgggacaaggctcttccttcgttcactcccgaggacgctggtgacgccacccgcaacttgtcccagaggtgtttgaacgccttggctaggactcttccaggacttatcggtggcagtgccgatttggcgtcgtcgaacatgactctgatgaagatgttcggagatttccagaaaagcacccctgctgagcgcaacgtgaggtttggagtgagggagcacgctatgggagctatttgtaacggaatgctgcagcacttgagtggtctgatcccgtactgcgccacattcttcattttcactgactacttgagggcggcgatgaggatttccgccttggccgaggctggtgtgatctacgtgatgacccacgactcgattggtttgggagaggatggtcccacccatcagcccattgagcatttggccagctttagggccatgcccaacatgttgatgctgaggcctgcggacggaaacgagacctcgggagcttacaaggtggcagtgctgaacaggaagagaccatcgaccttggctttgtcgcgacagaaactgcccaacttgcccggaacctccatcgacaatgtccagctcggcgcatacgcgatctcggatgattccaaggacaacaaacccgacctgatcctgatggcttcgggttcggagctggagatcgccgcgaaggccgcggacgtgatcaggggcgagggcaagaccgtgagggtgatctcgttcgtttgctgggagttgttcgaggagcagagcgcggaatacaaggaatctttgttgccctctgatgtgacggcccgtgtgtcggtggaggccggcgccacgttcggttgggagaggttcgtcggcctggagggcagggcgatcggagtggaccactttggtgccagtgccccagccaacattctgtacaaggagttcggaattaccgtcgacaacgtggtggcgaaggcgaaggaagtgatggcctaa

SEQ ID NO: 9593 - protein, 692 aa, Physcomitrella patens subsp. patens
MPARNARRGKQVSVRATAAVEIAQKTDDALVEKSVNTIRFLAIDAVEKANSGHPGLPMGCAPMGHILYDEVMKYNPKNPYWFNRDRFVLSAGHGCMLQYALLHLAGYDSVKQEDLKQFRQWGSRTPGHPENFETPGIEVTTGPLGQGIANAVGLALAEAHLAARFNKPDAKIVDHYTYCIVGDGCNMEGISNEAASLAGHWGLGKLICLYDDNHISIDGDTEIAFTENVDARFEALGWHTIWVKNGNTGYDEIRAAIEEAKSVTDKPTMIKVTTTIGFGSPNKANSYAVHGAALGGKEVEATRQNLGWPYEPFHVPDEVKSHWSKHTDLGTKYQSEWEAAVEEYAQKYPEEGAEFKQLISGELPDGWDKALPSFTPEDAGDATRNLSQRCLNALARTLPGLIGGSADLASSNMTLMKMFGDFQKSTPAERNVRFGVREHAMGAICNGMLQHLSGLIPYCATFFIFTDYLRAAMRISALAEAGVIYVMTHDSIGLGEDGPTHQPIEHLASFRAMPNMLMLRPADGNETSGAYKVAVLNRKRPSTLALSRQKLPNLPGTSIDNVQLGAYAISDDSKDNKPDLILMASGSELEIAAKAADVIRGEGKTVRVISFVCWELFEEQSAEYKESLLPSDVTARVSVEAGATFGWERFVGLEGRAIGVDHFGASAPANILYKEFGITVDNVVAKAKEVMA

SEQ ID NO: 9594 - DNA, 2148 bp, Physcomitrella patens subsp. patens
  CDS (1)..(2148)
atggcagcggcgaggtgtaatgtggctgcggttgcaggcgctgtggcgcctgctgccgtgcgcggaactgctcaggctcggaatgcacgcaaggggaagaaggtgtccgtgcgcgccactgcctctgtggagaccgctcagaagactgataacgccttggtggagaagtcggttaacaccatccgatttttggctatcgacgccgtggagaaggcgaattctggtcaccctggtctgcctatggggtgcgctcccatggggcacattttgtacgatgaggtgatgaagtacaatccgaagaatccctactggtttaacagggaccgcttcgtgttgtctgctggccacggatgcatgctccagtacgctctcctccacctcgctgggtacgacagtgttcaggaagaagacttaaagcagtttaggcagtggggaagcagaacccctgggcaccccgagaattttgagacccccggtattgaggtgaccaccggtcctctcggccagggtatcgctaacgccgttggtttggccttggccgaagcccacttggctgcccgtttcaacaagcctgacgccaagatcgtggaccactacacttactgtattctgggagacggttgcaacatggagggtatctctaacgaggcggcttcgctggcgggtcactggggactcggcaagttgatctgtttgtatgatgacaaccatatctcgatcgacggagacaccgagatcgctttcacggagaacgtggatgctcgttttgaggctttgggatggcacacgatctgggtgaagaatggcaacaccggctacgacgagatccgtgccgcaatcgaagaggctaagtccgtgacagacaagccaacgatgattaaggtgacgaccaccatcggtttcggatcgccgaataaggcgaactcgtatgctgtgcacggtgcggcgttgggaggcaaggaggtggaggcgactcggcagaacctggggtggccatatgagcccttccacgtgcccgatgaagtcaagagccactggagcaagcacactgacctgggaaccaagtaccagagcgagtgggaagctgctgtggaggagtacgcacagaagtaccctgaagaaggtgccgagttcaagcagttgatcagcggtgaattgcccgaaggctgggacaaggctcttccttctttcacccccgaggacgctggtgacgccacccgcaacttgtcccagagatgtttgaacgccttggccaggacccttccagggctgatcggtggcagtgccgatttggcgtcatcgaacatgaccctgatgaagatgttcggagatttccagaagagcaccccggctgagcgcaacgtgaggtttggagtgagggagcacgccatgggagctatctgtaacggaatgctgcagcacttgagtggtctgatcccgtactgcgccacattcttcattttcactgactacttgagggcggcgatgaggatttccgccttggccgaggctggtgtgatctacgtgatgacccacgactcgattggtttgggagaggatggtcccacccatcagcccattgagcatttggccagctttagggccatgcccaacatgttgatgctgaggcctgcggacggaaacgagacctcgggagcttacaaggtggcagtgctgaacaggaagagaccatcgaccttggctttgtcgcgacaaaaactgcccaacttgcccggaacctccatcgacaatgtccagctcggcgcatacgcgatctcggatgattccaaggacaacaaacccgacctgatcctgatggcttcgggttcggaactggagatcgccgcgaaggccgcggacgtgatcaggggcgagggcaagaccgtgagggtgatctcgttcgtttgctgggagttgttcgaggagcagagcgcggaatacaaggaatctttgttgccctctgatgtgacggcccgtgtgtcggtggaggccggcgccacgttcggttgggagagattcgtcggcctggagggcagggcgatcggagtagaccacttcggtgccagtgccccagccaacattctgtacaaggagttcggaattaccgtcgacaacgtggtggcgaaggcgaaggaagtgatggcctaa

SEQ ID NO: 9595 - protein, 715 aa, Physcomitrella patens subsp. patens
MAAARCNVAAVAGAVAPAAVRGTAQARNARKGKKVSVRATASVETAQKTDNALVEKSVNTIRFLAIDAVEKANSGHPGLPMGCAPMGHILYDEVMKYNPKNPYWFNRDRFVLSAGHGCMLQYALLHLAGYDSVQEEDLKQFRQWGSRTPGHPENFETPGIEVTTGPLGQGIANAVGLALAEAHLAARFNKPDAKIVDHYTYCILGDGCNMEGISNEAASLAGHWGLGKLICLYDDNHISIDGDTEIAFTENVDARFEALGWHTIWVKNGNTGYDEIRAAIEEAKSVTDKPTMIKVTTTIGFGSPNKANSYAVHGAALGGKEVEATRQNLGWPYEPFHVPDEVKSHWSKHTDLGTKYQSEWEAAVEEYAQKYPEEGAEFKQLISGELPEGWDKALPSFTPEDAGDATRNLSQRCLNALARTLPGLIGGSADLASSNMTLMKMFGDFQKSTPAERNVRFGVREHAMGAICNGMLQHLSGLIPYCATFFIFTDYLRAAMRISALAEAGVIYVMTHDSIGLGEDGPTHQPIEHLASFRAMPNMLMLRPADGNETSGAYKVAVLNRKRPSTLALSRQKLPNLPGTSIDNVQLGAYAISDDSKDNKPDLILMASGSELEIAAKAADVIRGEGKTVRVISFVCWELFEEQSAEYKESLLPSDVTARVSVEAGATFGWERFVGLEGRAIGVDHFGASAPANILYKEFGITVDNVVAKAKEVMA

SEQ ID NO: 9596 - DNA, 1998 bp, Physcomitrella patens subsp. patens
  CDS (1)..(1998)
atgaggatgctcaccgtggatgcagtaaacacagccaaggcagggcatcctggcttgcctcttggtatggcggaggtgggatacgtcttgtggcgctacgtcatgaagtttaaccccaagaaccccaactggttcaaccgtgaccgttttgtgctcagtgccggccatggatgtcttctgcagtacattacgttgcatctctctggctacgattctgtacagatcgaagacttaaagcgcctctgtcagattggcagtcgaacccccggtcaccccgagaatgttacgactgacggtatcgaagtcaccaccggtccgcttggtcaaggagtggcaaatgcagttggattggcattagcggagaagcatttggctgctcgcttcaataagcacgacggcaaaatcgttgaccatcgaacgttctgcatcatgggtgatgggtgtgcgatggaggggatcactaacgaggccgcgtcgctcgcagctcattggaagctcaacaagctcacagtgatttatgatgacaaccacaacaccattgacggagacacatctctggcattctcggaggatgtcggcgcaaggtttgaggcgttgggctggaaccgtgtcgtcattgacaacatctatcatgacattgactctttcaaagaagccgtcctcaacttcgcaggcaagagtgataagccgaccttcattcaagtgaaatcacgcatcggacgggagtcagtgaaggagaacaccgctaaagctcaccacggcacctttgacgaggacgatgtgaagcatatgcacaagaacctcaaatgggagaaccgtgagccattctacgtcatccctcaagtttacgaagagtttacagatcatgcaaaacacggtatatcggaggaagaagagtggaacgaggcgttggaagattattcgaaaaagtatccggaagaagctcgcaattttaaggagctcatcagcggcgagctccccaaggactgggagaaagctattcctcattttccagaggacgagaagattgacgcaacccggggatactcggagacatgcttgaacgccgtggcaaaggtgttgcctggcttgatcggtgggagtgccgaccttgcgagctcaaacaaggtctacatgaaagactttcctgacttctccgccgaaacacccgagggtcgcaacatccggtatggcatccgcgagcacgccatggctggcatttccaacgggcttgctctccacaactcgggtttaatccccatagctgcaacttttttgatattcagcgattacatgaagaactcaatgcgcctgtccgccttgagtgaagctggtgtgatctacatcctgacacacgactcaattggactaggagaagatggaccaacacatcagcctgtagagcaattagctgggttaagagccatccctggaatgtatgttttgcgacccgccgatgctaaagaagtagcgggtgcgtacaaggttgcaatctcccggcggcatgcgccaacggtcctgtctctctctcgccaaaaagtggcggccaatgttggtggtacttctgccgagggcgtgttaaagggtggctatgtcgtaagtgacaatactgatgagaacagcctcccagagctcatcttgattggaacaggcacagagctcgccctgtgcgagaaatctgctgagactctacggcaagaaggaaagaaagttcgtgtcgtctcccttgtgtgctggcaattgtttgatcagcaaccagaggagtaccgagagaaaattttgccttctgcaatggagaagcgaatcagtgtcgaagctgggtcccctttcggatggcgtgagtacgttggctccaagggtaaaatcttggctgtctacacgttcggttgcagcggcgcatacacgaaagtcttcgagaaatatgggttcacagcagagaatattactgatgtcgcccagaaacttctaacggaaacggaaaccagaaaccaaaactaa

SEQ ID NO: 9597 - protein, 665 aa, Physcomitrella patens subsp. patens
MRMLTVDAVNTAKAGHPGLPLGMAEVGYVLWRYVMKFNPKNPNWFNRDRFVLSAGHGCLLQYITLHLSGYDSVQIEDLKRLCQIGSRTPGHPENVTTDGIEVTTGPLGQGVANAVGLALAEKHLAARFNKHDGKIVDHRTFCIMGDGCAMEGITNEAASLAAHWKLNKLTVIYDDNHNTIDGDTSLAFSEDVGARFEALGWNRVVIDNIYHDIDSFKEAVLNFAGKSDKPTFIQVKSRIGRESVKENTAKAHHGTFDEDDVKHMHKNLKWENREPFYVIPQVYEEFTDHAKHGISEEEEWNEALEDYSKKYPEEARNFKELISGELPKDWEKAIPHFPEDEKIDATRGYSETCLNAVAKVLPGLIGGSADLASSNKVYMKDFPDFSAETPEGRNIRYGIREHAMAGISNGLALHNSGLIPIAATFLIFSDYMKNSMRLSALSEAGVIYILTHDSIGLGEDGPTHQPVEQLAGLRAIPGMYVLRPADAKEVAGAYKVAISRRHAPTVLSLSRQKVAANVGGTSAEGVLKGGYVVSDNTDENSLPELILIGTGTELALCEKSAETLRQEGKKVRVVSLVCWQLFDQQPEEYREKILPSAMEKRISVEAGSPFGWREYVGSKGKILAVYTFGCSGAYTKVFEKYGFTAENITDVAQKLLTETETRNQN

SEQ ID NO: 9598 - DNA, 1998 bp, Pseudomonas putida GB-1
  CDS (1)..(1998): transl_table=11
atgcccagccgtcgtgaacgtgccaacgccattcgtgccctcagcatggatgccgtgcaaaaggccaacagcggccacccaggtgcccccatgggcatggcggatatcgccgaagtgctttggcgcgactatctgaagcacaacccgagcaacccgagcttcgccgaccgtgaccgcttcgtgctgtccaacggccacggctcgatgctgatctactcgctgctgcacctgaccggctacgacgtcaccatcgatgacatcaaaggcttccgccagctgcacagccgcaccccgggccacccggaatacggctacaccccaggcgtcgagaccaccactggcccgctcggccaaggtatcgccaatgccgtgggcttcgccctggccgaaaaagtgctggctgcccagttcaaccgtgacggccacaacatcgtcgaccacaacacctacgtgttcctcggcgacggctgcatgatggaaggtatctcccacgaagtcgcctcgctggccggcaccctgggcctgaacaagctgatcgccttctacgacgacaacggcatttccatcgacggcgaagtgcacggctggttcaccgacaacaccccggcgcgcttcgaggcgtacaactggcaggtgatccgcaacgtcgacggccacgatgccgaagaaatcaagatggccatcgaaacggcgcgcaaaagcgaccgtccgaccctgatctgctgcaagaccatcatcggtttcggttcgccgaacaagcagggcaaggaagactgccacggtgccccgctgggcaacgacgaaatcgccctggcccgcaaggaactgaactggaaccacggcccgttcgaaatcccagccgacatttatgccgagtgggatgccaaggccgccggtgccaaggccgaagccgactggaaccagcgcttcgacgcctacgccaaggcctacccggagctggctgccgagttcaagcgccgtgacagcggcgagctgccggccgacttcagcgagaaggcccaggcctacatcaacgaagtggctgccaaaggcgaaaccatcgccagccgcaaagccagccagaacgccctgaacgctttcggcccgctgctgcccgagttcctcggcggctcggctgacctggccggctccaacctgaccctgtggaaaggttgcaagggtgtcgaagccaatgacgccagcggcaactacgtgttctacggcgtgcgcgagttcggcatgaccgccatcatgaacggcgttgccctgcacggtggcctggtgccttacggcgcgaccttcctgatgttcatggaatacgcccgcaacgccgtgcgcatgtcggcgctgatgaagcagcgcgtgatccacgtgtacacccacgactccatcggcctgggcgaagacggcccgactcaccagccgatcgagcagctgaccagcctgcgcagcacgccgaacctggacacctggcgcccagccgacgcggtggagtccgccgtgtcctggaaaaacgccctggagcgcaaggacggcccttcggcgctgatcttctcgcgtcagaacctgcagcaccaggaccgcaacgcccagcagatcgccgacatcagccgtggtggctacgtgctcaaggactgcgctggcgagcctgagctgatcctgatcgctaccggttcggaagtgggcctggctgttcaggccttcgacaagctgaccgagcaaggccgcaaggcgcgcgtggtctccatgccgtgcaccagcgtgttcgatgcccaggacgctgcctacaagcagtccgtgctgccgctggaagtcggtgcgcgcatcgccatcgaagccgcccacgccgacttctggtacaagtacgtcggcctggaaggtcgtatcattggcatgaccacctacggtgagtcggcgccagcttcggcactgttcgaagagtttggtttcaccctggagaacatcctgggtactgccgaagagctgctggaagactga

SEQ ID NO: 9599 - protein, 665 aa, Pseudomonas putida GB-1
MPSRRERANAIRALSMDAVQKANSGHPGAPMGMADIAEVLWRDYLKHNPSNPSFADRDRFVLSNGHGSMLIYSLLHLTGYDVTIDDIKGFRQLHSRTPGHPEYGYTPGVETTTGPLGQGIANAVGFALAEKVLAAQFNRDGHNIVDHNTYVFLGDGCMMEGISHEVASLAGTLGLNKLIAFYDDNGISIDGEVHGWFTDNTPARFEAYNWQVIRNVDGHDAEEIKMAIETARKSDRPTLICCKTIIGFGSPNKQGKEDCHGAPLGNDEIALARKELNWNHGPFEIPADIYAEWDAKAAGAKAEADWNQRFDAYAKAYPELAAEFKRRDSGELPADFSEKAQAYINEVAAKGETIASRKASQNALNAFGPLLPEFLGGSADLAGSNLTLWKGCKGVEANDASGNYVFYGVREFGMTAIMNGVALHGGLVPYGATFLMFMEYARNAVRMSALMKQRVIHVYTHDSIGLGEDGPTHQPIEQLTSLRSTPNLDTWRPADAVESAVSWKNALERKDGPSALIFSRQNLQHQDRNAQQIADISRGGYVLKDCAGEPELILIATGSEVGLAVQAFDKLTEQGRKARVVSMPCTSVFDAQDAAYKQSVLPLEVGARIAIEAAHADFWYKYVGLEGRIIGMTTYGESAPASALFEEFGFTLENILGTAEELLED

SEQ ID NO: 9600 - DNA, 2145 bp, Oryza sativa Japonica Group
  CDS (1)..(2145)
atggcgacggcgacgcaagctcccacctcgcccgccgccgcgtccgggcgtggctccgttctccccctcctccgtggccgcccctccacccgcgtccgcctcgccgttggccggcgaccgcagaccgccctccgcgcgcagccgccgggggcggcggaggtggtggagcagtcggtgaacaccatccggttcctcgccgtggactccgtggagaaggccaagtccggccacccgggactccccatggggtgcgcgccgctgggccacgtcctattcgacgagttcctccggttcaaccccaagaacccctactggttcgaccgcgaccgcttcatcctctccgccggccatggatgcatgctccagtacgcactgcttcacctcgccggatacgacagcgtcacgatggatgatctgaaagctttccggcagtggggaagcagaactcctggtcacccagaaaacttcgaaacacctggtgttgaagtcactactggtcctctggggcagggttttgcaaatgctgttggcctagcgcttgctgagaaacatctagctgcccgtttcaataagcctgatttgaaaatcgtggatcatcacacgtatgttatacttggggatggctgccaaatggaaggtgtgtcaaatgaggcatcctcccttgctggtcactggggtctcgggaaactaattgccttctacgatgacaatcatatatcaattgatggtagcacaggcattgctttcactgaagatgcacttgcccgatatgaggcactaggttggcatactatctgggtgaaaaatggtaacacagggtatgatgacatccgtgctgcaattaaggaagcaaaggcagtcaaagacaagccaactcttatcaaggtgactactactattggttatggatccccaaacaaagcaaacacttatagtgttcatggtagcgctctaggtaccaaagaagtagaggcaaccaaaaacaatctttcttggcatcatgaacctttccatgttcctgatgaggtgaaaaggcactggagtcaccatattgatgagggtgcttctctggaagctgaatggaataaaaaaattgttgaatatgaaaagaaatatcgccaggaggctgctgagttaaagagcataatttcaggagaactgccttccgggtgggacaattctcttccaaaatatactcctgaaaatcctgctgatgctacaaggaacttatctcaacaatgcttgaatgctcttgctaaagcaatacctggatttcttggaggtagtgccgatctcgcaacatcaaatatgacattactaaaaatgtttggtgattttcaaaaagacacacctgaagaaagaaacatccgttttggtgtgagagagcatgcaatgggtgccatttccaacggcattgcattgcacagtcctggactaataccttactgtgcaacattctttgtgtttactgactatatgagagctgccattcgtctttcggccttatgtggatcaagggtgatctttgtaatgactcatgattcaattggccttggagaagatgggccaacacatcagcctgttgaacagttattcagcctccgcgccatgccaaacatactaatgcttcgacctgcagatggaaacgagacttctggagcttacaagattgcagttcttaataggcaaaggccctctgtccttgccctttctaggcagaagcttcaacagctgaaaggaacatcagcggaaggcgttgccaagggaggatacattatttctgataattcatcaggaaacaaaccagatatcattctcatcggcactggttctgaacttgagattgtagaaaaagccgcagatgagctgaggaaagatgggaagactgtacgagtagtttcactggtttgctgggaattgtttgaggagcagtcggagaaatacaaggagagtgtttttccaagtgaagtaacttctaggatcagcgtcgaggctggggtcacatttggatgggagaaatatatcggagaaaaaggtaaagctattggtgttgaccgttttggttctagtgcgcctgctgggaaaatatacaaggagcttggtttgacagtggaaaatgtcattgcaacggccaagtcactgtga

SEQ ID NO: 9601 - protein, 714 aa, Oryza sativa Japonica Group
MATATQAPTSPAAASGRGSVLPLLRGRPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSRTPGHPENFETPGVEVTTGPLGQGFANAVGLALAEKHLAARFNKPDLKIVDHHTYVILGDGCQMEGVSNEASSLAGHWGLGKLIAFYDDNHISIDGSTGIAFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSAEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 9602 - DNA, 2037 bp, Oryza sativa Japonica Group
  CDS (1)..(2037)
atgcgcgcggcggcggtcgagacgctcgaggggcaggcggcgacgggggcgctgctcgagaagtcggtgaacacgatccggttcctcgccatcgacgccgtcgagaaggccaactcggggcaccccggcctgcccatggggtgcgcgcccatggggcacatcctctacgacgaggtcatgcggtacaaccccaagaacccctactggttcaaccgcgaccgcttcatcctctccgccggccacggctgcatgctccagtacgccctgctccacctcgccggctacgacgccgtcttggaggaggacttgaagcaattcaggcaatggggaagcaagactccaggccatcccgagaacttcgagacgcccggagttgaagttaccactggacctcttggtcagggtattgcaaatgcagttgggctggcccttgctgagaagcacctggctgctcgtttcaacaagcccgacagcgagattgttgatcactacacctactgtattttgggagatgggtgccagatggagggtatctccaatgaagcttgctcgttggctggccattggggtcttggcaagctgattgcattctatgatgacaaccacatttccattgacggagacacagagattgcattcactgaggatgtgagtgctcgctttgaggctcttgggtggcatacaatctgggttaagaatggaaacgatggctatgatgagattcgtgccgccattaaggaagcaaaggcggtaactgacaagccaacactaatcaaggtgaccaccacaatcggttttggatcacccaacaaggccaactcatacagcgtccacggaagtgctttgggtaccaaagaggttgaagcaaccagagagaaccttggatggccctatgagccattctttgtgcctgaggatgtgaagagccactggagccgccatgtgcctcaaggtgctgcttttgaggctgactggaatgctaagttcgccgagtatgagaagaagtacccagaagatgcagcgaccttgaagagcattgtctcaggggagttgcctgctggctgggctgacgctcttcctaaatacactccagagagccctgcagatgccaccaggaatctgtcacagcagtgcttaaacgcacttgctaaagttgttcctggtcttcttggaggaagtgctgatcttgcatcctccaacatgacattgcttaagatgttcggtgacttccagaaggatacgcctgaggagcgcaatgtccgatttggagtcagggagcatggaatgggcgccatttgcaacggcattgctctgcacagcccaggactcattccatactgtgctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattctgatgcttcgtcctgctgatggtaacgagactgctggggcatacaaaatcgcggtcctcaacaggaagaggccatccgtccttgctctctccaggcaaaagcttgctcagctgcctggtacctcgattgagggtgttgagaagggtgggtacatcgtctctgacaactcaactggcaacaagcctgacttcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaa

SEQ ID NO: 9603 - protein, 678 aa, Oryza sativa Japonica Group
VRAAAVETLEGQAATGALLEKSVNTIRFLAIDAVEKANSGHPGLPMGCAPMGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 9604 - DNA, 2052 bp, Mesorhizobium loti MAFF303099
  CDS (1)..(2052): transl_table=11
gtgtcgcgcaccttttcaagggcgctcccaagcccccaaacccccacctttggaggaaccatgacgtcgcgtgaacaacatgatcggatggccaatgcgatccgctttctctccatggatgccgtcgagaaggcccagtccggccatcccggcctgcccatgggctgcgccgacattgcaacggtgctgttcacccgcttcctgaaatacgatcccaaagccccgcactggcccgaccgcgaccgcttcatcctgtcggctggccatggctcgatgctgctctattcgctgctgcatctgaccggctacgaagacatgaccatcgaccagatcaagcacttccgccagctcggctccaagaccgccggccatcccgaatacggccacgccaccggcatcgagacgacgaccggcccgctcggccagggcctcgccaattcggttggcttcgcgctcggcgagcgcatcatgaacgccgctttcggcaacgacctcgtcagccactacacctatgtgctggccggcgacggctgcctgatggagggcgtttcccaggaagccattgcgctggccgggcatctcaagctcaacaagctgatcgtcttctgggacaacaacaacatctcgatcgacggcccggtctcgctggccgacaacaccgaccaggttgcccgtttccaggcctccggctggaacgccagccatatcgacggcaccgatccggaagccatcgcctacgccatcgaagccgcccgccattccgacaagccgacgatgatcgcctgcaagacgaccatcggcttcggcgcgccgaccaaggccggcaccaacaaggcacacggttcgccgctcggcgccgacgagatcgccggtgcgcgcaagttcttcaactgggagtcgccgcccttcgagattccggccgacatcctcgatgcctggcgcaccgccggcaaggccggagccaagccgcgcgccgactgggaaggccgtctcgccaaggccgagccgaagctgaaggccgagttcgagcgccggctcgccggcaagctgccgtccaatttcgacgccgtcatcgccgactacaagaagaagctctcggccgacaagccgaaggtcgccacccgcaaatcgtcggaaatggcgcttgaggtcatcaacggcgccgttccggaaactatcggcggctccgccgacctgaccggctccaacaacaccaagaccagccagaccaagaacatcacgccggacgattacggccagcgctatgtccactacggcatccgcgagcacggcatggcggcggccatcaacggcctgacgctgcatggcggcctcatcgcctatggcggcaccttcatgtgcttctccgactatgctcgcccgtcgatgcggctttcctcgctgatgggcatccgctcgatcttcgtcatgacccatgattccatcggtctgggcgaggacggcccgacccaccagccggtcgagcatctggcagcgctgcgcgccattcccaaccacaatgtcttccgcccggccgacgccgtggaaaccgcggaatgctggcagatcgcgctcgaatccgaaaagacgccgtcgacgctggcgctgacccgccagaacctgccgacggtgcgcatcgagcactcggccaagaacctgagcagccagggcgcttacgaactggccgcggccagcggcgaggcggcagtgacgatcttcgccaccggctccgaggtcgagatcgcactcggcgcccgcgacctgctcgagaagcatggccacccgacccgcgtcgtgtcggtgccttgcttcgagctgttcgacaagcagagcgacgactaccgcaagaagacgatcggcaacgcgcctatcaagatggcgatcgaggccggcatccgccagggttgggaccatctcatcggctcggacggcatcttcgtcggcatgaccggcttcggcgcctcgggcacgatcgagcagctctacccgcatttcggcatcaccgccgaggcggcggccaaggcggcggaagcccgcctgcacgccaagtaa

SEQ ID NO: 9605 - protein, 683 aa, Mesorhizobium loti MAFF303099
MSRTFSRALPSPQTPTFGGTMTSREQHDRMANAIRFLSMDAVEKAQSGHPGLPMGCADIATVLFTRFLKYDPKAPHWPDRDRFILSAGHGSMLLYSLLHLTGYEDMTIDQIKHFRQLGSKTAGHPEYGHATGIETTTGPLGQGLANSVGFALGERIMNAAFGNDLVSHYTYVLAGDGCLMEGVSQEAIALAGHLKLNKLIVFWDNNNISIDGPVSLADNTDQVARFQASGWNASHIDGTDPEAIAYAIEAARHSDKPTMIACKTTIGFGAPTKAGTNKAHGSPLGADEIAGARKFFNWESPPFEIPADILDAWRTAGKAGAKPRADWEGRLAKAEPKLKAEFERRLAGKLPSNFDAVIADYKKKLSADKPKVATRKSSEMALEVINGAVPETIGGSADLTGSNNTKTSQTKNITPDDYGQRYVHYGIREHGMAAAINGLTLHGGLIAYGGTFMCFSDYARPSMRLSSLMGIRSIFVMTHDSIGLGEDGPTHQPVEHLAALRAIPNHNVFRPADAVETAECWQIALESEKTPSTLALTRQNLPTVRIEHSAKNLSSQGAYELAAASGEAAVTIFATGSEVEIALGARDLLEKHGHPTRVVSVPCFELFDKQSDDYRKKTIGNAPIKMAIEAGIRQGWDHLIGSDGIFVGMTGFGASGTIEQLYPHFGITAEAAAKAAEARLHAK

SEQ ID NO: 9606 - DNA, 1926 bp, Helicobacter pylori 26695
  CDS (1)..(1926): transl_table=11
atgcgattgagtaacgctgacttagaacgattaaaaagcatggcgaatgcacttcgctttttgtgtgcggacatgatagataaggctaatagcgggcatccgggcgtgtgcttgggattagctgatgtgatggtggttttaagcttgcacctaaacctaaaccccactaaccctaaatggctcaatagggataggctggtttttagcggagggcatgcgagcgcgttagcgtatagtttgttgcatttgtggggctttgatttgagtttagaagatttaaagcgtttcaggcaattacactctaaaaccccaggacaccccgaattgcaccacaccgaaggcattgagatcaccacaggtcctttggggcaaggttttgctaacgctgtgggctttagcatggcgagccaatacgctcaaaaccttttggataaagaagccatttctcataaagtctattgcttgtgtggggatggggatttgcaagaaggcattagttatgagagcgcttctttagccgggcaccttcgccttgataacctcattgtgatttacgacagcaaccagatcagcattgaaggcgctatcaatattagttttagcgaacaggttaaaacgcggtttgtggcgcaaaattgggaagtgctagaatgcgatgggcatgactatcaagcgattcataacgctttagaagaagccaaaaaatccaccaaacccacgcttttaatcgctcatacgattattggtaagggggctgttggcttagaggggagtgaaaaaacgcatggctcgcctttaaataaagaagtgttaaaacaatccaaagaaaacgctcaaatcaatcctaacgaaagctttatcattagcccaaaaaacaaaatgcattttgaagaagtgaaagttaggggcgttagtttagaagccttatgggaaaaatccttaagccctaaaataaaagaaaagatccatgcgttaaaggattttgattttagcgccatccattaccccacctttaaaaaaggcgaatctctagccacgagagtgagtaacggcatgattttaaacgctatcgctaaagaatgcgagggctttttaggggggagcgcggatctagccccctctaacaacacgcagttaaaacactctggcgatttccctttagggcaaaacttgcattttgggatcagagagcatgccatgggggctatcactaacgctttagcggcgtatggcttgtttgtgcctttttgcgcgaccttttttgtgtttagcgattacttgatgcccagcattcgtttgagcgctttaatgaaactgaaagccctttttatcttcacgcatgacagcattggcgtgggtgaagatggagcgacgcaccagcccatagagcaattgaaccatttacgcgctttgcccaatttctatgctttcagacccagcgacgcttttgaaaatacggcttgcatgcaaatagcgttaagtttgaacgctcctagtgggcttattttatcacgccagaatttacccgtgcttgatgaggtttctaaagagcgggttttaaaaggggcgtatgttaaacaccattctaaagatcccattatcacgcttgttgcgagcgggagcgaagtgtctttggctttagagagcgctaaaattttagagcgagaaaatatccaaacgcaagtcatcagcgcgccatgctttgacttgttgatagagcaagatgaaagctatcttaaagaactttttaagggtaaagtcttagtcattgaagcgagccgcgcgatagagtggtatcgttttgcggataaaatcattggcatggattcttttgggagctcagcaaagggcgataaactctttgaaaaatttggctttagcgttgaaaacattaccgctcaagcgaaaagattactcaacgcatga

SEQ ID NO: 9607 - protein, 641 aa, Helicobacter pylori 26695
MRLSNADLERLKSMANALRFLCADMIDKANSGHPGVCLGLADVMVVLSLHLNLNPTNPKWLNRDRLVFSGGHASALAYSLLHLWGFDLSLEDLKRFRQLHSKTPGHPELHHTEGIEITTGPLGQGFANAVGFSMASQYAQNLLDKEAISHKVYCLCGDGDLQEGISYESASLAGHLRLDNLIVIYDSNQISIEGAINISFSEQVKTRFVAQNWEVLECDGHDYQAIHNALEEAKKSTKPTLLIAHTIIGKGAVGLEGSEKTHGSPLNKEVLKQSKENAQINPNESFIISPKNKMHFEEVKVRGVSLEALWEKSLSPKIKEKIHALKDFDFSAIHYPTFKKGESLATRVSNGMILNAIAKECEGFLGGSADLAPSNNTQLKHSGDFPLGQNLHFGIREHAMGAITNALAAYGLFVPFCATFFVFSDYLMPSIRLSALMKLKALFIFTHDSIGVGEDGATHQPIEQLNHLRALPNFYAFRPSDAFENTACMQIALSLNAPSGLILSRQNLPVLDEVSKERVLKGAYVKHHSKDPIITLVASGSEVSLALESAKILERENIQTQVISAPCFDLLIEQDESYLKELFKGKVLVIEASRAIEWYRFADKIIGMDSFGSSAKGDKLFEKFGFSVENITAQAKRLLNA

SEQ ID NO: 9608 - DNA, 2001 bp, Chlamydia trachomatis D/UW-3/CX
  CDS (1)..(2001): transl_table=11
atggctggcaatagtgatttagatatagacatcttagaaaagattgcaggaactattaaacagttgagcatagaaagtattcagaaagcatcttcaggtcatccaggaatgcctttaggatgcgcagagctcgctgcttatttatatggttacgtattgcgatataattctaaagattctcgatgggtgaatagggatcgctttgttctctctgctggacatggttctgctcttctttactcttgtttgcatttagcaggattcgatgtaaacctagaggatctgcaacaatttcgtcagctccaatcccgaactcccgggcatccagaatttagagaaactgatggtgtagaagccactacaggacctctaggacaaggagtaggaaatgctgttggaatggctctttcattaaaaatgttaggagccagatttaatcagcctgcgaattctatctttgatgcaaaagtgtattgcttagcaggagatgggtgcttcatggaaggcgtgagtcatgaagcttgtagtttcgcgggttctttaggcttggataatctcgttttgatttatgatcataatgagattattttagacgggactcttcacgatgtaagtattgaggatacaaaacagagattcttagcatatggctgggatgtgtttgaaactgacggacatgattttgagagcttgcatcaggttttcacacagatcaagaaaagccaatgcaaacctacgttgattattgcacatactattattggacacggctcccctaaagaaggaaccaataaagcacatgggtctcctttaggagaggatggtgttgctcaaactaaaagtttctggcatctcccagaagaaaagtttttcgttccttcggcagtgaagatgttctttgctgcaaaacaacaggaaggtaagaaattacaggaagaatggcaagaacgcttccgagtctggtctaaacaagctcccgagcaacatcaagaatatcttcgattgattcaagagatctcgattcaagaactcgaagaaattttgaatcttattgatatgccagagtccatagccgggcgtgcagcttcgaataaagtcattcaggtattagcagaggatattccatccctcgtagggggatcggcggatctctctagttcagatggtacctggatagctaaagaaggaactattagtgctagcgattttcttgggcggaatattcgctatggagtgcgcgaattcggaatgggcacgattatgaacggattagcgtatagtcaagtattccgtccttttgggggaacttttttagtcttttccgattatttgcgttccgcgattcgattagcagcattatctaaattgccggtaatttatcagttcactcatgattcgatttttgttggagaggatggacctacacatcagcctatagagcaaatcatgtcgctgcgggctattccagggctaagagtgattcgtcctgcggatgcgaatgaagtgaaaggagcatggttagctgctttagaaagcgctggtccaacagcgttaattttatctcgacaaaatctacctactcttaaagagacgaaacgttctttcagagaaggagtaagaaagggtgcttatattctggttaaagaggaaggagatcgcccagactatacgctgtgtgcttctggatccgaggtgcatttggctatagaggttgcacaaagtcttatggctttagataatcgtgtgcgagtgatttcattcccttgttgggagctattcgagagacaagacgttgagtatcgcgaatccgtaataggaggagatttagggttgcgtgtttctatagaagcaggtaccgccttgggttggtacaaatacatcggtagcaatggcttagccattgccatggatgggtttggaatgtccggagctcccaatgaggtggcagagacttgcggtttcactgtagataatattgtgcagagaatcctttctgtttag

SEQ ID NO: 9609 - protein, 666 aa, Chlamydia trachomatis D/UW-3/CX
MAGNSDLDIDILEKIAGTIKQLSIESIQKASSGHPGMPLGCAELAAYLYGYVLRYNSKDSRWVNRDRFVLSAGHGSALLYSCLHLAGFDVNLEDLQQFRQLQSRTPGHPEFRETDGVEATTGPLGQGVGNAVGMALSLKMLGARFNQPANSIFDAKVYCLAGDGCFMEGVSHEACSFAGSLGLDNLVLIYDHNEIILDGTLHDVSIEDTKQRFLAYGWDVFETDGHDFESLHQVFTQIKKSQCKPTLIIAHTIIGHGSPKEGTNKAHGSPLGEDGVAQTKSFWHLPEEKFFVPSAVKMFFAAKQQEGKKLQEEWQERFRVWSKQAPEQHQEYLRLIQEISIQELEEILNLIDMPESIAGRAASNKVIQVLAEDIPSLVGGSADLSSSDGTWIAKEGTISASDFLGRNIRYGVREFGMGTIMNGLAYSQVFRPFGGTFLVFSDYLRSAIRLAALSKLPVIYQFTHDSIFVGEDGPTHQPIEQIMSLRAIPGLRVIRPADANEVKGAWLAALESAGPTALILSRQNLPTLKETKRSFREGVRKGAYILVKEEGDRPDYTLCASGSEVHLAIEVAQSLMALDNRVRVISFPCWELFERQDVEYRESVIGGDLGLRVSIEAGTALGWYKYIGSNGLAIAMDGFGMSGAPNEVAETCGFTVDNIVQRILSV

SEQ ID NO: 9610 - DNA, 2085 bp, Vibrio cholerae O1 biovar eltor str. N16961
  CDS (1)..(2085): transl_table=11
ttgcagcagcaggggggctttgcgacaatagccgccactgattttccgcatccattcatttcgcttacttcccatttaggagtcgacatgtcttctcgcaaacaacttgccaatgctatccgcgccctgagcatggacggcgttcaaaaagctaactctggccacccgggagccccaatgggcatggcggatatcgccgaagtgctgtggcgttcacacttaaaccacaacccacaaaacccaaactgggctgaccgcgaccgtttcgtactgtctaacggccacggctctatgctgatttactcgctgctacacctgagcggctatgagctgtcgattgacgatttgaaaaacttccgtcaactacactccaaaacaccgggtcacccagagtacggttatgcaccgggcatcgaaacgactacgggcccactcggccaaggcatcaccaatgccgtaggtatggcgattgctgagaaagcactggcggcgcagttcaacaaaccgggtcacgacatcgttgaccacttcacttatgtgttcatgggtgacggctgtttgatggaaggtatctcgcacgaagcgtgttcactggcgggcacacttggccttggcaaactgattgcgttctgggatgacaacggtatctctatcgacggccacgtggaaggctggttctcagacgacacaccaaaacgttttgaagcgtacggctggcacgtaatcccagcggttgatggtcacgatgcagacgcgattaatgcagcaattgaagcggcgaaagcagaaacctctcgcccaacgctgatttgtaccaaaaccatcatcggtttcggctctccaaacaaagcgggctcacacgactgtcacggcgcgcctctgggcaacgatgaaatcaaagctgcacgtgaattcttgggttgggaacacgctccgtttgaaatcccagcggacatctacgcagcgtgggatgcaaaacaagcaggcgcaagcaaagaagccgcttggaatgagaaattcgccgcttacgcgaaagcttacccagccgaagctgctgaatacaaacgccgcgtagcgggcgagctgccagcgaattgggaagccgcaaccagcgagattatcgctaacctgcaagctaaccctgccaacatcgcatcgcgtaaagcatcacaaaatgcgctggaagcgttcggcaaactgctgccagaatttatgggtggttctgctgacttggcgccttctaacctcaccatgtggtctggctctaagtcactgacagcagaagatgcgtcaggcaactacatccactacggtgtgcgtgagtttggtatgacggccatcatcaacggtatcgcgctgcacggcggttttgtcccttacggtgcaaccttcctgatgtttatggaatacgcgcgtaacgcgatgcgtatggcagcactgatgaaagtgcaaaatatccaagtgtacacgcatgactctatcggtctgggtgaagatggcccaactcaccaaccagttgagcaaatcgcttctctgcgtatgacaccaaacatgagcacatggcgcccatgtgaccaagtggaatcggcagtggcttggaaactggccatcgagcgtaaagatgcgccatctgcgctgattttctcgcgtcaaaaccttgcgcagcaaccacgcagcgcagagcaagtcgcgaacatcgctaaaggcggttacatcctgaaagattgtgcaggccaacctgagctaattctgattgcaacaggctctgaagtggaactggcggttgccgcttacgagcaactgagcgccgaaggtaaagcggttcgcgtcgtttctatgccatcgaccgatgcgtttgataagcaagatgcggcttaccgtgaagccgttctgccagccgctgtgactaagcgtatcgcgattgaagcgggcattgccgacttctggtacaagtacgttggctttggtggtcgcatcatcggtatgactagcttcggtgaatcagcaccagcgggtgagctgttcaaactgtttggtttcacgactgaaaacgtagtgaagcaagctaaagaactgctggcgtaa

SEQ ID NO: 9611 - protein, 694 aa, Vibrio cholerae O1 biovar eltor str. N16961
MQQQGGFATIAATDFPHPFISLTSHLGVDMSSRKQLANAIRALSMDGVQKANSGHPGAPMGMADIAEVLWRSHLNHNPQNPNWADRDRFVLSNGHGSMLIYSLLHLSGYELSIDDLKNFRQLHSKTPGHPEYGYAPGIETTTGPLGQGITNAVGMAIAEKALAAQFNKPGHDIVDHFTYVFMGDGCLMEGISHEACSLAGTLGLGKLIAFWDDNGISIDGHVEGWFSDDTPKRFEAYGWHVIPAVDGHDADAINAAIEAAKAETSRPTLICTKTIIGFGSPNKAGSHDCHGAPLGNDEIKAAREFLGWEHAPFEIPADIYAAWDAKQAGASKEAAWNEKFAAYAKAYPAEAAEYKRRVAGELPANWEAATSEIIANLQANPANIASRKASQNALEAFGKLLPEFMGGSADLAPSNLTMWSGSKSLTAEDASGNYIHYGVREFGMTAIINGIALHGGFVPYGATFLMFMEYARNAMRMAALMKVQNIQVYTHDSIGLGEDGPTHQPVEQIASLRMTPNMSTWRPCDQVESAVAWKLAIERKDAPSALIFSRQNLAQQPRSAEQVANIAKGGYILKDCAGQPELILIATGSEVELAVAAYEQLSAEGKAVRVVSMPSTDAFDKQDAAYREAVLPAAVTKRIAIEAGIADFWYKYVGFGGRIIGMTSFGESAPAGELFKLFGFTTENVVKQAKELLA

SEQ ID NO: 9612 - DNA, 2043 bp, Vibrio cholerae O1 biovar eltor str. N16961
  CDS (1)..(2043): transl_table=11
ttgttgaacgcactccgttcaacctcctttattgaaatgagtaacactatgaatcgcaaacaacttgccaatgctattcgtgccctgagcatggacggcgttcaaaaagctaactctggccacccgggagccccaatgggcatggcggatatcgccgaagtgctgtggcgttcacacttaaaccacaacccacaaaacccaaactgggctgaccgcgaccgtttcgtactgtctaatggccacggctctatgctgatttactcgctgctgcacctgagcggttatgagctgtcgattgacgatttgaaaaacttccgtcaactgcactccaaaacaccgggtcacccagagtacggttacgcaccgggcatcgaaaccaccactggcccactcggccaaggcatcaccaatgccgtaggtatggcgattgctgaaaaagctctggcggcgcagttcaacaaaccgggtcacgacatcgttgaccacttcacttatgtattcatgggtgacggctgtttgatggaaggtatctcgcacgaagcctgttcactagcaggcacacttggccttggcaaactgattgcattctgggatgacaacggtatttctatcgacggtcacgtagaaggctggttctcagacgacacaccaaaacgctttgaagcgtacggctggcacgtaattccagcagttgatggccacgatgcagatgcgattaacgctgcgattgaagcggcgaaagcagaaacgtctcgcccaacgctgatttgtaccaaaaccatcatcggtttcggctcaccaaacaaagcgggctcccacgactgtcacggtgcgcctctgggcaacgatgaaatcaaagccgcgcgtgaattcttgggttgggaatacgctccatttgaaatcccgactgacatctacgccgcgtgggatgcaaaacaagcaggcgcaagcaaagaagccgcttgggatgagaaattcgcggcttacgcgaaagcttacccagccgaagctgctgaatataaacgccgcgtagcaggcgagctgccagcgaattgggaagccgcgaccagcgagattatcgctaacctgcaagctaaccctgccaacatcgcatcgcgtaaagcatcacaaaatgcgctggaagcgtttggcaaactgctaccagaatttatgggcggttctgctgacttggcgccttctaacctcaccatgtggtctggctctaagtcactgacagcagaagatgcgtcaggcaactacatccactacggtgtgcgtgagtttggtatgacggccatcatcaacggtatcgcgctgcacggcggttttgtcccttacggtgcaaccttcctgatgttcatggaatacgcgcgtaacgcgatgcgtatggcagcactgatgaaagtgcaaaacatccaagtgtacacgcatgactctattggtctgggtgaagatggcccaactcaccaaccggttgagcaaatcgcttctctgcgtatgacaccaaacatgagcacatggcgtccatgtgaccaagtagaatcggcagtggcttggaaactggccatcgagcgtaaagatgctccatctgcgctgattttctcgcgtcaaaacctcgcgcagcaaccacgcagcgcagagcaagtcgcgaacatcgctaaaggcggctacatcctgaaagattgtgcaggccaacctgaactgatcctgattgcgacaggctctgaagtggaactcgcggttgccgcttacgagcaactgagcgccgaaggcaaagcggttcgcgtagtttctatgccatcgaccgatgcatttgataagcaagatgcggcttaccgtgaagccgttctgccagccgccgtgaccaagcgtatcgcgattgaagcgggcattgccgacttctggtacaagtacgttggctttggcggtcgcatcatcggtatgaccagctttggcgaatcagcaccagccggtgaactgttcaaactgtttggtttcacaactgaaaacgtagtgaaacaagccaaagaactactggcgtaa

SEQ ID NO: 9613 - protein, 680 aa, Vibrio cholerae O1 biovar eltor str. N16961
MLNALRSTSFIEMSNTMNRKQLANAIRALSMDGVQKANSGHPGAPMGMADIAEVLWRSHLNHNPQNPNWADRDRFVLSNGHGSMLIYSLLHLSGYELSIDDLKNFRQLHSKTPGHPEYGYAPGIETTTGPLGQGITNAVGMAIAEKALAAQFNKPGHDIVDHFTYVFMGDGCLMEGISHEACSLAGTLGLGKLIAFWDDNGISIDGHVEGWFSDDTPKRFEAYGWHVIPAVDGHDADAINAAIEAAKAETSRPTLICTKTIIGFGSPNKAGSHDCHGAPLGNDEIKAAREFLGWEYAPFEIPTDIYAAWDAKQAGASKEAAWDEKFAAYAKAYPAEAAEYKRRVAGELPANWEAATSEIIANLQANPANIASRKASQNALEAFGKLLPEFMGGSADLAPSNLTMWSGSKSLTAEDASGNYIHYGVREFGMTAIINGIALHGGFVPYGATFLMFMEYARNAMRMAALMKVQNIQVYTHDSIGLGEDGPTHQPVEQIASLRMTPNMSTWRPCDQVESAVAWKLAIERKDAPSALIFSRQNLAQQPRSAEQVANIAKGGYILKDCAGQPELILIATGSEVELAVAAYEQLSAEGKAVRVVSMPSTDAFDKQDAAYREAVLPAAVTKRIAIEAGIADFWYKYVGFGGRIIGMTSFGESAPAGELFKLFGFTTENVVKQAKELLA

SEQ ID NO: 9614 - DNA, 1998 bp, Pseudomonas aeruginosa PAO1
  CDS (1)..(1998): transl_table=11
atgcccagccgtcgtgagcgagccaatgccatccgtgcactgagcatggatgccgtgcagaaagccaacagcggccacccgggcgccccgatgggcatggccgatatcgccgaggtcctctggcgcgactacatgcagcacaacccgagcaacccgcagtgggccaaccgcgaccgcttcgtgctgtccaacggccacggctcgatgctgatctactccctgctgcacctcaccgggtacgacctcggcatcgaggacctgaagaacttccgccagctcaactcgcgcaccccgggccacccggagtacggctacaccgccggcgtcgagaccaccaccggtccgctcggccagggcatcgccaatgcggtgggcatggcgctggcggagaaggtcctggccgcccagttcaaccgcgacggccacgcggtggtcgaccactacacctacgccttcctcggcgacggctgcatgatggaaggcatttcccatgaggtcgcctcgctggccggcaccctgcgcctgaacaagctgatcgccttctacgacgacaacggcatttccatcgacggcgaggtccacggctggttcaccgacgacaccccgaagcgcttcgaggcctatggctggcaagtgatccgcaacgtcgacgggcatgacgccgacgagatcaagaccgccatcgataccgcgcgcaagagcgaccagccgaccctgatctgctgcaagaccgtgatcggtttcggctcgccgaacaagcagggcaaggaagagtgccacggcgcgccgctgggcgccgacgagatcgccgcgacccgcgccgcgctgggctgggagcacgctccgttcgagatcccggcgcagatctacgccgagtgggacgccaaggaaaccggcgccgcccaggaagccgagtggaacaagcgtttcgccgcctaccaggctgcccatccggaactggccgccgaattgctgcgccgcctgaagggcgagctgccggccgacttcgccgagaaggccgcggcctacgtcgccgatgttgccaacaagggtgagaccatcgccagccgcaaggccagccagaacgcgctgaacgccttcggcccgctgctgccggagctgctcggcggttccgccgacctggccggctccaacctgaccttgtggaagggctgcaagggcgtcagcgccgacgacgccgccggcaactacgtgttctacggcgtgcgcgaattcggcatgagcgcgatcatgaatggcgtcgccctgcacggcggtttcattccctacggtgcgaccttcctgatcttcatggaatacgcgcgcaacgccgtgcgcatgtccgcactgatgaagcagcgcgtgctctacgtgttcacccacgactccatcggcctcggcgaggacggcccgacccaccagccgatcgaacaactggccagcctgcgcctgaccccgaacctggacacctggcgcccggccgacgcggtcgagtcggcggtggcctggaagcatgccatcgagcgcgccgacggtccgtccgcgctgatcttctcccgccagaacctgccgcaccaggcgcgcgacgtcgcccaggtggccgacatcgcccgcggcggctacgtgctgaaggactgcgaaggcgagccggaactgatcctgatcgccaccggttcggaagtcggcctggccgtgcaggcctacgacaagctcagcgagcagggccgcaaggtccgcgtggtatcgatgccatgcaccagcgtctacgagcagcaggacgagtcctacaagcagtccgtgctgccggtggaagtcggcgcgcgcatcgccatcgaggccgcccatgccgactactggtacaagtacgtcggtctcgacgggcgcatcatcggcatgaccagcttcggcgagtcggcgccggccccggcgctgttcgagcacttcggcttcaccctggacaacgtcctggcggtggccgaggagctgctggaagactga

SEQ ID NO: 9615 - protein, 665 aa, Pseudomonas aeruginosa PAO1
MPSRRERANAIRALSMDAVQKANSGHPGAPMGMADIAEVLWRDYMQHNPSNPQWANRDRFVLSNGHGSMLIYSLLHLTGYDLGIEDLKNFRQLNSRTPGHPEYGYTAGVETTTGPLGQGIANAVGMALAEKVLAAQFNRDGHAVVDHYTYAFLGDGCMMEGISHEVASLAGTLRLNKLIAFYDDNGISIDGEVHGWFTDDTPKRFEAYGWQVIRNVDGHDADEIKTAIDTARKSDQPTLICCKTVIGFGSPNKQGKEECHGAPLGADEIAATRAALGWEHAPFEIPAQIYAEWDAKETGAAQEAEWNKRFAAYQAAHPELAAELLRRLKGELPADFAEKAAAYVADVANKGETIASRKASQNALNAFGPLLPELLGGSADLAGSNLTLWKGCKGVSADDAAGNYVFYGVREFGMSAIMNGVALHGGFIPYGATFLIFMEYARNAVRMSALMKQRVLYVFTHDSIGLGEDGPTHQPIEQLASLRLTPNLDTWRPADAVESAVAWKHAIERADGPSALIFSRQNLPHQARDVAQVADIARGGYVLKDCEGEPELILIATGSEVGLAVQAYDKLSEQGRKVRVVSMPCTSVYEQQDESYKQSVLPVEVGARIAIEAAHADYWYKYVGLDGRIIGMTSFGESAPAPALFEHFGFTLDNVLAVAEELLED

SEQ ID NO: 9616 - DNA, 1977 bp, Lactococcus lactis subsp. lactis Il1403
  CDS (1)..(1977): transl_table=11
atgtttgatactactgatcaattggctgtaaatacgattcgtactctatcattagatgcgattcaaaaagcaaattcaggacatcctggacttccaatgggctctgcaccaatggcttatgtactttggagcaaatttcttaatgtgaaccctaagacaagtcgtaaatggtcaaatcgtgaccgttttgtcttgtctgctggtcatggttctgcaatgttatatagtttattacatttggcaggttataatgtaacgactgatgatttaaaaggtttccgtcaatggcaatcaaaaacaccgggacatccagaagttaatcatacagatggtgttgaagcaacaacaggtcctttaggacaaggaattgccaatgctgtcggaatggcaatggctgaagcacatttagcagcacaatacaataaacctggttttgatattgttgaccattacacttacgccttaaatggtgatggtgatttgatggaaggtgtttcacaagaagcagcttcacttgcaggtaaattgaaacttggtaaattgattcttttctatgattcaaataatatttctctagatggtgacttatctatgtcatttattgatgatattcaaaaacgttttgaatcatatggctggcaacatttattggtaaaagatggaaatgatttagaagaaatcgcagcagctgttgaagtggctaaagctgaaaaatctaaaccaacaatcattgaagttaaaacagtcattggttttggtgctgaaaaacaaggaacttcagcagttcacggagctcctcttggagctgaaggtgttgcatttgccaagaaagcatatggttgggattatcctgaatttacagttcctgaagaagtatcaaaacgctttttagaaacgacagttgcgcgtggtgaagcgatggagcaagtatggcgcagtacttttgatgattattctgaaaaataccctgagcttgctgagcaatacgcaaaagcttttgaaaatgaaacgccagagcttactttgaccaagcatgaaatggaaacaagcaaggccagccgtgtaacttcacaagaagctatccaagaattatcagctcaaatgccaaatctttggggtgggtctgctgacctttcggcttcaaataatacaatggttaaagttgaagaagacttcatgccagataactatgctggacgtaatatttggtttggtgtacgtgaatttgcaatgggagccattatgaatgggattgctttgcatggtggaactcgtgtctatggcggaacattcttcgtcttctcaaactacatgcttccttctgttcggatggctgctctacaaagcttaccagttacttatgtttggacacatgattccattgctgttggggaagatggtccaactcacgaacctgttgaacaattagcttctgttcgctcaattcctaatttggatgtaattcgtccagctgatggaaatgaagtagtggctgcatggcgtcgtgctgcatcaagtaaaagccgcccaaccgcacttattttgactcgtcaaaatcttccagttttacctgatacttatgaattggctgaagaaggtctgaatcgtggggcttatattctttcaaaagaagaaggaaaacttgaaggaatcatcattgcgactggttcagaagtagcattagctcttgaagctaagaagactttgggttctggcattcgtgtcgtttcaatgccttcaatgaatatttttgacgaacaagaagcagcttatcgcgaagaaattttaccaaaagatgtaagacgtcgtttagcgattgaagctggtacaagttacggatggggtaaatatgttggacttgatggtgcaacagttacagtagatacttggggcgcttcggcaccagcaaatatcgttcttccagcttacggatttactgctgaaaatgtagttaaagcatacaaagagcttgactaa

SEQ ID NO: 9617 - protein, 658 aa, Lactococcus lactis subsp. lactis Il1403
MFDTTDQLAVNTIRTLSLDAIQKANSGHPGLPMGSAPMAYVLWSKFLNVNPKTSRKWSNRDRFVLSAGHGSAMLYSLLHLAGYNVTTDDLKGFRQWQSKTPGHPEVNHTDGVEATTGPLGQGIANAVGMAMAEAHLAAQYNKPGFDIVDHYTYALNGDGDLMEGVSQEAASLAGKLKLGKLILFYDSNNISLDGDLSMSFIDDIQKRFESYGWQHLLVKDGNDLEEIAAAVEVAKAEKSKPTIIEVKTVIGFGAEKQGTSAVHGAPLGAEGVAFAKKAYGWDYPEFTVPEEVSKRFLETTVARGEAMEQVWRSTFDDYSEKYPELAEQYAKAFENETPELTLTKHEMETSKASRVTSQEAIQELSAQMPNLWGGSADLSASNNTMVKVEEDFMPDNYAGRNIWFGVREFAMGAIMNGIALHGGTRVYGGTFFVFSNYMLPSVRMAALQSLPVTYVWTHDSIAVGEDGPTHEPVEQLASVRSIPNLDVIRPADGNEVVAAWRRAASSKSRPTALILTRQNLPVLPDTYELAEEGLNRGAYILSKEEGKLEGIIIATGSEVALALEAKKTLGSGIRVVSMPSMNIFDEQEAAYREEILPKDVRRRLAIEAGTSYGWGKYVGLDGATVTVDTWGASAPANIVLPAYGFTAENVVKAYKELD

SEQ ID NO: 9618 - DNA, 1980 bp, Neisseria meningitidis MC58
  CDS (1)..(1980): transl_table=11
atgtctcaactggcaaacgcaatccgcttcctctcggccgatgccgttcaaaaagccaattccggccaccccggcgcgcctatgggtatggcggaaatggcggaaacattgtggacgaaattcctcaatcacaaccccgccaaccccaaattctacaaccgcgaccgcttcgtcctctccaacggccacgcgtctatgctgttgtacagcctgctgcacctgaccggctacaacctaagcattgaagacttgaaaaacttccgccaactgcacagcaaaacccccggccatcccgaatacggctacaccgacggcgtggaaaccacgaccggcccgttggggcaagggattgccaacgcggtgggtatggcattggcagaaaaaatccttgccgccgaatttaataaagacggtttgaacatcgtcgatcattacacctacgtctttatgggcgacggctgtctgatggaaggcgtatcgcacgaagcctgttcgctcgccggcaccttgggcttgggcaaactgattgttttatatgatgacaacaatatttccattgatggtaaagtggacggctggtttaccgaaaacatcccgcaacgctttgaaagctacggctggcacgtcgttcccaatgtaaacggtcatgacaccgccgccattcaagccgccatcgaagccgcacgtgccgaaaccggcaaaccgtccatcatctgctgcaaaaccttaatcggcaaaggcagtgccaacaaagaaggcagccacaaaacccacggcgcacctttgggcgcggacgaaatcgaagccacgcgcaaacatttgggctggacttaccccgcctttgaaatcccgcaagaaatttacgatgcgtggaatgccaaagaacaaggcgcgaaactggaagccgactggaacgaactgttcgcgcaatatcaagccaaatatcctgccgaagccgcagaatttgtgcgccgtatggataaaaagctgccggacaatttcgatgaatacgttcaagccgcattgaaagaagtgtgcgccaaagccgaaaccatcgccacccgcaaagccagccaaaacagcatcgaaatcttggcaaaagagttgcctgaattggtaggcggttctgccgacctgaccccgtccaatctgaccgactggtcaaacagcgtctccgttacccgcgacaaaggcggcaactacatccactacggcgtgcgcgagttcggcatgggtgcgattatgaacggtttggtattgcacggcggcgtaaaacccttcggcgcgactttcctgatgttcagcgaatacgagcgcaatgccctgcgtatggctgcgttgatgaaaatcaaccctgtatttgtgtttacccacgattccatcggtttgggcgaagacggcccgacccatcaaccgattgagcaaaccgccaccctgcgcctgattccgaatatggacgtatggcggccgtgcgacaccgccgaatccttggtggcttgggcagaagccgtcaaagccgccgatcacccgtcctgcctgattttcagccgtcaaaacctgaaattccaagcgcgcagcgagcaacaactgaacgacatcaaacgcggcggctacgtcatcagcgaagcccaaggcaacgcccaagccgtcatcattgccaccggctcagaagtcgagctggctttggaagcgcaaaaagccctcgccgcgcaaaacatcgccgtgcgcgtcgtttccatgccgtccaccaacgtattcgaccgccaagacgccgcctatcaagccgccgtcctgcccgaaggcctgccgcgcatcgccgtagaagccggacacgccgacggctggtacaaatatgtcggactgaacggcgcagtcgtcggcatcaaccgcttcggcgaatccgcccctgccgatttactcttcaaagcattcggctttaccgtggacaatgtggttgatacggtgaaatccgtgctgtaa

SEQ ID NO: 9619 - protein, 659 aa, Neisseria meningitidis MC58
MSQLANAIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQAAIEAARAETGKPSIICCKTLIGKGSANKEGSHKTHGAPLGADEIEATRKHLGWTYPAFEIPQEIYDAWNAKEQGAKLEADWNELFAQYQAKYPAEAAEFVRRMDKKLPDNFDEYVQAALKEVCAKAETIATRKASQNSIEILAKELPELVGGSADLTPSNLTDWSNSVSVTRDKGGNYIHYGVREFGMGAIMNGLVLHGGVKPFGATFLMFSEYERNALRMAALMKINPVFVFTHDSIGLGEDGPTHQPIEQTATLRLIPNMDVWRPCDTAESLVAWAEAVKAADHPSCLIFSRQNLKFQARSEQQLNDIKRGGYVISEAQGNAQAVIIATGSEVELALEAQKALAAQNIAVRVVSMPSTNVFDRQDAAYQAAVLPEGLPRIAVEAGHADGWYKYVGLNGAVVGINRFGESAPADLLFKAFGFTVDNVVDTVKSVL

SEQ ID NO: 9620 - DNA, 1980 bp, Neisseria meningitidis Z2491
  CDS (1)..(1980): transl_table=11
atgtctcaactggcaaacgcaatccgcttcctctcggccgatgccgttcaaaaagccaattccggccaccccggcgcgcctatgggtatggcggaaatggcggaaacattgtggacgaaattcctcaatcacaatcccgccaaccccaaattctacaaccgcgaccgcttcgtcctctccaacggccacgcgtctatgctgttgtacagcctgctgcacctgaccggctacaatctgagcattgaagacttgaaaaacttccgccaactgcacagcaaaacccccggccatcccgaatacggctataccgacggcgtggaaaccacgaccggcccgttggggcaagggattgccaacgcggtgggcatggcattagccgaaaaaatccttgccgccgaatttaataaagatggtttgaacatcgtcgatcattacacctacgtctttatgggcgacggctgcctgatggaaggcgtatcgcacgaagcctgctcactcgccggcactttgggcttgggcaaactgattgttttatatgatgacaacaatatttccattgatggtaaagtggacggctggtttaccgaaaacatcccgcaacgctttgaaagctacggctggcacgtcgttcctaacgtaaacggtcatgacaccgccgccattcaagccgccatcgaagccgcacgtgccgaaaccggcaaaccgtccatcatctgctgtaaaaccttaatcggcaaaggcagtgccaataaagaaggcagccacaaaacccacggcgcacctttgggcgcggacgaaatcgaagccacgcgcaaacatttgggctggacttaccctgcctttgaaatcccgcaagaaatttacgatgcgtggaatgccaaagaacaaggcgcgaaactggaagccgaatggaacgaactcttcgcgcaatatcaaaccaaatatcctgccgaagccgcagaatttgtgcgccgtatggataaaaagctgccggacaatttcgatgaatacgttcaagccgcattgaaagaagtgtgcgccaaagccgaaaccatcgccacccgcaaagccagccaaaacagcatcgaaatcttggcaaaagagctgcccgaactggtgggcggctctgccgacctgaccccgtccaacctgaccgactggtcaaacagcgtttccgttacccgcgacaaaggcggcaactacatccactacggcgtgcgcgagttcggtatgggcgcgattatgaacggtttggtattgcacggcggcgtaaaacccttcggcgcgactttcctgatgttcagcgaatacgagcgcaacgccctgcgtatggctgcgttgatgaaaatcaaccctgtatttgtgttcacccacgattccatcggtttgggcgaagacggcccgacccaccagccgattgagcaaaccgccaccctgcgcctgattccgaatatggacgtatggcggccgtgcgacaccgccgaatccttggtcgcttgggcagaagccgtcaaagccgccgatcacccgtcctgcctgattttcagccgtcaaaacctgaaattccaagcgcgcagcgagcaacaactgaacgacatcaaacgcggcggctacgtcatcagcgaagcacaaggcaacgcccaagccgtcatcattgccaccggttccgaagtcgagctggctttggaagcgcaaaaagccctcgccgcgcaaaacatcgccgtgcacgtcgtttccatgccgtccaccaacgtattcgaccgccaagacaccgcctatcaagccgccgtcctgcccgaaagcctgccgcgcatcgccgtagaagccggacacgccgacggctggtacaaatacgtcggactgaacggcgcagtcgtcggcatcaaccgcttcggcgaatccgcccctgccgatttactcttcaaagcattcggctttaccgtggacaatgtggtcgatacagtgaaatcagtgctgtaa

SEQ ID NO: 9621 - protein, 659 aa, Neisseria meningitidis Z2491
MSQLANAIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQAAIEAARAETGKPSIICCKTLIGKGSANKEGSHKTHGAPLGADEIEATRKHLGWTYPAFEIPQEIYDAWNAKEQGAKLEAEWNELFAQYQTKYPAEAAEFVRRMDKKLPDNFDEYVQAALKEVCAKAETIATRKASQNSIEILAKELPELVGGSADLTPSNLTDWSNSVSVTRDKGGNYIHYGVREFGMGAIMNGLVLHGGVKPFGATFLMFSEYERNALRMAALMKINPVFVFTHDSIGLGEDGPTHQPIEQTATLRLIPNMDVWRPCDTAESLVAWAEAVKAADHPSCLIFSRQNLKFQARSEQQLNDIKRGGYVISEAQGNAQAVIIATGSEVELALEAQKALAAQNIAVHVVSMPSTNVFDRQDTAYQAAVLPESLPRIAVEAGHADGWYKYVGLNGAVVGINRFGESAPADLLFKAFGFTVDNVVDTVKSVL

SEQ ID NO: 9622 - DNA, 2004 bp, Escherichia coli O157:H7 EDL933
  CDS (1)..(2004): transl_table=11
  misc_feature (341)..(341): y is t or c
atgtcccgaaaagaccttgccaatgcgattcgcgcactcagtatggatgcggtacaaaaagccaattctggtcatcccggcgcgccgatgggcatggctgatattgccgaagtgctgtggaacgattttcttaaacataaccctaccgacccaacctggtatgatcgcgaccgctttattctttccaacggtcacgcgtcgatgctgctctacagtttgctgcatctgaccggttacgacctgccgctggaagagctgaagaactttcgtcaactgcattcgaaaacccctggccacccggaaatcggctatacgcccggagttgaaaccaccaccggtcytcttggacaaggtttggcgaacgccgtcgggctggcgatagcggaacgtacactggcggcgcagtttaaccagccggatcatgaaattgtcgatcacttcacctatgtgtttatgggcgacggctgcctgatggaaggtatttcccacgaagtctgttcgctggcgggcacgctgggactgggcaagctgattggtttttacgatcacaacggtatttcgattgatggagaaaccgaaggctggtttaccgacgatacggcaaaacgttttgaagcctatcactggcatgtgatccatgaaatcgacggtcacgatccgcaggcggtgaaggaagcaatccttgaagcgcaaagcgtgaaagataagccgtcgctgattatctgccgtacggtgattggctttggttcgccgaataaagcaggtaaggaagaggcgcacggcgcaccgctgggggaagaagaagtggcgctggcacggcaaaaactgggctggcaccatccgccatttgagatccctaaagatatttatcacgcttgggatgcccgcgaaaaaggcgaaaaagcgcagcagagctggaatgagaagtttgccgcctataaaaaggctcatccgcaactggcagaagagtttacccgtcggatgagcggtggtttaccgaaggactgggagaaaacgactcagaaatatatcaatgagttgcaggcgaatccggcgaaaatcgctacccgtaaggcttcgcaaaatacgcttaacgcttacgggccgatgctaccggagctgctcggcggttcggcggatctggctcccagcaacctgaccatctggaaaggttctgtttcgctgaaggaagatccggcgggcaactacattcactacggggtgcgtgaatttggcatgaccgctatcgccaacggcattgcgcaccacggcggctttgtgccgtataccgcaacgttcctgatgtttgttgaatacgcccgtaacgccgcgcggatggcggcactgatgaaagcgcggcagattatggtttatacccacgactcaattggtctgggcgaagatggtccgacgcaccaggctgttgagcaactggccagcctgcgcttaacgccaaatttcagcacctggcgaccgtgcgatcaggtggaagcggcggtgggctggaagctggcggttgagcgccacaacggaccgacggcactgattctctccaggcagaatctggcccaggtggaacgtacgccggatcaggttaaagagattgctcgtggcggttatgtgctgaaagacagcggcggtaagccagatattattttgattgccaccggttcagagatggaaatcaccctgcaagcggcggagaaattagcgggagaaggtcgcaatgttcgcgtggtttccctgccctcgaccgatattttcgacgcccaggatgaggaatatcgggagtcggtgttgccttctaacgttgcggctcgcgtggcggtggaagcaggtattgccgattactggtacaagtatgttggtctgaaaggggcaattgtcgggatgacgggttatggggaatctgctccggcggataagctgttcccgttctttggctttaccgccgagaatattgtggcaaaagcgcataaggtgctgggagtaaaaggtgcctga

SEQ ID NO: 9623 - protein, 667 aa, Escherichia coli O157:H7 EDL933
  misc_feature (114)..(114): The Xaa at location 114 stands for Leu, or Pro.
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGXLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKDIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 9624 - DNA, 1992 bp, Escherichia coli O157:H7 EDL933
  CDS (1)..(1992): transl_table=11
  misc_feature (1834)..(1834): r is g or a
atgtcctcacgtaaagagcttgccaatgctattcgtgcgctgagcatggacgcagtacagaaagccaaatccggtcacccgggtgcccctatgggtatggctgacattgccgaagtcctgtggcgtgatttcctgaaacataacccgcagaatccgtcctgggctgaccgtgaccgcttcgtgctgtccaacggccacggctccatgctgatctacagcctgctgcacctcaccggttacgatctgccgatggaagaactgaaaaacttccgtcagctgcactctaaaactccgggccacccggaagtgggttacaccgctggtgtggaaaccaccaccggtccgctggggcagggtattgccaacgcagtaggtatggcgattgcagaaaaaacgctggcggcgcagtttaaccgtccgggccacgacattgtcgaccactacacctacgccttcatgggcgacggctgcatgatggaaggcatctcccacgaagtttgctctctggcgggtacgctgaagctgggtaaactgattgcgttctacgatgacaacggtatttctatcgatggtcacgttgaaggctggttcaccgacgacaccgcaatgcgtttcgaagcttacggctggcacgttattcgcgacatcgacggtcatgacgcagcatccatcaaacgcgcagtagaagaagcgcgcgcagtgactgacaaaccgtccctgctgatgtgcaaaaccatcatcggtttcggttccccgaacaaagccggtactcacgactcccacggtgcgccgctgggtgatgcagaaatcgctctgacccgcgaacagctgggctggaaatacgcaccgttcgaaatcccgtctgaaatctatgcgcagtgggatgcgaaagaagcaggccaggcgaaagaatctgcatggaatgagaagtttgcggcttacgcgaaagcttatccgcaggaagcggctgaatttacccgccgtatgaaaggcgaaatgccgtctgacttcgacgccaaagcgaaagagtttatcgctaaactgcaggctaatccggcgaaaatcgccagccgtaaagcgtctcagaatgctatcgaagcgttcggcccgctgttgccggaattcctcggcggctccgctgacctggcaccgtctaacctgaccctgtggtctggttctaaagcaatcaacgaagatgctgcgggtaactacatccactacggtgttcgcgagttcggtatgaccgcgattgctaacggtatctccctgcacggtggcttcctgccgtacacctccaccttcctgatgtttgttgaatacgcacgtaacgccgtacgtatggctgcgctgatgaaacagcgtcaggttatggtttacacccacgactccatcggtctgggcgaagatggcccgactcaccagccggttgagcaggttgcttctctgcgcgtgaccccgaacatgtctacatggcgtccgtgtgaccaggttgaatccgcggtcgcgtggaaatacggtgttgagcgtcaggacggtccgaccgcgcttatcctctcccgtcagaacctggcgcagcaggaacgtactgaagagcaactggcaaacatcgcgcgcggtggttatgtgctgaaagactgtgctggtcagccggaactgatcttcatcgcgaccggttcggaagttgaactggctgttgccgcctacgaaaaactgactgccgaaggcgtgaaggcgcgcgtggtttccatgccgtctaccgatgcattcgacaagcaggatgcggcttaccgtgaatccgtactgccgaaagcggttactgcacgcgttgcggtaraagcgggtattgctgactactggtacaagtatgttggcctgaatggcgctatcatcggtatgaccaccttcggtgagtcagctccggcagagttgctgttcgaagagttcggcttcaccgtcgacaacgtcgttgcgaaagcaaaagaactgctgtaa

SEQ ID NO: 9625 - protein, 663 aa, Escherichia coli O157:H7 EDL933
  misc_feature (612)..(612): The Xaa at location 612 stands for Glu, or Lys.
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVXAGIADYWYKYVGLNGAIIGMTTFGESAPAELLFEEFGFTVDNVVAKAKELL

SEQ ID NO: 9626 - DNA, 2001 bp, Deinococcus radiodurans R1
  CDS (1)..(2001): transl_table=11
atgacagaccagagcgtttcccaaaacgtggcgcggctgagtgtgaacaccattcgcacgctcgccattgacgcggtgcaggccgccaactcgggccaccccggtgcgccgctgggcatggccccgatgggctacgtgctgtggcacaagttcctgcgccacaaccccgcgcaccctgagtggccgggccgcgaccgcttcgtgctgtcggcggggcacgcctccatgctgatctacagcctgctgcacctgaccggctaccaggaaatgacgctcgacgacctgcgccacttccggcagtggggctaccacacccccggccaccccgagtttttccacaccaagggtctggacgcgaccaccggcccgcttgggcagggcgcggcgatgacggtgggcatggcgatggccgaagcacacctcgccgcccgctacaaccgcgaaggctttccgattttcgacaaccgcacctacgccatcatgggcgacggcgatctgcaagaaggcatcaaccacgaagccgccgcgctcgccgggcacctgaaactcggcaagctgatctggctgcacgacgacaaccacatccagctcgacacgcccacgaacaaggccgagtccgaggacaccgccgcccgcttccgcgcctatggctggaacgtgctgaaggtggaagacggcgacaatctggacgaaattgaaaaggcgattgccgaggcccgcagccaaagcgagcggcccacgctgattcaggtgcgcaccatcatcggcttcggcagcccgcgcgccggcacgagcaaggcgcacggcgagccgctcggcgaagagggcgtggccgagacgaagaaagcgttgggctgggagtaccccgcttttaccgtgcccgacgaagtggctgcgcacatgaacgctcgcgctaagggtgctcaactcgaagccgactgggaaaaactgatggccgactaccgcaccgcgcaccccgacctcggcaaggaagtggacgcgctgctcgcccgtgaactgcccgccaacctcgccgacctgctgcccaagtacgaagtcggcggcaaggcggcggccacccgcaacgcgagcggcgaagtcatcaacgcgctggcgaaggtgcttcccggtttgatgggcggcagcgcggacctctcgggctcgaccaagaccaccatcaaggacggcggcgagatggaagcgggcaccatgggcgggcgcaacgtgctgttcggcgtgcgcgagttcggcatgagcgccgcgggcaatggcctgagcctctacggcggcctgcacccgatggtaggcaccttcctggtattcgccgactacctcaagccggctttccgcctctcggcgctgcaaatgcagccggtgacttacgtgctgacccacgactccatcggtctgggcgaagacgggccgacccaccagccggtggaccagctcgccatgctgcgagcggtgccgggcgcccacgtcattcgccccgccgacgccaacgaaaccgccgccgcgtggctgatggcgctggaatacgacaagggccccaccgcgctcgccctctcgcgccaggatctgccgattctgcccgccaacatcgaaggcgtgaagaagggcgcgtatgtcctccgagatgtggacggtgccgatggtcagggggctcaagtcatcctgatcgccagcggctcggaagtcgccctggccctgagcagcgccgagcggctggccgaagagggcgtgcaggcccgcgtggtgtccatgccgtgcatggaggtctttcgccagcaggagcagagctaccgcgacagcgtgctgacccccggcgtgaagcgcgtcgccatcgaggccgccagcccgcagccctggtacgagtggacgctcggcggcccagtcatcggcatgacgaccttcggtgcgtcggccccggccaaggtgctgtttgagaagttcggcttcagcgtggaaaacgtggtgaaggtggtccactccgtgctgtaa

SEQ ID NO: 9627 - protein, 666 aa, Deinococcus radiodurans R1
MTDQSVSQNVARLSVNTIRTLAIDAVQAANSGHPGAPLGMAPMGYVLWHKFLRHNPAHPEWPGRDRFVLSAGHASMLIYSLLHLTGYQEMTLDDLRHFRQWGYHTPGHPEFFHTKGLDATTGPLGQGAAMTVGMAMAEAHLAARYNREGFPIFDNRTYAIMGDGDLQEGINHEAAALAGHLKLGKLIWLHDDNHIQLDTPTNKAESEDTAARFRAYGWNVLKVEDGDNLDEIEKAIAEARSQSERPTLIQVRTIIGFGSPRAGTSKAHGEPLGEEGVAETKKALGWEYPAFTVPDEVAAHMNARAKGAQLEADWEKLMADYRTAHPDLGKEVDALLARELPANLADLLPKYEVGGKAAATRNASGEVINALAKVLPGLMGGSADLSGSTKTTIKDGGEMEAGTMGGRNVLFGVREFGMSAAGNGLSLYGGLHPMVGTFLVFADYLKPAFRLSALQMQPVTYVLTHDSIGLGEDGPTHQPVDQLAMLRAVPGAHVIRPADANETAAAWLMALEYDKGPTALALSRQDLPILPANIEGVKKGAYVLRDVDGADGQGAQVILIASGSEVALALSSAERLAEEGVQARVVSMPCMEVFRQQEQSYRDSVLTPGVKRVAIEAASPQPWYEWTLGGPVIGMTTFGASAPAKVLFEKFGFSVENVVKVVHSVL

SEQ ID NO: 9628 - DNA, 2001 bp, Chlamydia muridarum Nigg
  CDS (1)..(2001): transl_table=11
atggctggcaatagtgaattggatatagatatcttggaaaagattgcagggactattaaacagttgagtatagagagtattcaaaaggcttcttcaggccacccaggaatgccattaggatgcgctgagatcgcagcatatttgtatggttgcgtattgcgatataattctaaggattctcaatggatgaatagagatcgatttgttctatctgcagggcatggttctgctcttctttattcttgtctacatttagcaggctttaatgtgaggttagaggatcttcagcagtttcgacaacttcactcccaaactcctgggcatccagaatttcgggaaacggatggtgttgaagcgacaactggacctttagggcaaggaatagggaatgctgtaggaatggctctttcattgaagatgttgggatctagattcaatcagtcttccacgtccatttttgatgctaaggtctattgcttggcaggagatggatgcttcatggaaggagtaagtcatgaagcttgtagctttgcaggttccttgggattggataatcttattttaatctatgattataatgagattattttagatgggactcttcaagatgttagtgttgaggatacgaaacaacgattcttagcctatggctgggatgtttttgaagccaatggtcatgattttgaggatttacatcgggtattttctcaaatcaaaaaagggcaacaaaaacctactttgattattgcacatactattattggtcatggatctcctaaagaaggaacgaacaaagctcatggatcccctttgggagaagatggagtcgcgcaaactaaaagtttttggcacctgccagaagaaaagttttttgtcccttcatctgtgaagatgttctttgcagcaaaacaacaagaaggacaaaaattacaggaagaatggcaggagcgcttccgggtgtggtcaaaacgattcccagaacaacaccaggaatatcttaagttaactcaagaaatttccattcaagatcttgaagtattattgaatcttattgatatgccagagtctatagctggacgggctgcttcaaacaaagtaatccaggttttggcagagaatattccatctctaatagggggatcggcggatctttccagctcagatggtacctggatagctaaggagactgctgtcaacgcttctcattttcaaggtcggaatattcgctatggtgtacgagaattcggcatgggcacgattatgaacggactcgcgtacagccaggtatttcgtccttttggtggaacatttttagtattttcagattatttacgtgcagcgattcgactagcagcattgtctaagcttccggttatttatcaatttacacatgattctatttttgttggggaagatggccctactcatcaacctatagagcaaattatgtcattacgtgcaataccaggattaagggtagtgcgtcctgcggatgcgcatgaagtaaaaggagcctggttatctgcattagaaaactcagggcctacagctttgattctatctagacaaaatctcccaactcttaaagagactaaacggtcgtttagagatggagtaggaagaggagcttatattttagttaaagaagaagggggaagcccggactatacattatgcgcttctgggtcagaggtacatttggcaatggaagttgcgcaaagcctcatggctttggataagcgagttcgcgtaatttcattcccttgttgggagttatttgagcgacaagaccccgagtatcgtgaatctgtgattggtggggacttaggattgcgtgtctctatagaggccggatctgctttggggtggtacaaatatataggcagtaatggcttgtctattgctatggatgtgtttggtatgtctggagctccccacgaagttgctgaaacttgtggttttactgtggatagtattgttcagagaattctttctgtttaa

SEQ ID NO: 9629 - protein, 666 aa, Chlamydia muridarum Nigg
MAGNSELDIDILEKIAGTIKQLSIESIQKASSGHPGMPLGCAEIAAYLYGCVLRYNSKDSQWMNRDRFVLSAGHGSALLYSCLHLAGFNVRLEDLQQFRQLHSQTPGHPEFRETDGVEATTGPLGQGIGNAVGMALSLKMLGSRFNQSSTSIFDAKVYCLAGDGCFMEGVSHEACSFAGSLGLDNLILIYDYNEIILDGTLQDVSVEDTKQRFLAYGWDVFEANGHDFEDLHRVFSQIKKGQQKPTLIIAHTIIGHGSPKEGTNKAHGSPLGEDGVAQTKSFWHLPEEKFFVPSSVKMFFAAKQQEGQKLQEEWQERFRVWSKRFPEQHQEYLKLTQEISIQDLEVLLNLIDMPESIAGRAASNKVIQVLAENIPSLIGGSADLSSSDGTWIAKETAVNASHFQGRNIRYGVREFGMGTIMNGLAYSQVFRPFGGTFLVFSDYLRAAIRLAALSKLPVIYQFTHDSIFVGEDGPTHQPIEQIMSLRAIPGLRVVRPADAHEVKGAWLSALENSGPTALILSRQNLPTLKETKRSFRDGVGRGAYILVKEEGGSPDYTLCASGSEVHLAMEVAQSLMALDKRVRVISFPCWELFERQDPEYRESVIGGDLGLRVSIEAGSALGWYKYIGSNGLSIAMDVFGMSGAPHEVAETCGFTVDSIVQRILSV

SEQ ID NO: 9630 - DNA, 2001 bp, Xylella fastidiosa 9a5c
  CDS (1)..(2001): transl_table=11
atgaccaagcccacacgccgccagttggccaacgcaatccgtttccttgccgctgatgcagtacaggctgctcattctgggcacccgggcatgccgatgggcatggctgatatcgctgaagttctttggaacgatttcctacgccataaccctaacaacccgaactggtttaaccgcgaccgcttcgttctttccaacggtcacggctcgatgttgcaatatgcattgctgcatttaagtggctatgacctgccgttggatgaactcaagcgattccgtcagctgcatagcaaaacagctggtcatcctgagcgcagcgagaccccagggattgagacgaccacggggccacttggtcaggggtttgctaacgcagtgggttttgccttggccgagaaacttctagcgcaacgctacaaccgtccagaacatctgattgtcgatcaccgcacctgggtgttcatgggtgacggctgcctcatggaaggtatctcacatgaagcagccgcgctggcgggtacctggaacttaggcaaattgatttgtttctgggatgacaacaacatttctattgatggcaatactgcgggttggtttaccgaagacactccagcacgattcgaagcctatggttggcatgtaatccgcgatattgatggccatgatgcggaaaaaatcgcaaccgcaatccaagccgccgttgctcaagagaacaagccctcattgctatgctgccgtaccgtgatcggatttggctcacccaataaagcaggtaaagaatcctcgcatggtgccccattaggagcggaggaactggaggccacgcgtaagatgttggattggccatacggcccgttcgagattccgtccgagatttacgatggttggcgtgctaacggcacaggcatgctacgtcaagccgagtgggagcaggggttcgacaactatgcccgacagtatcctaaggaagcagctgaattaacccggcgctcccacgctgagttacctactgattttctcagccaattggatgcttacattgccaaagttcacgctgcggggccctccattgcttcccgtaaagcatcgcagatggcgattgaagcatttgcacctttccttcccgagttaattggcggctcggctgacttggcacattccaatctaacgttgtggaaagggagccaaacagttgttggcgatgcccccaacgccaactatgcctattacggcgtacgtgagtttgggatgagtgctatcgcaaatggacttgcattgcatggcggctttatccccttcgatgcgacatttctagtcttcagtgattacgcccgcaacgcagtgcgtatgagtgcattgatcccagcccatgtgattcacgtttacacacatgattcaattggacttggcgaagacggtccaacgcatcagcctgttgaacacttggccgcactgcgctacatccccaacaatgacgtgtggcgtccctgtgacgcagttgaatctgcagtggcatggaaggcggcgatcactcgcaagaacggcccgagctgtttggtgttcagccgccaaaacttgccgcaccaaccgcgccatgatgcacaacttgagcagattgcacgtggtggctatatcttggtcgacgcggcgagcagcatccccgacatcatcttgatcgcgaccggctcggaagtcagcctagcgatcgaagcgaaaaagacacttgatgcgatgcagctaaaaacacgcgtggtctcgatgccctcgaccaatgtgtttgaacgtcaggaccccacctaccgtgagtcggtcctcccatcgaaagtccacaagcgtgttgcaatagaagctggcgtcactggtttttggtggcaatacgtagggttacatggtgccgtgattggcctggatacctttggtgcatcagccccagcggatgtcttgtacaaacattttaatatcactgcagaacacgttgtcgaagtcgcaaaggcactttag

SEQ ID NO: 9631 - protein, 666 aa, Xylella fastidiosa 9a5c
MTKPTRRQLANAIRFLAADAVQAAHSGHPGMPMGMADIAEVLWNDFLRHNPNNPNWFNRDRFVLSNGHGSMLQYALLHLSGYDLPLDELKRFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQGFDNYARQYPKEAAELTRRSHAELPTDFLSQLDAYIAKVHAAGPSIASRKASQMAIEAFAPFLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRKNGPSCLVFSRQNLPHQPRHDAQLEQIARGGYILVDAASSIPDIILIATGSEVSLAIEAKKTLDAMQLKTRVVSMPSTNVFERQDPTYRESVLPSKVHKRVAIEAGVTGFWWQYVGLHGAVIGLDTFGASAPADVLYKHFNITAEHVVEVAKAL

SEQ ID NO: 9632 - DNA, 1998 bp, Chlamydophila pneumoniae J138
  CDS (1)..(1998): transl_table=11
atgatcaataaagaattagatattggtattttaggaaaaattgctggggctattaaacaaattagtattgaatccatccaaaaggcctcttctggtcatccaggacttcccctaggatgcgcagaacttgctgcctatttatatggttatgtcctgcggcaaaatccacgtgatccccattggattaatagggatcggtttgtcttgtcagcaggtcatggatctgctcttctctattcttgtttgcatcttgccggatttgatgtttccttagaggatcttcaggaatttcgccagcttcactcccgaactcccgggcatcccgagtacggcgaaactgtgggagtcgaagcaacgacaggtcctctgggacagggattaggcaatgctgtcggcatggcgctctctatgaagatgttggaatcccgattcaatcgcccaggacatgagatttttaacggaaaaatctattgtttggcaggggatggctgttttatggagggagtcagccacgaagtttgtagctttgcaggctctttaaatttaaataatcttgtggtcatctatgactacaataatgttgttctcgatggatatcttaatgaaattagtgttgaggatacaaaaaaacgttttgaagcctatggctgggatgtatatgaaattgatgggtatgattttacccatattcatgagacattctcgagcatcaaacgggggcaggaacgtcctgtattagtgattgcacatacaattattggtcatggttcgcctaaggaagggacaaataaggctcatggttctcctttaggagtcgaagggactcatgaaacaaaacagttttggcatctccctgaagaaaagttttttgtccctcctgcagtaaagaacttctttgctcataaaatacaagaagatcgaaaagcacaggagcaatggctggatgaagttcgtgtttggtcaaaacagttcccagaattacacgaagaattcgttgcgttgacctctcataagttacctaaaaacttagaatccttggtgcagagtgtagaaatgccagactctatagctggccgggctgcttcaaataaactgatccaagtattagtacagcacattccttatttgattggagggtccgcagatctttcaagctcagatggaacttggattgcgaatgagaaagtcatccatacgtatgacttctctggaaggaacattaaatacggcgttcgtgagtttggtatggccacaatcatgaatggtttagcttatagccaggtatttcgtccttttggtggaacatttttagttttttctgactatatgcgtaatgcaattcgcttggccgcattatctaaattaccagtcatctatcaatttacccatgattctatatttgttggagaagatggacctacgcatcagcctgtggaacaattgatgtctttgcgcgcgatccctggattgtatgtaatacgtcctgccgatgctaatgaagttagaggagcgtggattgcaggattaaagcacacaggtcctacagtcattgtcttgtcgcgacaagcattgcccacactgcctgctgcgcatcggccttttaaagatggtgtaggtcgtggtgcttatattgtcttaaaagagtcaggagaaaaaccagactatactctcttcgctacagggtcagaagtttctttagctctttctgtagctaaagaactcgaacacttggataagcaagtgcgtgtagtttctttcccttgttgggagctttttgaagctcaagatgtggactacaaacagagtattgtaggcggagatcttggaattcgtgtctctatagaagcaggatctgctttggggtggtataagtatatcggatctgaaggtttagctatcgctatggatagattcggatactcaggagcttctgatgatgtatcagaagaatgtggctttactacagagcaaatccttcagaggattctctctcaatag

SEQ ID NO: 9633 - protein, 665 aa, Chlamydophila pneumoniae J138
MINKELDIGILGKIAGAIKQISIESIQKASSGHPGLPLGCAELAAYLYGYVLRQNPRDPHWINRDRFVLSAGHGSALLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWDVYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGVGRGAYIVLKESGEKPDYTLFATGSEVSLALSVAKELEHLDKQVRVVSFPCWELFEAQDVDYKQSIVGGDLGIRVSIEAGSALGWYKYIGSEGLAIAMDRFGYSGASDDVSEECGFTTEQILQRILSQ

SEQ ID NO: 9634 - DNA, 1848 bp, Mycoplasma pulmonis UAB CTIP
  CDS (1)..(1848): transl_table=4
atgaacaaactagatcaactttcaataaatactctaaaagttaattcagtagctgcaattaacaaagccaactcgggtcatccaggaatagccctaggagctgccattattagccatagtctttttacaagacatttaaattttgacattgaaaatcctaattgaataaaccgtgatcgttttgtcttaagtgcaggacatggctcttcacttctttattcacatctaagaattttaggatatattagcgagcaagatttaaaagactttagacagcttaattctttaactccaggtcatccagagtataaacataccataggagttgaagctacaaccgggcctttaggtcaaggtcttgcaatggcagttggtctagccttggcacaagcacatttaaattctagatttaaagagctagatcactatacatatgtgctttgtggtgatggtgatcttcaagaaggagtagccaatgaagcccttgatctagctggtcatttaggactaaaaaaactaattgttctttatgattcaaatgatgttcaattagatagcaaagttgatattgtttattcttcaaataataaaaaacgctttgaagctatgaattttaactacattttagttgacaaagttagcattgaaaatatagataaggcaatcgaaaaagccaaagcctcttctaagccaacaattattgaaattaaaacaataattggtgaaggagctcacaaccaaggaacaagcgatgtccatggagctcctcttggaaaaaatattgatgttttacttaaaaatttaaattgaaataacgattctttttatcttcctgaagaggttaaaaaatactatcaagaaactttagggaaaagatcctctgaagcttttaaaaaatttaaagcctcaagtgaattagaaaagtttttaagccaaaaacctaatgttgattttagcgagttaaaactagaaaataaccttgcaactagaatttataatggaaaaattttagattttttaagctctaaaaattcaaacatcataggaggctcagctgatttgacagtttcaactaaagcagctggttctgatggaattttttcaaagacaaatctaagtggaagaaatatcttttttggtgttagagaatttgctatggcagctatatctaatggaatggctcttcactctaatttaattcctttttcttcaacatttttagtttttgcagattatttaaaagcagctattagattaggtgctttgatgaacttgaaaactctttacattttttcacatgattcagtttttgttggagaagatggcccaactcatcaaccaattgaacaacttgcaatgcttagatcaattcctaatgtagcagtttttagaccagctgatcaaagggaaatgcaaggagcttatgcttttgctctaaataataatggccctactgtaattgcaacaacaagacaaaatattgtttctttagaaaactcatcaagtcaaaaaagccaaaatggatattatcaacttttagattctaattcagaatatagtttaattgcctcaggttcagaggtggccaatgccttagaaatagctaaagaactaaagttaaatatgtactcagttcctgctatgaacttggttgaggattttccatgaaaaagagataaaactatttcaatagaggcagcttcaacttttggttggtcaaaactagcaaaatacaacattggaattgaccgttttggactttcagctcctggaaatcttgtttataaagaaatgaaattagacatagactcactaaggcaaaaaattaaaagcattatcgaaaaataa

SEQ ID NO: 9635 - protein, 615 aa, Mycoplasma pulmonis UAB CTIP
MNKLDQLSINTLKVNSVAAINKANSGHPGIALGAAIISHSLFTRHLNFDIENPNWINRDRFVLSAGHGSSLLYSHLRILGYISEQDLKDFRQLNSLTPGHPEYKHTIGVEATTGPLGQGLAMAVGLALAQAHLNSRFKELDHYTYVLCGDGDLQEGVANEALDLAGHLGLKKLIVLYDSNDVQLDSKVDIVYSSNNKKRFEAMNFNYILVDKVSIENIDKAIEKAKASSKPTIIEIKTIIGEGAHNQGTSDVHGAPLGKNIDVLLKNLNWNNDSFYLPEEVKKYYQETLGKRSSEAFKKFKASSELEKFLSQKPNVDFSELKLENNLATRIYNGKILDFLSSKNSNIIGGSADLTVSTKAAGSDGIFSKTNLSGRNIFFGVREFAMAAISNGMALHSNLIPFSSTFLVFADYLKAAIRLGALMNLKTLYIFSHDSVFVGEDGPTHQPIEQLAMLRSIPNVAVFRPADQREMQGAYAFALNNNGPTVIATTRQNIVSLENSSSQKSQNGYYQLLDSNSEYSLIASGSEVANALEIAKELKLNMYSVPAMNLVEDFPWKRDKTISIEAASTFGWSKLAKYNIGIDRFGLSAPGNLVYKEMKLDIDSLRQKIKSIIEK

SEQ ID NO: 9636 - DNA, 2178 bp, Mycobacterium tuberculosis CDC1551
  CDS (1)..(2178): transl_table=11
atgcggcactgcaagcgccgggattcccgcactagggtgaggactgatcatcttgctgactcgaggactgaatttgtgaccacactcgaagagatctccgcgcttacccgaccgcgccatcccgacgactggaccgagatcgattcggctgccgtcgacaccatccgggtattggccgccgatgccgtccaaaaggtcggcaacggtcatcctggaacggcgatgagcctggctccgttggcctacacgctgtttcagcggacaatgcgtcacgatcccagcgacacacactggctgggccgcgatcggttcgttttgtcggccgggcacagcagcctgaccctctacatccagctctacctcggcggcttcggcctggaactgtccgacattgagtcgttgcgcacctggggatccaagacccccggacacccggagttccgccacacccccggcgttgagatcaccaccggcccgctggggcagggactggcgtcggcggtcgggatggcgatggcctcgcgctacgagcgcggcctgttcgacccggacgccgaaccgggcgccagccccttcgaccactacatctatgtcatcgcctccgacggtgacatcgaagaaggggtgacctcggaggcgtcgtcgctggccgcggtccagcaactgggcaacctcatcgtgttctacgaccgcaaccagatctcgatcgaggacgacaccaacatcgcgctgtgtgaggacaccgcggcccgctaccgcgcgtacggctggcacgtgcaagaggttgagggcggtgagaacgtcgtcggcatcgaggaggccatcgccaatgcgcaggcggtcaccgaccggccctcgttcatcgcgctgcgcaccgtcatcggctatccggcgccgaacctgatggacaccggcaaggcgcacggcgcggcgctgggcgacgacgaggtggccgcagtcaagaagatcgtcggcttcgatccggacaagacgttccaggtccgcgaggacgtcctcacccacacccgagggctggtggcccgcggcaaacaggcccacgaacgctggcagctcgaattcgatgcctgggcgcggcgtgaacccgagcgcaaggcgctgctggaccggctgctcgcgcagaagttgcccgacggctgggacgccgacttgccccactgggaaccggggtccaaggcgctggccacccgtgcggcctcgggtgcggtgctgtccgcgctcgggccgaaactgcccgagttgtggggcggttcggccgacctggcgggcagcaacaacacaacgataaagggcgccgactcctttggcccgccctcgatttccaccaaggagtacaccgcgcactggtatggtcgcaccttgcacttcggtgttcgcgagcacgcgatgggtgccatcctgtccggcatcgtgctgcacggacccacccgggcttacggcggcaccttcctgcagttctccgactacatgcgcccggcggtgcggctggcggcgttgatggacatcgacaccatctacgtctggacgcacgactcgatcggcctcggcgaagacgggcccacccatcaaccgatcgagcacctctcggcgctgcgcgcgatcccccggctgtcggtggtgcgcccggcagatgccaacgagacagcctacgcctggcgcacgatcctggcccgccgcaacggcagcgggccggtcgggttgatcctgacccgccagggtgtgccggtgctggacggcaccgacgccgagggggttgcccgcggcggttacgtgctgagtgacgccggtggtctgcaaccgggcgaggaacccgacgtcattctcatcgccaccggctcggaggtgcagctggcggtcgcggcgcagacgttgctggcggacaacgacatcctcgctcgggtggtgtcgatgccgtgcctggagtggttcgaggcccaaccctacgagtaccgcgacgcggtgctgcccccgacggtgtcggcgcgggtggccgtcgaagccggcgtcgcgcaatgctggcaccagctggttggcgacacgggcgagatcgtctcgatcgagcactacggcgaatccgcggaccacaagaccttgttccgcgagtacggcttcactgccgaggccgtggccgccgccgccgaacgagcgctggataactga

SEQ ID NO: 9637 - protein, 725 aa, Mycobacterium tuberculosis CDC1551
MRHCKRRDSRTRVRTDHLADSRTEFVTTLEEISALTRPRHPDDWTEIDSAAVDTIRVLAADAVQKVGNGHPGTAMSLAPLAYTLFQRTMRHDPSDTHWLGRDRFVLSAGHSSLTLYIQLYLGGFGLELSDIESLRTWGSKTPGHPEFRHTPGVEITTGPLGQGLASAVGMAMASRYERGLFDPDAEPGASPFDHYIYVIASDGDIEEGVTSEASSLAAVQQLGNLIVFYDRNQISIEDDTNIALCEDTAARYRAYGWHVQEVEGGENVVGIEEAIANAQAVTDRPSFIALRTVIGYPAPNLMDTGKAHGAALGDDEVAAVKKIVGFDPDKTFQVREDVLTHTRGLVARGKQAHERWQLEFDAWARREPERKALLDRLLAQKLPDGWDADLPHWEPGSKALATRAASGAVLSALGPKLPELWGGSADLAGSNNTTIKGADSFGPPSISTKEYTAHWYGRTLHFGVREHAMGAILSGIVLHGPTRAYGGTFLQFSDYMRPAVRLAALMDIDTIYVWTHDSIGLGEDGPTHQPIEHLSALRAIPRLSVVRPADANETAYAWRTILARRNGSGPVGLILTRQGVPVLDGTDAEGVARGGYVLSDAGGLQPGEEPDVILIATGSEVQLAVAAQTLLADNDILARVVSMPCLEWFEAQPYEYRDAVLPPTVSARVAVEAGVAQCWHQLVGDTGEIVSIEHYGESADHKTLFREYGFTAEAVAAAAERALDN

SEQ ID NO: 9638 - DNA, 1989 bp, Clostridium acetobutylicum ATCC 824
  CDS (1)..(1989): transl_table=11
atgaacattgatgaattatcaataaataccataaggattttatcagctgaagcaattcaaaaggccaattcagggcatccaggtaccccactaggagcagcacctgtagcgtatacactttggtcaaagtatttaaaacacaatccttcaaatcctaaatgggtcaatagagatagatttattttatctgctggtcatgcatctatgcttttgtattcacttcttcacttatttggctataagatttccatagatgatttaaagaattttagacaatgggagagtataacaccaggacatcctgaatatggagttaccccaggtgttgagataagcacaggacctttaggtcaaggtatagctaatggtgtaggtatggctattgcagaagcacatcttgcatcaaaattcaataaacagggttttgatatagttgatcactatacatatgttttaagcggagacggctgtatgatggaaggaatagctagcgaagctgcttcttttgctggaactttaggattatcaaaactaatagtaatatatgatgataatgatatttcaatagaaggaaatactgatatagcatttaaggaaaatgttggagaaagatttaaagcatatgattggaatgtaataaacgttgaagatggaactgacgtaagtagtttaagtaaagcaattgaaaaggcaaaacagcaaaacgataaaccatcaatcattatagctaaaacagtaataggctttggctcaccaaatcaaggaacagctggagttcatggctctccactaggagaaactggagtaagtggattaaagaaaaatttaaattggaattatgaagaagaattttatgttccagaagaagttaaagagcatataaaaaagcttcaaaaaacatttgaagaaaatgaaagtaactggaatgaacttttaaataaatataaagaaaaatatcctgatttatttgatgaatttaatgcttggatgaatggtgaagtaaaagtaaagctagatgaaattgatgcatttaaagagttagaaaaacctatggcaacaagagattcatcaggaaaagcattaaatataatagcaaatgtagtgccaaatttaataggtggatctgctgacttagcaccatcaaataaaacatacatgaatgataagggtgatttttcttctgatgatagaagtggatcaaatcttcactttggagtaagagagcatgctatggctgctattgcaaatggagtatctgcacatggcggactaaaaatattcgtatcaactttctttgtattcagtgattatatgaagggtgcaatgagaatgtctgctcttatgaatctccctgttgtgtatgtgcttactcatgatagtataggagtaggagaagacggaccaactcatgaaccaatagaacagttagcagcacttagaagtatacctaatttaacagtattgagaccttgtgattcaaaggaaactgtagaggcatggaaatacgcattagaaagagaagatggacctacagcacttgtacttacaaggcaaaagcttcctttgtataatgaaactggaaaaggtttattaaaaggtgcgtatacactaaaagattctaaaaaggatgttccagatatgcttcttatggcttcaggctcagaagttgaattggtgtatgaggcacaagaagaacttttaaataaaggaatagattcaagagttatcagtgttccatcctttgaacttttcgataagcaggataaggcttataaagaaagtgttatgccaagcagcgttagagctcgtgttgcagtagaggcagcatcttcatttggttggcataaatatactggaattgatggggaaatcatttcaatagatcattttggagcttcagcaccagctgaaacacttttcgaagtgtttggattcactaaggaaaatgttattaagacaagtgaagaagtgctaaaaaataataaataa

SEQ ID NO: 9639 - protein, 662 aa, Clostridium acetobutylicum ATCC 824
MNIDELSINTIRILSAEAIQKANSGHPGTPLGAAPVAYTLWSKYLKHNPSNPKWVNRDRFILSAGHASMLLYSLLHLFGYKISIDDLKNFRQWESITPGHPEYGVTPGVEISTGPLGQGIANGVGMAIAEAHLASKFNKQGFDIVDHYTYVLSGDGCMMEGIASEAASFAGTLGLSKLIVIYDDNDISIEGNTDIAFKENVGERFKAYDWNVINVEDGTDVSSLSKAIEKAKQQNDKPSIIIAKTVIGFGSPNQGTAGVHGSPLGETGVSGLKKNLNWNYEEEFYVPEEVKEHIKKLQKTFEENESNWNELLNKYKEKYPDLFDEFNAWMNGEVKVKLDEIDAFKELEKPMATRDSSGKALNIIANVVPNLIGGSADLAPSNKTYMNDKGDFSSDDRSGSNLHFGVREHAMAAIANGVSAHGGLKIFVSTFFVFSDYMKGAMRMSALMNLPVVYVLTHDSIGVGEDGPTHEPIEQLAALRSIPNLTVLRPCDSKETVEAWKYALEREDGPTALVLTRQKLPLYNETGKGLLKGAYTLKDSKKDVPDMLLMASGSEVELVYEAQEELLNKGIDSRVISVPSFELFDKQDKAYKESVMPSSVRARVAVEAASSFGWHKYTGIDGEIISIDHFGASAPAETLFEVFGFTKENVIKTSEEVLKNNK

SEQ ID NO: 9640 - DNA, 1992 bp, Clostridium acetobutylicum ATCC 824
  CDS (1)..(1992): transl_table=11
atgaatatagataatttagctataaatactataagaattctttctgcagaagctatacaaaaggcaaagtctggtcatcctggattgcctatggggtgtgcaccaatggcatatacactttggagcagacatttaaaacataatcctaataattccaaatggaaagatagagatagattcgtgctttcagcaggacatggttctatgctcttatattcgttacttaatatatttggttatgatgtaagtgttgaggaaataaaaaactttagacaattcaaaagtaagactccaggacatcctgagtatagatggacagatggagtagaaacaacaacaggacctttaggacaaggaatatgcaatgctgtgggaatggcaatagcggaaacttatctagcaaataaatttaataaggaaagttacaatattgtagaccattatacctatgcgcttgtaggtgacggctgtcttatggaaggaatatcaggagaggcaagttctcttgcaggtacattaggtcttggaaaattaatagttttatatgattcaaataacatatcaatagaaggaagtacagacattgcctttagagaaaacgtagctttaagatacgaagcatacggatggcaggttatcaaagtggatgatggtactaatttagaaaaaatagatttagccataaaggaagctaaggtagaaaaaaataaacctaccataataatagtaaaaaatgttataggatatggctgtccatcaaaacagggtaaagcagctgctcatggagagcctttgggagaagaaaatttaaagctcacaaaggaaaatttaaattggaattatgaaccttttactgttccggaagaagtaagagcatacactaaagagtttaaagtaagggctcaaagacaagaggataagtggaacagtatgtttgaagaatataaaaaggaatatccaaagctttataaagagtgggaagtttggtttagtgaaaaaactccaatgaagctattagataatggagaattttggaagtttgataaaaacatggctacaagacagtcctcaggggttcttattaatagacttgcaaaacttattcctaacttaataggaggctctgctgatttagcaccatcaaacaagacacatatggatgacagaggagatttttcagctgaaaacagaagtggctctaatatgcattttggagttagagaacatgctatggcagctattgcaaatggaatgtacttgcatggtggacttaaggtatttgtagcaaccttctttgtatttagtgattacatgaaaggagctatgagactttcttctataatgaagcttccaatagtttatgttttaacgcatgacagtattggtgtaggtgaagatgggccaactcatgaacctattgagcaattggcagccttaaggtctatgcctaatatgactgtgtttaggccagcggattctaatgaaactgcagcagcctggtatagtgcattaaatactaaaaatggaccaacagccttagttttaacaagacaagcacttcctttatatgattcttcaggaaaaaatgctttaaagggaggatacattctaaaggattctaaaaataaagaaaatccagatgtaatacttatggcttcaggttctgaagttgagcttatattaaatgcagcaaaagagcttcaaaatgaaaatatagatgcaagagttgtaagtatgccttcctttgaagtatttgaagagcaaagtgaagactataaaaattctatattacctagaaatataagagccagagttgcagttgaagctgcatcaccttttgggtggcataaatatgttggacttgatggcgaagtgattgctatggagagttttggtgcatcaggtaaatcagatatattatttaaagagtttggttttactgtggagaatgtagttgaaaaagtaaaaaatgttttgaaaaatttaaaataa

SEQ ID NO: 9641 - protein, 663 aa, Clostridium acetobutylicum ATCC 824
MNIDNLAINTIRILSAEAIQKAKSGHPGLPMGCAPMAYTLWSRHLKHNPNNSKWKDRDRFVLSAGHGSMLLYSLLNIFGYDVSVEEIKNFRQFKSKTPGHPEYRWTDGVETTTGPLGQGICNAVGMAIAETYLANKFNKESYNIVDHYTYALVGDGCLMEGISGEASSLAGTLGLGKLIVLYDSNNISIEGSTDIAFRENVALRYEAYGWQVIKVDDGTNLEKIDLAIKEAKVEKNKPTIIIVKNVIGYGCPSKQGKAAAHGEPLGEENLKLTKENLNWNYEPFTVPEEVRAYTKEFKVRAQRQEDKWNSMFEEYKKEYPKLYKEWEVWFSEKTPMKLLDNGEFWKFDKNMATRQSSGVLINRLAKLIPNLIGGSADLAPSNKTHMDDRGDFSAENRSGSNMHFGVREHAMAAIANGMYLHGGLKVFVATFFVFSDYMKGAMRLSSIMKLPIVYVLTHDSIGVGEDGPTHEPIEQLAALRSMPNMTVFRPADSNETAAAWYSALNTKNGPTALVLTRQALPLYDSSGKNALKGGYILKDSKNKENPDVILMASGSEVELILNAAKELQNENIDARVVSMPSFEVFEEQSEDYKNSILPRNIRARVAVEAASPFGWHKYVGLDGEVIAMESFGASGKSDILFKEFGFTVENVVEKVKNVLKNLK

SEQ ID NO: 9642 - DNA, 1983 bp, Agrobacterium tumefaciens str. C58
  CDS (1)..(1983): transl_table=11
atgatttctcgcgacaaacacaaccggatggccaatgcgatccgctttcttgccatggatgcagtggagaaggccaactccggccatcccggactgccgatgggcgccgccgatgtcgccaccgttcttttcacccgctacctgaaattcgatccgaaggcgcctctgtgggcggaccgcgaccgcttcgtgctgtctgccggccatggctccatgctgctttactcgctgctttatttgacgggctacgaggacatgacgatcgacgagatcaagcggttccgtcagttcggctccaagaccgccggccatcctgaatatggccatgccaccggcatcgaaacgaccaccggtccgctcggccagggcattgccaacgccgtcggcatggcaattgctgagcgcaagctggaagaggagttcggctccgacctgcagagccacttcacctatgtgctgtgcggcgacggctgcctcatggaaggcatcagccacgaagccatcgcgcttgccggccatctgaagctcaacaagctcgttctcttctgggacgacaacaacatcaccatcgacggtgaagttggcctgtccgacagcaccgaccagatcgcccgcttccaggccgttcactggaacactatccgtgttgatggccatgatcccgacgcgattgctgccgccatcgaggcagcgcagaaatccgaccgcccgaccttcatcgcctgcaagaccgtcatcggtttcggcgcccccaacaagcagggtacccacaaggtgcacggcaacccgctcggcgcagaagaaatcgccgctgcccgcaagagcctgaactgggaagccgaagccttcgtcattccggaagatgtgctcgatgcatggcgcctcgccggcctgcgctccaccaagacgcgccaggactgggaagcccgtctcgaagccaccgagacggccaagaaggccgaattcaagcgccgctttgccggcgacctgcccggcaacttcgacagctccatcgatgccttcaagaaaaagatcatcgagaacaacccgacggttgccacccgcaaggcctcggaagattcgctcgaagtcatcaacggcatcctgccggaaatggtcggcggttcggctgacctgacgccgtccaacaacaccaagaccagccagatgaagtcgatcacgccgacggacttctccggccgttacctgcattacggcatccgcgagcacggcatggctgcggccatgaacggtatcgctctccacggcggtctcatcccctatgccggtggcttcctgatcttctcggattattgccgtccgtcgatccgccttgcagcactgatgggcatccgcgtcgtccacgttctgacgcacgattccatcggcgtcggtgaagatggtccgacccaccagccggtcgagcagatcgcagcgttgcgcgccattccgaacctgctcgtcttccgcccggcggatgaaaccgagacggcggaatgctggcagctggctctcgagcaaaagcaccgtccgtccgcactggcgcttacccgccagaatctcacgccttcgcgcaaggaatatgaagagaagaacctgtccgcttacggcgcatacgaactcgtctccgccagcgacgccaaggtttcgatcttcgcttccggttcggaagtcgaagtggcgctgaaagctgctgcgacgctgaaggacaagggtgtttccgcccgcgtcgtttccgttccctgcttcgaactcttcaaggaacagccggaaacctatcgcaacgccatcatcggcaaggctccggtcaagatcgcggtggaagccgccatccgccagggctgggattacttcatcggcaatgacggcgctttcgtcggcatgcactcctttggagcctctgcaccggcgaaggatctcttcaagcacttcggcatcacggcggaagccgtcgtcgccgcagtcgaggcaaaacttgcatga

SEQ ID NO: 9643 - protein, 660 aa, Agrobacterium tumefaciens str. C58
MISRDKHNRMANAIRFLAMDAVEKANSGHPGLPMGAADVATVLFTRYLKFDPKAPLWADRDRFVLSAGHGSMLLYSLLYLTGYEDMTIDEIKRFRQFGSKTAGHPEYGHATGIETTTGPLGQGIANAVGMAIAERKLEEEFGSDLQSHFTYVLCGDGCLMEGISHEAIALAGHLKLNKLVLFWDDNNITIDGEVGLSDSTDQIARFQAVHWNTIRVDGHDPDAIAAAIEAAQKSDRPTFIACKTVIGFGAPNKQGTHKVHGNPLGAEEIAAARKSLNWEAEAFVIPEDVLDAWRLAGLRSTKTRQDWEARLEATETAKKAEFKRRFAGDLPGNFDSSIDAFKKKIIENNPTVATRKASEDSLEVINGILPEMVGGSADLTPSNNTKTSQMKSITPTDFSGRYLHYGIREHGMAAAMNGIALHGGLIPYAGGFLIFSDYCRPSIRLAALMGIRVVHVLTHDSIGVGEDGPTHQPVEQIAALRAIPNLLVFRPADETETAECWQLALEQKHRPSALALTRQNLTPSRKEYEEKNLSAYGAYELVSASDAKVSIFASGSEVEVALKAAATLKDKGVSARVVSVPCFELFKEQPETYRNAIIGKAPVKIAVEAAIRQGWDYFIGNDGAFVGMHSFGASAPAKDLFKHFGITAEAVVAAVEAKLA

SEQ ID NO: 9644 - DNA, 1995 bp, Sinorhizobium meliloti 1021
  CDS (1)..(1995): transl_table=11
atgtccgaccgccgtgcgctggcgaacgccattcgatttctaactgttgacgtcgtgcagaaggcgaattcgggccaccccggaacggccatgggaatggcggacattgccgaggttctgtggaacgacttcctgcggcacaatccggccaatccgaaatggatcaaccgtgaccgtttcgtgcagtcgaacggacatgggtcgatgctgacctattcgttgctgcatctctccggctacgggcttacggttcaggacctgaaggatcaccgcaagctgcattccaggacgcccggccatccggaatacggaatcacggcaggggtcgagacgacgaccggcccactcggccaaggttttgccacggcggccggcatggcactggcagaaaagaagcttgcgcaggagttcaatcgcgacggctttcccgtggtcgatcacttcacctatgttttcgtcggggacggctgcctcatggagggcgtagcgcaggaggccgcctcgctcgccggcactttgaagctcaacaagctcatcgcggtctatgacgacaacaggatctccatcgacggcgagacgccgggctggttcgccgacgacacggccgctcgtttccgtgcgctcggctggaacgtcatcgcggacgtggacggccatgatgcggaggcaatcaccgcggctttcgatgccgcccgccgctcgaccgacaagccgaccatgatctgctgcaagacgatcatcggctatggatcgccgaacaagcagggcagggaggaggtgcatggggcgccgctcggcgtggaggaagtggcccgcacccgcgagcaccttggctggaagcatgaggctttcgtcgtgccggataccgtgatgcgggcctgggacgcccgcccgcgcggcgagagggcggaagccgaatggaatgcactttttacggcctatgaggcaaagcatcccgaactggccgccgagctgacgcggcgtacagcaggccggctgccggacgatttcgatgcggtcgtggcaagcgaggcagagcggattcttgctcaagaaccggtcaggcaaccgatccgcaaggcttccaaccgcgttctcggcaatctcctcgcaagcgtgccggaggtgatcggtggttcggccgatgtttcgatgtcgacgttggcctggacaggtgcggcgcgttccatcacgccggacgatttttcagggaatttcgtgcactatggcgtgcgcgagttcggcatgtcggcaatgatgaacggcatggcggcccatggcggtctcatcccctacggcgcctgctatctcgtgttcagcgattacagccgcaatgccgtgcgcctttcggcgttgatgggcctcaagaccatcttcctctacacgcacgattcgatcggagtgggcgaggacggaccgacgcatcagccgtgcgagcaactggtggcgctccgcgcgatcccgaacatgtcgctctggcggccgggcagcgaactggaggctctcgttgcctgggaatcggcgctgaagcgtgaagggccaagcgttatcgttgctgcgcgacaggacggtgcggttttcgcgcaccggagcggcgatctcgacggtatccgtcgcggcggttacgtgctgcaggacgcgggcggaaagcccgatatcgtcctcgttgcgaccgggtccgagatcggccttgtccttgaagccgcggcggtgctggaggggcagggcaaggcggttcggctcgtctccattcccaatggcaatctcttcgcagcgcaggaccgtgactatcaggagagcgtgctggctttcggcacgccgacggtatttgtcgaggcggcctctccgctttattggtaccagttcctcaagggaccgggtacggtcgtcggcgtcgaccgtttcggcgaatccgcgccaggaccggaaatctaccgcgtcatgaacctgacggctgagcggatcgtatccgaggccggtcagttcctgtgctga

SEQ ID NO: 9645 - protein, 664 aa, Sinorhizobium meliloti 1021
MSDRRALANAIRFLTVDVVQKANSGHPGTAMGMADIAEVLWNDFLRHNPANPKWINRDRFVQSNGHGSMLTYSLLHLSGYGLTVQDLKDHRKLHSRTPGHPEYGITAGVETTTGPLGQGFATAAGMALAEKKLAQEFNRDGFPVVDHFTYVFVGDGCLMEGVAQEAASLAGTLKLNKLIAVYDDNRISIDGETPGWFADDTAARFRALGWNVIADVDGHDAEAITAAFDAARRSTDKPTMICCKTIIGYGSPNKQGREEVHGAPLGVEEVARTREHLGWKHEAFVVPDTVMRAWDARPRGERAEAEWNALFTAYEAKHPELAAELTRRTAGRLPDDFDAVVASEAERILAQEPVRQPIRKASNRVLGNLLASVPEVIGGSADVSMSTLAWTGAARSITPDDFSGNFVHYGVREFGMSAMMNGMAAHGGLIPYGACYLVFSDYSRNAVRLSALMGLKTIFLYTHDSIGVGEDGPTHQPCEQLVALRAIPNMSLWRPGSELEALVAWESALKREGPSVIVAARQDGAVFAHRSGDLDGIRRGGYVLQDAGGKPDIVLVATGSEIGLVLEAAAVLEGQGKAVRLVSIPNGNLFAAQDRDYQESVLAFGTPTVFVEAASPLYWYQFLKGPGTVVGVDRFGESAPGPEIYRVMNLTAERIVSEAGQFLC

SEQ ID NO: 9646 - DNA, 1983 bp, Sinorhizobium meliloti 1021
  CDS (1)..(1983): transl_table=11
atgatctctcgcgaaaaacacgaccggatggcgaatgcaatccgcttcctctccatggacgccgtcgagaaggcaaattccggccaccctggcctcccaatgggcgccgccgatatcgcaacagtgctgttcacccgctatctgagcttcgaccctaaaaaccccgcctggccgaaccgcgaccgcttcgtcctgtcggccggccacgggtccatgctgctctattcgctgctctacctcacgggctacgacgacatcaccatcgacgagatcaagaacttccgccagctgggttcgcgcacggcgggtcacccggaatacggccacgccgccggcatcgagacgaccacgggtccgctcggccagggcattgccaattccgtcggcatggcgatcgccgagcgcaagctgcgcgaagagttcggcagcgaactgatggagcattatacctatgtgctcgccggcgacggctgcctgatggaagggatcagtcaggaagcgatcgcgcttgccggccacctgaagctcaacaagctgatcgtcttctgggacgacaacaacatctcgatcgacggtccgatctccattgccgactcgaccgaccagcacgcccgcttccgcgccagcaaatggcacacgatcgccgtcgacggccatgatcccgaagcgatcgccgccgcgatcgaagaggctcacaagtccgacaagccgaccatgatcgcctgcaagaccgtgatcggcttcggtgcgccgaacaaggccggtacgcacaaggtccacggctccccgctcggcgccgaggaaatcgccgccacccgcaaggcgctcggctgggaagccgaggcgttcacggttccctccgacgtgctcgacgcctggcgcatcgcaggcctgcggtcggccaaggcgcgcaaggaatgggaagaacggctcgaagccgctgaggcggagaagaaggcgcagttcgtccgccgcttctccggcgagctcgaaggcagcctcgcctctgcgatcggcgcctacaagcagaagcttgccgagaccaagccctcgccggcgacgcgcaaggcttcggaggatgcgctggaagtcatcaacggcgtacttgccgagacgatcggcggctctgccgacctgaccggctccaacaataccaagacgagccagacacactccatcaccccggacgatttctccggccgctacatccactacggcgtgcgcgagcacggcatggcggccgcaatgaacggcatggcgctgcatggcggcctcatcccctattccggcggcttcctgatcttctcggattattgccgcccgtcgatccgccttgccgcgctcatgggcatccgcgtcatccacgtgctcacgcatgattccatcggtctcggcgaggacgggccgacccaccagccggtcgagcacatggccgcgcttcgggccatccccaatctcctgatgttccgccccgcggatgcgacggagaccgccgaatgctggcagctcgccctggaaaaccgcaagcgcccctccggtcttgcgctcacccgccagaacctgatggcggtgcgcacggaatacgaggaacagaacctctgcgcccgcggcgcctatgacctgatctccgcaagcgatgcgcaggtgacgatcttcgccaccggctcggaagtcgagatcgccgtcaaggcctgccagacgctgaccgccaagggcatcgcgacgcgcgtcgtctccgtcccctgcttcgagctcttcgccgagcagagcgaggactaccagcaggcgatcatcggcacgtcgccggtcaagatcgccgtcgaagccggcatccgccagggctgggaccacttcatcggcaacgatggcatcttcatcggcatgtcgagcttcggtgcttcgggcccctacaaggatctctacaagcacttcggcattacgccagaagtcgtggttgcgtccgccgaagccaagctgtcctga

SEQ ID NO: 9647 - protein, 660 aa, Sinorhizobium meliloti 1021
MISREKHDRMANAIRFLSMDAVEKANSGHPGLPMGAADIATVLFTRYLSFDPKNPAWPNRDRFVLSAGHGSMLLYSLLYLTGYDDITIDEIKNFRQLGSRTAGHPEYGHAAGIETTTGPLGQGIANSVGMAIAERKLREEFGSELMEHYTYVLAGDGCLMEGISQEAIALAGHLKLNKLIVFWDDNNISIDGPISIADSTDQHARFRASKWHTIAVDGHDPEAIAAAIEEAHKSDKPTMIACKTVIGFGAPNKAGTHKVHGSPLGAEEIAATRKALGWEAEAFTVPSDVLDAWRIAGLRSAKARKEWEERLEAAEAEKKAQFVRRFSGELEGSLASAIGAYKQKLAETKPSPATRKASEDALEVINGVLAETIGGSADLTGSNNTKTSQTHSITPDDFSGRYIHYGVREHGMAAAMNGMALHGGLIPYSGGFLIFSDYCRPSIRLAALMGIRVIHVLTHDSIGLGEDGPTHQPVEHMAALRAIPNLLMFRPADATETAECWQLALENRKRPSGLALTRQNLMAVRTEYEEQNLCARGAYDLISASDAQVTIFATGSEVEIAVKACQTLTAKGIATRVVSVPCFELFAEQSEDYQQAIIGTSPVKIAVEAGIRQGWDHFIGNDGIFIGMSSFGASGPYKDLYKHFGITPEVVVASAEAKLS

SEQ ID NO: 9648 - DNA, 1962 bp, Caulobacter crescentus CB15
  CDS (1)..(1962): transl_table=11
atgcccgtttcgcccatcaagatggccgacgcgatccgcgtcctctccatggacgccgtgcacaaggcgaagtccggccaccagggcatgccgatgggcatggccgacgtggcgacggtcctatggggcaagttcctgaaattcgacgcgtctaagcctgactgggccgaccgcgaccgcttcgtgctgtcggccggtcacggctcgatgctgctctattccctgctgcatctgaccggcttcaaggccatgacgatgaaggagatcgagaacttccgtcagtggggggcgctgaccccgggccacccggaagtgcatcacacgcccggcgtcgagaccacgaccggtccgctgggccagggcctggccaccgccgtcggcatggccatggccgaggcgcacctggccgcccgctacggctctgacctcgtcgaccaccgcacctgggtgatcgccggcgacggatgcctgatggagggcgtcagccatgaggcgatcagcatcgccggccgcctgaagctctcgaagctgacggtcctcttcgacgacaacaacaccaccatcgacggggtggccaccatcgccgagaccggcgaccaggtcgcgcgcttcaaggccgccggctgggcggtcaaggtcgtcgacggccacgaccacggcaagatcgctgcggccctgcgctgggccaccaagcaggaccgcccgaccatgatcgcgtgcaagacgctgatctcgaagggcgcgggccccaaggaaggcgacccccacagccacggctacaccctgttcgacaacgagatcgccgcctcgcgcgtggccatgggctgggacgctgcgcccttcaccgtgcccgacgacatcgccaaggcctggaagagcgtcggccgtcgcggcgccaaggtccgcaaggcctgggaggccaagctggccgcctcgcccaagggggccgacttcacccgcgccatgaagggcgagctgccggcgaacgccttcgaggcgctggacgcccacatcgccaaggccctggagaccaagccggtcaacgccacccgcgtccactccggctcggccctggagcacctgatcccggcgatccccgagatgatcggcggctcggccgacctgaccggctcgaacaacaccctggtcaagggcatgggcgcgttcgacgcgcccggctacgaaggccgctatgtccactatggcgtgcgtgagttcggcatggccgcggccatgaacggcatggccctgcacggcgggatcatcccctattcgggcaccttcctggccttcgccgactacagccgcgcggccatccgcctgggcgccctgatggaggcccgcgtcgtccacgtgatgacccacgactccatcggtctcggcgaagacggtcccacccaccagccggtcgagcacgttgccagcttgcgcgccattccgaacctgctggtcttccgtccggccgatgccgtcgaggccgccgagtgctggaaggcggccctgcaacatcaacgcacgccgtcggtgatgaccctgtcgcgccagaagaccccgcacgtccgcacccagggcggcgacttgtcggccaagggcgcctacgagctgctggcggccgagggcggcgaggcgcaggtgacgatcttcgcctcgggcaccgaggtcggcgtcgccgtcgccgcgcgcgacatcctgcaggccaagggcaagccgacccgcgtggtctccacgccctgctgggagctgttcgatcagcagcccgccgcctaccaggccgccgtcatcggcaaggccccggtgcgcgtcgccgtcgaagcgggcgtcaagatgggctgggagcgcttcattggcgagaacggcaagttcatcggcatgaagggcttcggcgcctcggctccgttcgagcgcctgtataaagagttcggcatcaccgctgaagccgtggccgaagcggctctggcctga

SEQ ID NO: 9649 - protein, 653 aa, Caulobacter crescentus CB15
MPVSPIKMADAIRVLSMDAVHKAKSGHQGMPMGMADVATVLWGKFLKFDASKPDWADRDRFVLSAGHGSMLLYSLLHLTGFKAMTMKEIENFRQWGALTPGHPEVHHTPGVETTTGPLGQGLATAVGMAMAEAHLAARYGSDLVDHRTWVIAGDGCLMEGVSHEAISIAGRLKLSKLTVLFDDNNTTIDGVATIAETGDQVARFKAAGWAVKVVDGHDHGKIAAALRWATKQDRPTMIACKTLISKGAGPKEGDPHSHGYTLFDNEIAASRVAMGWDAAPFTVPDDIAKAWKSVGRRGAKVRKAWEAKLAASPKGADFTRAMKGELPANAFEALDAHIAKALETKPVNATRVHSGSALEHLIPAIPEMIGGSADLTGSNNTLVKGMGAFDAPGYEGRYVHYGVREFGMAAAMNGMALHGGIIPYSGTFLAFADYSRAAIRLGALMEARVVHVMTHDSIGLGEDGPTHQPVEHVASLRAIPNLLVFRPADAVEAAECWKAALQHQRTPSVMTLSRQKTPHVRTQGGDLSAKGAYELLAAEGGEAQVTIFASGTEVGVAVAARDILQAKGKPTRVVSTPCWELFDQQPAAYQAAVIGKAPVRVAVEAGVKMGWERFIGENGKFIGMKGFGASAPFERLYKEFGITAEAVAEAALA

SEQ ID NO: 9650 - DNA, 2013 bp, Synechocystis sp. PCC 6803
  CDS (1)..(2013): transl_table=11
atggtcgttgctacccagtccttagacgaactttctattaatgccattcgctttttagccgttgacgccattgaaaaggccaaatctggccaccctggtttgcccatgggagccgctcctatggcctttaccctgtggaacaagttcatgaagttcaatcccaagaaccccaagtggttcaatcgggaccgctttgtgttgtccgccggccatggctccatgttgcagtatgccctgctctatctgctgggttatgacagtgtgaccatcgaagacattaaacagttccgtcaatgggaatcttctacccccggtcacccggagaattttctcactgctggagtagaagtcaccaccggccccttgggtcaaggcattgccaatggtgtgggtttagccctggcggaagcccatttggctgccacctacaacaagcctgatgccaccattgtggaccattacacctatgtgattctgggggatggttgcaatatggaaggtatttccggggaagccgcttccattgcagggcattggggtttgggtaaattaatcgccctctatgatgacaatcatatttccattgatggttccaccgatgtggccttcaccgaagatgtgagcaagcgttttgaagcctacggttggcacgtgctccatgtcgaagatggcaataccgatttggcggcgatcgccaaggctattgaggaagccaaggccgtaaccgataaaccttctatgatcaaagtcaccaccatcattggttacggtgcgcccaataaatccgataccgcgggcatccatggggctgctttgggcactgatgaagtggccgccacccgcaaaaacttgggttgggattatgctccctttgaagtgccccaggaggtgttggactacactcgcaaagccattgaacggggagccagctacgaagcggaatggaaccaagcctttgcccaatacaaaaccaaatatcccactgaagcggccgcctttgaacggcaactgagcggtgctttaccggaaggttgggacaaaaccctagctagctttacccccgatcaaaagggtttggccacccggaaatattccgaggaatgtctcaatgcgttggcccccgtattaccagagttaattggtggttcggcggatttaacccactccaacctaacggaacttcactgctctggggatttccaaaaaggagcttatcaaaaccgtaacgtccactttggggtacgggaacatgccatgggggctatctgtaacggtattgctctccacggttctgggttactacccttcggtgctaccttcctaattttcaccgattacatgcgggccgccattcgcctttcggccctttccgaggcaggggtaatttgggtcatgacccacgactccattggtcaaggggaagatggtcccacccaccaacccattgaagtgctggcttccctccgggctattcccaacttgactgtgattcgtcccgccgatggcaatgaaacctccggtgcctacaaagtggcgatcgccaaagcgaaggaaaatgcccccaccctgttatccttgacccggcaggcggtacccaatttgcctggaacttccattgatgccgtggccaaaggtgcctataccattgttgattctgaaggtgttcctgagttaatcttgataggtacgggttccgaagtacaactttgtgtggctgctgctgaaaagttagccgctcaaggcaagaaagtccgggtagtttccatgccttcctgggaactgtttgaaacccaggatgccgcctacaaagagtcagtgttgccaaaggctgtcaccaaacgcctttccgtagaagccgccaccaactttggttggcacaaatatgtgggcacggaaggagatacagttagtattgaaacatttggtgcctcggcgcccggcggggtttgcctcgagaaatttggtttcagcgttgataatgtgctggccaaagctaaaactctcctgagctag

SEQ ID NO: 9651 - protein, 670 aa, Synechocystis sp. PCC 6803
MVVATQSLDELSINAIRFLAVDAIEKAKSGHPGLPMGAAPMAFTLWNKFMKFNPKNPKWFNRDRFVLSAGHGSMLQYALLYLLGYDSVTIEDIKQFRQWESSTPGHPENFLTAGVEVTTGPLGQGIANGVGLALAEAHLAATYNKPDATIVDHYTYVILGDGCNMEGISGEAASIAGHWGLGKLIALYDDNHISIDGSTDVAFTEDVSKRFEAYGWHVLHVEDGNTDLAAIAKAIEEAKAVTDKPSMIKVTTIIGYGAPNKSDTAGIHGAALGTDEVAATRKNLGWDYAPFEVPQEVLDYTRKAIERGASYEAEWNQAFAQYKTKYPTEAAAFERQLSGALPEGWDKTLASFTPDQKGLATRKYSEECLNALAPVLPELIGGSADLTHSNLTELHCSGDFQKGAYQNRNVHFGVREHAMGAICNGIALHGSGLLPFGATFLIFTDYMRAAIRLSALSEAGVIWVMTHDSIGQGEDGPTHQPIEVLASLRAIPNLTVIRPADGNETSGAYKVAIAKAKENAPTLLSLTRQAVPNLPGTSIDAVAKGAYTIVDSEGVPELILIGTGSEVQLCVAAAEKLAAQGKKVRVVSMPSWELFETQDAAYKESVLPKAVTKRLSVEAATNFGWHKYVGTEGDTVSIETFGASAPGGVCLEKFGFSVDNVLAKAKTLLS

SEQ ID NO: 9652 - DNA, 1998 bp, Chlamydophila pneumoniae AR39
  CDS (1)..(1998): transl_table=11
  misc_feature (227)..(227): y is t or c
atgatcaataaagaattagatattggtattttaggaaaaattgctggggctattaaacaaattagtattgaatccatccaaaaggcctcttctggtcatccaggacttcccctaggatgcgcagaacttgctgcctatttatatggttatgtcctgcggcaaaatccacgtgatccccattggattaatagggatcggtttgtcttgtcagcaggtcatggatctgytcttctctattcttgtttgcatcttgccggatttgatgtttccttagaggatcttcaggaatttcgccagcttcactcccgaactcccgggcatcccgagtacggcgaaactgtgggagtcgaagcaacgacaggtcctctgggacagggattaggcaatgctgtcggcatggcgctctctatgaagatgttggaatcccgattcaatcgcccaggacatgagatttttaacggaaaaatctattgtttggcaggggatggctgttttatggagggagtcagccacgaagtttgtagctttgcaggctctttaaatttaaataatcttgtggtcatctatgactacaataatgttgttctcgatggatatcttaatgaaattagtgttgaggatacaaaaaaacgttttgaagcctatggctgggatgtatatgaaattgatgggtatgattttacccatattcatgagacattctcgagcatcaaacgggggcaggaacgtcctgtattagtgattgcacatacaattattggtcatggttcgcctaaggaagggacaaataaggctcatggttctcctttaggagtcgaagggactcatgaaacaaaacagttttggcatctccctgaagaaaagttttttgtccctcctgcagtaaagaacttctttgctcataaaatacaagaagatcgaaaagcacaggagcaatggctggatgaagttcgtgtttggtcaaaacagttcccagaattacacgaagaattcgttgcgttgacctctcataagttacctaaaaacttagaatccttggtgcagagtgtagaaatgccagactctatagctggccgggctgcttcaaataaactgatccaagtattagtacagcacattccttatttgattggagggtccgcagatctttcaagctcagatggaacttggattgcgaatgagaaagtcatccatacgtatgacttctctggaaggaacattaaatacggcgttcgtgagtttggtatggccacaatcatgaatggtttagcttatagccaggtatttcgtccttttggtggaacatttttagttttttctgactatatgcgtaatgcaattcgcttggccgcattatctaaattaccagtcatctatcaatttacccatgattctatatttgttggagaagatggacctacgcatcagcctgtggaacaattgatgtctttgcgcgcgatccctggattgtatgtaatacgtcctgccgatgctaatgaagttagaggagcgtggattgcaggattaaagcacacaggtcctacagtcattgtcttgtcgcgacaagcattgcccacactgcctgctgcgcatcggccttttaaagatggtgtaggtcgtggtgcttatattgtcttaaaagagtcaggagaaaaaccagactatactctcttcgctacagggtcagaagtttctttagctctttctgtagctaaagaactcgaacacttggataagcaagtgcgtgtagtttctttcccttgttgggagctttttgaagctcaagatgtggactacaaacagagtattgtaggcggagatcttggaattcgtgtctctatagaagcaggatctgctttggggtggtataagtatatcggatctgaaggtttagctatcgctatggatagattcggatactcaggagcttctgatgatgtatcagaagaatgtggctttactacagagcaaatccttcagaggattctctctcaatag

SEQ ID NO: 9653 - protein, 665 aa, Chlamydophila pneumoniae AR39
  misc_feature (76)..(76): The Xaa at location 76 stands for Ala, or Val.
MINKELDIGILGKIAGAIKQISIESIQKASSGHPGLPLGCAELAAYLYGYVLRQNPRDPHWINRDRFVLSAGHGSXLLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWDVYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGVGRGAYIVLKESGEKPDYTLFATGSEVSLALSVAKELEHLDKQVRVVSFPCWELFEAQDVDYKQSIVGGDLGIRVSIEAGSALGWYKYIGSEGLAIAMDRFGYSGASDDVSEECGFTTEQILQRILSQ

SEQ ID NO: 9654 - DNA, 2001 bp, Salmonella enterica subsp. enterica serovar Typhi str. CT18
  CDS (1)..(2001): transl_table=11
atgtcccgtaaagaccttgccaatgcgattcgtgcgctgagcatggatgccgttcaaaaagccaattccgggcaccccggcgcgccgatggggatggcggatatcgctgaagtgctatggaacgattttcttaaacataaccccaccgatccgacctggtatgaccgtgatcgttttatcctttccaacagtcacgcctccatgctgctctatagtctgctgcatttaaccgggtatgacctgccgctggaggagctaaaaaacttccgtcaactgcactctaaaacgcctggtcacccggagattggctatacgcctggcgttgaaaccaccaccgggccgctgggccaggggctggcgaatgccgtcgggctggcgattgccgagcgtacgttaggcgcacagttcaaccggccggaccatgagattgtcgaccactacacctatgtctttatgggcgacggctgtctgatggaggggatctcgcatgaggtgtgttcgctggctggtacgctgggactgggcaaactgatcggcttttacgatcacaacggcatctccattgatggcgaaaccgaaggctggtttaccgacgatacagccaaacgttttgaagcctaccactggcatgtcgtgcatgacattgacgggcacgctccggaggcggtgaaaaaagccattctggaagcccagagcgtaaaagataaaccttcgctaattatctgtcggacggtgataggttttggctcgccgaataaagccgggaaggaggagtcgcacggcgcggcgctgggcgaagaagaggtggcgctgacccgccagaagctgggatggcatcatccggcgtttgagatcccaaaagagatttaccgcgcgtgggatggccgtgaaaaaggcgagaaagcgcagcagcagtggcaggaaaagtttgctgcttatgagaaggcttatcctgagctggccgcggagtttacccgccggatgagcggcggattgccggaggcatgggaatccgccacgcaaaaatttattaacgacttgcaggctaatccggccaaaatcgccacccgtaaagcatcgcaaaatacgctcaatgcctatggtcccctgttgccggaactgttgggcggatcggcggatctggcgccgagcaacctgactatctggaaaggtttgacctcgttgaaagaggatccggcaggtaattacatccactatggcgtgcgcgaattcggcatgaccgccattgccaacggcatcgcccaccacggcggctttgtaccgtataccgccacgtttctgatgtttgtcgaatatgcgcgtaacgcggcgcgtatggcggccttaatgaaagcccggcagattatggtctatacccacgactccatcggtttgggcgaagatggcccgacgcaccaggccatggaacaactggcgagcctgcgcttaacgcctaacttcagcacctggcgtccctgcgatcaggttgaggcggcagtcggttggaagctggccattgaacgtcagcacgggccgacggcgttgattctctcgcggcagaatctggcgcaggtggaacgcacgccggaacaggtgaaagcgattgcccgcggcggttatattctgaaagatagcggcggcaagccggatatcattctgatcgctaccggatcggaaatggaaattaccctccaggcggcggaaaaattgactggcgaggggcataacgttcgggtggtgtcgttgccttcaacggatattttcgatgcgcaggacgaggcatatcgcgaatcagtgctaccggcgcacgtaaccgcccgcgtcgcggtggaggccggtatagccgactactggtataaatatgttggcctaaaaggcgcaattatcggcatgacgggatacggtgaatccgccccggctgacaaactgttcccgtattttggctttaccgtggaaaatattgtggaaaaagcccgccgggtgctgaacatcaaaggctaa

SEQ ID NO: 9655 - protein, 666 aa, Salmonella enterica subsp. enterica serovar Typhi str. CT18
MSRKDLANAIRALSMDAVQKANSGHPGAPMGMADIAEVLWNDFLKHNPTDPTWYDRDRFILSNSHASMLLYSLLHLTGYDLPLEELKNFRQLHSKTPGHPEIGYTPGVETTTGPLGQGLANAVGLAIAERTLGAQFNRPDHEIVDHYTYVFMGDGCLMEGISHEVCSLAGTLGLGKLIGFYDHNGISIDGETEGWFTDDTAKRFEAYHWHVVHDIDGHAPEAVKKAILEAQSVKDKPSLIICRTVIGFGSPNKAGKEESHGAALGEEEVALTRQKLGWHHPAFEIPKEIYRAWDGREKGEKAQQQWQEKFAAYEKAYPELAAEFTRRMSGGLPEAWESATQKFINDLQANPAKIATRKASQNTLNAYGPLLPELLGGSADLAPSNLTIWKGLTSLKEDPAGNYIHYGVREFGMTAIANGIAHHGGFVPYTATFLMFVEYARNAARMAALMKARQIMVYTHDSIGLGEDGPTHQAMEQLASLRLTPNFSTWRPCDQVEAAVGWKLAIERQHGPTALILSRQNLAQVERTPEQVKAIARGGYILKDSGGKPDIILIATGSEMEITLQAAEKLTGEGHNVRVVSLPSTDIFDAQDEAYRESVLPAHVTARVAVEAGIADYWYKYVGLKGAIIGMTGYGESAPADKLFPYFGFTVENIVEKARRVLNIKG

SEQ ID NO: 9656 - DNA, 2001 bp, Salmonella typhimurium LT2
  CDS (1)..(2001): transl_table=11
atgtcccgtaaagaccttgccaatgcgattcgtgcgctgagcatggatgccgttcaaaaagccaattccgggcaccccggcgcgccgatggggatggcggatatcgctgaagtgctatggaacgattttcttaaacataaccccaccgatccgacctggtatgaccgtgatcgttttatcctttccaacggtcacgcctccatgctgctctatagtctgctgcatttaaccgggtatgacctgccgctggaggagttaaaaaacttccgtcaactgcactctaaaacgccaggtcacccggagattggctatacgcccggcgttgaaaccaccaccggaccgctgggccaggggctggcgaatgccgtcgggctggcgattgccgagcgtacgttaggcgcacagttcaaccggccggaccatgagattgtcgaccactacacctatgtctttatgggcgacggctgtctgatggaggggatctcgcatgaggtgtgttcgctggctggtacgctgggactgggcaaactgatcggcttttacgatcacaacggcatctccattgatggcgaaaccgaaggctggtttaccgacgataccgccaaacgttttgaagcctaccactggcatgtcgtacatgacattgacgggcacgatccggaggcggtgaaaaaagccattctcgaagcccagagcgtaaaagataaaccttcgctaattatctgtcggacggtgataggttttggctcgccgaataaagccgggaaggaggagtcgcacggcgcggcgctgggcgaagaagaggtggcgctgacccgccagaagctgggatggcatcatccggcgtttgagatcccaaaagaaatttaccgcgcgtgggatggccgtgaaaaaggcgagaaagcgcagcagcagtggcaggaaaagtttgctgcttatgagaaggcttatcctgagctggccgcggagtttacccgccggatgagcggcggactgccggaggcatgggaatccgccacgcaaaaatttattaacgacttgcaggctaatccggccaaaatcgccacccgtaaagcatcgcaaaatacgctcaatgcctacggtcccctgttgccggaactgttgggcggatcggcagatctggcgccgagcaacctgactatctggaaaggttcgacctcgttgaaagaggatccggcaggtaattatatccactatggcgtgcgcgaattcggcatgaccgccattgctaacggcatcgcccaccacggcggctttgtaccgtataccgccacgtttctgatgtttgtcgaatatgcgcgtaacgcggcgcgtatggcggccttaatgaaagcccggcagattatggtctatacccacgactccatcggtttgggcgaagatggcccgacgcaccaggccgtggaacaactggcgagcctgcgcttaacgcctaacttcagcacctggcgtccctgcgatcaggttgaggcggcagtcggctggaagctggccattgaacgtcagcacgggccgacggcgctgattctctcgcggcagaatctggcgcaggtggaacgcacgccggaacaggtgaaagcgattgcccgcggcggttatattctgaaagatagcggcggcaagccggatatcattctgatcgctaccggatcggaaatggaaattaccctacaggcggcggaaaaattgactggcgaggggcataacgttcgcgtggtgtcgttgccttcaacggatattttcgatgcgcaggacgaggcatatcgcgaatcagtgctaccggcacacgtaaccgcccgcgtcgcggtggaggccggtatagccgactactggtataaatatgttggcctaaaaggcgcaattatcggcatgacgggatacggtgaatccgctccggctgacaaactgttcccgtattttggctttaccgtggaaaatattgtagaaaaagcccgccgggtgctaaacatcaaaggctaa

SEQ ID NO: 9657 - protein, 666 aa, Salmonella typhimurium LT2
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLGAQFNRPDHEIVDHYTYVFMGDGCLMEGISHEVCSLAGTLGLGKLIGFYDHNGISIDGETEGWFTDDTAKRFEAYHWHVVHDIDGHDPEAVKKAILEAQSVKDKPSLIICRTVIGFGSPNKAGKEESHGAALGEEEVALTRQKLGWHHPAFEIPKEIYRAWDGREKGEKAQQQWQEKFAAYEKAYPELAAEFTRRMSGGLPEAWESATQKFINDLQANPAKIATRKASQNTLNAYGPLLPELLGGSADLAPSNLTIWKGSTSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAIERQHGPTALILSRQNLAQVERTPEQVKAIARGGYILKDSGGKPDIILIATGSEMEITLQAAEKLTGEGHNVRVVSLPSTDIFDAQDEAYRESVLPAHVTARVAVEAGIADYWYKYVGLKGAIIGMTGYGESAPADKLFPYFGFTVENIVEKARRVLNIKG

SEQ ID NO: 9658 - DNA, 1992 bp, Salmonella typhimurium LT2
  CDS (1)..(1992): transl_table=11
atgtcctcacgtaaagagcttgccaatgctattcgtgcgctgagcatggacgcagtacagaaagccaagtccggtcacccgggtgccccgatgggtatggctgacattgccgaagtcctgtggcgtgatttcctgaaccacaacccgaccaacccgtcctgggccgaccgcgaccgcttcgtgctgtccaatggccacggctcaatgctgatttacagcctgctgcacctcaccggttatgacctgccgatgtccgagctgcagaatttccgtcagctacattcaaaaacccctggtcacccggaagtgggctacaccgctggcgttgaaaccactactggcccgctgggtcagggtattgccaacgccgtcgggatggcgattgccgagaaaactctggcggcgcagtttaatcgtcctggccacgatatcgttgaccacttcacctacgtctttatgggcgacggctgcatgatggaaggcatttctcacgaagtgtgctctctggctggtactctgaaactgggcaaactgatcgcgttctatgatgacaacggtatctctatcgatggtcatgttgaaggctggttcaccgatgacaccgcgaaacgttttgaagcctacggctggcacgttatccgtggcattgacggtcacgatgccgacgccattaaacgcgccacggaagaagctcgcgccgtgactgacaaaccgtccctgctgatgtgcaaaaccatcatcggtttcggttcgccgaacaaacagggtacccacgattcccacggcgcgccgctgggcgacgcggaaatcgcgctgacccgcgaacagttgggctggaaatacgcgccgttcgaaatcccgtctgaaatctacgcccagtgggatgcgaaagaagccggccaggcgaaagagtctgcatggaatgagaaattcgcggcttatgagaaagccttcccgcaggaagctgctgaattcactcgtcgtatgaaaggcgacatgccggctgacttcgatgcgaaagcgaatgagttcatcgctaaactgcaggcgaatccatccaaaatcgccagccgtaaagcgtcccagaataccatcgaagccttcggtccgctgttgccggaattcctcggcggctccgctgacctggctccttctaacctgaccctgtggtccggttcgaaagcgattaacgaagatgccgcaggtaactacattcattacggtgtgcgcgaattcggtatgaccgctatcgccaacggtatcgccctgcacggcggtttcctgccgtacacctccaccttcctgatgttcgtcgaatatgcccgtaacgcagtgcgtatggcagcgttgatgaaacaacgtcaggtgatggtgtacacccacgactccatcggtctgggcgaagatggcccgacgcaccagccggtcgagcaggtggcaagcctgcgcgtaacgccgaacatgtccacatggcgtccgtgcgaccaggtggaatccgcggtggcgtggaaatatggcgtagagcgtcaggatggcccaaccgcgctgatcctctcccgtcagaacctggcgcagcaggaacgtactgaagagcaactggcgaatatcgcccgcggtggttacgtactgaaagattgtgcgggccagccgcagattatcttcattgcgaccggttcagaggttgagctggcggttgccgcttacgaaaaactgactgccgaaggcgtgaaggcgcgcgtggtttccatgccgtccaccgacgcgttcgacaagcaggatgcggcttaccgtgaatccgtgctgccgaaggcggtctctgcgcgtgtggcgattgaagcgggtatcgctgactactggttcaaatacgtcggcctgaacggcgctattgtcgggatgaccaccttcggtgagtctgctccggcagagctgttgtttgaagagtttggcttcacggtggacaacgtgatcgccaaagcgaaagcactgctgtaa

SEQ ID NO: 9659 - protein, 663 aa, Salmonella typhimurium LT2
MSSRKELANAIRALSMDAVQKAKSGHPGAPMGMADIAEVLWRDFLNHNPTNPSWADRDRFVLSNGHGSMLIYSLLHLTGYDLPMSELQNFRQLHSKTPGHPEVGYTAGVETTTGPLGQGIANAVGMAIAEKTLAAQFNRPGHDIVDHFTYVFMGDGCMMEGISHEVCSLAGTLKLGKLIAFYDDNGISIDGHVEGWFTDDTAKRFEAYGWHVIRGIDGHDADAIKRATEEARAVTDKPSLLMCKTIIGFGSPNKQGTHDSHGAPLGDAEIALTREQLGWKYAPFEIPSEIYAQWDAKEAGQAKESAWNEKFAAYEKAFPQEAAEFTRRMKGDMPADFDAKANEFIAKLQANPSKIASRKASQNTIEAFGPLLPEFLGGSADLAPSNLTLWSGSKAINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPQIIFIATGSEVELAVAAYEKLTAEGVKARVVSMPSTDAFDKQDAAYRESVLPKAVSARVAIEAGIADYWFKYVGLNGAIVGMTTFGESAPAELLFEEFGFTVDNVIAKAKALL

SEQ ID NO: 9660 - DNA, 1998 bp, Listeria monocytogenes EGD-e
  CDS (1)..(1998): transl_table=11
atgagcagaattgatgaacaaatggttaactcgattcgtgtattatcaatggatatgattgaaaaagcgaactccggacatcccggtttaccgatgggagccgcaccaatggctttctcactttggaaaaatcatttaaaattcaatccagaacatccaacttggtttaaccgcgatcgcttcgttctgtcagctggtcacggttcagcaatgctttatagtttgctccatctatttggttatgatttaccaatgagcgagctgaaaaacttccgccaaactggcagtaaaacgcccggtcatcctgaatttggtcatacggttggtgtggatgcaactactggtccgcttggtcaaggtttcgcaatgggagttgggatggcaatggccgaggctcaccttggtgccaaatttaaccaacctgaattccctgttgtcgatcataacacctacgtgctatgcggagacggctgcttgatggaaggtatttcctatgaagccgcatcccttgccggccatttaaaactgggaaaattagttgttttatatgattcaaacgatatttcacttgatggcgatttaaacgagtcattttcagaagacatcgaactcagattccgagctgctggttggcaaacgctacgtgtggacgacggaaacgacttagatgcgcttgatgcagcaatccatcttgcaaaaacggaaaaatcccgcccaactttgattgaagtgaagacagtgattggttatggtagccctggaaaagccggaaaatcggcggctcacggatccccacttggtgaaaaggaactcaagcttgcaaaagaagcttacgactggcaaatgccaccttttgaattaccgaaaaccgtcgaaaaccaaaaagaattttatcattccaaaggtcgcgcgagtgaaagcagctggctccggacattcaatgcttacaaacaaaaatatccagcactagcagaaagcttgcaacacctaatggacgataatttgacagctgattgggacgcagaacttcctgtcttcgatgaaaatgcagataaaccagttgcgactcgtgaagtatcggggattattcttcaagaattggagaaaaaattgcctaacttatttggtggcgcagctgatttagcttcctccaataaaacccatttaaaagctagcgaacggttcgctccaggtaattacgcggccaaaaatatctcgttcggcgtccgcgaattcgcgatgggagcagcagtcaacggaatgacgcttcatggcggagttcaagcattcggcgcgactttcttcgttttctcggattatctacgttccgcgattcgttcggcagccttaatgggcattccatccaccttcattatgacccatgattccatcgcggttggtgaagacggtccaacacacgaaccaatcgagcatctcgcatccttccgcgccatgccgggacttcacgtaatccgaccagctgacggcaacgaaaccgtcgaagcataccgctttgcctttactcaaaaagaacaaccaaccatgctagtcctcagccgccaaaacctgccaattttaccaaacagcgcagcaaaagcgaaaaccggacttgcaaaaggtgcctacatcttagccgattccccgctggacaagctagatatcatcctactcgcttccggatccgaagtgcacctaatgacagctgtcagagataatctcgctaaaaaaggcttcggcgcacgcgtagtcagcatgccaagctttgatttattcgacaaacaaagccccgaatacaaagagtccattttgccaaaagcagtgaaaaaacgcttcgccgctgaaatgggcgcatcgtacggctggcataaatacctcggtgactcaggtgaaatcctcgcgattgattcattcggaatgtctggcccgggagacgagctggcagagcgatttggatttactgtggagaatttgacggagcttgcgttgaaacagttgtag

SEQ ID NO: 9661 - protein, 665 aa, Listeria monocytogenes EGD-e
MSRIDEQMVNSIRVLSMDMIEKANSGHPGLPMGAAPMAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQHLMDDNLTADWDAELPVFDENADKPVATREVSGIILQELEKKLPNLFGGAADLASSNKTHLKASERFAPGNYAAKNISFGVREFAMGAAVNGMTLHGGVQAFGATFFVFSDYLRSAIRSAALMGIPSTFIMTHDSIAVGEDGPTHEPIEHLASFRAMPGLHVIRPADGNETVEAYRFAFTQKEQPTMLVLSRQNLPILPNSAAKAKTGLAKGAYILADSPLDKLDIILLASGSEVHLMTAVRDNLAKKGFGARVVSMPSFDLFDKQSPEYKESILPKAVKKRFAAEMGASYGWHKYLGDSGEILAIDSFGMSGPGDELAERFGFTVENLTELALKQL

SEQ ID NO: 9662 - DNA, 1995 bp, Listeria monocytogenes EGD-e
  CDS (1)..(1995): transl_table=11
ttgttcgataacacagatagtttagcagtgaatacaattcgtacattatcaatggacgcaattcaaaaagcaaattctggtcatccgggattaccaatgggagcagctccaatggcttacgcgctttggtctcgcgtattaaacacaaaccctaaaaattcacattggtttaaccgggatcgttttgtactttctgctggacacggctcaatgcttttatatagtttattacatttaagcggattcaaattagaattagaagatcttaaaaatttccgtcaatgggaaagtaaaactccaggtcacccagaatatcgttatacggatggtgtagacgcaactactggtccacttggtcaaggtattgcgatggctgttggtatggctatggcagaaagacatttagaagcgaaatataataaagatggtttcccagtggtggatcattatacttacgcactatgcggagatggtgacttaatggaaggtgttgcttcagaagcggcttcttatgcaggtcatcaacaattaggaagattagttgttttatatgattccaatgatatctctcttgatggtgatttagacaaatctttctctgaaaatgtaaaacaacgctttgaagcttatggttgggaacatttattagtaaaagacggtaatgatacagctgaaattttagctgcaattgaaaaagcgaaacaaaacacttctcaacctactatgatcgaagtgaaaactgttatcggttttggtgctccaaatgccggtacaagtaaagttcacggtgctccactaggtgatgaaggtattttagaagcgaaaaaagcttatggttggaactacgaagagaaattctttgttcctgaagaagttactgctcgctttaaagaaactattggcgaacgtggcgaaaaagcagaaaaagcttggaatgaattattcgcttcttataaagctgaatatccagagcttgctaaacaattagaagatagtttaaacaataagttaccagctgattgggatgcggatcttcctgtatatgatgattctaaagcacttgctagccgtgcttcaagtggcgaagtaatcaatgcattagctgggaaaataccaactatttttggtggatcagctgaccttgcgggttctaataatacaacaattaaaacagatggtgaatttacaaaagcaactccagctgaaagaaatatttggtttggcgttcgtgaatttgcgatgggtgctgcattaaacggtatggcacttcatggcggattacaagtatatggtggaacattcttcgtattctctgactatgtacgtgctgccattcgtttatctgccattcaacatttaccagtaacttacgtaatgacgcatgatagtattgctgtaggtgaagatggaccaacacatgagccagtcgaacaacttgcaagcttacgtgcaatgccaggtctttctgtcattcgtcctgctgatggaaatgaagtagtggaagcttggaaacttgctatcacttctacatctacaccgcatgtacttgttcttactcgtcaaggtttaccaacattaccaaattctgctaaattaactgcagaaggcgttaaaaaaggtgcttacgtaatttcacctgcaaaaggggaagtaccggaagcaatcattcttgcgagtggttctgaagttaacttagctatcgaagcgcaaaaagaacttcaagctcaaggaacggatgtatcagttgtcagtgtgccatcatttgatctattcgagcaacaatctgcggaatacaaagaaagtgtattaccgaatgctgttagaaaacgtattgcagtagagatgggcgctagctttggctgggaacgctacgttggattagatgggaaagttatcggaatcgacaaatttggcgcttctgctccaggtgaaactgttattaagaattatggctttactgttgaaaacgtcgttaatacagtaaaatcactttaa

SEQ ID NO: 9663 - protein, 664 aa, Listeria monocytogenes EGD-e
MFDNTDSLAVNTIRTLSMDAIQKANSGHPGLPMGAAPMAYALWSRVLNTNPKNSHWFNRDRFVLSAGHGSMLLYSLLHLSGFKLELEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTARFKETIGERGEKAEKAWNELFASYKAEYPELAKQLEDSLNNKLPADWDADLPVYDDSKALASRASSGEVINALAGKIPTIFGGSADLAGSNNTTIKTDGEFTKATPAERNIWFGVREFAMGAALNGMALHGGLQVYGGTFFVFSDYVRAAIRLSAIQHLPVTYVMTHDSIAVGEDGPTHEPVEQLASLRAMPGLSVIRPADGNEVVEAWKLAITSTSTPHVLVLTRQGLPTLPNSAKLTAEGVKKGAYVISPAKGEVPEAIILASGSEVNLAIEAQKELQAQGTDVSVVSVPSFDLFEQQSAEYKESVLPNAVRKRIAVEMGASFGWERYVGLDGKVIGIDKFGASAPGETVIKNYGFTVENVVNTVKSL

SEQ ID NO: 9664 - DNA, 2016 bp, Listeria monocytogenes EGD-e
  CDS (1)..(2016): transl_table=11
ttgaaaaaaacattagatagacaagcagtagatacgattcgttcgttatcaattgatatgattgagaaagcaaattcaggacacccgggaatgccgatgggagcagcaccaatggcgtatatgctatttgcgaaacatttagtatttaacccagccaacccagaatggtttaaccgcgaccgatttgtcttatcagcagggcacgggtccgcgctactttatagcatgcttcatttatttggttatgatgtgaaaatggaggacttaaaacagttccgtcagttagatagtttgacaccaggacatcctgaattcggatggactgcaggagttgatgcaacgagtggaccgcttggacaagggattggtatggcagctggaatggcacttgcagagtctcatttggcggcggaatataaccaaccaaactacccaattgtcgaccattacacgtatgcgatttgcggtgatggcgatttgatggaaggtgtggcatcagaaacagcctcacttgcaggacatttaggacttggaaaattaatcgtactatacgattcaaacgatatttgtttagatggtgatttaagtgcaacattcagtgaaaatgcagcagaccgtttccgtgcatacggatggcaagttttgcgcgtagaagatggcaacaacttagcagctattcaagaaaaaattgttcaagctaaattagaaacatcaaaaccaacactaatcgaagtgaaaacagtcattggttacggtgcgccaacaaaagcaggtagctccgcaagtcacggtgctccgcttggtgaaaaagaagctaatggcgcgaaagaacattatgaatgggcagaagagcctttcacagtaccggctgaagttcgtgattatttaagaaattacaaagcgcgcggagaaaaactagaaggcgcttggaacacgatgcttgctaattacaaaaaagaattcccagaacttgcgagacaattagatcgagtgctagcgggagaagtagcagctgattggaatgctaatttgccaacttttgaagcaggcacaaatgtcgcaacgcgctctgcttctggaaaaatgatcaacgcgattgcagccgaattaccggaacttttcggtgggtctgctgacttaggttgctcgaataaaacatttattgatgcgagcccagcgtatagcattcaagacccagctggtaaaaatatttggttcggcgtgcgcgagtttgcgatgggagcaatgttaaacggaatggcacttcatagcggcttacgagtatttggctcgactttcttcgtcttctcagactatgtccgcccagcaatgcggatggctgctttaatgcaacttccagtaacatatgtattcacgcatgacagtatcgctgttggtgaagacggcccgacacatgaaccaatcgaacaattagcctcgcttcgtgccatgccaggtctaaccgttatccgaccagctgatgccaaagaaacgcgcgctgcttgggaaatcgctgcaactaacacaaacggcccgatcgcacttgtattatcacgtcaagacttaccggtactcgaaaacgaccaagaagaagtagatgcagggatcgaaaaaggtgcatatatcgtagctccagcaaatagttccaaaccagacgcaatcattatcgcaacagggtccgaagtgtccctggcaatcgaagcgaaagccgaactcgcgaaaaaagatatcgacgtttccgttgtcagtttatccagctgggaacgcttcgaaaaaacaaccgatgcgtataaagaaagtattttaccaaaagaagtcacagcgagatttgcgattgaagccggagcaacatttggttggaaagaattcattggatcagaaggtgacatgctaggaattgatcattttggcgcatctgctccagcgaaagatttgtttaacgcttacggcttcactcctgaaaatgtggcggatcgcgtcgaagctgtaattgcgaaagccggtgtgcgcgtatga

SEQ ID NO: 9665 - protein, 671 aa, Listeria monocytogenes EGD-e
MKKTLDRQAVDTIRSLSIDMIEKANSGHPGMPMGAAPMAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELARQLDRVLAGEVAADWNANLPTFEAGTNVATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTNGPIALVLSRQDLPVLENDQEEVDAGIEKGAYIVAPANSSKPDAIIIATGSEVSLAIEAKAELAKKDIDVSVVSLSSWERFEKTTDAYKESILPKEVTARFAIEAGATFGWKEFIGSEGDMLGIDHFGASAPAKDLFNAYGFTPENVADRVEAVIAKAGVRV

SEQ ID NO: 9666 - DNA, 1998 bp, Listeria innocua Clip11262
  CDS (1)..(1998): transl_table=11
atgagcagaattgatgaacaaatggttaactcgattcgcgtattatcaatggatatgattgaaaaagcgaactccggacatcccggtttgccgatgggagccgcaccaatggctttctcgctttggaaaaatcatttaaaattcaatccagaacacccaacttggtttaaccgcgatcgcttcgtcttgtcagctggtcacggttcggcaatgctttatagtttgctacatctatttggttatgatttaccaatgagcgagctgaaaaacttccgccaaactggcagtaaaacgcccggtcatcctgaatttggtcatacggttggtgtcgatgcaactaccggtcctcttggtcaaggtttcgcaatgggagttgggatggcaatggccgaggctcaccttggcgccaaatttaaccaacctgaattcccggttgttgatcacaatacctatgtgctatgcggtgacggctgtttgatggaaggtatttcctacgaagctgcctcccttgctggtcatttaaaactgggaaaattagttgttttatatgattcaaacgatatttcactggatggcgatttaaacgagtctttttcagaagacatcgagcttagattccgagctgctggttggcaaacgctacgtgtggacgacggaaacgacttagatgcgcttgatgcagcaatccatcttgcaaaaaccgagaaatcccgcccaactttaatcgaagtgaaaacggtcatcggttatggtagccctggaaaagccggaaaatcagcggcacacggctccccacttggcgaaaaagaactcaaactagcaaaagaagcttacgattggcaaatgccaccttttgaattaccaaaaactgtcgaaaatcagaaagaattttatcattctaaaggtcgcgcgagtgaaagcagctggctccggacattcaatgcttacaaacaaaaatatccagcactcgcagaaagtttgcaacaattaatggatgataatttgaatccagattgggatgcagaattacctgtctttgatgaaaatgcggacaaaccagttgcaactcgtgaagtatcagggattgtccttcaagaattagagaaaaaactgcctaacttatttggcggtgcggctgatttagcttcctccaacaaaaccaatttaaaagctagcgaacggtttgctccaggtaactatgccgccaagaatatttcgttcggcgtccgcgaatttgcgatgggagcagcagtcaacggcatgacgcttcacggcggagttcaagcattcggcgcgaccttcttcgtattctcggattatctacgttccgcgattcgttcagcagccttaatgggcattccatccaccttcattatgacccatgattccatcgcggtcggtgaagacggtccaacacacgaaccaatcgagcatctcgcatccttccgcgccatgcctggacttcacgtcatccgaccagctgacggcaacgaaaccgtagaagcataccgctatgcctttactcaaaaagaacaaccaaccatgctcgttcttagccgccaaaacctgccaattttaccaaacagcgcagcaaaagcgaaaaccggtctagcaaaaggtgcttacatcttagccgattccccgcttgataaactagatattatcttactcgcttctggatccgaagtacacctaatgacagctgtcagagataatcttgctaaaaaaggcttcggcgcacgcgtagtcagcatgccaagctttgatttattcgacaaacaaagccccgaatataaagagtccattttaccaaaagcagtgaaaaaacgcttcgccgctgaaatgggcgcctcatacggctggcacaaatacctcggtgatgcaggcgaaatcctcgcgattgattcgtttgggatgtctggcccgggagacgagctggcagaacgatttggctttactgtagagaacttgacggaacttgcattgaagcagttgtag

SEQ ID NO: 9667 - protein, 665 aa, Listeria innocua Clip11262
MSRIDEQMVNSIRVLSMDMIEKANSGHPGLPMGAAPMAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQQLMDDNLNPDWDAELPVFDENADKPVATREVSGIVLQELEKKLPNLFGGAADLASSNKTNLKASERFAPGNYAAKNISFGVREFAMGAAVNGMTLHGGVQAFGATFFVFSDYLRSAIRSAALMGIPSTFIMTHDSIAVGEDGPTHEPIEHLASFRAMPGLHVIRPADGNETVEAYRYAFTQKEQPTMLVLSRQNLPILPNSAAKAKTGLAKGAYILADSPLDKLDIILLASGSEVHLMTAVRDNLAKKGFGARVVSMPSFDLFDKQSPEYKESILPKAVKKRFAAEMGASYGWHKYLGDAGEILAIDSFGMSGPGDELAERFGFTVENLTELALKQL

SEQ ID NO: 9668 - DNA, 1995 bp, Listeria innocua Clip11262
  CDS (1)..(1995): transl_table=11
ttgttcgataacacagatagtttagcagtaaatacaattcgtacattatcaattgatgcaattcaaaaagcaaattctggtcatccgggattaccaatgggagcggctccaatggcttatgcactttggtctcgcgtattaaatacaaaccctaaaaattcacattggtttaaccgtgatcgttttgtactttctgctggacacggctcaatgcttttatatagtttattacatttaagtggtttcaaattagaaatagaagaccttaaaaacttccgtcaatgggaaagtaaaactccaggtcacccagaatatcgttatactgatggagtagatgcaactactggtccacttggtcaaggtattgcgatggctgttggtatggctatggcagaaagacatcttgaagcaaaatataacaaagatggtttcccagttgtggatcactatacttatgcgctatgtggagatggagacttaatggaaggtgttgcttctgaagcggcttcttacgcaggtcaccaacaacttggaagacttgttgttttatacgattccaatgatatttctcttgatggcgatttagacaaatctttctctgaaaatgtaaaacaacgctttgaagcttatggttgggaacatttattagttaaagatggcaatgatacagcagaaatcctagctgctattgaaaaagcaaaacaaaatacatcacaacctacaatgattgaagttaaaacagttattggttttggtgctcctaatgcaggtactagtaaagttcatggtgctcctctaggtgacgaaggtattttagaagcgaaaaaagcttatggttggaactacgaagaaaaattctttgttcctgaagaagttacaactcgctttaaagaaactattggagaacgcggtgaaaaagcagaagcagcatggaacgaattatttgcttcttataaagcgaaatacccagagcttgctaaacaattagaagatagcttaaataacaagttaccagctgattgggatgcagatcttccagtatatgacgattctaaagcacttgctagccgtgcttcaagtggtgaagttatcaatgcattagctgcgaaaatacctactatttttggtggttcagcagaccttgctggttctaacaatacaacaattaaaacagatggtgaattcactaaaaaaacaccagcagaaagaaatatctggtttggtgttcgtgaatttgcaatgggtgcagcgttaaacggtatggcactacacggcgggttacaagtatacggaggtacattctttgtattctctgactatgtacgtgctgcgattcgtttatccgcaatccaacatttacctgtaacatatgtaatgacacatgatagtattgctgtaggggaagatggtccaacccatgagccaatcgagcaacttgcaagcttacgtgctatgccaggactttctgttatccgtcctgctgatggaaatgaagtagtagaagcttggaaactagcgattacttcgacagatactccacatgtgcttgttcttactcgtcaaggattaccaactttaccaaattctgcgaaattatctgcagaaggcgttaaaaaaggtgcttatgttatttctcctgctaaaggtgaggttccagaagcaattattcttgcaagtggttctgaagttaatttagctgttgaagcgcaaaaagaacttcaagctcaaggaacagatgtatccgttgtgagcgtgccatcatttgatctatttgcaaaacaatcagcagaatacaaagaaagcgtcttaccaaatgctgttagaaaacgtgtagcagtagagatgggtgctagctttggttgggaacgttatgttggtttagatggtaaagtgattggaattgacaaatttggtgcttctgctccaggtgaaacagttattaaaaattatggctttactgtagaaaacgttgttaatacagtaaaatcactttaa

SEQ ID NO: 9669 - protein, 664 aa, Listeria innocua Clip11262
MFDNTDSLAVNTIRTLSIDAIQKANSGHPGLPMGAAPMAYALWSRVLNTNPKNSHWFNRDRFVLSAGHGSMLLYSLLHLSGFKLEIEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTTRFKETIGERGEKAEAAWNELFASYKAKYPELAKQLEDSLNNKLPADWDADLPVYDDSKALASRASSGEVINALAAKIPTIFGGSADLAGSNNTTIKTDGEFTKKTPAERNIWFGVREFAMGAALNGMALHGGLQVYGGTFFVFSDYVRAAIRLSAIQHLPVTYVMTHDSIAVGEDGPTHEPIEQLASLRAMPGLSVIRPADGNEVVEAWKLAITSTDTPHVLVLTRQGLPTLPNSAKLSAEGVKKGAYVISPAKGEVPEAIILASGSEVNLAVEAQKELQAQGTDVSVVSVPSFDLFAKQSAEYKESVLPNAVRKRVAVEMGASFGWERYVGLDGKVIGIDKFGASAPGETVIKNYGFTVENVVNTVKSL

SEQ ID NO: 9670 - DNA, 2016 bp, Listeria innocua Clip11262
  CDS (1)..(2016): transl_table=11
ttgaaaaaaacattagatagacaagctgtggacacgattcgttcgttatccattgatatgattgagaaagcaaactcagggcacccaggaatgccgatgggagctgctccaatggcgtatatgctatttgcaaaacatttagtatttaacccagccaacccagaatggtttaaccgcgaccgatttgtcttatcagcagggcacgggtccgcgctactttatagcatgcttcatctatttggttatgatgtgaaaatggaggacttaaaacagttccgtcaattagatagtttgacaccaggacaccctgaatttggatggactgcgggagttgatgcaacgagtggcccacttggacaagggattggtatggccgctggtatggcgctggcagaatctcatttagcggctgagtataaccaaccaaattatccaattgtcgaccattatacgtatgcgatttgtggtgacggggacttgatggaaggtgtggcatcagaaacagcctcacttgcagggcatttaggacttggaaaattaatcgtattgtacgattccaatgatatttgtttagatggcgatttaagtgcaacgttcagtgaaaatgcagcagatcgtttccgtgcatacggctggcaagttttacgcgtagaagatggcaacaatttagcagcaattcaagagaaaattgttcaagcaaaattagaaacatcaaaaccaacgctaatcgaagtgaaaacagtcatcggttacggtgcgccaacaaaagcaggaagctctgcaagtcacggtgctccgcttggtgaaaaagaagcgaatggcgcgaaagaacattatgaatgggcagaagaacctttcacagtaccagctgaagttcgtgattatttaagaaattacaaagctcgcggggaaaaactagagggtgcttggaacacgatgctcgctaattacaaaaaagaattcccagaacttgcaaggcaattagaccgagtgttagcgggagaagtagcagctgattggaacgccaatttgccaactttcgaagcaggtacaaatattgcaacacgctctgcttctggaaaaatgattaacgcaattgcagccgaattaccggaacttttcgggggatctgctgacttaggttgttcgaacaaaacatttattgatgcgagcccagcatacagcattcaagacccagctggtaaaaatatctggttcggtgtgcgcgaatttgcgatgggagcaatgttaaacggaatggcgcttcatagcggtttacgagtatttggctccactttcttcgtcttctcagactatgtgcgtccagcaatgcggatggctgctttaatgcaactcccagtaacgtatgtattcacgcatgacagtatcgctgtaggtgaagacggcccgacacatgaaccaatcgaacaactagcctcactccgtgccatgccaggcctaacagttatccgcccagccgatgccaaagaaactcgcgctgcttgggaaattgctgcaaccaacacgcatggtccaatcgctcttgtactatcacgccaagacttaccagtacttgaaaatgcacaagaagaagtagatgcaggtgtagataaaggtgcttatatcgtagcaccagcaaatagttccaaaccagacgctatcattatcgcaacaggatccgaagtgtcccttgcaattgaagcgaaagccgaacttgcgaaaaaagatatcgacgtttccgttgttagtttgtccagctgggaacgctttgaaaaaacaaccgatgcttataaagaaagcattttaccaaaagaagtcacagcgagatttgcgattgaagctggagcaacattcggttggaaagaatttattgggtcagaaggcgatatgttaggaatcaatcacttcggcgcatctgcccctgcgaaagatttgtttaacgcttatggatttacaccagaaaatgtggcggatcgtgtcgaagctgtgattgcgaaagccggtgtgcgcgtatga

SEQ ID NO: 9671 - protein, 671 aa, Listeria innocua Clip11262
MKKTLDRQAVDTIRSLSIDMIEKANSGHPGMPMGAAPMAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELARQLDRVLAGEVAADWNANLPTFEAGTNIATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTHGPIALVLSRQDLPVLENAQEEVDAGVDKGAYIVAPANSSKPDAIIIATGSEVSLAIEAKAELAKKDIDVSVVSLSSWERFEKTTDAYKESILPKEVTARFAIEAGATFGWKEFIGSEGDMLGINHFGASAPAKDLFNAYGFTPENVADRVEAVIAKAGVRV

SEQ ID NO: 9672 - DNA, 2013 bp, Nostoc sp. PCC 7120
  CDS (1)..(2013): transl_table=11
atggctgttgcaacccaatccctcgaagaactttctattaatgcgattcgtttcttggctgttgatgccatagaaaaggcaaaatcgggacaccccggactaccgatgggcgcggctccaatggcttttgtgctgtggaaccgctttatgcggtataacccgaaaaatcccaaatggtttaaccgcgatcgctttgttttgtctgctggtcatggttccatgttgcagtatgccctgctctacctgacaggctacgatagcgtcagcattgaggacatcaagcaattccgccagtgggaatccaaaacccccggacacccagaaaacttcatgaccgcaggtgtagaagtcaccactgggccactaggtcaaggtattgccaatggtgttggtttagcgatcgcagaagctcacctcgcagctaagttcaacaaacccgatgccaagattgttgaccattatacctatgtaattttaggtgatggttgcaacatggaaggcgtttctggtgaagcagcctcttttgctggacacttgggattaggtaaactgatcgctctgtacgacgacaaccacatttccatcgatggttctacagatgtagcctttaccgaagatgtttccaagcgttttgaatcttatggctggcacgtcatccatgttaaagatggcaacaccgatttagaagcaattcacaaagctattgaagaggcaaaagctgtcaccgataagcccaccatgattaaggtgacaaccattatcggttacggttcccctaacaaatctaatactgccggggttcacggtgcagcattgggtggagatgaagtagccttaactcgtcaaaatctaggttggtcacacgacccatttgttgttcccgaagatgtcctcaactatacccgtaaagcagtagagcgcggtgcaggctacgaatctgactggaacaaaacctacgcagattacaaagctaaatatccccaagaagcggctgaatttgagcgttacttaagcggcaaactggctgatggttgggataaggtactaccatcctacacccccgaagataaaggacttcccacccgtaagcattcagaaacctgcctcaacaaattggcggcggttctacctgaactcattggtggttcggctgacttgacccattccaacctcaccgaaatcaagggcaaaggcgacttccaaaaaggacaataccaaaatcccaacatccactttggtgtccgggaacatggtatgggcgcaatctgtaacggtattgcgctgcatggttcgggattaattccctatggcgctaccttcttaatcttcagtgattatatgcgcgctcccatccgtttatctgccctgtctcaagccggctcgatttgggtgatgacccacgattccatcggtcaaggtgaagacggcccgacccaccaaccaatcgaaacgctggcctcactccgtgctattcctaacctgacagtaattcgtcccgccgacggtaacgaaacctccggcgcttacaaagtagcaattgagagagctaagaacaacgctcctactttgttggcgtttactcgtcaaaatgttcccaacttggcaggtacatcgattgatgacgtagctaagggcggatacattgttgtagataccgatggcacaccagatttaatcctgattggtactggttcagaattgagcctctgtgtcaccgcagccgagaaactcaaagctgaaggcaagaaagttcgtgtagtctccttggctgcttgggatttgtttgatgcacaagatgcagcttacaaagaatcagttctacctaaagctgtcaccaagcgtttagctgtagaagcggctagcagcttcggctggcacaaatatattggtagtgaaggcgatgctgtaactatagaccgcttcggtgcttctgctcctggcggcgtttgtttggagaaatttggttttagcgttgataatgtattagctaaagctaaacaattgttgggttaa

SEQ ID NO: 9673 - protein, 670 aa, Nostoc sp. PCC 7120
MAVATQSLEELSINAIRFLAVDAIEKAKSGHPGLPMGAAPMAFVLWNRFMRYNPKNPKWFNRDRFVLSAGHGSMLQYALLYLTGYDSVSIEDIKQFRQWESKTPGHPENFMTAGVEVTTGPLGQGIANGVGLAIAEAHLAAKFNKPDAKIVDHYTYVILGDGCNMEGVSGEAASFAGHLGLGKLIALYDDNHISIDGSTDVAFTEDVSKRFESYGWHVIHVKDGNTDLEAIHKAIEEAKAVTDKPTMIKVTTIIGYGSPNKSNTAGVHGAALGGDEVALTRQNLGWSHDPFVVPEDVLNYTRKAVERGAGYESDWNKTYADYKAKYPQEAAEFERYLSGKLADGWDKVLPSYTPEDKGLPTRKHSETCLNKLAAVLPELIGGSADLTHSNLTEIKGKGDFQKGQYQNPNIHFGVREHGMGAICNGIALHGSGLIPYGATFLIFSDYMRAPIRLSALSQAGSIWVMTHDSIGQGEDGPTHQPIETLASLRAIPNLTVIRPADGNETSGAYKVAIERAKNNAPTLLAFTRQNVPNLAGTSIDDVAKGGYIVVDTDGTPDLILIGTGSELSLCVTAAEKLKAEGKKVRVVSLAAWDLFDAQDAAYKESVLPKAVTKRLAVEAASSFGWHKYIGSEGDAVTIDRFGASAPGGVCLEKFGFSVDNVLAKAKQLLG

SEQ ID NO: 9674 - DNA, 2028 bp, Ralstonia solanacearum GMI1000
  CDS (1)..(2028): transl_table=11
atgtccgctcccgccctccattcgatcacctcactgcccacccagcagatggccaatgccatccgcgtgcttgcgatggacgccgtccagcaagccaactcgggccaccccggcatgccgatgggcatggcggacatcgccgtggcgctgtggagccgccacctgcgccacaacccggcgaacccgcactggcccgaccgcgaccgcttcgtgctgtccaacggccacggttcgatgctgctgtacgcgctgctgcacctgaccggctacgacctgccgatgtcggaactgaagaacttccgccagctgcacagcaagaccgccggccaccccgaatacggcatcacgccgggcgtggaaaccaccaccggcccgctggggcagggcctcaccaacgcggtcggcatggcgctggccgagcgcctgctgggccaggaattcaaccgtcccggcttcgacatcgtcaaccaccacacctacgtcttcctgggtgacggctgcctgatggaaggcatcagccacgaagcctgctcgctggccggcacgctcggtctgaacaagctgatcgcgctgtgggacgacaacggcatctcgatcgacggcgacgtcgtccactggttcaacgacgacacgcccaagcgcttcgaagcctatggctggaatgtgatccgcgccgtcgacggccacaatgtcgccgccgtggaagccgccatcgcgcaggccaagacgtccgacaagccgaccctgatctgctgccgcaccgtgatcggcaagggcgcgcccaccaaggcgggcggccacgacgtgcatggcgcgccgctgggcggtgccgagatcgccgccgcgcgcgaggcgctggcctggccgcatgcgccgttcgacgtgccgcaggccgtgtacgacgcgtgggatgcgcgcggccagggtcaggcgctcgaaaaggcctggaacgcactgttcgatgcctatgccgagcgctatccggccgaagccgggcagttccagcgccgcatgcgcggccagttgccggaagccttcgagcaggccgccgccgaattcatcgagaagtgcgagctgaaggccgagaccatcgccacccgcaaggccagccagaacacgctggaagcctacggcccggtgctgcctgagctgctgggcggctcggccgacctgaccggctcgaacctgaccaactggagcggcagcaaggccgtgcgcgtggatgcctggggcaaccacgtcaactacggcgtgcgcgagttcggcatgagcgccatcatgaacggcatcgcgctgcacggcggctacatcccgtacggcggcacgttcctgaccttctccgactacagccgcaacgcgctgcgcatggcggcgctgatgaagctccgctcgctgttcgtcttcacgcacgattccatcggcctgggcgaagacggcccgacgcaccagtcgatcgagcacgtcgccagcctgcgcctgatcccgaacatggacgtctggcgcacggccgacaccactgaaaccgccgtcgcctgggccgccgccatcgcgcgccagaacggcccgagctgcctgatcttcagccgccagaacctgccgttccaggcgcgcaacccggccacccgcgaagccattgcccgaggcggttatgtgctgcgcgatgcgaccgaaggcaagcgcccggacgtggtcatcatcgccaccggctcggaagtgggcctggccgtcggcgccgccgagcacctcgccgccgagggcatccaggcgcgcgtggtgtcggtgccgtcgaccaccgtgttcgacaagcaggacgccgcctacaaggccagcgtgctgccggccggcgtgccgcgcatcgccgtcgaggcgggcgtgaccgatttctggtggaagtaccaggtgcaggccgtcgtcggcatcgacacgttcggcgagtcggccccggcgggcgtgctgttcaagcacttcggcttcaccgtcgagaacgtggtgaacacagccaagagcgtcatcgctccggctgtctga

SEQ ID NO: 9675 - protein, 675 aa, Ralstonia solanacearum GMI1000
MSAPALHSITSLPTQQMANAIRVLAMDAVQQANSGHPGMPMGMADIAVALWSRHLRHNPANPHWPDRDRFVLSNGHGSMLLYALLHLTGYDLPMSELKNFRQLHSKTAGHPEYGITPGVETTTGPLGQGLTNAVGMALAERLLGQEFNRPGFDIVNHHTYVFLGDGCLMEGISHEACSLAGTLGLNKLIALWDDNGISIDGDVVHWFNDDTPKRFEAYGWNVIRAVDGHNVAAVEAAIAQAKTSDKPTLICCRTVIGKGAPTKAGGHDVHGAPLGGAEIAAAREALAWPHAPFDVPQAVYDAWDARGQGQALEKAWNALFDAYAERYPAEAGQFQRRMRGQLPEAFEQAAAEFIEKCELKAETIATRKASQNTLEAYGPVLPELLGGSADLTGSNLTNWSGSKAVRVDAWGNHVNYGVREFGMSAIMNGIALHGGYIPYGGTFLTFSDYSRNALRMAALMKLRSLFVFTHDSIGLGEDGPTHQSIEHVASLRLIPNMDVWRTADTTETAVAWAAAIARQNGPSCLIFSRQNLPFQARNPATREAIARGGYVLRDATEGKRPDVVIIATGSEVGLAVGAAEHLAAEGIQARVVSVPSTTVFDKQDAAYKASVLPAGVPRIAVEAGVTDFWWKYQVQAVVGIDTFGESAPAGVLFKHFGFTVENVVNTAKSVIAPAV

SEQ ID NO: 9676 - DNA, 2124 bp, Brucella melitensis 16M
  CDS (1)..(2124): transl_table=11
atgctatgtgtccccctgccttctggagcatcatcccgaaaagcggctgacggttttcgctggagattgtgttcaggtaaaaggcatcgccgcaaccccgttaaaccctcccaaggaaagacggctgagaccatgaccaataccgacaaacaaaaccagatggctaatgcaatccgcttcctctccatggatgcggtggagaaggccaattcgggccaccccggcctgccgatgggcgcagccgatatagcgacgacgctttatacccgtttcctctcgcacgacccgaaaaacccgcactggccggaccgcgaccgtttcgtgctttccgccggccacggctcgatgctgctctattcgctgctctatctttcgggctacgaagacatcaccatcgatgaaatcaagaaattccgccagcttggcagccgcaccgcgggccaccctgaatatggccatgccgctggcatcgaaacgacgaccggcccgctcggacagggtattgccaatgccgtcggcatggcgatttccgaacgcatcctgaatgcccagttcggtgacagcctcgtcaatcattatacctatgcgctcgtcggcgacggctgcctcatggaaggcatcagccaggaagccatcgcgcttgcgggacacctgaagctcaacaagctgatcgtgctctgggatgacaacaacatctcgatcgacggcccgatcacgctttccgacaataccgatcagccagcccgtttcgccgcttccggctggaacaccatggctgtcgacggtcacgaccaggatgcgattgccaaggccatcgaactggcccgggtctccgaccgcccgacgctgatcgcctgcaagacgaccatcggtttcggtgctccgaacaaggctggcaccaacaaggtgcacggctcaccgcttggcgcggaagaaatcgccgccacgcgcaaggcgctgggctggtcttccgaacctttcgtcgttccggctgaagttctggacgcctggcgcgtcgcgggcctcaacgccgccaagaagcgcctggaatgggaaaagcgcctttctgccgtagaagcggaaacccgcgccgaattcgagcgccgcatgcgtggcgagctgccttccggtttcgatgctgcaatcgtcgaatacaagaagaagctttccgccgacaagccgaaggttgccacccgcaagtcgtccgaaatggcgctggaagtcatcaacggtgtcgtgccggaaaccgtaggcggctctgccgaccttaccggctccaacaacaccaagaccagccagaccaaggctgtcacgccggaaaactatgatggccgttatatccattacggcatccgcgagcttggcatggctgcagcgatgaacggcatcacgctgcatggcggcctgatcccctattccggcaccttcctgtgcttctccgattatgcgcgtccggccatgcgtctttcctcgctgatgggcattcgcgtcgtctatgtgatgacgcatgattccatcggtcttggcgaagacggcccgacccatcagccggtcgaacatctcgccgcactgcgcgccattccgaaccacaatgtcttccgtccggcagacgctgtggaaacggcggaatgctggcagcttgcgctgcattcaaggaagacgccatccacgctggctttgacccgccagaacctgccgacggtccgcaccgagcatcgcgaagaaaacctttgcgctttcggcgcctacgaacttgccgccgccagcagcgacgccaaggtgacgatcttcgcaacgggctcggaagtggaaattgcgctgaaggcccgcgatcttctggaaggtaagggcattgccacccgcgtcgtttcggtgccgtgctttgagcttttcgagcagcagagcgacacctacaaggaagcgaccattggcgatgcgccagtcaagcttgccattgaagcggccatctcgctcggctgggaacgcttcatcggcgaaaacggcatcttcatcggcatgaagggcttcggcgcttcgggtgagatcaatgatctctacaagcatttcggcattacggcggaacatgccgtcgaagctgcggaaaagaagctcaacgctgcatga

SEQ ID NO: 9677 - protein, 707 aa, Brucella melitensis 16M
MLCVPLPSGASSRKAADGFRWRLCSGKRHRRNPVKPSQGKTAETMTNTDKQNQMANAIRFLSMDAVEKANSGHPGLPMGAADIATTLYTRFLSHDPKNPHWPDRDRFVLSAGHGSMLLYSLLYLSGYEDITIDEIKKFRQLGSRTAGHPEYGHAAGIETTTGPLGQGIANAVGMAISERILNAQFGDSLVNHYTYALVGDGCLMEGISQEAIALAGHLKLNKLIVLWDDNNISIDGPITLSDNTDQPARFAASGWNTMAVDGHDQDAIAKAIELARVSDRPTLIACKTTIGFGAPNKAGTNKVHGSPLGAEEIAATRKALGWSSEPFVVPAEVLDAWRVAGLNAAKKRLEWEKRLSAVEAETRAEFERRMRGELPSGFDAAIVEYKKKLSADKPKVATRKSSEMALEVINGVVPETVGGSADLTGSNNTKTSQTKAVTPENYDGRYIHYGIRELGMAAAMNGITLHGGLIPYSGTFLCFSDYARPAMRLSSLMGIRVVYVMTHDSIGLGEDGPTHQPVEHLAALRAIPNHNVFRPADAVETAECWQLALHSRKTPSTLALTRQNLPTVRTEHREENLCAFGAYELAAASSDAKVTIFATGSEVEIALKARDLLEGKGIATRVVSVPCFELFEQQSDTYKEATIGDAPVKLAIEAAISLGWERFIGENGIFIGMKGFGASGEINDLYKHFGITAEHAVEAAEKKLNAA

SEQ ID NO: 9678 - DNA, 2226 bp, Arabidopsis thaliana
  CDS (1)..(2226)
atggcttctacttcttctctagcgctctcacaagctctccttacacgagccatctctcacaatggctctgaaaactgcgtctctataccagctttctctgctctcaaatccacttctccacgcaccagtggcaccatctcttcccgtcgacgaaacgcctccacgatcagtcactctctccgccctctggttcgtgcagccgccgtagaggcaatcgtgacaagttctgattcgtccctggttgataagtcggtgaacacgatcaggtttctggcaatagatgcggttgagaaggcgaaatcaggtcatccaggtcttcctatgggctgtgctccgatgtctcacattttgtacgatgaagtcatgaagtataaccccaagaatccttactggtttaaccgtgatcgtttcgttctctctgctggacatggatgcatgttgcaatacgctctgcttcaccttgctggctacgacagcgttagggaggaagatttgaagagcttccgtcaatggggaagtaagactccaggacatcctgagaattttgagactcctggtgttgaagccactactggtcctcttggacaaggtattgcaaatgctgttggtttagctcttgcggagaagcatttggctgctagatttaacaaacctgacaatgagattgttgaccactacacgtattcgattcttggagatggttgtcagatggaagggatttcaaatgaagtttgctctctagctggtcactggggacttggaaagctaatcgctttctacgatgacaatcacatttccattgatggagacacagatattgcttttaccgagagcgtggacaaacgctttgaagctcttggatggcatgttatctgggtaaagaatggaaacaatggttatgatgagatccgtgctgccattagggaagctaaggctgtaacagacaagcccactttgattaaggtcactactacaattggttatggttctcccaacaaggcaaactcatacagtgtccatggagctgcgcttggtgagaaggaagttgaggctacccgaaacaatcttgggtggccatatgagccgttccatgtacctgaggatgtcaaaagccattggagccgtcacacgcccgaaggggctgctcttgaagctgattggaatgccaaatttgcagcttatgagaagaaatatccggaggaagctgcagagttgaaatctattatctcaggtgaattgcccgttggttgggagaaggcacttcctacatatacaccagactctccgggtgatgccaccagaaacctgtctcagcaatgtcttaacgcacttgcgaaagctgtgcctggttttcttggtgggagtgctgaccttgcatcttccaacatgacaatgcttaaagcattcggcaacttccaaaaagccacacctgaagaaagaaaccttagatttggtgtcagggaacatggtatgggagctatctgcaacggcattgcccttcacagccccggttttatcccttactgcgcaactttctttgtgtttactgactatatgagagctgcaatgagaatctcggctttgtctgaagctggtgttatatacgttatgacccatgactccattggtcttggagaagatggaccaacccaccaacccatcgaacacttatccagtttccgtgccatgcccaatattatgatgttccgtccagctgatgggaacgaaacagccggtgcatacaaaatcgctgtcacaaaacgtaagacaccttctgtcttagccttatctagacaaaagctgcctcaacttccaggaacatctattgagagcgtcgagaaaggtggatacaccatttctgacaactcaaccggtaacaaacccgatgtgatcttgatcggaactggatcagagctagagattgctgctcaagctgcagagaagttaagggaacaaggcaaaagtgtgagagttgtttcctttgtatgttgggagcttttcgacgagcaatcagatgcatacaaggaaagtgttttgccatctgatgtatcagctagagttagtatcgaagctggatcgacttttggatggggaaagatcgtcggaggaaaagggaaatcgattggaattgatacgtttggagcaagtgcaccagcaggaaagctttataaagagtttggtatcaccattgaagctatggttgaagcagccaagtcacttatttaa

SEQ ID NO: 9679 - protein, 741 aa, Arabidopsis thaliana
MASTSSLALSQALLTRAISHNGSENCVSIPAFSALKSTSPRTSGTISSRRRNASTISHSLRPLVRAAAVEAIVTSSDSSLVDKSVNTIRFLAIDAVEKAKSGHPGLPMGCAPMSHILYDEVMKYNPKNPYWFNRDRFVLSAGHGCMLQYALLHLAGYDSVREEDLKSFRQWGSKTPGHPENFETPGVEATTGPLGQGIANAVGLALAEKHLAARFNKPDNEIVDHYTYSILGDGCQMEGISNEVCSLAGHWGLGKLIAFYDDNHISIDGDTDIAFTESVDKRFEALGWHVIWVKNGNNGYDEIRAAIREAKAVTDKPTLIKVTTTIGYGSPNKANSYSVHGAALGEKEVEATRNNLGWPYEPFHVPEDVKSHWSRHTPEGAALEADWNAKFAAYEKKYPEEAAELKSIISGELPVGWEKALPTYTPDSPGDATRNLSQQCLNALAKAVPGFLGGSADLASSNMTMLKAFGNFQKATPEERNLRFGVREHGMGAICNGIALHSPGFIPYCATFFVFTDYMRAAMRISALSEAGVIYVMTHDSIGLGEDGPTHQPIEHLSSFRAMPNIMMFRPADGNETAGAYKIAVTKRKTPSVLALSRQKLPQLPGTSIESVEKGGYTISDNSTGNKPDVILIGTGSELEIAAQAAEKLREQGKSVRVVSFVCWELFDEQSDAYKESVLPSDVSARVSIEAGSTFGWGKIVGGKGKSIGIDTFGASAPAGKLYKEFGITIEAMVEAAKSLI

SEQ ID NO: 9680 - DNA, 2226 bp, Arabidopsis thaliana
  CDS (1)..(2226)
atggcttctacttcttccctcgctctctctcaagctctcctagctcgtgcaatctctcaccatggttctgaccaacgtggatctttaccagctttctctggactcaaatccaccggttcacgcgcctcagcttcgtctcgtcgacgtatcgctcaatccatgaccaaaaaccgatctctccgtcctcttgttcgcgctgcagctgttgagactgttgagccaaccactgattcgtcgattgtggacaaatcggtcaactcgattaggtttttggctatcgatgcggtggagaaggccaaatcaggtcatcctggtcttcctatgggttgtgctccgatggctcacattttgtatgatgaggtcatgaggtataaccccaagaacccttattggttcaaccgtgaccgattcgttctatctgctggacatggatgtatgttgctctacgcgttgcttcatcttgccggctacgacagcgtccaggaggaagatttgaagcagttccgtcaatggggaagcaagacaccaggacatcctgagaatttcgagactcctggaattgaagtcactactggtcctcttggacaaggaatcgctaatgctgttggtttagctcttgctgagaagcatttggctgctagattcaacaaacctgatgctgaagtagtcgaccactacacatatgcgatccttggagatggttgtcagatggagggtatttctaatgaagcttgctctctagctggccattggggacttggaaagctcattgctttctacgatgacaatcacatttctatagatggagacacagaaattgccttcactgagaacgtggaccagcgatttgaagcccttggatggcatgttatctgggtgaagaatggaaacactgggtatgacgagatccgtgctgccattaaggaagctaaaactgttactgacaagcctactttgatcaaggtcactactaccattggttatgggtctcccaacaaggcgaactcatacagtgtccatggagctgcacttggcgagaaggaagttgaggctaccagaaataaccttggatggccgtatgagccgttccaggtacctgacgatgtaaaaagccactggagtcgtcatacacctgaaggagctactcttgaatctgactggagtgcaaagtttgcagcatatgaaaagaagtacccagaggaagcttctgagttgaaatctattatcactggtgaattacctgctggctgggagaaggctctacctacatacacaccagagtctccaggtgatgccaccagaaacctgtcacagcaatgtcttaacgcccttgctaaagttgttcccggtttccttggtggaagtgctgaccttgcatcatccaacatgacattgctgaaagcctttggcgacttccaaaaggccacacctgaagaaagaaatcttaggtttggtgttagggagcacggaatgggagccatctgcaatggcattgcccttcacagccccggtcttatcccttactgtgcgacgttctttgtcttcaccgactacatgagaggtgccatgagaatctcagctttgtctgaagctggtgttatctatgttatgacccatgattccattggtcttggagaagatggaccaacccatcagcccattgagcacattgcaagtttccgtgctatgcccaacactcttatgttccgtcctgctgatggaaatgaaacagccggtgcatacaagatcgctgtcaccaagcgcaagacaccatctatcttagctctgtctaggcaaaagctgcctcatcttccaggtacatccatcgaaggagtggaaaagggtggatatacaatttctgacgactcttcaggcaacaaacccgatgtgatcttgattggaactggttctgagctagagattgctgcacaggctgcggaggtgctcaggaaagacggcaaaaccgttagagttgtttctttcgtgtgctgggaactatttgacgagcaatcagatgaatacaaggagagtgtgttgccatcggatgtatcagctagagttagcattgaagcagcttcgactttcggatggggaaagattgttggaggcaaaggaaagtccattggtattaattcattcggagccagcgcaccagcacccttactctacaaggagtttggtatcaccgttgaagctgttgttgatgcggccaagtcattcttctaa

SEQ ID NO: 9681 - protein, 741 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 9682 - DNA, 1887 bp, Encephalitozoon cuniculi GB-M1
  CDS (1)..(1887)
atggacaacgtaaataatattagaacactgtgtgcagatatggtccaaagggctaacagcgggcatccgggagcaccccttggactagcaccgtttgtttatattctgtatacagagtttatcaactttgatcctgacgatgagaagtggataggacgagacatatttctgctgtcgaatggccatgcttgtgctctccagtatgtcgtgagctatctcataggacacctgaatatggaggacctgatgaatttccggcagattggcggaagaactcctggacacccagagaggaagtatccaggtgttgagtcgagtaccgggccgttaggccaggggctagcaaacgccgttggctttgcaatatcactgaaaaagcttggggatctggggctcttcaaccgtgtatattgcgtgtttggggacggatgctaccaagaaggaatgggacaggagtcattttcattggctgcaaaccttaagctagataacatagtcttcatatatgactttaacaaaacaacaatagacgggccgacatctctttctatgaatgaggatgttgcccagagattcctgagccttggattcgaggttgatattgttgatggagatgatctggatggaataagaaaggcattaagcaaaaaggtttcaaaaccaatggtcattattctggaaacaattattgggcgtggaagcactgtggagggaagctgcaaggctcacggggcacctcttggagaggatggagtaagaaggcttaaggagaagtttgggattcctgctgtggatttctatgtttctccgtcgctaatggagaagttcaagattcttaacgaaaaaaagcggagaataagaactgaatgggatgtgaaggggatcaaggccatcacagtcagggaatggacggatattcagaggaagatggactcgatctacaaatccacatacaaggcacaagatgccccaaaagccaccaggaaacacttttctgaagccttgaaggatcttaaggaagtaagctatctcattggaggagctgcagatttgcagtcttcagtgttgacaaagatagggggggatgactttaatgcagaaaatcacaacggaggatatatcaactttggaatcagagagcattgcatgtgcggtgtcatgaatggtattgcatcccacggatactttctcccatactcaggaaccttcctaaacttcatttcatatgggtttccgtctgtcaggcttggatgtatggacaacctgaatcttttctacgtactaacccatgattccataggtcttggagaagatggtccaacacaccagccaattgaggttttatccactctaagagcaacaccaaaccttattacaatgaggccatgcgatggaacagaagtcagaacttcgctgtataccgcgttaaccagggaaggtccaaaggcggtgattttgtccaggcaaagtgttcccgaaattcctcacaccgatatggaaaaggccaggagaggcgcatattaccttgttgaggtagaaaacccggatctgatattactttcaacggggtccgaggtccagatatgctacgaagtggccgaagccttatctgacctcaaaatttcgattgtatcgttcttctcttgggagttgtttgaagaacaaggggaggaatataagaagcatattctcaaagacgttccaaaggtcagcattgaggccttgagtacatttggttggacaaaatactccgacatgcagataggaatgaccacctttggggcaagtggagcatgtaaggatgtttacaaccactttggattgaattgtaaggaaatctcaaaaaagatagttagttttctcaataaactttccaaatgtttatag

SEQ ID NO: 9683 - protein, 628 aa, Encephalitozoon cuniculi GB-M1
MDNVNNIRTLCADMVQRANSGHPGAPLGLAPFVYILYTEFINFDPDDEKWIGRDIFLLSNGHACALQYVVSYLIGHLNMEDLMNFRQIGGRTPGHPERKYPGVESSTGPLGQGLANAVGFAISLKKLGDLGLFNRVYCVFGDGCYQEGMGQESFSLAANLKLDNIVFIYDFNKTTIDGPTSLSMNEDVAQRFLSLGFEVDIVDGDDLDGIRKALSKKVSKPMVIILETIIGRGSTVEGSCKAHGAPLGEDGVRRLKEKFGIPAVDFYVSPSLMEKFKILNEKKRRIRTEWDVKGIKAITVREWTDIQRKMDSIYKSTYKAQDAPKATRKHFSEALKDLKEVSYLIGGAADLQSSVLTKIGGDDFNAENHNGGYINFGIREHCMCGVMNGIASHGYFLPYSGTFLNFISYGFPSVRLGCMDNLNLFYVLTHDSIGLGEDGPTHQPIEVLSTLRATPNLITMRPCDGTEVRTSLYTALTREGPKAVILSRQSVPEIPHTDMEKARRGAYYLVEVENPDLILLSTGSEVQICYEVAEALSDLKISIVSFFSWELFEEQGEEYKKHILKDVPKVSIEALSTFGWTKYSDMQIGMTTFGASGACKDVYNHFGLNCKEISKKIVSFLNKLSKCL

SEQ ID NO: 9684 - DNA, 2103 bp, Corynebacterium glutamicum ATCC 13032
  CDS (1)..(2103): transl_table=11
ttgaccaccttgacgctgtcacctgaacttcaggcgctcactgtacgcaattacccctctgattggtccgatgtggacaccaaggctgtagacactgttcgtgtcctcgctgcagacgctgtagaaaactgtggctccggccacccaggcaccgcaatgagcctggctccccttgcatacaccttgtaccagcgggttatgaacgtagatccacaggacaccaactgggcaggccgtgaccgcttcgttctttcttgtggccactcctctttgacccagtacatccagctttacttgggtggattcggccttgagatggatgacctgaaggctctgcgcacctgggattccttgaccccaggacaccctgagtaccgccacaccaagggcgttgagatcaccactggccctcttggccagggtcttgcatctgcagttggtatggccatggctgctcgtcgtgagcgtggcctattcgacccaaccgctgctgagggcgaatccccattcgaccaccacatctacgtcattgcttctgatggtgacctgcaggaaggtgtcacctctgaggcatcctccatcgctggcacccagcagctgggcaacctcatcgtgttctgggatgacaaccgcatctccatcgaagacaacactgagatcgctttcaacgaggacgttgttgctcgttacaaggcttacggctggcagaccattgaggttgaggctggcgaggacgttgcagcaatcgaagctgcagtggctgaggctaagaaggacaccaagcgacctaccttcatccgcgttcgcaccatcatcggcttcccagctccaactatgatgaacaccggtgctgtgcacggtgctgctcttggcgcagctgaggttgcagcaaccaagactgagcttggattcgatcctgaggctcacttcgcgatcgacgatgaggttatcgctcacacccgctccctcgcagagcgcgctgcacagaagaaggctgcatggcaggtcaagttcgatgagtgggcagctgccaaccctgagaacaaggctctgttcgatcgcctgaactcccgtgagcttccagcgggctacgctgacgagctcccaacatgggatgcagatgagaagggcgtcgcaactcgtaaggcttccgaggctgcacttcaggcactgggcaagacccttcctgagctgtggggcggttccgctgacctcgcaggttccaacaacaccgtgatcaagggctccccttccttcggccctgagtccatctccaccgagacctggtctgctgagccttacggccgtaacctgcacttcggtatccgtgagcacgctatgggatccatcctcaacggcatttccctccacggtggcacccgcccatacggcggaaccttcctcatcttctccgactacatgcgtcctgcagttcgtcttgcagctctcatggagaccgacgcttactacgtctggacccacgactccatcggtctgggcgaagatggcccaacccaccagcctgttgaaaccttggctgcactgcgcgccatcccaggtctgtccgtcctgcgtcctgcagatgcgaacgagaccgcccaggcttgggctgcagcacttgagtacaaggaaggccctaagggtcttgcactgacccgccagaacgttcctgttctggaaggcaccaaggagaaggctgctgaaggcgttcgccgcggtggctacgtcctggttgagggttccaaggaaaccccagatgtgatcctcatgggctccggctccgaggttcagcttgcagttaacgctgcgaaggctctggaagctgagggcgttgcagctcgcgttgtttccgttccttgcatggattggttccaggagcaggacgcagagtacatcgagtccgttctgcctgcagctgtgaccgctcgtgtgtctgttgaagctggcatcgcaatgccttggtaccgcttcttgggcacccagggccgtgctgtctcccttgagcacttcggtgcttctgcggattaccagaccctgtttgagaagttcggcatcaccaccgatgcagtcgtggcagcggccaaggactccattaacggttaa

SEQ ID NO: 9685 - protein, 700 aa, Corynebacterium glutamicum ATCC 13032
MTTLTLSPELQALTVRNYPSDWSDVDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSING

SEQ ID NO: 9686 - DNA, 2190 bp, Streptococcus pyogenes MGAS8232
  CDS (205)..(2190): transl_table=11
gtggctactgtgtcaacaggctctcttatattcatcgtcaaaaagaattcaccaatgatgtccaaactagtttttttctggcaaaatagggaaaaagaatttagggactttggaggattttctgaaaaaagcgtctatttttgtgatacaatagacaatagaaaacgtttaattttagttgtaataaacagagaggttttacttatgacatttgatgcaattgaccaattggcagtaaacactgtccgcaccctatcaatggatgccattcaagcggcaaattctggacacccaggacttccaatgggggcagcacctatggcctatgttctttggaatcacttcatgaacatcaatcccaaaacaagccgtaattggtcaaacagagaccgttttatcctatcagcaggtcatggaagtgccatgctttatagcttgttgcatttagcaggttatgatttatctgtagaagatttaaagaacttccgtcaatggggatctaaaacaccaggtcacccagaagtgaaccacacagacggtgtcgaagcaaccacaggacctcttggtcaagggatcgcaaatgccgttggtatggccatggcagaagctcacctagcagctaaatttaacaaaccaggctttgacatcgttgatcactacacatttgctttgaatggtgacggtgaccttatggaaggggtcagccaagaagcagcaagtatggcaggacatttaaaacttgggaaattggtcttgctatatgattcaaacgacatctctcttgatggtccaacctctatggctttcacagaagatgtgaaaggacgtttcgaagcttatggttggcaacatatccttgtgaaagatggaaatgatttagaagaaattgcagctgctattgaagcagctaaagctgaaactgagaaaccaaccatcatcgaagtcaaaaccattattggttttggtgccgaaaaacaaggaacttcagctgttcacggcgctcctcttggagcagaaggcattgcttttgccaaaaaagcttaccaatggactcatcaagattttgaagtacctgctgaagtgactgaacgttttgctcaaggacttcaagcacgtggtgaaaaagcagaacaagcctggaatgacttgtttgcagcttatcaagcagaatatcctgaattggcagcagaataccaaaaagcctttgctaacgaagctgctcaagttgaacttgaagcgcacgaacttggcagctcaatggcgagtcgtgtttctagccaacaagccatccaacaaatctcagaacaagtagcctctttctggggtggatcagcagatctttcagcatctaacaacacaatggttaaggctgaaacagatttccaaccaggtcactacgaaggccgtaacatctggtttggcgttcgtgaatttgccatggctgcagccatgaacggtattgcccttcacggcgggacacgcgtttacggcggaaccttctttgtcttctcaaactatcttcttccagctgttcgtatggcagcgctccaaaacttgccaacagtttatgtcatgacacatgattctatcgctgttggtgaagatgggccaacgcacgaaccaattgaacaattggcaagtgttcgttcaatgcctaacttgaacgttattcgtccagcagacggtaacgaaacaaatgctgcttggaaacgtgccattgctgaaacagatcgcccaaccatgcttgtattgacgcgtcaaaaccttccagtgcttgagggaacaaaagaattggcagaagatggtcttaacaaaggagcttacattttatcagaagccaaaggcgaccttgatggtatcatcattgcaacaggttcagaagtgaaactggcaatggatactcaagaagctcttgaagcagaaggcattcatgtgcgtgtggtatctatgccatcacaaaatatctttgacgaacagtcagcagagtataaagaaagcatcctaccagcagctgtgactaaacgtctcgctatcgaagcaggttcaagctttggctgggcaaaatatgtcggcctagcaggaaaaacattgaccattgacacttggggtgcttcagctccaggaaatcgtatcttcgaagaatatggtttcactgtggcaaatgcaactgagttatacaaatcactctag

SEQ ID NO: 9687 - protein, 661 aa, Streptococcus pyogenes MGAS8232
MTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYQAEYPELAAEYQKAFANEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLNKGAYILSEAKGDLDGIIIATGSEVKLAMDTQEALEAEGIHVRVVSMPSQNIFDEQSAEYKESILPAAVTKRLAIEAGSSFGWAKYVGLAGKTLTIDTWGASAPGNRIFEEYGFTVANATELYKSL

SEQ ID NO: 9688 - DNA, 2004 bp, Thermoanaerobacter tengcongensis MB4
  CDS (1)..(2004): transl_table=11
atggcaaaaagaatagagcagttggccataaacgctataagagtgctgtctattgatgccattgaaaaggcgaaatcaggccatcccgggatgccaatgggagcagctcctatggcgtatgtactttggacagagtttatgaatcacaatcctctcaattctaagtggttcaaccgcgacaggtttgtcctgtcagcaggacatgcttcaatgcttttgtacgcgcttttgcacctttcaggctacaaagtttccatggaagacataaagaatttccgccagtgggggtcaaaaactcctgggcatccggagtacggccttactgatggagtagaggcgacgactggacctttagggcagggccttgggatggcagtaggaatggcaatggctgaacgcttccttgccaataagtataaccgcggttcttacaacataatagaccactatacatatgtaattgcaagcgatggagacctaatggaagggatatctcacgaagcaggttcattggcaggacatttaaagcttggcaaactgattgtgctttacgattctaacgatgtaaccttggatggagacaggcacttatcctttacagaaagcgttgcagataggttcaaagcctatggatggcaggttttaagagtcgatgatggcaatgaccttgacgctataagaaatgctataagtgaagctaagaaaaacacagaacagcctaccttaattgaagtaaagaccgtcttgggttacggggctcccaataaagcaggcaaatctgatgcacacggggctccactaggtgaagaggaggctcgtttggcaaaagaatattataaatgggagtatgaacctttctttattccagaagaaatatacgagcattacagggctaaagttcttgagagaggcaaaaaggcagaagaagagtggaataagctatttgaggcttataaaaaagaatatcctgagttagcaaaagaattagaagatgccataaatggaaaccttccagaaggctgggacaaagacatgccttcttatgataaaggggcctatgcgacgagagatgtatctggagagatgataaatgctttagcgaaaaatatcccctacttcataggtggcagtgctgaccttgcaagttctaacaagacagctataaaaggagaacagccctttgggcctaccagcaattacactggaagaaacatatggtttggtgtaagggaatttggaatggctacagctttgaatgggatggcacttcacggaggacttaaagtctatggcggaacattccttgtatttagtgattatctccgccccgctttaaggctttcagctttaatgggagtacctgtaacttatgtatttacacatgactcaatcgctgtaggagaagatggacctacacatcagccagtagagcatcttgcggcatttcgcgcaatgccaaatgtgtcagttataaggccagcagacgggaatgagacaagagctgcatggaaattagcagtgcagtctaagaataagcctactgttttgattttgacaaggcagaagctccccattcttcctacaacaaaagaaaaagttgaagaaggcgtggcaaaaggtgcttatatagtatccgacggcgaaaaggaaataccggatattctccttttggcatctggatcagaagtatctttagcagttgaagcgcaaaagaagttaaaagaagaagggatagacgcaagagttatcagtatgccctcatgggatagatttgaggaacaggacaagtcctacaaggactacatactgcctccaaatgttaaaaagagactggctattgaagcggcagcacctcttggatgggagcgctatgtaggagatgagggtaaagtattgggggtaaatacatttggcgcttctgccccgggagaaaaactgatggaggaatacgggtttacagtggacagaatagtaaaagaggcaaaagagctgctcaggaagtaa

SEQ ID NO: 9689 - protein, 667 aa, Thermoanaerobacter tengcongensis MB4
MAKRIEQLAINAIRVLSIDAIEKAKSGHPGMPMGAAPMAYVLWTEFMNHNPLNSKWFNRDRFVLSAGHASMLLYALLHLSGYKVSMEDIKNFRQWGSKTPGHPEYGLTDGVEATTGPLGQGLGMAVGMAMAERFLANKYNRGSYNIIDHYTYVIASDGDLMEGISHEAGSLAGHLKLGKLIVLYDSNDVTLDGDRHLSFTESVADRFKAYGWQVLRVDDGNDLDAIRNAISEAKKNTEQPTLIEVKTVLGYGAPNKAGKSDAHGAPLGEEEARLAKEYYKWEYEPFFIPEEIYEHYRAKVLERGKKAEEEWNKLFEAYKKEYPELAKELEDAINGNLPEGWDKDMPSYDKGAYATRDVSGEMINALAKNIPYFIGGSADLASSNKTAIKGEQPFGPTSNYTGRNIWFGVREFGMATALNGMALHGGLKVYGGTFLVFSDYLRPALRLSALMGVPVTYVFTHDSIAVGEDGPTHQPVEHLAAFRAMPNVSVIRPADGNETRAAWKLAVQSKNKPTVLILTRQKLPILPTTKEKVEEGVAKGAYIVSDGEKEIPDILLLASGSEVSLAVEAQKKLKEEGIDARVISMPSWDRFEEQDKSYKDYILPPNVKKRLAIEAAAPLGWERYVGDEGKVLGVNTFGASAPGEKLMEEYGFTVDRIVKEAKELLRK

SEQ ID NO: 9690 - DNA, 2088 bp, Streptomyces coelicolor A3(2)
  CDS (1)..(2088): transl_table=11
gtgagcaccaagccgaccaccacagacctcgagtggaccgaactggaccagcgggccgtggacaccgcccgcgtcctggccgccgatgccgtacagaaggttggcaacggccatccgggtacggcgatgagcctggcgcccgccgcctacaccctcttccagaaggtgatgcggcacgaccccgccgacgcgaactgggtcgggcgcgaccgtttcgtgctgtccgcgggccactcgtccctgaccctctacacccagctgtacctggccggtttcggcctggagctggcggacctggagtccttccgcacctggggctccaagacccccggccacccggagtacggccacaccacgggcgtggagaccacgaccggcccgctgggccagggtgtcgccaacgcggtgggcatggcgatggccgcccgctacgagcgcggcctgttcgacccggaggccgccgagggcgagtccccgttcgaccacttcgtctactgcatcgccggtgacggctgcctccaggagggcatctcctccgaggcgtcctcgacggccggtcaccagaagctcggcaacctggtgctcttgtgggacgacaaccacatctccatcgagggcgacacggagaccgccgtctccgaggacacctgcaagcggtacgaggcgtacggctggcacgtccagcgtgtcgcgccgaagccggacggcgacctggacccgaacgcgatctacgacgcgatcgaggcggccaagaaggtcaccgaccgcccctccttcatcgcgatgcgctcgatcatcgcctggcccgccccgaacgcgcagaacaccgaggccgcgcacggctcggcgctcggcgacgacgaggtcgcggcgaccaagcgggtcctgggcttcgacccggagaagtccttcgaggtctccgacgaggtcatcgagcacacccgcaaggccctggagaaggggcaggcggcccgcgcggtgtgggagaagtccttccagcagtggcgggacaacaacccggagcgcgccgccgagtacgaccgcgtggccaagggtgagctgccggcgggctgggaggagaagatcccggtcttcgaggcgggcaagggcctggcgacccgcgccgcgtccggcaaggtgctccaggcgctcggcgcggtgatcccggagctgtggggcggatcggccgacctcgcgggctcgaacaacacgacgatcgacaagacgtcgtccttcctcccggcgggcaacccgctgccggaggccgacccgtacggccgcaccatccacttcggcatccgcgagcacgcgatggcggcggagatgaacggcatcgcgctgcacgggaacacccgcatctacggcggaacgttcctggtcttctccgactacatgcgcaacgccgtgcgcctgtcggccctgatgcacctgccggtgacgtacgtgtggacgcacgactccatcggtctgggcgaggacggcccgacccaccagccggtcgagcacctggcctcgctgcgcgccatcccgggtctgaacgtggtccgcccggccgacgccaacgagacggcgatcgcctggcgggagatcctgcgccgctggacgaaggagttcggcaagggccagccgcacggtctggcgctgacccgccagggtgtgccgacgtacgagccgaacgaggacgcggccaagggcggctacgtgctgttcgaggcggagggcggcgacgccgaggtcgtgctcatcgccaccggttccgaggtgcacgtggccgtcggggcgcgtgagcggctccaggccgacggcgtgccgacccgtgtggtgtccatgccgtccgtggagtggttcgagcagcaggaccaggggtaccgggacagcgtcctgcccccgtccgtgaaggcccgggtcgcggtcgaggccgggatcggtctgacctggcacaagtacgtgggagacgccggccgcatcgtctcgctggagcacttcggtgcttcggcggacgccaaggtgctcttcaaggagttcggcttcaccgccgagaacgtggcctccgccgcgcgggaatccctggccgcggcccagcgctga

SEQ ID NO: 9691 - protein, 695 aa, Streptomyces coelicolor A3(2)
MSTKPTTTDLEWTELDQRAVDTARVLAADAVQKVGNGHPGTAMSLAPAAYTLFQKVMRHDPADANWVGRDRFVLSAGHSSLTLYTQLYLAGFGLELADLESFRTWGSKTPGHPEYGHTTGVETTTGPLGQGVANAVGMAMAARYERGLFDPEAAEGESPFDHFVYCIAGDGCLQEGISSEASSTAGHQKLGNLVLLWDDNHISIEGDTETAVSEDTCKRYEAYGWHVQRVAPKPDGDLDPNAIYDAIEAAKKVTDRPSFIAMRSIIAWPAPNAQNTEAAHGSALGDDEVAATKRVLGFDPEKSFEVSDEVIEHTRKALEKGQAARAVWEKSFQQWRDNNPERAAEYDRVAKGELPAGWEEKIPVFEAGKGLATRAASGKVLQALGAVIPELWGGSADLAGSNNTTIDKTSSFLPAGNPLPEADPYGRTIHFGIREHAMAAEMNGIALHGNTRIYGGTFLVFSDYMRNAVRLSALMHLPVTYVWTHDSIGLGEDGPTHQPVEHLASLRAIPGLNVVRPADANETAIAWREILRRWTKEFGKGQPHGLALTRQGVPTYEPNEDAAKGGYVLFEAEGGDAEVVLIATGSEVHVAVGARERLQADGVPTRVVSMPSVEWFEQQDQGYRDSVLPPSVKARVAVEAGIGLTWHKYVGDAGRIVSLEHFGASADAKVLFKEFGFTAENVASAARESLAAAQR

SEQ ID NO: 9692 - DNA, 1848 bp, Streptomyces coelicolor A3(2)
  CDS (1)..(1848): transl_table=11
atgaacaccggtgaactcgtcgacctcggacagcagctgcgcgtcgacagcgtacgggcggccgccgccgcgggctccgggcacccgacgtcgtcgatgtccgccgcggacctgatggccgtactgctggccaaccacctccgctacgacttcgaacgccccgcccaccccggcaacgaccgcttcgtgctctccaagggacacgcctcgcccctgctgtactccgccttcaaggcggccggtgccatcgacgacgaggagctgctcaccttccgcaagcagggcagccgcctggaggggcaccccacaccgcagcggctgccgtgggtcgagacggccaccgggtcgctcggccaggggctgcccgtgggcgtcggcatcgcgctgtccggcaagcggctcgaccacaccgactaccgcgtgtgggtgctgtgcggcgacagcgagctggccgaggggtcgatctgggaggccgccgagcacgccgggcacgagcacctcgacaacctcaccgtgatcgtcgacgtcaaccggctcggccagcgcggccccacccggcacggccacgacctcgacgcctacgcacgccggttcagggccttcgagtggcacacgatcgaggtcgacggccacgacgtcgacgccgtcgaccgcgcctacggcgaagcgctgtccaccaagggccagcccaccgcgatcatcgcccgcaccctcaagggcaagggcgtacgggcggtggaggaccgcgagggccagcacggcaagccgctgccggaggccgaggaggccgtcgccgaactcggcggcccccgtgacatcagggtgcgggtgcacgcgcccgaggacgcccggtcgctgcgctcgacgggcaccgggcagaccgagctgccccgctacggcctgggcgacgaggtcgccacccgcaacgccttcggggaggcgctcgccgcggtcggcacggcgcgcggcgacgtcgtcgccctcgacggcgaggtcggcgactccacccgggccgagttcttcgccaaggaacaccccgagcgctacttcgagtgctacatcgccgagcagcagatggtcgccgcggcggtggggatggcggcccgcggctgggtgccgttcgccaccaccttcgccgccttcctgacccgcgcgtacgacttcgtgcgcatggcctcgatcagcggtgccggcatcaacctcgtcggctcccacgcgggtgtcgccatcggccaggacgggcccagccagatgggcctggaggatctcgccatgatgcgggccatccacggctcgaccgtgctgtacccgtgcgacgccaaccaggccgcgcgcctcgtcgccgagatggccggcctggagggcatccggtatctgcgcacctcgcgcggcgagagcaaggtgatctacggccccgacgaggagttccccgtcggcggcagcaaggtactgcgctcctccgacgccgaccggctcaccgtcgtcgcggccggcgtcaccctgcacgaggcgctcgccgcggccgacgcgctcggagcggacggcatcccggtccgggtgatcgacctgtactcggtcaagcccgtcgaccgggccaccctgcgcgccgccgccgaggagaccggctgtctggtgaccgtggaggaccaccggcgggagggcggcatcggcgacgccgtcctggacgccttctcggacgggcggcccgtgccccggctggtgcggctggcggtcacgacgatgccggggtccgcgaccccggcggaggaactgcacgccgcggggatcgacgccgagtccatcgaggcggccgcacggatgctcgtggagcaggcgatcgttccgtga

SEQ ID NO: 9693 - protein, 615 aa, Streptomyces coelicolor A3(2)
MNTGELVDLGQQLRVDSVRAAAAAGSGHPTSSMSAADLMAVLLANHLRYDFERPAHPGNDRFVLSKGHASPLLYSAFKAAGAIDDEELLTFRKQGSRLEGHPTPQRLPWVETATGSLGQGLPVGVGIALSGKRLDHTDYRVWVLCGDSELAEGSIWEAAEHAGHEHLDNLTVIVDVNRLGQRGPTRHGHDLDAYARRFRAFEWHTIEVDGHDVDAVDRAYGEALSTKGQPTAIIARTLKGKGVRAVEDREGQHGKPLPEAEEAVAELGGPRDIRVRVHAPEDARSLRSTGTGQTELPRYGLGDEVATRNAFGEALAAVGTARGDVVALDGEVGDSTRAEFFAKEHPERYFECYIAEQQMVAAAVGMAARGWVPFATTFAAFLTRAYDFVRMASISGAGINLVGSHAGVAIGQDGPSQMGLEDLAMMRAIHGSTVLYPCDANQAARLVAEMAGLEGIRYLRTSRGESKVIYGPDEEFPVGGSKVLRSSDADRLTVVAAGVTLHEALAAADALGADGIPVRVIDLYSVKPVDRATLRAAAEETGCLVTVEDHRREGGIGDAVLDAFSDGRPVPRLVRLAVTTMPGSATPAEELHAAGIDAESIEAAARMLVEQAIVP

SEQ ID NO: 9694 - DNA, 2097 bp, Streptomyces coelicolor A3(2)
  CDS (1)..(2097): transl_table=11
atgagcacgcagtcgagcaagcagacagtggacggcgcggaccgcttcgaatggaccgaactcgaccggcgtgccgtggacaccgcccggatcctggcggccgacgccgtgcagaaggtgggcaacggtcacccgggtacggcgatggccctcgccccggccgcctacacgatctttcagaaggtgatgcggcacgaccccgccgatcccgagtggaccggccgtgaccgcttcgtcctctcccccggccacacctcgctgaccctctacacccagctcttcctcgccgggtacgaggtggagctggacgacctcaaggccttccgcacgcacggctccaggacgccgggccaccccgagtacgggcacacggccggcgtggagaccaccacggggccgctgggccagggtgtggccaacgcggtgggcatggcgatggcggcccgctacgagcgcggcctgttcgaccccgaggcccccgagggcgagtcgcccttcgaccacaccatctgggcgatcgtcagcgacggcgacctccaggagggcgtctccgcggaggcgtcgtcgctcgccggtcaccaaaagctcggcaatctggtcttcctctacgacgacaaccacatctcgatcgagggcgacaccgtgaccgcgttctccgaggacgtgctgaagcgctacgaggcgtacggctggcacacacagcgcgtcgagcccgccgagagcggcgacgtggacgtgcgcgcgctgcacgcggcgatgacggcggcgaaggccgagaccggccgcccctccatcatcgccatgcgcacgatcatcgcctggcccgccccgaacgcccagaacaccgaggcctcccacggctccgccctcggcgcggacgagatcgccgccaccaagcgcgtcctcggcttcgacccggagcggtccttcgaggtcgccgacgaggtcctcgcccacacccgccgggccctggaccggggcgccgaggcgcacgccgcctgggacaagcggatcgccgcctggcgcgacgccgcccccgagcgcgcggcgctgttcgaccgcgtggtcgcgggccggctgcccgagggctgggagaacgccctgccggtgttcgagaccggcaaggcggtcgccacccgggccgcgtccggcaaggtcctccaggcgctcggcccggtgctgcccgaactgtggggcggctccgcagacctggccggctcgaacaacacgacgatcgacaagacgtcgtccttcctgcccgggggcaacccgctccccggcgccgacccgtacggccgcaccgtgcacttcggcatccgcgagttctccatggccgcggagatgaacggcatcgccctgcacggcaacacccggatctacggcggcaccttcctggtcttctccgactacatgcgcaacgcggtgcgcatgtccgcgctgatgcagctgccggtgacgtacgtgtggacgcacgactccatcggcctcggtgaggacgggcccacccaccagccggtcgaacacctggcctcgctgcgcgcgatccccggcctcaacgtcgtccgccccgccgacgccaacgagaccgcgaccgtgtgggccgagatcctgcgccgccactccacccacccggcgccgcacggcctcgccctcacccgccagggcgtaccgacctacgcgccgaacccggacgcggcgcgcggcgggtacgtcctcgccgacgcgtccaccggcgccccggacgtcgtcctgatcgccaccggctccgaggtgcagctcgcgatggccgcgcgggagacgctggaggccgagggcaccgccacgcgcgtggtgtcgatgccgtccgtggagtggttcgaggagcagccccgcgcctaccgcgagagcgtgctgccgccgtccgtgcgggcccgggtggccgtggaggccgggatcggcctgacctggcaccggttcgtcggggacgcgggccgcatcgtctccctggagcacttcggcgcctccgccgacgcgaagaccctgttcagcgagttcggcttcaccgccgggcacgtggccgccgccgcccgggactccctggccgccgcccgcggctga

SEQ ID NO: 9695 - protein, 698 aa, Streptomyces coelicolor A3(2)
MSTQSSKQTVDGADRFEWTELDRRAVDTARILAADAVQKVGNGHPGTAMALAPAAYTIFQKVMRHDPADPEWTGRDRFVLSPGHTSLTLYTQLFLAGYEVELDDLKAFRTHGSRTPGHPEYGHTAGVETTTGPLGQGVANAVGMAMAARYERGLFDPEAPEGESPFDHTIWAIVSDGDLQEGVSAEASSLAGHQKLGNLVFLYDDNHISIEGDTVTAFSEDVLKRYEAYGWHTQRVEPAESGDVDVRALHAAMTAAKAETGRPSIIAMRTIIAWPAPNAQNTEASHGSALGADEIAATKRVLGFDPERSFEVADEVLAHTRRALDRGAEAHAAWDKRIAAWRDAAPERAALFDRVVAGRLPEGWENALPVFETGKAVATRAASGKVLQALGPVLPELWGGSADLAGSNNTTIDKTSSFLPGGNPLPGADPYGRTVHFGIREFSMAAEMNGIALHGNTRIYGGTFLVFSDYMRNAVRMSALMQLPVTYVWTHDSIGLGEDGPTHQPVEHLASLRAIPGLNVVRPADANETATVWAEILRRHSTHPAPHGLALTRQGVPTYAPNPDAARGGYVLADASTGAPDVVLIATGSEVQLAMAARETLEAEGTATRVVSMPSVEWFEEQPRAYRESVLPPSVRARVAVEAGIGLTWHRFVGDAGRIVSLEHFGASADAKTLFSEFGFTAGHVAAAARDSLAAARG

SEQ ID NO: 9696 - DNA, 2001 bp, Xanthomonas axonopodis pv. citri str. 306
  CDS (1)..(2001): transl_table=11
atgacccagcccacccgccgccagctggccaacgccatccgttttcttgccgcagatgcggtcgaagccgccaagtccggtcatcccggcatgccgatgggcatggccgatatcgccgaagtgctgtggaacgacttctaccggcacaacccgaacaatccgcagtggttcaaccgcgaccgtttcgtgctgtccaacgggcatggatcgatgttgcagtacgccctgctgcacctgtccggctacgacctgccgatcgaacagctcaagcagttccgccagctgcacagcaagaccgccggtcaccccgagcgcagcgaaactcccggcgttgagaccaccaccggccccctcgggcagggctttgccaatgcggtgggctttgcactggccgagaagttgctggcgcagcgctacaaccgcccggagctggaaatcgtcgatcaccgcacctgggtgttcatgggcgacggctgcctgatggaaggcatttcgcacgaagcggcgtcgctggccggtacctggggcctgggcaagctggtggcgttctgggacaacaaccagatttccatcgacggcaatacggccggctggttcagcgacgacaccccggcgcgtttcgaggcctatggctggcacgtgatccgcgatgtggacgggcatgacgccgacaagatcaaggccgccatcgagacagcgctggaaaacaccgacaagcccacgctgatctgctgccgtaccaagatcggtttcggtgcgccgaccaaggccggcaaggagtcctcgcatggcgctccgttgggcaaggacgagctggaaggcgcgcgcaaggcgttggagtggccgtacggcccgttcgaaattcccgaagagatctacgccggctggcgtgccggcggcaccggtaccttgcgtcaggccgaatgggaacagctgttcgacaagtacgccaagcagtacggcgcgcaggccgacgagctgacccgtcgttcgcatggcgaactgccggccgacttcatcgccaaggccgatgcctacatcgccaaggcgcaggaagagggccagaccattgcctcgcgcaaggcctcgcagctggcgatcgaagcgttcgcgccgctgttgccggaattgatcggtggctcggccgacctggcgcactccaacctgaccttgtggaaggccagcaagtcggtcgccaccgacgacccggacgccaactacgtgtattacggcgtgcgcgagttcggcatgaccgccattgccaacggtctggcgctgcatggcgggttcattccgttcgacgccaccttcctggtgttcagcgactacgcacgcaacggcgtgcgcatgagcgcgttgaacccggcgcatgcgattcatgtgtacacgcatgactcgatcggcctgggcgaagacggcccgacccatcagccggtggaacacctggcctcgctgcgctacatccccaacaacgatgtgtggcgcccgggcgatgcggtggaatcggcagtgagctggaaggcggccattacccgcaaggacggcccaagctgcctgatcttcagccgccagaacctgcagcatcagccgcgcagcgccgagcagctcaagctgatcgagcgcggtggctacgtgctggccgacgccgaaggcggtacgccggacgtgatcctgatcgccaccggttcggaagtcggtctggcagtggaagccaaaaagacgctggatgcggccggcctcaagacgcgcgtggtgtcgatgccgtcgaccgatgtgttcgatcgccaggacgcggcgtaccgtgagtcggtgctgccgaacgccgtgcgcaagcgcgtggcggtggaagcgggggtgaccggcttctggcgcaagtacgtgggcctggatggcgatgtcgtcggcatggacaccttcggtgcctcggcgccggccgaccagttgtatgcgtacttcaagatcaccgcagagcacgtggtggccgcagccaaggcgctgtaa

SEQ ID NO: 9697 - protein, 666 aa, Xanthomonas axonopodis pv. citri str. 306
MTQPTRRQLANAIRFLAADAVEAAKSGHPGMPMGMADIAEVLWNDFYRHNPNNPQWFNRDRFVLSNGHGSMLQYALLHLSGYDLPIEQLKQFRQLHSKTAGHPERSETPGVETTTGPLGQGFANAVGFALAEKLLAQRYNRPELEIVDHRTWVFMGDGCLMEGISHEAASLAGTWGLGKLVAFWDNNQISIDGNTAGWFSDDTPARFEAYGWHVIRDVDGHDADKIKAAIETALENTDKPTLICCRTKIGFGAPTKAGKESSHGAPLGKDELEGARKALEWPYGPFEIPEEIYAGWRAGGTGTLRQAEWEQLFDKYAKQYGAQADELTRRSHGELPADFIAKADAYIAKAQEEGQTIASRKASQLAIEAFAPLLPELIGGSADLAHSNLTLWKASKSVATDDPDANYVYYGVREFGMTAIANGLALHGGFIPFDATFLVFSDYARNGVRMSALNPAHAIHVYTHDSIGLGEDGPTHQPVEHLASLRYIPNNDVWRPGDAVESAVSWKAAITRKDGPSCLIFSRQNLQHQPRSAEQLKLIERGGYVLADAEGGTPDVILIATGSEVGLAVEAKKTLDAAGLKTRVVSMPSTDVFDRQDAAYRESVLPNAVRKRVAVEAGVTGFWRKYVGLDGDVVGMDTFGASAPADQLYAYFKITAEHVVAAAKAL

SEQ ID NO: 9698 - DNA, 1872 bp, Drosophila melanogaster
  CDS (1)..(1872)
atgtcgaacgctaagctggacagtaaggtcgttcagaacctgaaggacgtggcccaaaagctgcggatccactcgatcacctcgacacaggcggccaagtcgggacatccgacgtcctgtgcctcgttggccgagataatgacggtgctgttctttcagcagatgcgcctaaatctgaagcatcctcgcgatccttccagcgatcgattggttctgtccaagggacacgctgcacccattctgtacgccgtttgggcggaggctggactcttcccggtggaggagctgcgaaatttgcgcaaggtggacagtgatctagagggtcatcccactccacggctgagtttcgtcgatgtgagcaccggatccctgggacagggcatctcagtggccgctggaatggcctatgtgggcaaacacctggacaaggccgactatcgtacatatgtgatcgtgggcgatggcgaggctaccgaaggagcagtctgggaatcgctccactttgccggccactactgcctggacaacctgtgcgtaatcttcgatatgaacaagatcttctgctcggacataggcactgaaatggaggtttatcgggagaggttggacgccttcgggttcaatgccctagtcttaaatggccacgatattgatgagctggccaaggccttcattaatgcggccagcaccaagggtaagcccacggctcttttagccaggacgactaagggaaaggactttctgggcatcgaaggaatcgaagaaatgcatgcacagccactgggtaagagggccgaatctgcaatcaagcatttgcagatgaaaatcgcaaatcccaacgtccgcctgacacccaaaaaggtgggaaagtgcggccacgcccccgaggtgcatattaacaatataatgctgtgcagtccgcccaattatcggctgggagattcggtagccccacgcttagcctacggaaccgccttggccaaaatcgcggctgataatcctcgggtaattgcccttgatggcgatacaaagaactcgacgtatgcggacaagatgaggaatgcatttccagagcgtttcatcgagtgcttcaccgcacagcagaatctggtgggcgtggccgtgggagccacctgtcgacgtcgcactgtggccttcgtttcgacgtatgcgacctttttcacacgggcctttgatcagatccgcatgggcgcaatttcgcacacgaatgttaactttgcgggctcccactgtggctgcagcatcggcgaggatggtccctcccaaatgggactggaggacatggccatgttcaggagcattcccgggagcacggtcttctatcccacggacgcagttagcacggagagggcggtggaactggctgccaatactaagggcgtgtgctacatccgcacaacgtatccgagcacaacggtgatctacaacaatgacgaggtgtttgccgtgggactgggcaaagtggtgcgccagaagccctcggatgaagtgctcctgattggagccggcgtcacattgtacgagtgcctggccgcagcggagagattggaggaggattgcattacggcacgagtgatcgacccctttacagtgaagcccctcgatgtcggactaatcgtgaagcatggaaagctgtgtcgtggaagaatcgtcgtggtggaggatcattaccagcaaggcggattgggcgaggcggtcctcagtgctctggccgactatcgaaactttgtggtcaagcatctctatattaccactgtaccgagatcaggccctcctgctgttctgctggacatgtttggggtctcctccagaaatatatacaaagcaagcctggccatcatgaagaagtga

SEQ ID NO: 9699 - protein, 623 aa, Drosophila melanogaster
MSNAKLDSKVVQNLKDVAQKLRIHSITSTQAAKSGHPTSCASLAEIMTVLFFQQMRLNLKHPRDPSSDRLVLSKGHAAPILYAVWAEAGLFPVEELRNLRKVDSDLEGHPTPRLSFVDVSTGSLGQGISVAAGMAYVGKHLDKADYRTYVIVGDGEATEGAVWESLHFAGHYCLDNLCVIFDMNKIFCSDIGTEMEVYRERLDAFGFNALVLNGHDIDELAKAFINAASTKGKPTALLARTTKGKDFLGIEGIEEMHAQPLGKRAESAIKHLQMKIANPNVRLTPKKVGKCGHAPEVHINNIMLCSPPNYRLGDSVAPRLAYGTALAKIAADNPRVIALDGDTKNSTYADKMRNAFPERFIECFTAQQNLVGVAVGATCRRRTVAFVSTYATFFTRAFDQIRMGAISHTNVNFAGSHCGCSIGEDGPSQMGLEDMAMFRSIPGSTVFYPTDAVSTERAVELAANTKGVCYIRTTYPSTTVIYNNDEVFAVGLGKVVRQKPSDEVLLIGAGVTLYECLAAAERLEEDCITARVIDPFTVKPLDVGLIVKHGKLCRGRIVVVEDHYQQGGLGEAVLSALADYRNFVVKHLYITTVPRSGPPAVLLDMFGVSSRNIYKASLAIMKK

SEQ ID NO: 9700 - DNA, 1881 bp, Drosophila melanogaster
  CDS (1)..(1881)
atgtcgtaccacaagcccgaagctaagaccgtccaggatctgaaagatctggcccagaaactgcgaattcactctatcaacgccacccaggcctccaaatcgggccatcccacatcatgtgcctcgatcgctgagatcatgtccgtgctgttcttccagcagctgcgcctgaacctgaagcacccacgcgatccctccagcgatcgcttcatcctgtccaaaggacacgctgctcccattctgtatgccgcctgggctgaggctggtctcttccccatcgcggatctgaacaacctgcgcaagatcgacagcgatctggagggtcacccgacgcctcgtctgaacttcatcgatgtgggcactggatccctgggacagggtgtcgccgtcggcgctggcatggcctatgtgggcaagaacttcgacaaggccgactaccgcacctacgtggtggtgggtgatggtgagtccgccgagggttccatctgggagtcgctgcactttgccggccactataaactggacaacctttgcgtgatctttgatgtgaaccgcttgggccagtcggaggccacctccctgcagcataagctggatgtttaccgtgatcgtctggaggccttcggctttaatgccgtcgttgtcgatggtcatgatgtcgaggaattgagcaaggctttccattgtgctgcaatcaccaagaacaagcccaccgccatcattgcaaagacgttcaagggcagggacttccccaacatcgaggatttggacaactggcacggcaagccactgggcgacaaggccgccgaagtggtgaagcatctggagggactgattgtcaacaagaacgtcaagctgacccctaagccggtgcccaagactggtgctgctcccgacgtggacatcaacaacattaagttgagctcgccacccgcctacaagctgggtgattccattgccacccgtttggcctatggaacagctctggccaagattggccagaacaacctgcgtgttgttgccctagacggagacaccaagaactcaactttctccgacaagctgaagaacctcgacccgcagcgctacattgagtgcttcatcgctgagcagaatcttgtgggagtggccgttggagccgcctgccgtcgccgcactgtggcctttgtgtccacctttgccaccttcttcacccgtgccttcgatcagatccgtatgggcgccatctcgcagacgaacgttaactttgtgggctcccactgcggctgcagtatcggtgaggatggtccttcgcagatgggtctggaggacattgccatgttccgcaccattccgggcagcaccatcttctatccctccgatgcagtgagcacggagcgtgccgtcgaactggccgccaacaccaagggtgtctgcttcatccgtacgtcccgtcccaacacctgtgtgatctacgacaacgaggaacccttcaccattggccgcggcaaggtggtgcgccaaaagagctccgacgaggtgcttctgatcggagctggaatcactttgtacgagtgcctggctgccgccgatcagctggagaagaactgcatcaccgtccgtgtgatcgatccgttcaccgtgaagccattggacgccgagctgatcatcgagcacggcaagcagtgcggaggacgcgtagtcgtcgtggaggatcactaccagcaaggaggcctgggtgaagctgtgctgagtgccctggctggcgagcgcaacttcgttgtcaagcacttgtacgtgcccaccgtgccacgttcgggtcctccgtcggtactcatcgatatgttcggcatctccgcacgtcacgtcgtcaacgccgttaacgagatcctcaaggattag

SEQ ID NO: 9701 - protein, 626 aa, Drosophila melanogaster
MSYHKPEAKTVQDLKDLAQKLRIHSINATQASKSGHPTSCASIAEIMSVLFFQQLRLNLKHPRDPSSDRFILSKGHAAPILYAAWAEAGLFPIADLNNLRKIDSDLEGHPTPRLNFIDVGTGSLGQGVAVGAGMAYVGKNFDKADYRTYVVVGDGESAEGSIWESLHFAGHYKLDNLCVIFDVNRLGQSEATSLQHKLDVYRDRLEAFGFNAVVVDGHDVEELSKAFHCAAITKNKPTAIIAKTFKGRDFPNIEDLDNWHGKPLGDKAAEVVKHLEGLIVNKNVKLTPKPVPKTGAAPDVDINNIKLSSPPAYKLGDSIATRLAYGTALAKIGQNNLRVVALDGDTKNSTFSDKLKNLDPQRYIECFIAEQNLVGVAVGAACRRRTVAFVSTFATFFTRAFDQIRMGAISQTNVNFVGSHCGCSIGEDGPSQMGLEDIAMFRTIPGSTIFYPSDAVSTERAVELAANTKGVCFIRTSRPNTCVIYDNEEPFTIGRGKVVRQKSSDEVLLIGAGITLYECLAAADQLEKNCITVRVIDPFTVKPLDAELIIEHGKQCGGRVVVVEDHYQQGGLGEAVLSALAGERNFVVKHLYVPTVPRSGPPSVLIDMFGISARHVVNAVNEILKD

SEQ ID NO: 9702 - DNA, 2067 bp, Chlorobium tepidum TLS
  CDS (1)..(2067): transl_table=11
ttgactgtcagagtccgtccgatttctctcaatctcagaaacaatccgattatgacacgcacccgttccatcgatgaagaggccgtcgccaccatcaggcttctggcggtcgatatggtagaaaaggccaaatcgggccaccctggactgccgcttggtgcggctccgatggcgtacacgctctttaccaaaatcatgcggtttaaccccgccaatccggagtggccgaatcgcgaccgcttcgtgctctcggcgggccacggctccgcgctgctctactccatgttgcacctctgcggctacggcctcggcatggatgagctgaagcagttccggcagctcggcagccgcacgcctggccaccccgaatacggtcacacgccgggcgtcgaaacgaccactggcccgctcggccagggcattgccactgccgtcggaatggctgccgccgaacgcttcctcgccacgaaactcaacacggcagagcgggcactcatcgaccacttcacctacgtcatctgcggcgacggtgacctcatggagggcatcagttcggaagcctcgtcgcttgccggacacctcaggctcgggcgcctcatctgcctctacgacagcaaccacatcagcatcgaaggctcgaccggtctggccttcacggaggatgttgcccgccgctacgaggcgtacggctggcacgtcctgtcgcacatcgacggcaacgaccttgcggccatcgagcaagcagtgcgcaatgcacaggagatcgacgaccgcccgtcgctcatcatcgtcaacaccaccatcggctacggtagcccgcacaagcagggcaccgcgtcagcacacggcgagccgcttggcccggaagaaacgaagctggtcaagcaggctttcgggtttgatgaaaatgaatcgttcgtcgtgtcggatcgtgtgtacgaccattttcacgcgatagccgaacgcggcgcggcgctcgaagccgaatggcaaacgcagtggcagtcgttcaggcaggaagaacccggcctcgcctcggcgctgaccgacctgctcgcgggccgcttccctgaatcgtggctgcccgaaatgccgaaattcacgactggcgaaaagctcgccacgcggcaggcatcgaaaagcgtgcttgccaaaatcgcagaaaaggcgccgctgctggcgggcggctcggctgacctcgccccgtcgaacggcacgctcatcggagccgctttcgaggctggaagctacggcggctcgaccttccacttcggcgttcgggaacacgcaatgggcgcacttgtcaacggcatggcactctcaaaaatgatgatcccctatggcgcgaccttcctcgtctttgccgattacatgaaacccgcgctgcgcatcgccgcaatgatgcaatccccctcgatcttcatcttcacgcacgacagcatcggccttggcgaggacggcccaacccaccagcccatcgagcagctcgccatgctccgcgccatgccgggcttcgacgtctatcgcccggcggacgcgaatgaaacggcagcggcgtggctgctcgcgctgaaacgccgcaaaccggcagcgctcgtgctcacacgccagggtttgccagtgctcgacgacgccgatggacgcctccgcaacggcgtgacaaaaggcggctatgtgctcgcggaatgggcagatacggacgacgacgacgaccgccggatcattatcgtggcgacgggatcggaggtgcatcccgcgctcgaagcaaaaacgctgatcgaacaggagggattcgcggcacgggtggtctcgatgccgtcgcgggagctgttcgccgagcaaccggcggagtatcgcgccgccgtgctgcctccgacggtgcgggcacgagccgtggtcgaagccgccgcgaccttcggctggcacgacattgcgggcgacggcggaatcgtgatcggcatcgaccgcttcggcatgtcagcccccagctcgcaggtgatggagcacttcggcttcacggcggaaaacatcgccgcccgcgccctcgaactcctgaaccggaaatga

SEQ ID NO: 9703 - protein, 688 aa, Chlorobium tepidum TLS
MTVRVRPISLNLRNNPIMTRTRSIDEEAVATIRLLAVDMVEKAKSGHPGLPLGAAPMAYTLFTKIMRFNPANPEWPNRDRFVLSAGHGSALLYSMLHLCGYGLGMDELKQFRQLGSRTPGHPEYGHTPGVETTTGPLGQGIATAVGMAAAERFLATKLNTAERALIDHFTYVICGDGDLMEGISSEASSLAGHLRLGRLICLYDSNHISIEGSTGLAFTEDVARRYEAYGWHVLSHIDGNDLAAIEQAVRNAQEIDDRPSLIIVNTTIGYGSPHKQGTASAHGEPLGPEETKLVKQAFGFDENESFVVSDRVYDHFHAIAERGAALEAEWQTQWQSFRQEEPGLASALTDLLAGRFPESWLPEMPKFTTGEKLATRQASKSVLAKIAEKAPLLAGGSADLAPSNGTLIGAAFEAGSYGGSTFHFGVREHAMGALVNGMALSKMMIPYGATFLVFADYMKPALRIAAMMQSPSIFIFTHDSIGLGEDGPTHQPIEQLAMLRAMPGFDVYRPADANETAAAWLLALKRRKPAALVLTRQGLPVLDDADGRLRNGVTKGGYVLAEWADTDDDDDRRIIIVATGSEVHPALEAKTLIEQEGFAARVVSMPSRELFAEQPAEYRAAVLPPTVRARAVVEAAATFGWHDIAGDGGIVIGIDRFGMSAPSSQVMEHFGFTAENIAARALELLNRK

SEQ ID NO: 9704 - DNA, 1986 bp, Streptococcus pyogenes MGAS315
  CDS (1)..(1986): transl_table=11
atgacatttgatgcaattgaccagttggcagtaaacactgtccgcaccctatcaatggatgccattcaagcggcaaattctggacacccaggacttccaatgggggcagcacctatggcctatgttctttggaatcacttcatgaacatcaatcccaaaacaagccgtaattggtcaaacagagaccgttttatcctatcagcaggtcatggaagtgccatgctttatagcttgttacacttagctggttatgatttatctgtagaagatttaaagaacttccgtcaatggggttctaaaacaccaggtcacccagaagtgaaccacacagacggtgtcgaagcaaccacaggacctcttggtcaagggatcgcaaatgccgttggtatggccatggcagaagctcatctagcagctaaatttaacaaaccaggctttgacatcgttgatcactacacctttgctttgaatggtgacggtgaccttatggaaggggtcagccaagaagcagcaagtatggcaggacatttaaaacttgggaaattggtcttgctatatgattcaaacgacatctctcttgatggtccaacctctatggctttcacagaagatgtgaaaggacgtttcgaagcttatggttggcaacatatccttgtgaaagatggaaatgatttagaagaaattgcagctgctattgaagcagctaaagctgaaactgagaaaccaaccatcatcgaagtcaaaaccattattggttttggtgccgaaaaacaaggaacttcagctgttcacggcgctcctcttggagcagaaggcattgcttttgccaaaaaagcttaccaatggactcatcaagattttgaagtgcctgctgaagtaacagagcgctttgctcaaggtcttcaagcgcgtggtgaaaaagcagaacaagcctggaatgacttgtttgcagcttatgaagcagaatatccagaattagcagcagaataccaaaaagcctttactaacgaagctgctcaagtagaacttgaagcgcacgaacttggtagttcaatggcgagtcgtgtatccagtcaacaagccatccaacaaatttcagaacaagtagcctctttctggggtgggtcagcagacctttcagcttcaaacaatactatggttaaggctgaaacagatttccaaccaggtcactacgaaggccgtaacatctggtttggcgttcgtgaatttgccatggctgcagccatgaacggtattgcccttcacggcgggacacgcgtttacggcggaaccttctttgtcttctcaaactatcttcttccagctgttcgtatggcagcgctccaaaacttgccaacagtttatgtcatgacacatgattctatcgctgtcggtgaagatgggccaacgcacgaaccaattgaacaattggcaagtgttcgctcaatgcctaacttgaacgttattcgtccagcagacggtaacgaaacaaatgctgcttggaaacgtgccattgctgaaacagatcgcccaaccatgcttgtattgacgcgtcaaaaccttccagtgcttgagggcacaaaagaattggcagaagatggtcttaacaaaggagcttatatcttgtcagaagccaaaggcgaccttgatggtatcttgattgcaacaggttcagaagtgaaactggcaatggatactcaagaagctcttgaagcagaaggcattcatgtgcgtgtcgtatctatgccatcacaaaatatctttgacgaacagtcagcagagtataaagaaagcatcctaccagcagctgtgactaaacgtctcgctatcgaagcaggttcaagctttggctgggcaaaatatgtcggcctagcaggaaaaacattgaccattgacacttggggtgcttcagctccaggaaatcgtatcttcgaagaatatggtttcactgtggcaaatgcaactgagttatacaaatcactctaa

SEQ ID NO: 9705 - protein, 661 aa, Streptococcus pyogenes MGAS315
MTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFTNEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLNKGAYILSEAKGDLDGILIATGSEVKLAMDTQEALEAEGIHVRVVSMPSQNIFDEQSAEYKESILPAAVTKRLAIEAGSSFGWAKYVGLAGKTLTIDTWGASAPGNRIFEEYGFTVANATELYKSL

SEQ ID NO: 9706 - DNA, 1995 bp, Yersinia pestis KIM
  CDS (1)..(1995): transl_table=11
atgtcctctcgtaaagagcttgccaacgctatccgcgcactaagcatggatgccgtgcaaaaagcgaagtccggccatcccggagccccgatgggtatggcagatattgccgaagtcctgtggcgtgattatctgaaccataatccaactaacccacactgggctgatcgtgaccgtttcgtcctgtcaaatggtcacggctccatgttgatttatagcctgttgcatctcacaggttatgacctgccgatggaagagctaaaaaatttccgccaactgcactctaaaacgcctggccaccctgaatatggttataccgctggtgtagaaaccaccactgggccattggggcaaggcattgccaatgctgttggttttgctatcgcagaacgcacgctgggggcgcagtttaaccgcccaggtcacgacattgtcgatcaccatacctacgcctttatgggcgatggttgcatgatggaagggatctctcacgaggtttgctctctggccggtacgatgaagctgggcaaactgacggctttctatgatgacaacggtatttctatcgatggtcatgttgaaggctggttcactgatgacacggcggcccgtttcgaagcctacggctggcatgtggtacggggtgttgatggccataacgcggactctattaaagcggctatcgaagaagcacataaggttaccgacaagccttcattgttgatgtgcaaaacgattattggttttggctcaccaaacaaagctggaacccatgattcccatggtgcgccattaggtgaagcggaagtggcagcaacccgtgaagcattaggttggaaatacccggcatttgaaatcccacaagatatctatgcggcatgggatgccaaagaagcgggcaaagccaaagaagcggcctggaacgagaagttcgctgcgtatgccaaggcttatccagaactggcggctgaattcaaacgtcgtgtcagcggtgaattaccggctaactgggccgttgaatccaagaaattcatcgaacaattgcaagccaatccagcaaatattgccagccgcaaagcctcacaaaatgcgctggaagccttcggtaaagtgttacctgagttcctgggcggttctgctgacctggcaccgagtaacctgactatctggtctggctctaaatccttgagcgacgatctggctggtaactacattcactacggtgtccgtgaatttggtatgtctgccatcatgaacggtattgccctgcacggcggtttcatcccttacggcgcaaccttcctgatgtttgtggaatatgcccgtaacgcagtgcgcatggcggcactgatgaaaatccgtagcgtgttcgtttatacccatgactctattggtctgggcgaagatggcccaacccatcagcctgttgaacagatggccagcctgcgtgttaccccgaatatgagtacctggcgtccttgtgatcaggtcgaatctgcagtggcatggcagtatgcgctggaacgtaaagatggcccaagcgcactgatcttctcccgacagaatctggcacagcagccacgtactgcggagcagctagccaatatcgccaaaggcgggtatgtgctgaaggattgtgcaggccagcctgaactgatcctgattgctaccggctctgaagtggagttagcagttgctgcggctgatcaactgacggccactggccgtaaagtccgcgttgtctctatgccatcaactgatgcattcgataaacaagatgcggcttaccgtgagtcagtattgccatctgcggttagcgcacgtgttgccgtagaagcgggtattgcggattattggtacaaatacgttggcctgaatggcgcggttgtcggtatgaccacgtttggtgaatcagcgccagctgaattgctgttcaaagagtttggtttcaccgtggaaaacgtggtggcgaaagctcaggcgctgctgaagtaa

SEQ ID NO: 9707 - protein, 664 aa, Yersinia pestis KIM
MSSRKELANAIRALSMDAVQKAKSGHPGAPMGMADIAEVLWRDYLNHNPTNPHWADRDRFVLSNGHGSMLIYSLLHLTGYDLPMEELKNFRQLHSKTPGHPEYGYTAGVETTTGPLGQGIANAVGFAIAERTLGAQFNRPGHDIVDHHTYAFMGDGCMMEGISHEVCSLAGTMKLGKLTAFYDDNGISIDGHVEGWFTDDTAARFEAYGWHVVRGVDGHNADSIKAAIEEAHKVTDKPSLLMCKTIIGFGSPNKAGTHDSHGAPLGEAEVAATREALGWKYPAFEIPQDIYAAWDAKEAGKAKEAAWNEKFAAYAKAYPELAAEFKRRVSGELPANWAVESKKFIEQLQANPANIASRKASQNALEAFGKVLPEFLGGSADLAPSNLTIWSGSKSLSDDLAGNYIHYGVREFGMSAIMNGIALHGGFIPYGATFLMFVEYARNAVRMAALMKIRSVFVYTHDSIGLGEDGPTHQPVEQMASLRVTPNMSTWRPCDQVESAVAWQYALERKDGPSALIFSRQNLAQQPRTAEQLANIAKGGYVLKDCAGQPELILIATGSEVELAVAAADQLTATGRKVRVVSMPSTDAFDKQDAAYRESVLPSAVSARVAVEAGIADYWYKYVGLNGAVVGMTTFGESAPAELLFKEFGFTVENVVAKAQALLK

SEQ ID NO: 9708 - DNA, 1995 bp, Thermosynechococcus elongatus BP-1
  CDS (1)..(1995): transl_table=11
atgcctgcggttactcaatcccttgatgaactctgtattaatgcgatccgtttcctagcgatcgatgcggtacaaaaggccaactctgggcaccccggtctgcctatgggggcggctcccatggcctacgtgctctggaaccagttcatgcggtttaaccccaaaaatccgcagtggttcaatcgcgatcgctttgtcctgtcggcgggtcatggctgtatgttgcagtatgccctgctctacctcacaggctatgacagcgttaccattgaggatattaaacagttccgccagtgggggtcgcacacccctggtcaccccgaaaactttgaaacccccggtgtagaggtgaccaccggtcccctcggtcaagggatttgtaacgccgttggcttagcggtggctgaagcccatctggccgcccgcttcaacaagcccgatatcaaactggtagatcactacacctatgtcatccttggggatggctgcaatatggagggtgtctccggagaagcctgctcccttgctggtcactgggggttgggtaaactcattgccctctacgacgataaccacatttccattgacggctccaccgacatcgcctttacagaggatgtctgcaagcgttttgaagcctacggttggcacgtgcagcacgttgccgatggcaatacggatcttgcaggcattgccaaggccattgaagctgctaaagccgtaaccgataagccgtcactcattaaagtcaccacgaccattggctacggttcccccaacaaagccaacactgccggtgtgcacggtgcccctcttggccctgaggaggtcaagctgacccgtgaaaaccttggctggaactatgagccctttgtcgtccccgaggaggttctcaaccacttccgcaaagccattgagcgcggtgccagctatgaggcgcagtggaaccaaacccttgccacctaccgccagaagtatcctgaggaggccgccgaatttgaacggctgctgcggggtgaattgcccgccaactgggatgccaatcttcccagttacacccctgaggataaggccgtggctacccgcaaacattcggaaatttgcctgaacgcgatcgcccctaacctgccagaactcattggcggttctgcggacctgacccactccaacctcaccgagctgaagtgttccggtgacttccaaaaaggtcagtaccaaaaccgcaacattcgctttggcgtgcgcgaacacggcatggctgcgatctgcaatggcattgcactccacaattccggcttgattccctactgcgccaccttcttggtctttgctgattacctgcggcctgccctgcgcctctcagccctctcccaagcgggtgtcatctatgtgatgactcacgactccattgcccttggggaagatggccccactcaccagccggtggaaaccttggcttcgttgcgtgccattcccaacctactagtgatccggccggccgatggcaatgaaacctcgggggcctatcaagttgctgtccaacggcgcaaacaacccaccctactggccctgacccgccaaaatgtgcccaacttggccggtagctctgcggcaaatgtcgccaaaggtgcctatacccttgtggattgtgaaggtacccccgacttgatcctgattgggacaggttcagaagtcgccctctgtgtcaaggccgctgaaaccctgaccgccaatggcaagaaggtgcgggtggtatccatgccctcttgggaactctttgaggagcaatcccctgagtacaaagccagtgtgctgccggcgggggtaaaacgccttgcggtggaggcggctgctagttttggttggtgccgctatgccgatgcaacggtcgcgatcgaacgctttggggcctccgctcccggcaacgtccttatggagaagtttggcttcactgtggacaatgtggtggccaaggccaatgccctgcttggctaa

SEQ ID NO: 9709 - protein, 664 aa, Thermosynechococcus elongatus BP-1
MPAVTQSLDELCINAIRFLAIDAVQKANSGHPGLPMGAAPMAYVLWNQFMRFNPKNPQWFNRDRFVLSAGHGCMLQYALLYLTGYDSVTIEDIKQFRQWGSHTPGHPENFETPGVEVTTGPLGQGICNAVGLAVAEAHLAARFNKPDIKLVDHYTYVILGDGCNMEGVSGEACSLAGHWGLGKLIALYDDNHISIDGSTDIAFTEDVCKRFEAYGWHVQHVADGNTDLAGIAKAIEAAKAVTDKPSLIKVTTTIGYGSPNKANTAGVHGAPLGPEEVKLTRENLGWNYEPFVVPEEVLNHFRKAIERGASYEAQWNQTLATYRQKYPEEAAEFERLLRGELPANWDANLPSYTPEDKAVATRKHSEICLNAIAPNLPELIGGSADLTHSNLTELKCSGDFQKGQYQNRNIRFGVREHGMAAICNGIALHNSGLIPYCATFLVFADYLRPALRLSALSQAGVIYVMTHDSIALGEDGPTHQPVETLASLRAIPNLLVIRPADGNETSGAYQVAVQRRKQPTLLALTRQNVPNLAGSSAANVAKGAYTLVDCEGTPDLILIGTGSEVALCVKAAETLTANGKKVRVVSMPSWELFEEQSPEYKASVLPAGVKRLAVEAAASFGWCRYADATVAIERFGASAPGNVLMEKFGFTVDNVVAKANALLG

SEQ ID NO: 9710 - DNA, 1986 bp, Streptococcus agalactiae 2603V/R
  CDS (1)..(1986): transl_table=11
atgacatttgacaccattgatcaattagcggttaatacagtccgcacgctttctattgatgctatccaagcagcaaattctgggcacccaggtcttcctatgggagctgcgcctatggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaatttcgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacatctcaatcatttacagaagatgttaaaggacgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatgtatgggaatatccagactttactgttcctgctgaagttgcagatcgatttgcctcagatcttcaagcgcgtggtgcgaaggcagaagaggcatggaatgatctttttgctaaatatgaagttgagtatccagaattagcaactgaatacaaagaagcttttgctggccaagctgagacagttgaactgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaactacgctgggcgtaatatttggtttggtgtacgtgaatttgcaatggctgctgcaatgaatggaattgcgcttcacggtgggactcgtgtttatgggggtacgttctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactttaa

SEQ ID NO: 9711 - protein, 661 aa, Streptococcus agalactiae 2603V/R
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYVWEYPDFTVPAEVADRFASDLQARGAKAEEAWNDLFAKYEVEYPELATEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 9712 - DNA, 2001 bp, Oceanobacillus iheyensis HTE831
  CDS (1)..(2001): transl_table=11
atgtcaggcaaggtagaacaattatcaataaatacaattcgtactttatctattgacgcaattgaaaatgcgaactcaggacaccctggtttaccaatgggtgcagcgccaatggcgtacacattatggacagactttatgaatcatcatccaaaaaactctaaatggtttaaccgtgatcgctttgtattatcagcgggacacggatcaatgttactatatagtttattgcacctttctggatacgatgtatctattgaagaccttaaaggatttcgtcagtgggattccaaaactcctggacatccggaagtacatcataccgatggtgtagaagcaactactggacctttaggacaaggtattgcgatgtcagtgggtatggctatggcagaagctcatttaggcgcaacgtttaataaagataaatattctgtagtggatcactatacgtatgccttagtaagtgacggtgatttaatggaagggatttctcatgaatccgcttctttagcaggtcacttaggtctaggtaaacttattgctctatatgattctaatgatatttcattagatggagatctagatcgttctttctcagaggaaacggaaaaacgttttgaagcttatggttggcaagtattgcgagtggaagatggaaacgatgtaaatgctattcgtgaagcaattaaagaagctcaacgtaatacgaagcaaccaacacttattgaagtgaagacaattataggttatggttctccaaataaatcagcttctgctgcttcgcatggtgcgccactaggtgaagatgaaataatattaacaaaagaatattatgagtgggaacatgaaccattccatgtaccagatgaagtatatgctgatttccaagaaaaaatcgttaacgatggtgaaaagaaagaagctgcttggaatcaactggttgaagaatataaaaaatcttatccagaattaggagagcaattcgatttagcaatcaaaggtcaacttccagaaggttgggaaaaagaacttccaatatatgagcctggaagcagcattgcaactcgtgcatcttcaggtgaagtgttaaatgcagtagctaaagcagttcctaacttctttggtggaagtgcagatctagctggatctaacaaaacaaccataaaagaagaaggcgactttacaaaagaagattattctggacgtaatgtatggtttggcgtacgtgaacacgctatgggagcggcattaaatggaatggccttgcatggaggtttacaagtatttgctggaacgttcttcgtgtttagtgattaccttcgccctgctgttcgtttagcagcaattatgaatatgccagtaaactttgtgtttactcatgattctattgcggttggtgaagatggtccgactcatgaaccaattgaacaattagcatctttaagagcagttccaaacttatcacttattcgtcctgcggatgcgaatgaagtacaagctgcatggagactagctcttgaatctgaacatcagccaacagcgcttgttcttactcgtcaaaacttaccaacactagaaggtacgaaggaaaatgcgtacgaaggtgtgaaaaaaggtgcctatgtaattagtaaatctgagaaagaaactccagatgcactattactagctactggttcagaagttcaattagcagtgcgtgcacaagaaacattaaaagaaaaaggtatcgatgttcaagtcgttagcatgccttcatgggatcgttttgaagctcaagaggatgcatacaagaatgaagtactaccaaaagaagtgaaagctagagtaggaatcgaaatggctgcttcatttggatgggaacgttatgtaggtcttgatggcaaagtaatcggtattaatcgctttggtgcatctgcaaaaggtgataaagttattgaagagtatggattcacagtagaaaatgttgtaaaacatgtggaagacttattaaaataa

SEQ ID NO: 9713 - protein, 666 aa, Oceanobacillus iheyensis HTE831
MSGKVEQLSINTIRTLSIDAIENANSGHPGLPMGAAPMAYTLWTDFMNHHPKNSKWFNRDRFVLSAGHGSMLLYSLLHLSGYDVSIEDLKGFRQWDSKTPGHPEVHHTDGVEATTGPLGQGIAMSVGMAMAEAHLGATFNKDKYSVVDHYTYALVSDGDLMEGISHESASLAGHLGLGKLIALYDSNDISLDGDLDRSFSEETEKRFEAYGWQVLRVEDGNDVNAIREAIKEAQRNTKQPTLIEVKTIIGYGSPNKSASAASHGAPLGEDEIILTKEYYEWEHEPFHVPDEVYADFQEKIVNDGEKKEAAWNQLVEEYKKSYPELGEQFDLAIKGQLPEGWEKELPIYEPGSSIATRASSGEVLNAVAKAVPNFFGGSADLAGSNKTTIKEEGDFTKEDYSGRNVWFGVREHAMGAALNGMALHGGLQVFAGTFFVFSDYLRPAVRLAAIMNMPVNFVFTHDSIAVGEDGPTHEPIEQLASLRAVPNLSLIRPADANEVQAAWRLALESEHQPTALVLTRQNLPTLEGTKENAYEGVKKGAYVISKSEKETPDALLLATGSEVQLAVRAQETLKEKGIDVQVVSMPSWDRFEAQEDAYKNEVLPKEVKARVGIEMAASFGWERYVGLDGKVIGINRFGASAKGDKVIEEYGFTVENVVKHVEDLLK

SEQ ID NO: 9714 - DNA, 2109 bp, Bifidobacterium longum NCC2705
  CDS (1)..(2109): transl_table=11
atgaccgaattcaaggagaccgagctcgacgagcgcgccatcaagatggcgaaggtcctttcggctgacgcggttgagaaggcaggctccggccaccccggctcccccatctccctggcgcccgtcgcctacacgctgtaccagcacttcatcaagcacgatccgaatgatcccaactgggaaggccgagatcgcttcatcctttccggtggccacgcctccctcacccagtacgtccagctgtacttctccggctacggcgtgaccctggacgaccttaagaacttccgtggcggcgctgccacccgcaccccgggccacccggagtacggcctgaccccgggcatcgaaatgaccaccggccctctgggccagggcttcgcctccgccatcggctttgcctacggcgagcgtttccagcgcggtctgcttgacccggagaccccgaaggaagattccccgttctaccacaagatctgggccatctgcggtgaaggcgacatcgaggagggcatctccggcgaggccgcttccctggccgccaaccagaagctcggcaacctgaccgtgatcttcgacgccaaccgcatccagatcgaaggcgacaccaacctggtgctggccgaggacgtgctcaagcgcttccaggcctacggctggtacaccgacgagttcagcttcatccagcccgacggctcctacaaggaggacatcgagggcttggctgacgtcatcgccaaggccgagaaggccgctccggaccagccgaagctcatcaaggttcactccctgatcgcttggccgaccccgggcaagaccaacgacccgtcctcccacggttccaagctgggtaccgaggctgttgccggcctcaaggaagccctcggctacgatccggaagagaacttccacgttgacgaagaggctctggctcacgctcgcaaggttgccgagcgcggtctcgaagcccacaaggaatgggacgagaagttcgacgcttggcgcaaggccaacccggacaaggctgccctgtacgaccgtctgaaggccggtgaactgccggaaggcttcgacaaggctcttgacgaccttgaggccaccttcgaagtcggcaagggtgtcgccactcgtggcgcctccggctccgtgctcaacgccatcgccgctgtcatgccggaactctggggcggctccgccgacctcggtggctccaacaagaccgatctcaagggcgctgccaccttcgccccggccgagtgcgccaccaagcagtggccgaactgcaacgagttcggtcgccagctgcacttcggcgtgcgcgagttcaccatgggctgcatcaccaacggcatcctgctgggctcccacacccgtccgttcggcggcaccttcttcatgttctccgactacgagcgttccgccgttcgtctggccgccctcatggagattccgaacctgtacatctggtcccacgactccgtcgccgtcggcgaggatggcccgacccaccagccggttgagcaccttgcttccttccgcgcgattcctcagcttgaggtcattcgcccggccgacgccttcgagaccgccgaggcttaccgttacttcttcgagaagaagaacaccctgcctggtgccatggttctgacccgtcagggtgtcccggttcttgccgagaccgccgccaaggccaaggacggtgtcaagaagggcgcttacgttctggtcgacaccgagggcactccggacgtcatcctcatggcttccggttccgaggtccagtgggctgtggctgccgccaagaccctggccggcgagggcgtcaaggctcgcgtcgtgtccgtgccgtccatggaatggttcgaggagcaggacgccgagtacaaggaggccgtgcttccggccgctgtcaaggctcgtgtctccgtcgaggccggcgttgccatgccgtggtacaagtacctcggctcctacggcaagcccgtctccatcgagcagttcggcctgcagggcgacggcgctcagaacatgatcgacctcggcatcaccgccgagcacgtggtggaagccgccaaggcctccatcgccgaagtcgaagccgccaagtga

SEQ ID NO: 9715 - protein, 702 aa, Bifidobacterium longum NCC2705
MTEFKETELDERAIKMAKVLSADAVEKAGSGHPGSPISLAPVAYTLYQHFIKHDPNDPNWEGRDRFILSGGHASLTQYVQLYFSGYGVTLDDLKNFRGGAATRTPGHPEYGLTPGIEMTTGPLGQGFASAIGFAYGERFQRGLLDPETPKEDSPFYHKIWAICGEGDIEEGISGEAASLAANQKLGNLTVIFDANRIQIEGDTNLVLAEDVLKRFQAYGWYTDEFSFIQPDGSYKEDIEGLADVIAKAEKAAPDQPKLIKVHSLIAWPTPGKTNDPSSHGSKLGTEAVAGLKEALGYDPEENFHVDEEALAHARKVAERGLEAHKEWDEKFDAWRKANPDKAALYDRLKAGELPEGFDKALDDLEATFEVGKGVATRGASGSVLNAIAAVMPELWGGSADLGGSNKTDLKGAATFAPAECATKQWPNCNEFGRQLHFGVREFTMGCITNGILLGSHTRPFGGTFFMFSDYERSAVRLAALMEIPNLYIWSHDSVAVGEDGPTHQPVEHLASFRAIPQLEVIRPADAFETAEAYRYFFEKKNTLPGAMVLTRQGVPVLAETAAKAKDGVKKGAYVLVDTEGTPDVILMASGSEVQWAVAAAKTLAGEGVKARVVSVPSMEWFEEQDAEYKEAVLPAAVKARVSVEAGVAMPWYKYLGSYGKPVSIEQFGLQGDGAQNMIDLGITAEHVVEAAKASIAEVEAAK

SEQ ID NO: 9716 - DNA, 1992 bp, Brucella suis 1330
  CDS (1)..(1992): transl_table=11
atgaccaataccgacaaacaaaaccagatggctaatgcaatccgcttcctctccatggatgcggtggagaaggccaattcgggccaccccggcctgccgatgggcgcagccgatatagcgacgacgctttatacccgtttcctctcgcacgacccgaaaaacccgcactggccggaccgcgaccgtttcgtgctttccgccggccacggctcgatgctgctctattcgctgctctatctttcgggctacgaagacatcaccatcgatgaaatcaagaaattccgccagcttggcagccgcaccgcgggccaccctgaatatggccatgccgctggcatcgaaacgacgaccggcccgctcggacagggtattgccaatgccgtcggcatggcgatttccgaacgcatcctgaatgcccagttcggtgacagcctcgtcaatcattatacctatgcgctcgtcggcgacggctgcctcatggaaggcatcagccaggaagccatcgcgcttgcgggacacctgaagctcaacaagctgatcgtgctctgggatgacaacaacatctcgatcgacggcccgatcacgctttccgacaataccgatcagccagcccgtttcgccgcttccggctggaacaccatggctgtcgacggtcacgaccaggatgcgattgccaaggccatcgaactggcccgggtctccgaccgcccgacgctgatcgcctgcaagacgaccatcggtttcggtgctccgaacaaggctggcaccaacaaggtgcacggctcaccgcttggcgcggaagaaatcgccgccacgcgcaaggcgctgggctggtcttccgaacctttcgtcgttccggctgaagttctggacgcctggcgcgtcgcgggcctcaacgccgccaagaagcgcctggaatgggaaaagcgcctttctgccgtagaagcggaaacccgcgccgaattcgagcgccgcatgcgtggcgagctgccttccggtttcgatgctgcaatcgtcgaatacaagaagaagctttccgccgacaagccgaaggttgccacccgcaagtcgtccgaaatggcgctggaagtcatcaacggtgtcgtgccggaaaccgtaggcggctctgccgaccttaccggctccaacaacaccaagaccagccagaccaaggctgtcacgccggaaaactatgatggccgttatatccattacggcatccgcgagcttggcatggctgcagcgatgaacggcatcacgctgcatggcggcctgatcccctattccggcaccttcctgtgcttctccgattatgcgcgtccggccatgcgtctttcctcgctgatgggcattcgcgtcgtctatgtgatgacgcatgattccatcggtcttggcgaagacggcccgacccatcagccggtcgaacatctcgccgcactgcgcgccattccgaaccacaatgtcttccgtccggcagacgctgtggaaacggcggaatgctggcagcttgcgctgcattcaaggaagacgccatccacgctggctttgacccgccagaacctgccgacggtccgcaccgagcatcgcgaagaaaacctttgcgctttcggcgcctacgaacttgccgccgccagcagcgacgccaaggtgacgatcttcgcaacgggctcggaagtggaaattgcgctgaaggcccgcgatcttctggaaggcaagggcattgccacccgcgtcgtttcggtgccgtgctttgagcttttcgagcagcagagcgacgcctacaaggaagcgaccattggcgatgcgccaatcaagcttgccattgaagcggccatctcgctcggctgggaacgcttcatcggcgaaaacggcatcttcatcggcatgaagggcttcggcgcttcgggtgagatcaatgatctctacaagcatttcggcatcacggcggaacatgccgtcgaagctgcggaaaagaagctcaacgctgcatga

SEQ ID NO: 9717 - protein, 663 aa, Brucella suis 1330
MTNTDKQNQMANAIRFLSMDAVEKANSGHPGLPMGAADIATTLYTRFLSHDPKNPHWPDRDRFVLSAGHGSMLLYSLLYLSGYEDITIDEIKKFRQLGSRTAGHPEYGHAAGIETTTGPLGQGIANAVGMAISERILNAQFGDSLVNHYTYALVGDGCLMEGISQEAIALAGHLKLNKLIVLWDDNNISIDGPITLSDNTDQPARFAASGWNTMAVDGHDQDAIAKAIELARVSDRPTLIACKTTIGFGAPNKAGTNKVHGSPLGAEEIAATRKALGWSSEPFVVPAEVLDAWRVAGLNAAKKRLEWEKRLSAVEAETRAEFERRMRGELPSGFDAAIVEYKKKLSADKPKVATRKSSEMALEVINGVVPETVGGSADLTGSNNTKTSQTKAVTPENYDGRYIHYGIRELGMAAAMNGITLHGGLIPYSGTFLCFSDYARPAMRLSSLMGIRVVYVMTHDSIGLGEDGPTHQPVEHLAALRAIPNHNVFRPADAVETAECWQLALHSRKTPSTLALTRQNLPTVRTEHREENLCAFGAYELAAASSDAKVTIFATGSEVEIALKARDLLEGKGIATRVVSVPCFELFEQQSDAYKEATIGDAPIKLAIEAAISLGWERFIGENGIFIGMKGFGASGEINDLYKHFGITAEHAVEAAEKKLNAA

SEQ ID NO: 9718 - DNA, 2004 bp, Shigella flexneri 2a str. 301
  CDS (1)..(2004): transl_table=11
atgtcccgaaaagaccttgccaatgcgattcgcgcactcagtatggatgctgtacaaaaagccaattctggtcatcccggcgcgccgatgggcatggctgatattgccgaagtgctgtggaacgattttcttaaacataatcctaccgacccaacctggtatgatcgcgaccgctttattctttccaacggtcacgcgtcgatgctgctctacagtttgctacatctgaccggttacgacctgccgctggaagaactgaagaacttccgtcagttgcattcgaaaaccccaggccacccggagattggctatacgccaggcgttgaaaccaccaccggcccgcttggacaaggtttggcgaacgccgtcgggctggcgatagcagagcgtacactggcggcgcagtttaaccagccagaccatgagatcgtcgatcacttcacctatgtgtttatgggcgacggctgcctgatggaaggtatttcccacgaagtctgttcgctggcaggcacgctgggactaggcaagctgattggtttttacgatcacaacggtatttccatcgacggtgaaacagaaggctggtttaccgacgatacggcaaaacgttttgaagcctatcactggcatgtgatccatgaaatcgacggtcacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttccccgacggatgagcggtggtttaccgaaggactgggagaaaacgactcagaaatatatcaatgagttacaggcaaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccggcgggcaactacattcactacggggtgcgtgaatttggcatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggcctgggcgaagatggtccgacgcaccaggctgttgagcaactggccagcctgcgcttaacgccaaatttcagcacctggcgaccgtgcgatcagatggaagcggcggtgggctggaagctggcggttgagcgccacaacggaccgacggcactgatcctctcaaggcagaatctggcccaggtggaacgtacgccggatcaggttaaagagattgctcgtggcggttatgtgctgaaagacagcggcggtaagccagatattattctgattgccaccggttcagagatggaaattaccctgcaagcggcagagaaattagcaggagaaggtcgcaatgtacgcgtagtttccctgccctcgaccgatattttcgacgcccaggatgaggaatatcgggagtcggtgttgccttctaacgttgcggctcgcgtggcggtggaagcaggtattgccgattactggtacaagtatgttggtctgaaaggggcaattgtcgggatgacgggttacggggaatctgctccggcggataagctgttcccgttctttggctttaccgccgagaatattgtggcaaaagcgcataaggtgctgggagtgaaaggtgcctga

SEQ ID NO: 9719 - protein, 667 aa, Shigella flexneri 2a str. 301
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFPRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQMEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 9720 - DNA, 1995 bp, Shewanella oneidensis MR-1
  CDS (1)..(1995): transl_table=11
atgtcttcccgtaaagtactcgccaacgcaatccgtgcgttaagtatggatgcagttcaaaaagcaaactcaggccaccctggcgccccaatgggcatggcagatattgctgaagtgctgtggaatgatttccttaagcacaacccgaacaatccgaaatgggtagatagagatcgctttatcctctctaacggtcacggctctatgctgatctactctttattacacctcactggctacgatctgccaatggatgaactgaagcaattccgtcagttacattctaaaaccccaggtcacccagaatatggttacaccccaggtgttgaaaccacaacgggtccattaggtgcggggatcagcaacgctgtgggtatggcgattgcagaaaaaaccttagcggcacagtttaaccgtgaaggtcacgagattgttgaccactacacttactgcttcctcggcgatggttgcttgatggaaggtatttcccacgaagcttgttctctggcaggtaccttaggcttaggcaaactgatcgcattttgggatgacaacggcatctctatcgacggccatgttgaaggctggtttactgatgacacgccaaaacgtttcgaatcatatggctggcacgtaattgctaacgtcgatggtcacgacagcgatgcgattcgcgcggctattgaagcggcaaaagccgtgaccgacaaaccaaccatgatctgctgcaaaaccattatcggttttggttcgccaaacaaatctggcagccacgattgccacggcgcaccattaggtgatgcggaaatcgccgctgcccgtgaattcttaggctggccacatgcgccattcgaaatccctgccgacgtatacgcaggttgggatgccaaagacgcgggagctgcccgtgaagccgcatggaacgacaagtttgccgcttatgctgctgcttacccagaattagctgctgaatacgagcgtcgcgttctgaaaggtgaattaccagccgatttcgaagctaaagcccaagcctttatccaagaatgccaagccaaaggcgaaggtattgcgagccgtaaagcgtcacaaaacgcgattgcagctttcggtgcgattctacctgaactgttaggcggcagtgctgacttagcaggttctaacctgaccttgtgggcaggttctaaagggattcaagatgatccagcgggtaactacgtgtactacggtgtgcgtgagtttggtatgagtggcatcatgaacggtgtgtctctgcacggtggtttcatcaactacggcgcgactttcatgatgtttatggaatacgcacgtaacgctgtacgtatgtctgcactgatgggtattcaaaacatcttcgtttacacccatgactctatcggtcaaggtgaagacggccaactcaccaacccgtttgagcaattagctaacttgcgtatgacgccaaacatggcggtatggcgcccctgtgatgcggcagaaaccgcagttgcgtggaaagcagcaattgaacgtcgtcatgctcctacatcactgatcttcagccgtcaaaacctgaaggctcaagcacgtactgctgagcaattagccaatgtggcaaaaggcgcttacgtactgcaagattgtgcagctacgcctgagtacatcctgatcgctaccggtagcgaagtacaattagcgatggaagcagctgcgactctgactgaacaaggcaagcaagtgcgtgtggtttctatgccatcaaacactgagtttgataagcaagatgcagcgtacaaagaatctgtactgccaaaagccgtgactaagcgtatcgctattgaagcggcccatactgacttctggtacaagtatgttggtttcgaaggcacggttgtgggcatgaccaccttcggtgagtctgcgccaggcaacgtgctactgaagcacttcggtttcaccgttgaaaatgtgctgaacgctgcaaaatcactaggctaa

SEQ ID NO: 9721 - protein, 664 aa, Shewanella oneidensis MR-1
MSSRKVLANAIRALSMDAVQKANSGHPGAPMGMADIAEVLWNDFLKHNPNNPKWVDRDRFILSNGHGSMLIYSLLHLTGYDLPMDELKQFRQLHSKTPGHPEYGYTPGVETTTGPLGAGISNAVGMAIAEKTLAAQFNREGHEIVDHYTYCFLGDGCLMEGISHEACSLAGTLGLGKLIAFWDDNGISIDGHVEGWFTDDTPKRFESYGWHVIANVDGHDSDAIRAAIEAAKAVTDKPTMICCKTIIGFGSPNKSGSHDCHGAPLGDAEIAAAREFLGWPHAPFEIPADVYAGWDAKDAGAAREAAWNDKFAAYAAAYPELAAEYERRVLKGELPADFEAKAQAFIQECQAKGEGIASRKASQNAIAAFGAILPELLGGSADLAGSNLTLWAGSKGIQDDPAGNYVYYGVREFGMSGIMNGVSLHGGFINYGATFMMFMEYARNAVRMSALMGIQNIFVYTHDSIGQGEDGQLTNPFEQLANLRMTPNMAVWRPCDAAETAVAWKAAIERRHAPTSLIFSRQNLKAQARTAEQLANVAKGAYVLQDCAATPEYILIATGSEVQLAMEAAATLTEQGKQVRVVSMPSNTEFDKQDAAYKESVLPKAVTKRIAIEAAHTDFWYKYVGFEGTVVGMTTFGESAPGNVLLKHFGFTVENVLNAAKSLG

SEQ ID NO: 9722 - DNA, 1977 bp, Streptococcus mutans UA159
  CDS (1)..(1977): transl_table=11
atgtcagatttatcggttaatgccattcgctttttaggggtagatgctattgaaaagtctaagtcgggtcacccgggtgttgtcatgggcgctgccccaatggcttacagtctatatactaagcatttacgtgttaacccaagtcagccaaattggattaaccgtgaccgttttgttttgtcagctggtcatggctcaatgcttttatatgctctcttgcacttgtcgggatttgaagatatttctattgatgaaatcaaaaatttccgtcagtggggctctaaaacaccggggcaccctgagtatggccataccgtaggtgttgatgtgacaacaggccctcttggccaagggatttcaatggctgttggtttggctcaagctgaacgtttcttagctgctaaatacaatcgtgaaggctaccctatttttgatcactatacttatgttattgccggtgatggtgattttatggaaggtgtttctggcgaagcgtcatcctatgctgccaaacaaaatttggataaactgattgttctttatgattctaatgatatttgtttggatggtgaaaccaatgatgcgttcactgaaagtgttcgtgcacgatatgatgcttatggatggcatacaatcttagttgaagatggcaataatattgaagctattggacttgctattgaagaagcaaaggcagctggcaaaccttctcttattgaaattaaaactgtgattggctacggtgctccaactaaaggcggtaccaatgctgttcatggtgcaccacttggagctgaagaagcagctgctactcgtaaggctctcaattggggttatgctccttttgaagttcctcaagaggtttatgatgatttcaaagaaaatgttgcggatcgtggtgaagctgcttacgatgcttggtcaaatcttgttggagaatatcgacaagcttatcctaaagaggcgcgtgaagtggatgcaattattgatggaaaagatcctgtggaaatcaaagaagctgattttccagtctacgaaaatggtttctctcaagcaacgcgtaattctagtcaagatgccatcaatgctgcggcagacgtactacctaactttcttggaggatctgctgatcttgcgcattctaacatgacttacattaaagcagatgggcttcaagatgctgatcatccgcttaaccgtaacatccagtttggtgttcgtgaatttgctatgggtactgtcttaaatggtatggctcttcatggcggactgcgtgtttatggcggtaccttctttgtcttttcagactatctcaaagcagctgttcgtttgtcagcccttcaaggagtaccagtaacttatgtctttacccacgattcgattgccgttggtgaagatggccctactcatgaaccgattgaacacttggcaggtttacgtgccactcctaatttggttgtttttcgcccagctgatgcacgcgaaacacaggcagcatggcattatgctttgacaagccaaaacacaccaacagctcttgttttgacacgtcaaaatcttgatgttgaagctggttcaagctttacttcagttgctaagggagcttatgttacttatgaaacagattctgactttaataccattcttttggcatcaggttctgaagttaacttagcagtcaaagcagctaaggaattggaagcacaaggcgaaaaagtacgtgttgtttctgttccttctacagagctctttgatgagcaatctgctgcctacaaagaagctattttaccaaattcagtacgccgtcgtgtagccattgaaatggcagccagccaaccatggtataaatatgttggtcttgatggtgcggttatcggtattgataaatttggagcatcagctcctgctgctcaagtcattgaaaattatggctttacagtagataatgtggttaaagttgttaaggaactgaaatag

SEQ ID NO: 9723 - protein, 658 aa, Streptococcus mutans UA159
MSDLSVNAIRFLGVDAIEKSKSGHPGVVMGAAPMAYSLYTKHLRVNPSQPNWINRDRFVLSAGHGSMLLYALLHLSGFEDISIDEIKNFRQWGSKTPGHPEYGHTVGVDVTTGPLGQGISMAVGLAQAERFLAAKYNREGYPIFDHYTYVIAGDGDFMEGVSGEASSYAAKQNLDKLIVLYDSNDICLDGETNDAFTESVRARYDAYGWHTILVEDGNNIEAIGLAIEEAKAAGKPSLIEIKTVIGYGAPTKGGTNAVHGAPLGAEEAAATRKALNWGYAPFEVPQEVYDDFKENVADRGEAAYDAWSNLVGEYRQAYPKEAREVDAIIDGKDPVEIKEADFPVYENGFSQATRNSSQDAINAAADVLPNFLGGSADLAHSNMTYIKADGLQDADHPLNRNIQFGVREFAMGTVLNGMALHGGLRVYGGTFFVFSDYLKAAVRLSALQGVPVTYVFTHDSIAVGEDGPTHEPIEHLAGLRATPNLVVFRPADARETQAAWHYALTSQNTPTALVLTRQNLDVEAGSSFTSVAKGAYVTYETDSDFNTILLASGSEVNLAVKAAKELEAQGEKVRVVSVPSTELFDEQSAAYKEAILPNSVRRRVAIEMAASQPWYKYVGLDGAVIGIDKFGASAPAAQVIENYGFTVDNVVKVVKELK

SEQ ID NO: 9724 - DNA, 1986 bp, Streptococcus agalactiae NEM316
  CDS (1)..(1986): transl_table=11
atgacatttgacaccattgatcaattagcggttaatacagtccgcacgctttctattgatgctatccaagcagcaaattctgggcacccaggtcttcctatgggagctgcgcctatggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaattccgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacgtctcaatcatttacagaagatgttaaagggcgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatggatgggaatatccagactttactgttcctgctgaagttgtagctcgatttgcctcagatcttcaagcgcgtggtgcgaaggcagaagaggcatggaatgatctttttgctaaatatgaagttgagtatccagaattagcagctgaatacaaagaagcttttgctggccaagctgagacagttgaattgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaattacgctgggcgtaacatttggtttggtgtacgtgaatttgcaatggctgctgcaatgaatggaattgcgcttcacggtgggactcgtgtttatgggggtacattctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactttaa

SEQ ID NO: 9725 - protein, 661 aa, Streptococcus agalactiae NEM316
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYGWEYPDFTVPAEVVARFASDLQARGAKAEEAWNDLFAKYEVEYPELAAEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 9726 - DNA, 2103 bp, Corynebacterium efficiens YS-314
  CDS (1)..(2103): transl_table=11
ttgaccaccttgacgctgtcacctgacctccaggcgctcaccgaacgtaagtacccctccgattggtccgatgtggacaccagggccgtggacaccgtccgcgtcctggctgtggatgcggtggagaactgcggatccggtcaccccggtaccgcaatgagtctcgcccccctcgcctacaccctctaccagcgcgtcatgaacgtcgacccgaccgacaccaactgggccggacgcgaccgtttcgttctctcctgtggccacacctccctcacccagtacatccagctctacctgggtggtttcggtctcgagatggatgacctcaaggccctgcgcacctggggttccctcaccccgggccacccggagtaccgccacaccaacggtgtggagatcaccaccggccccctcggccagggtctcgcctcggcagtgggcatggctatggcagcccgccgtgaacgcggcctgttcgatccagaggcaccggagggtgagtcccccttcgaccaccacatcttcgtcatcgcctccgacggtgatctccaggagggtgtcaccgccgaggcctcctccctcgccggaacccagcagctgggtaacctcatcgtcttctgggatgacaaccgcatctccatcgaggacaacaccgagatcgccttcaccgaggatgtcgtcgcccgttacaaggcctacggctggcagaccatcgagatcgagggcggcgaggatgtcgtcgccatcgaagccgccgtcgaggaggcgaagaaggacaccacccgcccgaccttcatccgtctgcgcaccgtcatcgcctatcccgcaccgaacgcgatgaacaccggtgcctcccacggtgccgccctcggtgccgaggaggtcgcggccatcaaggagatcctcgacttcgatccggagaagcacttccacatcgatgatgaggtcatcgcgcacacccggaagctcgccgagcgcgccgcggagaagaaggtcgcctggcaggagaagtacgaccgctgggccgccgccaacccggaggccaaggcactgcatgagcgtctgatcacccgcgcactgcccgagggcttcgcggacaacctccccacctgggaaccggatgccaagggcattgccacccgtaaggcctccgaggctgtcctccaggagctgggcaagaccctgcccgagctctggggtggttccgccgacctggcaggctccaacaacaccatcatcaagggcgagccgtccttcggtcctgaatccatctccaccgagacctggactgccgagccgtatggccgcaacctccacttcggtatccgtgagcacgccatgggcgcgatcatgaacggcatcgccctccacggcggcacccgcccgtacggtggcaccttcctcatcttctccgactacatgcgtccggcagtccgtctcgccgccctccagggcactgacgcctactatgtctggacccatgactccatcggtctcggcgaggatggcccgacccaccagcccgtggagaccctggccgccctgcgcgcgatcccgaacctgtccatcctgcgtccggccgacgccaacgagacctccgccgcatggcgtgccgctctcgaatacaaggagggaccgaagggtctggcactgacccgccagaatgtgcccgtgctggaaggcacgaaggaaaaggccgccgagggtgtgcgccgtggcgcctatgtcctggtcgagggatccaagcagaccccggacatcatcctcatgggctccggttccgaggtccagatcgcggtggaggcagccggcatcctcgaatccgagggtgtcgccgcccgcgtggtctccgtgccctgcatggactggttcgcggagcaggacgccgagtacatcgaatccgtcctgccctccgaggtcaccgcccgcgtctccgtcgaggccgccatcgccatgccgtggtaccgctggctcggcaccaggggtaaggccgtgtccctggagcatttcggcgcctccgccgactaccagaccctgtttgagaagttcggtatcaccaccgaggctgttctcgaggcagcacgcgccaccctcgacgcgtag

SEQ ID NO: 9727 - protein, 700 aa, Corynebacterium efficiens YS-314
MTTLTLSPDLQALTERKYPSDWSDVDTRAVDTVRVLAVDAVENCGSGHPGTAMSLAPLAYTLYQRVMNVDPTDTNWAGRDRFVLSCGHTSLTQYIQLYLGGFGLEMDDLKALRTWGSLTPGHPEYRHTNGVEITTGPLGQGLASAVGMAMAARRERGLFDPEAPEGESPFDHHIFVIASDGDLQEGVTAEASSLAGTQQLGNLIVFWDDNRISIEDNTEIAFTEDVVARYKAYGWQTIEIEGGEDVVAIEAAVEEAKKDTTRPTFIRLRTVIAYPAPNAMNTGASHGAALGAEEVAAIKEILDFDPEKHFHIDDEVIAHTRKLAERAAEKKVAWQEKYDRWAAANPEAKALHERLITRALPEGFADNLPTWEPDAKGIATRKASEAVLQELGKTLPELWGGSADLAGSNNTIIKGEPSFGPESISTETWTAEPYGRNLHFGIREHAMGAIMNGIALHGGTRPYGGTFLIFSDYMRPAVRLAALQGTDAYYVWTHDSIGLGEDGPTHQPVETLAALRAIPNLSILRPADANETSAAWRAALEYKEGPKGLALTRQNVPVLEGTKEKAAEGVRRGAYVLVEGSKQTPDIILMGSGSEVQIAVEAAGILESEGVAARVVSVPCMDWFAEQDAEYIESVLPSEVTARVSVEAAIAMPWYRWLGTRGKAVSLEHFGASADYQTLFEKFGITTEAVLEAARATLDA

SEQ ID NO: 9728 - DNA, 1998 bp, Pseudomonas putida KT2440
  CDS (1)..(1998): transl_table=11
atgcccagccgtcgtgaacgtgccaacgccattcgtgccctcagcatggatgccgtgcaaaaggccaacagcggccacccaggtgcccccatgggcatggcggatatcgccgaagtgctttggcgcgactacctgaagcacaacccgagcaacccgagcttcgccgaccgtgaccgcttcgtgctgtccaacggccacggctcgatgctgatctactcgctgctgcacctgaccggctacgacgtcaccatcgatgacatcaaaggcttccgccaactgcacagccgcaccccgggccacccggaatacggctacaccccaggcgttgaaaccaccaccggcccgctcggccagggtatcgccaacgccgtgggcttcgccctggccgaaaaagtactggctgcccagttcaaccgtgacggccacaatatcgtcgaccacaacacctatgtgttcctcggcgacggctgcatgatggaaggcatctcccatgaagtcgcctcgctggccggcaccctgggcctgaacaagctgatcgccttctacgatgacaatggcatctccatcgacggcgaagtgcacggctggttcaccgacaacaccccggcgcgcttcgaagcctacaactggcaggtgatccgcaacgtcgacggccacgatgccgaagaaatcaagatggccatcgagaccgcccgcaagagcgatcgcccgaccctgatctgctgcaagaccaccatcggtttcggttcgccgaacaagcagggcaaggaagactgccacggtgccccgctgggcaacgacgaaatcgccctgacccgccaggccctgaactggaaccacggcccgttcgaaatcccggccgacatctacgccgagtgggatgccaaggccgccggtgccaaggttgaagccgagtggaaccagcgcttcgacgcctacgccaaggcctacccggagctggctgccgagttcaagcgccgtgccagcggcgagctgccggccgacttcagcgaaaaggcccaggcctacatcaacgaagtggctgccaaaggcgaaaccatcgccagccgcaaggccagccagaacgccctgaacgccttcggcccgctgctgcccgagttcctcggcggttcggcggacctggccggctccaacctgaccctgtggaaaggttgcaagggcgtcgaagccaatgacgccagcggcaactacgtgttctacggcgtgcgcgagttcggcatgaccgccatcatgaacggcgttgccctgcacggtggcctggtgccttacggcgcgaccttcctgatgttcatggaatacgcccgcaacgccgtgcgcatgtcggccctgatgaagcagcgcgtgatccacgtgtacacccacgactccatcggtctgggcgaagacggcccgacgcaccagccgatcgagcagctgaccagcctgcgcagcaccccgaacctggacacctggcgcccggccgacgcggtggaatccgccgtgtcctggaaaaacgccctggagcgcaaggacggcccatcggcgctgatcttctcgcgccagaacctgcagcaccaggatcgcgatgcccagcagatcgccgacatcagccgcggtggttatgtgctcaaggactgcgccggcgagcctgaactgattctgatcgccaccggttccgaagtgggcctggctgttcaggccttcgacaagctgaccgagcaaggccgcaaggtgcgcgtggtttccatgccatgcaccagcgtgttcgatgcccaggacgctgcctacaagcagtccgtgctgccgctggaagtcggtgcgcgcatcgccatcgaagctgcccacgccgacttctggtacaagtacgtcggcctggaaggtcgtatcatcggcatgaccacctacggtgagtcggcgccggcttcggcattgttcgaagagtttggcttcaccctggagaacatcctcggtactgccgaagagctgctggaagactga

SEQ ID NO: 9729 - protein, 665 aa, Pseudomonas putida KT2440
MPSRRERANAIRALSMDAVQKANSGHPGAPMGMADIAEVLWRDYLKHNPSNPSFADRDRFVLSNGHGSMLIYSLLHLTGYDVTIDDIKGFRQLHSRTPGHPEYGYTPGVETTTGPLGQGIANAVGFALAEKVLAAQFNRDGHNIVDHNTYVFLGDGCMMEGISHEVASLAGTLGLNKLIAFYDDNGISIDGEVHGWFTDNTPARFEAYNWQVIRNVDGHDAEEIKMAIETARKSDRPTLICCKTTIGFGSPNKQGKEDCHGAPLGNDEIALTRQALNWNHGPFEIPADIYAEWDAKAAGAKVEAEWNQRFDAYAKAYPELAAEFKRRASGELPADFSEKAQAYINEVAAKGETIASRKASQNALNAFGPLLPEFLGGSADLAGSNLTLWKGCKGVEANDASGNYVFYGVREFGMTAIMNGVALHGGLVPYGATFLMFMEYARNAVRMSALMKQRVIHVYTHDSIGLGEDGPTHQPIEQLTSLRSTPNLDTWRPADAVESAVSWKNALERKDGPSALIFSRQNLQHQDRDAQQIADISRGGYVLKDCAGEPELILIATGSEVGLAVQAFDKLTEQGRKVRVVSMPCTSVFDAQDAAYKQSVLPLEVGARIAIEAAHADFWYKYVGLEGRIIGMTTYGESAPASALFEEFGFTLENILGTAEELLED

SEQ ID NO: 9730 - DNA, 2004 bp, Escherichia coli CFT073
  CDS (1)..(2004): transl_table=11
atgtcccgaaaagaccttgccaatgcgattcgtgcactcagtatggatgcggtacaaaaagccaattctggtcatcccggcgcgccgatgggcatggctgatattgccgaagtgctgtggaacgattttcttaaacataaccccaccgacccaacctggtatgaccgtgaccgctttattctttccaacggtcacgcgtcgatgctgctctacagtttgctgcatctgaccggttacgacctgccactggaagaactgaagaacttccgtcagttgcattcgaaaacccctggtcacccggaaatcggctatacgccaggtgttgaaaccaccaccggtcctcttggacaaggtttggcgaacgccgtcgggctggcgatagcagagcgtacgctggcggcgcaatttaatcagccggatcatgaaattgtcgatcacttcacctatgtgtttatgggcgacggctgcctgatggaaggtatctctcacgaagtctgttcgctggcgggcacgctggggctgggcaagctgattggtttttacgatcacaacggtatttccatcgacggtgaaaccgaaggctggtttaccgacgatacggcaaaacgttttgaagcctatcactggcatgtgatccatgaaatcgacggccacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccgctgggggaagaagaagtagctctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgtcggatgagcggcggtttgccgaaggactgggagaaaacgactcagaaatatatcaatgagttgcaggcgaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccggcgggcaactacattcactacggggtgcgtgaatttggtatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggtctgggcgaagatggtccgacgcaccaggctgttgagcaactggctagtctgcgcttaacgccaaatttcagcacctggcgaccgtgcgatcaggtggaagcggcggttggctggaagctggcggttgagcgccacaacggaccgacagcactgatcctctcaaggcagaatctggcacaggtagaacgaacaccggatcaggttaaagagattgctcgtggcggttatgtgctgaaagacagcggcggtaagccagatattattctgattgccaccggttcagagatggaaatcaccctgcaagcggcagagaaattagcgggagaaggtcgcaatgttcgcgtagtttccctgccctcgaccgatattttcgatgcccaggatgagaaatatcgggagtcggtactgccttcaaatgtttctgcccgcgtggcagtagaagcgggtattgccgattactggtacaaatatgttggcctgaaaggggcaattgtcgggatgacaggttatggggaatcagctccggcggataagctgttcccgttctttggctttaccgccgagaatattgtggcaaaagcgcataaggtactgggagtgaaaggtgcctga

SEQ ID NO: 9731 - protein, 667 aa, Escherichia coli CFT073
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEKYRESVLPSNVSARVAVEAGIADYWYKYVGLKGAIVGMTGYGESAPADKLFPFFGFTAENIVAKAHKVLGVKGA

SEQ ID NO: 9732 - DNA, 1992 bp, Escherichia coli CFT073
  CDS (1)..(1992): transl_table=11
atgtcctcacgtaaagagcttgccaatgctattcgtgcgctgagcatggacgcagtacagaaagccaaatccggtcacccgggtgcccctatgggtatggctgacattgccgaagtcctgtggcgtgatttcctgaaacacaacccgcagaatccgtcctgggctgaccgtgaccgcttcgtgctgtccaacggccacggctccatgctgatctacagcctgctgcacctcaccggttacgatctgccgatggaagaactgaaaaacttccgtcagctgcactctaaaactccgggtcacccggaagtgggttacaccgcaggtgtagaaaccaccaccggtccgctgggtcagggtattgccaacgcagtcggtatggcgattgcagaaaaaacgctggcggcgcagtttaaccgtccgggccacgacatcgtcgaccactacacctacgccttcatgggcgacggctgcatgatggaaggcatctcccacgaagtttgctctctggcgggtacgctgaagctgggtaaactgattgcgttctacgatgacaacggtatttctatcgatggtcacgttgaaggctggtttaccgacgacaccgcaatgcgtttcgaagcttacggctggcacgttattcgcgatatcgacggtcatgacgcggcatccatcaaacgcgcagtagaagaagcgcgcgcagtgactgacaaaccgtccctgctgatgtgcaaaaccatcatcggtttcggttccccgaacaaagccggtacccacgactcccacggtgcgccgctgggcgacgctgaaattgccctgacccgcgaacagctgggctggaaatacgcgccgttcgaaatcccgtctgaaatctatgctcagtgggatgcgaaagaagcaggccaggcgaaagaattcgcatggaacgagaaattcgctgcttacgcgaaagcttatccgcaggaagctgctgaatttacccgccgtatgaaaggcgaaatgccgtctgacttcgacgccaaagcgaaagagttcatcgctaaacttcaggctaatccggcgaagatcgccagccgtaaagcgtctcagaatgctatcgaagcgttcgggccgctgttgccggaattcctcggcggttctgcagacctggcgccgtctaacctgaccctgtggtctggttctaaagcaatcaacgaagatgctgcgggtaactacatccactacggtgtacgtgaattcggtatgactgcgattgccaacggtatctccctgcacggtggtttcctgccgtatacctcaaccttcctgatgttcgtggaatacgcacgtaatgccgtacgtatggctgcgctgatgaaacagcgtcaggtgatggtttacacccacgactccatcggtctgggcgaagatggcccgactcaccagccggtagaacagatcgcttctctgcgcgtgaccccgaacatgtctacatggcgtccgtgtgaccaggttgaatccgcagtagcgtggaaatacggcgttgagcgtcaggacggcccgactgcgcttatcctctcccgtcagaacctggcgcagcaggaacgtactgaagagcagctggcaaacatcgcgcgcggtggttatgtgctgaaagactgtgctggtcagccggaactgatcttcatcgcgaccggttctgaagttgaactggctgttgccgcctacgaaaaactgactgccgaaggcgtgaaagcgcgcgtggtttccatgccgtctaccgacgcattcgacaagcaggacgcggcttaccgtgaatccgtactgccgaaagcggttaccgctcgtgttgcggtggaagctggcattgctgactactggtacaagtatgttggcctgaacggtgctatcgtcggcatgaccaccttcggtgaatctgctccggcagagcagctgtttgaagagttcggcttcaccgttgacaacgttgttgcgaaagcaaaagcgctgctgtaa

SEQ ID NO: 9733 - protein, 663 aa, Escherichia coli CFT073
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKEFAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQIASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAEQLFEEFGFTVDNVVAKAKALL

SEQ ID NO: 9734 - DNA, 1998 bp, Escherichia coli CFT073
  CDS (1)..(1998): transl_table=11
atgaattcacaattactggctaacgccatccggatgttaagtgttgatgcgatccagaaagcgaactccggtcatccgggcgcgccgatggggatggcggatattgccgaagtggtctggcgtcgtcacctgcgtcataacccaaaaaatccgcagtggtttaaccgcgaccgctatgttcagtcgaacgggcacggttccatgttgatttacgctttgctgcatcttacaggctacgacctgtcgatggatgatattcgcgactttcgtcagctccactcccgcacgccaggtcatccagaatatggttatacgccgggtgttgaaaccaccaccggcccgttggggcagggcgtagctaatgcggtggggatggcgattgcggagaaggcgctggcggcagaatttaacaaaccgggctttaatattgttgatcatcacacatggctatttttgggtgatggctgcctgatggaagggatctcccacgaggcctgtggtcttgcaggaacgctgaagctcggcaatctgattgctatctgggacgataacggtatttcgatcgatggtcacgtagaaggctggtttgctgaagatacggctgcccgttttcgtgcctacggctggcatgtcattgaaggcgttgatggtcacgatccagaagaggtagatgctgcggtgcgtgaagcgaaaagcgtcacggataagcccagtctgctgtgctgcaaaacgattatcggttttggttcgccaaataaagccaacagccacgattgccacggctcggcgctgggtgcagatgaagtggcgctggtgcgtgaacgtctgcaatggccgtatgcccctttcgaaattcctggtgaaatttatgccgcatgggatgcgaccgagaaaggcgcgcaggttcaacaggaatgggatgcactgtttgccgactacgcgaagcagtggccggaactggcggcggagtttactcgtcgcatgaagggtgatttgcctgctggctgggtcgagaatatgcagaaatatgtgcacgatctgcaatcccatccggcggcgctggcaacccgtcaggttagccagaaatgcctcaatcacttcgcagatatgctgccggaactgatgggcggctcggcggacttgtcgccctctaacctgactcgccatcagaaatcggttgatttcaccggagaaaatccggcggggaattacatctcctatggcgtgcgtgaatttggtatgtcggccatcatgaacggtcttgcgctgcatggtgggtttatcccttacggcggtactttcctgatgtttatggaatatgcgcgtaatgcactgcgtatggcggcgctgatgaagatccgctcggtgtttgtttatacccacgataccatcggcctgggcgaagacggcccgacacatcagcccgttgagcaactggcgtcgctgcgtctgacgccgaatatggaaacctggcgcggttgcgatcaggtggaagtggcggtggcctggcaacaggcgattgagcgcaaagatggcccaacgtcgttggtattaacgcgccaacctctggcgcaacagccgcgcaccgctgcacagttggcagagattgcgcgtggtggttatgtactgagtgattgtgacggtcagcctgagatgatcctcatttctgcgggttcagagattgagttagtggtcagcgccgcaaaagcgttaacggaagaagggcgtaaagttcgcgtggtttccctgccgtgtaccgagcgtttcgataatcaggatgcggcgtacaaagagtcggtattgccaaaagctgtacgcaaacgtctggcggtagaagccagcatcgccggattctgggaacgctacgtgggcctgaacggtaaagtgatcggcatgacgagctttggtgagtctgctccggcgaatgtgttgttcaaacactttggttttacgccggaaaatgtcctggcgcaggcgcgtgagctactgaacagctaa

SEQ ID NO: 9735 - protein, 665 aa, Escherichia coli CFT073
MNSQLLANAIRMLSVDAIQKANSGHPGAPMGMADIAEVVWRRHLRHNPKNPQWFNRDRYVQSNGHGSMLIYALLHLTGYDLSMDDIRDFRQLHSRTPGHPEYGYTPGVETTTGPLGQGVANAVGMAIAEKALAAEFNKPGFNIVDHHTWLFLGDGCLMEGISHEACGLAGTLKLGNLIAIWDDNGISIDGHVEGWFAEDTAARFRAYGWHVIEGVDGHDPEEVDAAVREAKSVTDKPSLLCCKTIIGFGSPNKANSHDCHGSALGADEVALVRERLQWPYAPFEIPGEIYAAWDATEKGAQVQQEWDALFADYAKQWPELAAEFTRRMKGDLPAGWVENMQKYVHDLQSHPAALATRQVSQKCLNHFADMLPELMGGSADLSPSNLTRHQKSVDFTGENPAGNYISYGVREFGMSAIMNGLALHGGFIPYGGTFLMFMEYARNALRMAALMKIRSVFVYTHDTIGLGEDGPTHQPVEQLASLRLTPNMETWRGCDQVEVAVAWQQAIERKDGPTSLVLTRQPLAQQPRTAAQLAEIARGGYVLSDCDGQPEMILISAGSEIELVVSAAKALTEEGRKVRVVSLPCTERFDNQDAAYKESVLPKAVRKRLAVEASIAGFWERYVGLNGKVIGMTSFGESAPANVLFKHFGFTPENVLAQARELLNS

SEQ ID NO: 9736 - DNA, 1971 bp, Mycoplasma penetrans HF-2
  CDS (1)..(1971): transl_table=4
atggattatagcaaatatattaatagcattaggttattatctttaaatgctattaaaaaagctaagcaaggacatgttggaatgagcatgtctgcagctactataacttatacattgtttactaaacacattaatatttccagtgttgatccaaaatgaatcaatagagatagatttattttaagtgcaggtcatggttcgttatcaatttattcaatattgcattttagtggattaatctctttagaagagtttaagaaatttaaaaataatagtgaaattgttcctggtcatccagagtatttaaaaaacaattttatagatgcttcaactggccctttaggtcaaggaattggaatggctgttggaaatgcaattgctcaaaagtatattgttaataaatttaaaagtataagtgatttgtttgatcattatgtttatgctttagtaggtgatggagacatacaagaaggtatcagttatgagtctatgagcttagctgggaaattaaaactaaataaactaatagtattgcatgattcaaatgattatcaattggatagttctgtagaaactgtatttaatgaagatttacaaaaaagaatggaatcaatggggtgattttatttaaaagtaaataatgaagttgatgaaattgatttagcaatttcccttgctaaaaaacaggataagccaacttatattgaagttaaaactttaattggatatgggactaaaaatattaattcaaacaaatctcatagtatgagtttatctgaagatgacattgagtatgctaaaacaatttttgatttaaaaaatgaagaattttcttttggtcaaaacatatatgatcacttcaaaactgaagttttaaatagaaataggaaatatgaaaaatgattaaataaatttaaagagtatgaaagagaaaataattcagattttattaagtttaataattatttaaaaagaaactataaaattgaagaaattcttaaaaacattaaattttcaaaaacttcagtagctacaagaaattatgtaaaagatttgatggactgcttaaaaaatcataattcagattttattattgcaggttgtgcagatttagaagctgcaacaaatattaaaataaatgattcagattttaattatgattattcttctaacaatattaaatatggtattagagaatttgcgatgggtgctatcactaatggtatcttgctgcatagttgtttaaaaactatatcaggaacttttttggtttttagtgattatttaaaaagtgctattagattaggaacattaatgagcttacctaacttttatatttttactcatgattcatatcaagtaggaggagatggccccactcatcaacctatagaacaacttgcaatgctaagaagtattccaagagttaatgtatttagaccatgtgatgaaactgaatttttagctgcttcttataaggctttaaaatcaacatcagaaactaacattttagttttaactagacaaccattaaaatctaaaattaatacatctttaaaaggaactattaatgatggtggttatgttttagaaagtgatcaaaatcctgatatcacaattgcaggatgtggttctgaaattgatttattgtttgatgttaaacaagatttaaatgatctaaattacaaagttaaaattgtttctattccatcattaaatattttcttaaataataaagaatctaaaataaaagaaatcctaaattctaaatatggtttatttactatagaaccatcttctgatgcttattggtataaactttcttcatatgtaaaatcacatattcattttgaagcaaaagaatatggtaaatcaatggatggtgatgcactatataaagaaaaaggttttaacaaagataatattaaaaatcttattttaaggaagttaataaaatatgacaataactag

SEQ ID NO: 9737 - protein, 656 aa, Mycoplasma penetrans HF-2
MDYSKYINSIRLLSLNAIKKAKQGHVGMSMSAATITYTLFTKHINISSVDPKWINRDRFILSAGHGSLSIYSILHFSGLISLEEFKKFKNNSEIVPGHPEYLKNNFIDASTGPLGQGIGMAVGNAIAQKYIVNKFKSISDLFDHYVYALVGDGDIQEGISYESMSLAGKLKLNKLIVLHDSNDYQLDSSVETVFNEDLQKRMESMGWFYLKVNNEVDEIDLAISLAKKQDKPTYIEVKTLIGYGTKNINSNKSHSMSLSEDDIEYAKTIFDLKNEEFSFGQNIYDHFKTEVLNRNRKYEKWLNKFKEYERENNSDFIKFNNYLKRNYKIEEILKNIKFSKTSVATRNYVKDLMDCLKNHNSDFIIAGCADLEAATNIKINDSDFNYDYSSNNIKYGIREFAMGAITNGILLHSCLKTISGTFLVFSDYLKSAIRLGTLMSLPNFYIFTHDSYQVGGDGPTHQPIEQLAMLRSIPRVNVFRPCDETEFLAASYKALKSTSETNILVLTRQPLKSKINTSLKGTINDGGYVLESDQNPDITIAGCGSEIDLLFDVKQDLNDLNYKVKIVSIPSLNIFLNNKESKIKEILNSKYGLFTIEPSSDAYWYKLSSYVKSHIHFEAKEYGKSMDGDALYKEKGFNKDNIKNLILRKLIKYDNN

SEQ ID NO: 9738 - DNA, 2013 bp, Vibrio vulnificus CMCP6
  CDS (1)..(2013): transl_table=11
atgcactcaggagcagacatgccttctcgtaaacatctcgctaatgcaatccgcgcactcagcatggacggcgtacaaaaagcaaactcaggccacccaggcgcacctatgggtatggcggacatcgctgaagttctttggcgcggccacctaaaccacaacccatcaaaccctgaatgggctgaccgcgaccgtttcgtactgtctaacggccacggctctatgctgatttactcgctactgcaccttagcggttacgagctatctatcgacgacctaaagaacttccgtcaattgcactctaagactccaggtcacccagagtacggctacgcaccgggcatcgaaacaacaactggcccgctaggtcaaggcatcaccaacgcggttggaatggcaatggctgagaaagcgctcgcagcgcagttcaacaaacctggccacgacatcgttgaccacttcacttacgtgttcatgggcgacggctgtctgatggaaggtatctcgcacgaggcatgttctctagcgggtacgctaggccttggtaaactgattgcattctgggatgacaacggcatctctatcgatggtcacgttgaaggctggttctctgacgatacgcctaagcgttttgaagcatacggctggcacgtcatcccagcagtagacggtcacaatgcggaagcgatcaacgcagcaattgaagccgctaaagcagatcctcgcccaactctaatttgtactaagactatcatcggttttggttcaccaaacaaatcgggttcacatgactgtcacggtgcaccactaggcgcggaagaaattgcagcggcacgtgaattcctaggttgggaacaccctgcatttgaaatccctgctgatgtatacgcagagtgggatgcaaaagcagctggcgctgaaaaagaagcggcgtggaacgcgaagttcgatgcgtacgcagcggcttacccaacagaagcagcagagcttaagcgtcgtctaaacggtgaacttcctgcagagtgggaagagaaagcaaaccaaatcattgccgatcttcaagcaaacccagcgaacatcgcatcacgtaaagcatcgcaaaacgcgctagaagcgtttggtaaaatgctgccagaattcatgggcggctctgctgacctagcgccttctaacctcaccatgtggtcgggttctaagtcgctagaagccaacgacttctctggtaactacatccactacggtgtacgtgaattcggtatgactgcgatcatgaacggtatcgcactacacggtggtttcgtaccttacggcgcaaccttcctaatgttcatggaatacgcacgtaacgcaatgcgtatggcggctctgatgaaagtgcaaaacatccaagtgtacacgcacgattctatcggtcttggcgaagatggcccaactcaccaacccgttgagcaaatcgcatcgctacgtctaacgccaaacatgagcacatggcgtccatgtgaccaagtggaatctgcagtggcatggaaactggcgattgaacgtaaagatggtccatcagcactgattttctctcgtcaaaacctagcacagcaaccacgcagcgctgagcaagtggcagacatcgccaaaggtggttacatcctgaaagacagcgatggtaagcctgagctcatcctaatcgcaacgggttcagaagttgagctagcagtgaaagcggcagaacaactaaccgctgaaggtaagaaagtacgtgtggtttcaatgcctgctactgatactttcgacaaacaagacgcggcttaccgtgaagcagtactgccatcagacgtaacggcacgtatcgctatcgaagcgggtattgctgacttctggtacaagtacgttggcttcgacggtcgcatcatcggtatgacgactttcggtgaatcagcaccagcagatcaactgttcgaaatgttcggttttacggtagaaaatgtggtgaacacagcgaaagaacttctcgcgtaa

SEQ ID NO: 9739 - protein, 670 aa, Vibrio vulnificus CMCP6
MHSGADMPSRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKPGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAAAREFLGWEHPAFEIPADVYAEWDAKAAGAEKEAAWNAKFDAYAAAYPTEAAELKRRLNGELPAEWEEKANQIIADLQANPANIASRKASQNALEAFGKMLPEFMGGSADLAPSNLTMWSGSKSLEANDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDTFDKQDAAYREAVLPSDVTARIAIEAGIADFWYKYVGFDGRIIGMTTFGESAPADQLFEMFGFTVENVVNTAKELLA

SEQ ID NO: 9740 - DNA, 2016 bp, Bradyrhizobium japonicum USDA 110
  CDS (1)..(2016): transl_table=11
atgatgcagctcgatgcctcccgtatggcccatacgcaggtcgaccactcccgtatggccaacgcgatccgcggcctttcgatggacgctgtcgagaaggcgaaatcgggccatcccggcctgccgatgggcgccgccgacatcgccacggtgctgttcacgcagttcctgaaattcgacgccgccgcgcccgcctggccggaccgcgaccgcttcgtgctgtcggccggccacggctcgatgctgctctattcgctgctgtacctgaccggcaatgccgacatgacgctggaccagctcaagcaattccgccagctcggcgggctgacgcctggccacccggagaacttccacaccaagggcatcgagaccaccaccggtccgctcggccagggcatctcgaccgcggtcggcatggcgctcgccgagaagatgctcgccgccgagttcggcaagaagatcgtcgatcaccacaccttcgtgctcgcctccgacggcgacctgatggagggcgtgtcgcaggaagcgatcgcgatggccgggcactggaagctcaacaagctgatcgtgctctacgatgacaacggcatctcgatcgacggcccgacctcgatcgccgattccgtcgaccaggtgaagcgcttcaagtccgccggctgggccgccgagaagatcgacggccacgaccaggccgcgatcacggcggccatcacgcgcgcgaagaaatccaacaagccgacgctgatcgcctgccgcaccaccatcggcttcggcgcgccgcacaaggccggcacgtcgaaggtgcacggcgaggcgctcggcgccgaggagctcaaggccgccaaggaaaatctcggcatctcgctcgagccgttctcggtgcccgacgacgtgctgaaagcctggcgcgcggccggcagccgcggcgctgcggctcgccaggaatgggaaggacggctcggcgagctcggcagccgcaagcgcgccgagttcgagcgccgcctgcgccatgagcgtccggcctcgctcgcaaaggcggtgcgcgcgtacaagaaggagctgctggaaaagccgctggttgcggccacccgcaaatcctcggaagcggtgatcgaagtcattgccggcgcgatgccgatggaattcctcgcaggctccgccgacctcaccggctccaacaacaacaaggcgaagtcggcgaccgccttctcggccaagacaccgaagggccgcttcatccactacggcatccgcgagcatggcatggccgccgcgatgaacggcatcttcctgcacggcggcttcgcgccgaacggcgcgaccttcctggtgttcaccgattatgcgcgtccggcgatgcgccttgccgcgctgatgggcacaggtgtcgtctacgtgatgacgcacgattccatcggcctcggcgaagacggcccgacccatcagccggtcgagcatctggccgcgcttcgcgccattccaaacatgcgcgtgttccgtccctgcgactcgatcgaggtcgccgagtgttgggagctcgcgctcaaccgcatcgacggcccgacggtgctggcgctgacgcggcagaacctgccgcagctccgcaccaccgcgccgaacgacaatccttgcgcggccggtgcctacgagctggttccggcgcagggcgaagccaaggcgacgctgttcgcctccggctccgaggtcgaaatcgcggtcgccgcccagaagcagctcgccgagcgcggcatcccgtcacgggtggtgtcggtgccctcgctcgagcttttgttagcgcaaccagaagccaagcgcgccgagatcatcggcaacgcgccggtgaaggtcgcgatcgaggccgcggtgcgctggggctgggatgctgtgatcggccaggatggcgaatttgtcggcatgcattccttcggcgcgagcgcgccggcgaaggacctgtacaagcatttcggcattaccgccgaggctgcggttaacgccgtgctgaaacgcgtttcctga

SEQ ID NO: 9741 - protein, 671 aa, Bradyrhizobium japonicum USDA 110
MMQLDASRMAHTQVDHSRMANAIRGLSMDAVEKAKSGHPGLPMGAADIATVLFTQFLKFDAAAPAWPDRDRFVLSAGHGSMLLYSLLYLTGNADMTLDQLKQFRQLGGLTPGHPENFHTKGIETTTGPLGQGISTAVGMALAEKMLAAEFGKKIVDHHTFVLASDGDLMEGVSQEAIAMAGHWKLNKLIVLYDDNGISIDGPTSIADSVDQVKRFKSAGWAAEKIDGHDQAAITAAITRAKKSNKPTLIACRTTIGFGAPHKAGTSKVHGEALGAEELKAAKENLGISLEPFSVPDDVLKAWRAAGSRGAAARQEWEGRLGELGSRKRAEFERRLRHERPASLAKAVRAYKKELLEKPLVAATRKSSEAVIEVIAGAMPMEFLAGSADLTGSNNNKAKSATAFSAKTPKGRFIHYGIREHGMAAAMNGIFLHGGFAPNGATFLVFTDYARPAMRLAALMGTGVVYVMTHDSIGLGEDGPTHQPVEHLAALRAIPNMRVFRPCDSIEVAECWELALNRIDGPTVLALTRQNLPQLRTTAPNDNPCAAGAYELVPAQGEAKATLFASGSEVEIAVAAQKQLAERGIPSRVVSVPSLELLLAQPEAKRAEIIGNAPVKVAIEAAVRWGWDAVIGQDGEFVGMHSFGASAPAKDLYKHFGITAEAAVNAVLKRVS

SEQ ID NO: 9742 - DNA, 2019 bp, Bradyrhizobium japonicum USDA 110
  CDS (1)..(2019): transl_table=11
atgaacatctccgtccatgccgaagccgacgttacggctgtcgcgcataacgatctcgccaacgccgtccgcttcctcgcggtcgatgccatcgagacatcgcagtccggccatcccggcctgccaatgggcatggccgatgtcgcgaccgtattgttctcgcgtttcctgaagttcgactcggcgcacccgagctggccggaccgcgatcgcttcgtgctttccgcgggccatggctcaatgctgctttatgcgctgctccatctcaccggcggcgctgtcagcctcgacgacatcaaggcgttccggcagtggggctcgaagacgccgggccaccccgaatatggtcacacgccgggcgtcgagaccacgacggggccactggggcaggggattgccactgccgtcggcatggcgctcgccgagcgcatggccaatgcgcggtatggcgatgggctcgttgaccacttcacctatgtcatcgcgggtgacggctgcctgatggaaggcatcagccaggaggcgatctcgcttgccggccatctccggcttggccgcctgatcgtgctgttcgacgacaacggcatctccatcgacgggccgacgtcgcttgcgacatcggacgaccagctcgcgcgcttcgccgcctccggctggtcggtgcgccgcgtcgatgggcacgatcccgaagccgttgcgcaggcgatcgccgaagagcgcgagaccgcaaaaccgtcgctgatcgcctgccgcaccgtcatcggttatggcgccccggaccggcagggcaccgagaaggcccatggcgcgccgctcggcaccgagcagacggcggcggcgcgccgaacgctcggctgggattatcagccgttcgtggtgccgatcccgatcctcaaggcgtggcgcatgatcggacagcgcgggcaggtcgaacgtctcgcctggctcgatcgttacgagagtgcgacgcccgagcagcgcgatttgttcgtcgaaggcaaggtcgtcgctctgccggccgcctatgcgctggccgcggcgaagttacgcgaacgctttgcgagcgagcggccgaagctcgcgacgcggcaggcctcgcaacaggtgctcgacggcatcgccgggacaattccgggcctcgtcggcggctcggcggacctgacccattcgaacctgacccatgccaagccgcagactccggtcacgcgcggcgcgttcgccggcgactatatccactacggcatccgcgagcacggcatggccgctgcgatgaacggcctcgcgctgcacggtggcttcattccctatggcggcacgttcctggcgttctccgactatagccggccggcgatccgccttgccgccttgatgcggctgcgcgtcatccacgtgatgacgcacgactccatcggtctcggagaggacggcccgacgcaccagccggtcgagcatctcgccgcgctgcgcgtgatcccgaacctcctggtgttccgcccggccgacgcggtggagacgctcgaggcctgggactgcgccctagcggcggagcatcgtccctccgtgctctgcctgtcgcggcaagccttgccgacgttccgcagcgatgcgcgcggcagaaaccgagttgcgcgcggtgcctatctcgtggtctcgccggacggcggccgcgatgtgacgctgatggcgaccggctcggaagtctcgatcgcgctggaagccgcccgcctgctcgcgaccgagcacattcgcgcggccgtcgtctcggcgccctgcctcgcgctgttcgaggagcagccggaggattatcgcgccaccgtgctcggcaccgcgccgcgtgtcgggatcgaggcggccgtgctcggcgactggccgcgctggatcggcgccgacggtgaattcgtcggcatgcgcggcttcggcgcctcggcgccggcgccggtgctgtatcgcgaattcggcatcaccccgcaaagcattgcggaagccgcccgccgggcgatcgcccgcaagagccaataa

SEQ ID NO: 9743 - protein, 672 aa, Bradyrhizobium japonicum USDA 110
MNISVHAEADVTAVAHNDLANAVRFLAVDAIETSQSGHPGLPMGMADVATVLFSRFLKFDSAHPSWPDRDRFVLSAGHGSMLLYALLHLTGGAVSLDDIKAFRQWGSKTPGHPEYGHTPGVETTTGPLGQGIATAVGMALAERMANARYGDGLVDHFTYVIAGDGCLMEGISQEAISLAGHLRLGRLIVLFDDNGISIDGPTSLATSDDQLARFAASGWSVRRVDGHDPEAVAQAIAEERETAKPSLIACRTVIGYGAPDRQGTEKAHGAPLGTEQTAAARRTLGWDYQPFVVPIPILKAWRMIGQRGQVERLAWLDRYESATPEQRDLFVEGKVVALPAAYALAAAKLRERFASERPKLATRQASQQVLDGIAGTIPGLVGGSADLTHSNLTHAKPQTPVTRGAFAGDYIHYGIREHGMAAAMNGLALHGGFIPYGGTFLAFSDYSRPAIRLAALMRLRVIHVMTHDSIGLGEDGPTHQPVEHLAALRVIPNLLVFRPADAVETLEAWDCALAAEHRPSVLCLSRQALPTFRSDARGRNRVARGAYLVVSPDGGRDVTLMATGSEVSIALEAARLLATEHIRAAVVSAPCLALFEEQPEDYRATVLGTAPRVGIEAAVLGDWPRWIGADGEFVGMRGFGASAPAPVLYREFGITPQSIAEAARRAIARKSQ

SEQ ID NO: 9744 - DNA, 2061 bp, Xylella fastidiosa Temecula1
  CDS (1)..(2061): transl_table=11
atgaccaaacccacacgccgccagttggccaacgcaatccgtttccttgccgctgatgcagtacaagctgctcattctgggcacccgggcatgccgatgggaatggcagatatcgctgaagttctttggaacgatttcctacgccataaccctaacaacccgaactggtttaaccgtgaccgcttcattctttccaacggtcacggctcgatgttgcaatatgcattgctgcatttaagtggctatgacctgccgttagatgaactcaagcaattccgtcagctgcatagcaaaacagctggtcatcctgagcgtagcgagaccccagggattgagacgactactgggccgcttggtcaggggtttgctaacgcagtgggttttgccttggccgagaaacttctagcgcaacgctacaaccgtccggaacatctcattgtcgatcaccgcacctgggtgttcatgggcgacggctgtctcatggaaggtatctcacatgaagcagccgcgctggcgggtacctggaacttaggcaaattgatttgtttctgggatgacaacaatatttctattgatggcaatactgcgggttggtttaccgaagacactccagcacgattcgaagcctatggttggcatgtaatccgcgatattgatggccatgatgcggaaaaaatcgcaaccgcaatccaagccgccgttgctcaagagaacaagccctcattgctatgctgccgtaccgtgatcggatttggctcaccaaataaagctggtaaagaatcttcgcatggtgccccactaggagcggaggaactggaggccacgcgtaagatgttggattggccatacggcccgttcgagattccgtccgagatttacgatggttggcgtgctaacggcacaggcatgctacgtcaagctgagtgggagcaggcgttcgacaactatgcccgacagtatcctaaggaagcagctgaattaacccggcgctcccacgctgagttacctactgattttctcagccaattggatgcttacattgccaaagttcacgctgtggggccctgcattgcttcccgtaaagcatcgcagatggcgattgaagcatttgcacctttacttcccgagttaattggtggctcggctgacttggcacattccaatctaacgttgtggaaagggagccaaacagttgttggcgacgcccccaacgccaactatgcctattacggcgtacgtgagtttgggatgagtgccatcgcaaatggacttgcattgcatggcggctttatccccttcgacgcgacatttctagtattcagtgattacgcccgcaacgcagtgcgtatgagtgcattgatcccagcacatgtgattcacgtttacacacatgattcaatcggacttggcgaagacggtccaacgcatcagcctgttgaacacttagccgcactgcgctatatcccgaacaatgacgtgtggcgtccctgtgacgcagttgaatctgcagtggcatggaaggcggcgatcactcgcaataacggcccgagctgtttggtgttcagccgccaaaacttgccgcaccaaccgcgccatgatgcacaacttgagcagattgcacgcggtggctatatcttggctgacgcggcgagcagcatcccagacatcattttgatcgcgaccggctcggaagtcagcctagcgatcgaagcgaaaaagacacttgatgcgatgcagctaaaaacacgcgtggtctcgatgccatcgaccaatgtgtttgaacgtcaggaccccacctaccgtgagtcggtcctcccatcgaaagtccacaagcgtgttgcaatagaagctggcgtcactggtttttggtggcaatacgtagggttacatggtgccgtgattggcctggacacctttggtgcatcagccccagcggatgtgttgtacaaacattttaatatcactgcagaacacgtggtcgaagtcgcaaaggcactatgtggaagagctgagacaacactatctcttccgtactatcaccaaatgccgctctccggttag

SEQ ID NO: 9745 - protein, 686 aa, Xylella fastidiosa Temecula1
MTKPTRRQLANAIRFLAADAVQAAHSGHPGMPMGMADIAEVLWNDFLRHNPNNPNWFNRDRFILSNGHGSMLQYALLHLSGYDLPLDELKQFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQAFDNYARQYPKEAAELTRRSHAELPTDFLSQLDAYIAKVHAVGPCIASRKASQMAIEAFAPLLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRNNGPSCLVFSRQNLPHQPRHDAQLEQIARGGYILADAASSIPDIILIATGSEVSLAIEAKKTLDAMQLKTRVVSMPSTNVFERQDPTYRESVLPSKVHKRVAIEAGVTGFWWQYVGLHGAVIGLDTFGASAPADVLYKHFNITAEHVVEVAKALCGRAETTLSLPYYHQMPLSG

SEQ ID NO: 9746 - DNA, 1989 bp, Clostridium tetani E88
  CDS (1)..(1989): transl_table=11
atgaacaaattagatactacagcaattaatactattagaattttatcagcagaagcaatccaaaaatctaactcaggacatccaggcttacctttaggatctgctcctatggcttatactctatgggctaaaaacatgaaacataatcctaaaaatcctaattggactaatagagatagatttgtactatccgcaggacatggatctatgttgatatattctctacttcatttatttaattacgggttaacaatggaagatttaaaggactttagacaatggggaagcaaaactccaggacacccagaatatggtcatactattggagtagaaactactacaggaccgctgggtcaaggtattgcaaatgctgtaggtatggctatggctgaggcatatcttgcagaaaaatttaataagcctggatgcgaattaatagatcattatacatattctcttgtgggagatggatgtttaatggaaggaatatcttctgaagctgcatcccttgcaggaactttaggattagataaattaatagttttatatgattctaataatattacaatagaaggaaatactgacatagcatttacagaagatgttaaaggaagatttgaggcatataactggcaagttataaatgtagaagatggaaatgatgtagaagctatagataaagctataaaagaagcgaaatcagataagaaaagaccaagtattataataattaaaacccaaataggctatggatgtcctgcaaaacaaggtaaatcctctgctcatggagaacctttaggagaagagaatttaaaaataacaagagaattcttaaaatggggtcatgaggaagaattctttgttccagaagaagttagagaatatatgaaggaaaaagttgaagaactatcaaaagaagaagaggaatggaacaaattaaaagaagaatacgataataagtatccagagttagcaaaggaatgggaactttggtttagtggaaaaatagaaaaggatcttttaaatgacgaagatttttggaagtttgaaaagaaaacagcaacaagagcagcctcaggtgatgttattaatagattggcagcggttgtcccaaaccttataggaggatctgctgacttagcaccatctaataagacttatatgaaggataagggagatttttcaaaggaagatagaaaaggagctaatctacactttggagtaagagaacatgcaatggcagctattgctaatggtatgtatttacatggtggactaaaggtatttgtttcaactttctttgttttctcagattatatgaaaccttctatgagattatcagcattaatgaatttaccaataacttatgtattaactcatgatagtataggagttggagaagatggaccaactcatgaaccaattgagcaattagcgtctcttagaagtattccaaatatgacagtatttagaccagctgatgcaaaggaaacagcagcagcgtggtattatgctataactaaagaagatggtccagtatctttagtattatcaagacaaaacttgcctttatacaatgaaacaggtaaagatgccctaaaaggagcatatatattaaaggatacagaagataaaaaaccagatattattctaatggctactggttctgaagtagaacttatatacgaaggagctaaaatactagaagaaaagggaatcaaggtaagagttgtaagcatgccttctttagaagtatttgaaaaacaaagtaaggaatataaagaagaagttttaccatcaaatgttacgaagagattagcagtagaggctgcatcctctttcggatggcataaatacttaggttttgatggagacatcctatcaatagaccattttggagcatctgcaccaggagatgtattatttaaggaatttggatttactatagaaaatttagttaaaaaagcagaagaagttttaaataaataa

SEQ ID NO: 9747 - protein, 662 aa, Clostridium tetani E88
MNKLDTTAINTIRILSAEAIQKSNSGHPGLPLGSAPMAYTLWAKNMKHNPKNPNWTNRDRFVLSAGHGSMLIYSLLHLFNYGLTMEDLKDFRQWGSKTPGHPEYGHTIGVETTTGPLGQGIANAVGMAMAEAYLAEKFNKPGCELIDHYTYSLVGDGCLMEGISSEAASLAGTLGLDKLIVLYDSNNITIEGNTDIAFTEDVKGRFEAYNWQVINVEDGNDVEAIDKAIKEAKSDKKRPSIIIIKTQIGYGCPAKQGKSSAHGEPLGEENLKITREFLKWGHEEEFFVPEEVREYMKEKVEELSKEEEEWNKLKEEYDNKYPELAKEWELWFSGKIEKDLLNDEDFWKFEKKTATRAASGDVINRLAAVVPNLIGGSADLAPSNKTYMKDKGDFSKEDRKGANLHFGVREHAMAAIANGMYLHGGLKVFVSTFFVFSDYMKPSMRLSALMNLPITYVLTHDSIGVGEDGPTHEPIEQLASLRSIPNMTVFRPADAKETAAAWYYAITKEDGPVSLVLSRQNLPLYNETGKDALKGAYILKDTEDKKPDIILMATGSEVELIYEGAKILEEKGIKVRVVSMPSLEVFEKQSKEYKEEVLPSNVTKRLAVEAASSFGWHKYLGFDGDILSIDHFGASAPGDVLFKEFGFTIENLVKKAEEVLNK

SEQ ID NO: 9748 - DNA, 2013 bp, Lactobacillus plantarum WCFS1
  CDS (1)..(2013): transl_table=11
atgcaagcatttgatgaaattgatgaattagcggtgaataatctacgagtactgagtgcggaaatgattgaacgggccggttctggtcatccaggattgccactcggcgcggctccaatgatgtgggcactgtggagccgacaattacgggtcgatccacagcagtctcaatgggctaatcgcgatcgctttgtcttatcagccggacacgggtcggcgttgttgtacagtctgctacatgtgagtggcttcaacgtgacaatgggcgagttacaacgttttcgtcaattcggcagtcatacgccaggccaccctgaactgggaatcgtggatggtgtggaagccacgaccggtccactgggacagggattagggatggcggtgggcatggccctggctgaacggcaactagcggctcagttctccgagtcaccgcagttggtggatcactatacttacgcgttagtcggtgatggtgatttgatggaaggcgtctcccacgaagctgccagctttgccggtaatcaacaattgcaaaaattaattgtattgtacgacgataacgctgtttcgcttgatggccccaccagccggtcgtttcgtaccgatgtgaaccagcgcttcgctagttatggttgggatacacaaacggtaggtgatggcaatgatttaacggcgattaatgccgccattgagcgtgccaaacacagttcacgtccaagcctgatcgctgttaaaacgacgattggatttggcgcaccacaagcgggtacgaatgcggtgcatggcaatccgttgggaacggccggtttaactagtttgcggcaacaattagggtggcaagccgcgccatttacggtaatgccggccgttgctaaacgcgcacagcaactaatcttgcaacgtggtcagcgtgcacatcgccggtggcagtcacaacgagaggctttaccacaagccgtacaacaccgtttcgaacaacagctcagtatgcgtctgccagttgacttagccaccagtttaccgatctttgatgaaggcgcccaagcttcgcggatcacgagtcataccgtcattcagaagctagccgctcagttaccaggattagtcgggggcgcggctgatttagccagttcgaataaaacgaccattgagcaggatcaattgtcgactccggtgaccccggatcagcgcaacgttgcctttggtgtccgggagtttggtatgggcaccattttgaatgggatgactttacacggtggcttgcgggtctttggtggcaccttccttgtcttttccgattacacgcgtgcggctattcgattggcggcgatgatgaagttaccagtcacttacgttttcacgcatgactcgattgcagtcggcgaggacggtccgactcatcagccaattgaacagctaatgagtttacgattgattccgaatctaacggtgatccggcccgctgacccgaatgaaacggtcgcagcttggtggcaagccatcaacgcgacggatcatccaaccgtgctcgtcttgacccgtcagaatttggcagtgctatccggatctaagactaaggccatgactggtgtggctcgtggcggttatgttctctcaccgcagcgtggccgccagccaatgggaatcttgattgcaagcgggtcagaagttgctttagctcttcaggcccaggcgaaactagctacgttaggtgaagatgtcagtgtcgtttcaatgccgtcgatggaaaactttgcgcgccaatcaacgaattaccaagctcaggtcttgccacctcaaattcggcggcgagttgcagtcgaaatgggcgcaacatctggctgggaacgttacgttgggttagatggggcggtactaggcttggaccactttggcgccagtggagcggccgaccaagtattagccgctaaccagttcacggtagcagacctagtgcggacgtatcaacaaacgcacgtggatcttggtcaacaattgcgagtcatttag

SEQ ID NO: 9749 - protein, 670 aa, Lactobacillus plantarum WCFS1
MQAFDEIDELAVNNLRVLSAEMIERAGSGHPGLPLGAAPMMWALWSRQLRVDPQQSQWANRDRFVLSAGHGSALLYSLLHVSGFNVTMGELQRFRQFGSHTPGHPELGIVDGVEATTGPLGQGLGMAVGMALAERQLAAQFSESPQLVDHYTYALVGDGDLMEGVSHEAASFAGNQQLQKLIVLYDDNAVSLDGPTSRSFRTDVNQRFASYGWDTQTVGDGNDLTAINAAIERAKHSSRPSLIAVKTTIGFGAPQAGTNAVHGNPLGTAGLTSLRQQLGWQAAPFTVMPAVAKRAQQLILQRGQRAHRRWQSQREALPQAVQHRFEQQLSMRLPVDLATSLPIFDEGAQASRITSHTVIQKLAAQLPGLVGGAADLASSNKTTIEQDQLSTPVTPDQRNVAFGVREFGMGTILNGMTLHGGLRVFGGTFLVFSDYTRAAIRLAAMMKLPVTYVFTHDSIAVGEDGPTHQPIEQLMSLRLIPNLTVIRPADPNETVAAWWQAINATDHPTVLVLTRQNLAVLSGSKTKAMTGVARGGYVLSPQRGRQPMGILIASGSEVALALQAQAKLATLGEDVSVVSMPSMENFARQSTNYQAQVLPPQIRRRVAVEMGATSGWERYVGLDGAVLGLDHFGASGAADQVLAANQFTVADLVRTYQQTHVDLGQQLRVI

SEQ ID NO: 9750 - DNA, 1992 bp, Lactobacillus plantarum WCFS1
  CDS (1)..(1992): transl_table=11
atgagttttgatgaaatggatacaaaagcagtcaatgcgattcgagcacttagtattgatatgattgaacatgctgaatccgggcaccccggtatgccgcttgatgccgcgccgatggcttatgtcacgtataaaaagcatttacggattgatcctaaacatccaaattggccaaatcgcgatcgatttgtattatctgctgggcacagttcgtcgatgttgtacgcgatgctatatttggcaggttatggtataaccgtagatgatttgaaaaacttcaggcgtcttgatagtttgacaccaggacatccagaattgattacacctggtgttgatgcggccactggaccgcttggacaaggccttggtatggctgttgggatggcaatggccagcaaacatttaggaactaagtataatgttgatgacatcaaaattttaaatagccgtgtctatgtaattgccagtgatggggacttaatggaaggaatcagtcatgaatcggcaagtttggcaggccatttgaaactgaataatttgattgttatgtatgattcaaatgacgtaacgttagacgcacaggcaagtaaaacgttgggcgatgatgcaggagaacgatttaaggcatatggctggaattatttgcgggttgaagatggcaataatctagatgagattgacaatgctctaaaactagctgaggctgaacaggaacgaccgacgattattgaagttaaaacggttttggggtatggatcgccacatgcaggtgaaaacactgttcatggaaatccacttacagctggtgaatgtcgacagacaatgcatgatttgggctgggattatgaaccatttgaagttcctgatgaagttcatcaacgttatgccgaaattttgcaagaaggacaacaacgatatgtatcatggcaaaacgaattgcataagcttaaaaaggtaaacgaagagctggcacaaaattttgaagttaatttttctaatcaagccgctacgggagatatcagtttacaatacaatgctggtgatacagaggctgtgcgaatgacggtgcataaactcattcagaaatcagctcatacgccattgaatttttggggcggctcggcagatttgtccagtagtaataaaacttattttgagaatgatgatggttttgaaccaggtcagtatcaaaataaaaatgtgttttatggtgtacgagaatttgcacaagcagcagctgtaaacggaataacgttatttgggggaagtagaacgtttgggagtacattctttgtctttagtgattatatgaaaaatgcgattcgtatggcagctttgcaaagaattcctgcaatcttcgcgtttagtcatgattcaattgcgctagggcaagatgggcctacgcatcaaccagttgaacaattggatggattacgtgcgatgccagggttgactgtatttcggccagcagatgcgattgaaacacagtcagtatgggactatgcattaaataaaaatcatggaccagtggtgattgcaatgtcacgccaagcacttccagtacttgaaggttcattaaagtatgcaaaagagtgtgttaaaaggggtggttatattgtatcaccgtctggtgtaagcaattcagatgggataataattgcaacgggttcagaagtaagtatttcaatagaggctcaaaccaaattgaaaaggcaaaatatcaatgtagaagtagtttccatgccaagtactgagctgtttttacaacaacctaaatcatatcgagataaggtgcttgatccgaccgttagaaatcgcatgtcagtagagatgggctctactcaatcttggtatcgattcactggtcttgatggtgtcaatatcggtttggaccactttggggctagtgggccggttgatgaaattattcaaagatttgggttttcctcagagaatattgctcaaacttatttacaacattttcgtggatag

SEQ ID NO: 9751 - protein, 663 aa, Lactobacillus plantarum WCFS1
MSFDEMDTKAVNAIRALSIDMIEHAESGHPGMPLDAAPMAYVTYKKHLRIDPKHPNWPNRDRFVLSAGHSSSMLYAMLYLAGYGITVDDLKNFRRLDSLTPGHPELITPGVDAATGPLGQGLGMAVGMAMASKHLGTKYNVDDIKILNSRVYVIASDGDLMEGISHESASLAGHLKLNNLIVMYDSNDVTLDAQASKTLGDDAGERFKAYGWNYLRVEDGNNLDEIDNALKLAEAEQERPTIIEVKTVLGYGSPHAGENTVHGNPLTAGECRQTMHDLGWDYEPFEVPDEVHQRYAEILQEGQQRYVSWQNELHKLKKVNEELAQNFEVNFSNQAATGDISLQYNAGDTEAVRMTVHKLIQKSAHTPLNFWGGSADLSSSNKTYFENDDGFEPGQYQNKNVFYGVREFAQAAAVNGITLFGGSRTFGSTFFVFSDYMKNAIRMAALQRIPAIFAFSHDSIALGQDGPTHQPVEQLDGLRAMPGLTVFRPADAIETQSVWDYALNKNHGPVVIAMSRQALPVLEGSLKYAKECVKRGGYIVSPSGVSNSDGIIIATGSEVSISIEAQTKLKRQNINVEVVSMPSTELFLQQPKSYRDKVLDPTVRNRMSVEMGSTQSWYRFTGLDGVNIGLDHFGASGPVDEIIQRFGFSSENIAQTYLQHFRG

SEQ ID NO: 9752 - DNA, 1998 bp, Lactobacillus plantarum WCFS1
  CDS (1)..(1998): transl_table=11
atgtttgataaagttgatgaattaggtgttaacacgattcgtacacttagtattgaagcgattcagaaagctaactcggggcatccaggactaccaatgggagctgcaccaatggcttacgtactatggacgaagcatttaaatattaatcccaagactcacatgaattgggtcaatcgtgatcgatttattctatctgcggggcatggttcagctatgttatatagcctgttacatttagccgggtatgatgtttcgattgatgatctcaagcattttcggcagtgggacagtcggactccggggcatccagagtatggacataccgatggcgttgaagtaactactggtccgttgggacaaggattcggtatggccgttggaatggcaatggcggaggcacatctagctgcccaatataaccgacctaattttccaattgttgatcattacacttatacaattgtcggtgatggcgacttaatggaaggaatttcgcacgaagctggttcactagctgggcatcttaagctgggaaagttaattgcactttacgattcgaacggcatttcattagatggtaagacgtcgcaagcgtttactgaaaatgttggtgacaggttcactgcttatggctggcagcatctggtggttgaagatgggaatgatcttgatgcaattgacgcggcaatcgaacttgcaaaaaagacaactgatcgtccttctttgattgaagtgaaaacggtgattggttatggcgcacctaaacaagggactaatgctgttcatggtaacccaattggtgcggatggcattaaagcagctgaaaaagtatatggctggaattactcggattttgaagtgccgtcagctgtttcagaccggtttgaagtaactattcaggaaaatggtgcgcgtgctgagcagcaatggaaacggctatttgaagaatatgaggcgaagtatccagatcaggcgcagtcttttaagcaagcgttcaacggacaattttctgatgacttgaaatctactttaccacactatcaattaacagatgcattggctagtcgggcggcaagcgctaaggcgattaacgctgctgccaaagtaatacctagcttatggggtggcgcagccgatttgtcgagttcgaacaaaacaatgattgcggaaacatcagactttcaaccagaatcctacgatggtcgtaatatttggttcggcgtacgtgaatttggcatggcggctgcgatgaacggaattgtattacatggcggcactcgggtattcgggggaacattctttgtcttcactgattacttacgtgcggcagtccggttgtccgcactgcaacacgcaccggttatctacgtcttaacgcatgattcaattgcggtcggcgaggatgggccgacccacgaaccgattgaacaattagctagtttacgatgcatgccgaacgtacaagtgattcggccagctgatggtaatgagacttcagctgcgtgggagcaagcactgaaaacaactgataaaccaaccgttctggtattgagtcgacaagccttgaagacattacctgtatcagttgatacggcctttgctggcgttgaaaagggtggctatgtggtcagtgctgctcaaaaagaaataccagatggtttactaattgcgactggttctgaagttaacttagcattggaggccaaagcccagttagcaaagcataatcaagatgtcgcggtcgtttcaattccgagttttgatcggtttgcgcaacaatcaccagaatatcgcgctagtgtgcttccgagcgcggtcacaagaagggtgacaattgaagctggatcaacatttggctgggatcagtatgctggcgatcatggtgctaagatcggtgtggatcgcttcggcacttcggcacctggtgacttggtacttgataagtatggttttaatgtaactaatgttgtgaatacttatctgaaattaaaataa

SEQ ID NO: 9753 - protein, 665 aa, Lactobacillus plantarum WCFS1
MFDKVDELGVNTIRTLSIEAIQKANSGHPGLPMGAAPMAYVLWTKHLNINPKTHMNWVNRDRFILSAGHGSAMLYSLLHLAGYDVSIDDLKHFRQWDSRTPGHPEYGHTDGVEVTTGPLGQGFGMAVGMAMAEAHLAAQYNRPNFPIVDHYTYTIVGDGDLMEGISHEAGSLAGHLKLGKLIALYDSNGISLDGKTSQAFTENVGDRFTAYGWQHLVVEDGNDLDAIDAAIELAKKTTDRPSLIEVKTVIGYGAPKQGTNAVHGNPIGADGIKAAEKVYGWNYSDFEVPSAVSDRFEVTIQENGARAEQQWKRLFEEYEAKYPDQAQSFKQAFNGQFSDDLKSTLPHYQLTDALASRAASAKAINAAAKVIPSLWGGAADLSSSNKTMIAETSDFQPESYDGRNIWFGVREFGMAAAMNGIVLHGGTRVFGGTFFVFTDYLRAAVRLSALQHAPVIYVLTHDSIAVGEDGPTHEPIEQLASLRCMPNVQVIRPADGNETSAAWEQALKTTDKPTVLVLSRQALKTLPVSVDTAFAGVEKGGYVVSAAQKEIPDGLLIATGSEVNLALEAKAQLAKHNQDVAVVSIPSFDRFAQQSPEYRASVLPSAVTRRVTIEAGSTFGWDQYAGDHGAKIGVDRFGTSAPGDLVLDKYGFNVTNVVNTYLKLK

SEQ ID NO: 9754 - DNA, 2097 bp, Tropheryma whipplei str. Twist
  CDS (1)..(2097): transl_table=11
atggaatataatgtttcgcgggaacggagggtttctgctttgactgtgtttgtttgggatgataaggatgatctggcggtaaacacagcccgggtacttgcggcagacgcagttgaaaatgtcgggaacggtcaccccggaacggcgattagtttggcacccgctgcttatcttttgtttcagaaggttatgcgccataacccctctgatccttcctgggcggcgcgcgatagattcgtgttatcctgcggtcatagttcacttaccctatatattcagctttttctggccggctataaactttccctgcaggatcttcgaggccttcgccagtggggctcgctgactcccggacacccggaatatgggcatacacccggggttgaaattacaacaggtcctcttggtcaaggccttgctagcgctgttgggtttgcatattccgcgcggttccaaaggggcctcttcaagacggatatattcgatcattatgtctatgtgatcgcgagtgaaggtgatatagaagaaggtgttacttctgaggcatgttctcttgctggacttcagcagctcggtaatcttttggtgattcttgacagaaactatataagtatcgaagataatactgatatagccctttctgaagatataaagtccagatatctgtcatacggttggcaagtaatcgaggttccctggcgtcgagcaggggcagagtatagggaggatgtcctctccctctatgaggccctcttggaagcgcaaaaggatactgatagaccgtcgctaataatcctggaaacggttatcgcttggccatcaccgggcaaacaaaatacgggcgctgcgcatggtgctgcacttggcgtaaatgaagtgaaagacctgaagcgtattctgggttttgatcccgaaaaaacattcgaggttccagacggtgttcttcagcacactaaaggggcacttgatcgaggccagtcacagcaggacaattgggaaaatgtcttttcatcttggcgtcaagagcatcccattgaggctgctttatttgacagattacaaaatggggttactccggatatagatcatgttttgcctgttttttcctcggagaaaccgatttctaccagggcggccagtgggcaagttataaaccgtatcgctgaagttatgccagagttatggggcgggtcggcggatctcgcagaatcgaataatacgactataaagtctgcgaacagtttcttacccgaaagtgtgacagttgatcattggaaatctgatcgttatggtcgcatcctgcactttggagtgagggaacatgcgatggctgcgctaataagcggaattgttctccacgggaatacaagggtatttggtgggacttttttggttttcagtgactatatgcgtcctgcggttagacttgctgcactcatgaagataccatctatttttgtttggactcatgactcaataggactgggagaagatgggccgactcatcaaccggttgaacatctttgggccttgcgtgccatccctggtttatctgtcattcggcccgctgatgctaacgaggttgcctgggcttggaaagaaattcttgagaggcgtgatggtccggttgggcttgttttatcacgacaaaatcttcctgtgctcgacaggacttgtcttgcacctgccagcgaactcagaaagggagcgtatatcctagctgatggatcgcgttatccgagattgatattaatcgcgacgggctcagaggtctcgctggcaataggtgctagggaagttcttgaaaatcgtggtattcccacaagagtggtttcggcgccgtgtcttgagtggttcgatcaacaagagaaaagttaccgcaaccatgtccttcctccagacgtagaaaccagaatttctgttgaggcaggtttgtcgctgggttggtcgaagtatattggagataagggcgcatccgtttctatagaacactatggagcatcagccgctggggatgttctttttgaacgtttcggttttaccgttgagaatattgtaaaaacagcagatgctctgttgggagggtgtggtgaatag

SEQ ID NO: 9755 - protein, 698 aa, Tropheryma whipplei str. Twist
MEYNVSRERRVSALTVFVWDDKDDLAVNTARVLAADAVENVGNGHPGTAISLAPAAYLLFQKVMRHNPSDPSWAARDRFVLSCGHSSLTLYIQLFLAGYKLSLQDLRGLRQWGSLTPGHPEYGHTPGVEITTGPLGQGLASAVGFAYSARFQRGLFKTDIFDHYVYVIASEGDIEEGVTSEACSLAGLQQLGNLLVILDRNYISIEDNTDIALSEDIKSRYLSYGWQVIEVPWRRAGAEYREDVLSLYEALLEAQKDTDRPSLIILETVIAWPSPGKQNTGAAHGAALGVNEVKDLKRILGFDPEKTFEVPDGVLQHTKGALDRGQSQQDNWENVFSSWRQEHPIEAALFDRLQNGVTPDIDHVLPVFSSEKPISTRAASGQVINRIAEVMPELWGGSADLAESNNTTIKSANSFLPESVTVDHWKSDRYGRILHFGVREHAMAALISGIVLHGNTRVFGGTFLVFSDYMRPAVRLAALMKIPSIFVWTHDSIGLGEDGPTHQPVEHLWALRAIPGLSVIRPADANEVAWAWKEILERRDGPVGLVLSRQNLPVLDRTCLAPASELRKGAYILADGSRYPRLILIATGSEVSLAIGAREVLENRGIPTRVVSAPCLEWFDQQEKSYRNHVLPPDVETRISVEAGLSLGWSKYIGDKGASVSIEHYGASAAGDVLFERFGFTVENIVKTADALLGGCGE

SEQ ID NO: 9756 - DNA, 2097 bp, Tropheryma whipplei TW08/27
  CDS (1)..(2097): transl_table=11
atggaatataatgtttcgcgggaacggagggcttctgctttgactgtgtttgtttgggatgataaggatgatctggcggtaaacacagcccgggtacttgcggcagacgcagttgaaaatgtcgggaacggtcaccccggaacggcgattagtttggcacccgctgcttatcttttgtttcagaaggttatgcgccataacccctctgatccttcctgggcggcgcgcgatagattcgtgttatcctgcggtcatagttcacttaccctatatattcagctttttctggccggctataaactttccctgcaggatcttcgaggccttcgccagtggggctcgctgactcccggacacccggaatatgggcatacacccggggttgaaattacaacaggtcctcttggtcaaggccttgctagcgctgttgggtttgcatattccgcgcggttccaaaggggcctcttcaagacggatatattcgatcattatgtctatgtgatcgcgagtgaaggtgatatagaagaaggtgttacttctgaggcatgttctcttgctggacttcagcagctcggtaatcttttggtgattcttgacagaaactatataagtatcgaagataatactgatatagccctttctgaagatataaagtccagatatctgtcatacggttggcaagtaatcgaggttccctggcgtcgagcaggggcagagtatagggaggatgtcctctccctctatgaggccctcttggaagcgcaaaaggatactgatagaccgtcgctaataatcctggaaacggttatcgcttggccatcaccgggcaaacaaaatacgggcgctgcgcatggtgctgcacttggcgtaaatgaagtgaaagacctgaagcgtattctgggttttgatcccgaaaaaacattcgaggttccagacggtgttcttcagcacactaaaggggcacttgatcgaggccagtcacagcaggacaattgggaaaatgtcttttcatcttggcgtcaagagcatcccattgaggctgctttatttgacagattacaaaatggggttactccggatatagatcatgttttgcctgttttttcctcggagaaaccgatttctaccagggcggccagtgggcaagttataaaccgtatcgctgaagttatgccagagttatggggcgggtcggcggatctcgcagaatcgaataatacgactataaagtctgcgaacagtttcttacccgaaagtgtgacagttgatcattggaaatctgatcgttatggtcgcatcctgcactttggagtgagggaacatgcgatggctgcgataataaacggaattgttctccacgggaatacaagggtatttggtgggacttttttggttttcagtgactatatgcgtcctgcggttagacttgctgcactcatgaagataccatctatttttgtttggactcatgactcaataggactgggagaagatgggccgactcatcaaccggttgaacatctttgggccttgcgtgccatccctggtttatctgtcattcggcccgctgatgctaacgaggttgcctgggcttggaaagaaattcttgagaggcgtgatggtccggttgggcttgttttatcacgacaaaatcttcctgtgctcgacaggacttgtcttgcacctgccagcgaactcagaaagggagcgtatatcctagctgatggatcgcgttatccgagattgatattaatcgcgacgggctcagaggtctcgctggcaataggtgctagggaagttcttgaaaatcgtggtattcccacaagagtggtttcggcgccgtgtcttgagtggttcgatcaacaagagaaaagttaccgcaaccatgtccttcctccagacgtagaaaccagaatttctgttgaggcaggtttgtcgctgggttggtcgaagtatattggagataagggcgcatccgtttctatagaacactatggagcatcagccgctggggatgttctttttgaacgtttcggttttaccgttgagaatattgtaaaaacagcagatgctctgttgggagggtgtggtgaatag

SEQ ID NO: 9757 - protein, 698 aa, Tropheryma whipplei TW08/27
MEYNVSRERRASALTVFVWDDKDDLAVNTARVLAADAVENVGNGHPGTAISLAPAAYLLFQKVMRHNPSDPSWAARDRFVLSCGHSSLTLYIQLFLAGYKLSLQDLRGLRQWGSLTPGHPEYGHTPGVEITTGPLGQGLASAVGFAYSARFQRGLFKTDIFDHYVYVIASEGDIEEGVTSEACSLAGLQQLGNLLVILDRNYISIEDNTDIALSEDIKSRYLSYGWQVIEVPWRRAGAEYREDVLSLYEALLEAQKDTDRPSLIILETVIAWPSPGKQNTGAAHGAALGVNEVKDLKRILGFDPEKTFEVPDGVLQHTKGALDRGQSQQDNWENVFSSWRQEHPIEAALFDRLQNGVTPDIDHVLPVFSSEKPISTRAASGQVINRIAEVMPELWGGSADLAESNNTTIKSANSFLPESVTVDHWKSDRYGRILHFGVREHAMAAIINGIVLHGNTRVFGGTFLVFSDYMRPAVRLAALMKIPSIFVWTHDSIGLGEDGPTHQPVEHLWALRAIPGLSVIRPADANEVAWAWKEILERRDGPVGLVLSRQNLPVLDRTCLAPASELRKGAYILADGSRYPRLILIATGSEVSLAIGAREVLENRGIPTRVVSAPCLEWFDQQEKSYRNHVLPPDVETRISVEAGLSLGWSKYIGDKGASVSIEHYGASAAGDVLFERFGFTVENIVKTADALLGGCGE

SEQ ID NO: 9758 - DNA, 1998 bp, Pseudomonas syringae pv. tomato str. DC3000
  CDS (1)..(1998): transl_table=11
atgccaagccgtcgtgagcgtgccaatgctattcgtgccctaagcatggatgccgtgcaaaaagccaacagcggccatccgggtgccccgatgggcatggcggatatcgcggaggttctgtggcgcgattatctgaaacacaacccgaccaacccgtcgtttgccgaccgtgaccgcttcatcatgtccaacggccacggctcgatgctggtctattcactgctgcacctgaccggctatgacctgtccatcgacgatctgaaaaacttccgtcagttgcacagccgcacgccgggccacccggagttcggctacaccccaggcgttgaaaccaccactggcccactgggtcagggttttgccaatgccgtcggtttcgccgctgccgagaagacactcgctgcacagttcaaccgtccaggccactccatcgttgatcaccatacctacgtgttcatgggtgatggctgcatgatggaaggcatttctcacgaagtcgcctccctggccggtacgctgcaactgggcaaactgatcgcgttctacgatgacaacggcatctccatcgacggcgaagttgaaggctggttcaccgatgacacgccaaagcgctttgaagcctacggctggcaggtcattcgcaatgtcgacggtcatgacgccgacgagatcaagaccgccatcgacacggcccgcaaaagcgatcagccaacgctgatctgctgcaagaccaccatcggtttcggctcgccgaacaagcagggtaaggaagaatcccacggtgcaccgctgggcgctgacgaaatcgccctgacccgcgctgccctgaagtggaaccatggtccttttgaaatcccggctgatatctacgccgagtggaatgcgaaggaaaaaggtctggctgttgaagccgagtgggaccagcgctttgctgcctactctgctgccttcccggagctggccaatgaatttatccgtcgcatgagcggcgaactgcctgctgactttgccgagaagtcggcggcttacgttgccgaagtcaacgccaagggcgaaaccattgccagccgcaaggccagtcagaacgcgctgagcgcactgggcccgttgctgccggaaattctcggcggttcggctgacctggccggttccaacctgaccatctggaaaggctgcaagagcatcaccggcgaagaccctaacggcaactacctgcattacggcgttcgcgaattcggcatggccgccatgatgaacggtatcgctctgcacggtggcttcgtgccatacggcgcaaccttcctgatcttcatggaatacgcgcgcaatgcggtgcgtatggcctcgttgatgaagaagcgcgtgatctacgtgttcacccatgactctatcggtctgggcgaagacggtccgactcaccagccaatcgagcagctgaccagcctgcgtaccacgccgaacctggacacctggcgtccggcagatgccgttgaatcggctgtggcctggaaatactcgctggagcgtaacgacggcccgtccgcgctgatcttctcgcgtcagaacctgactcaccaggcgcgcgaacagcagcaaatagatgccatcgctcgtggtggttatgtattgcgcgactgcgctgcagaacccgagctgatcctgatcgcgaccggctctgaagtcggtctggccgttgaagcctacgaaaagctgaccgctcagggtcgcaacgttcgtgtggtttccatgccatgcaccagcgtgttcgaagcgcaggacgcgggctacaagcaagccgttctgccgcttcaggtcagcgcacgtatcgccatcgaagcggcccatgccgactactggtacaaatacgtgggcctggaaggccgcgtgatcggcatgaccaccttcggcgagtcggcgcctgcgccgctgctgttcgaagagttcggcttcacgctggaaaacgtcctgagcattgctgaagagctgctggaagactga

SEQ ID NO: 9759 - protein, 665 aa, Pseudomonas syringae pv. tomato str. DC3000
MPSRRERANAIRALSMDAVQKANSGHPGAPMGMADIAEVLWRDYLKHNPTNPSFADRDRFIMSNGHGSMLVYSLLHLTGYDLSIDDLKNFRQLHSRTPGHPEFGYTPGVETTTGPLGQGFANAVGFAAAEKTLAAQFNRPGHSIVDHHTYVFMGDGCMMEGISHEVASLAGTLQLGKLIAFYDDNGISIDGEVEGWFTDDTPKRFEAYGWQVIRNVDGHDADEIKTAIDTARKSDQPTLICCKTTIGFGSPNKQGKEESHGAPLGADEIALTRAALKWNHGPFEIPADIYAEWNAKEKGLAVEAEWDQRFAAYSAAFPELANEFIRRMSGELPADFAEKSAAYVAEVNAKGETIASRKASQNALSALGPLLPEILGGSADLAGSNLTIWKGCKSITGEDPNGNYLHYGVREFGMAAMMNGIALHGGFVPYGATFLIFMEYARNAVRMASLMKKRVIYVFTHDSIGLGEDGPTHQPIEQLTSLRTTPNLDTWRPADAVESAVAWKYSLERNDGPSALIFSRQNLTHQAREQQQIDAIARGGYVLRDCAAEPELILIATGSEVGLAVEAYEKLTAQGRNVRVVSMPCTSVFEAQDAGYKQAVLPLQVSARIAIEAAHADYWYKYVGLEGRVIGMTTFGESAPAPLLFEEFGFTLENVLSIAEELLED

SEQ ID NO: 9760 - DNA, 2010 bp, Bacteroides thetaiotaomicron VPI-5482
  CDS (1)..(2010): transl_table=11
atgaacgataataaacttatgaatcgtgcagcggataacatccgtattcttgctgcttcaatggttgagaaagccaattccggtcacccgggtggcgccatgggtggtgctgactttgtaaatgtactcttctctgagtttctagtatacgatcctgaaaatccgcgttgggaaggtcgtgaccgtttcttccttgatccgggtcatatgtctccgatgctctattctacattggcattgacaggtaagttcactttggacgaactaaaagaatttcgccaatggggaagccctactccgggacatccggaagtagacatcatgcgtggtatcgaaaatacttccggtccgctgggacagggacatactttcgctgtaggtgccgctatcgcagctaaattcctgaaagcacgcttcaatgaagtaatgaatcagactatttacgcatacatttccgatggtggtattcaggaagaaatctctcagggtgccggacgcattgccggtgcattgggactggacaacctgatcatgttctacgactccaacgatattcagctttctacagaaacgaaagatgtaaccgttgaagacactgccatgaaatatgaagcatggggatggaacgtactcagcatcaatggtaatgatcctgacgaaatccgtgcagctatcaaagaagctcagacagaaaaagagcgcccgactctgattatcggtaaaaccgttatgggtaaaggcgcacgcaaagcagacggtagcagctacgaagccaactgtgctacacacggcgctccactcggtggcgacgcctatgtaaatacaatcaagaatttgggtggcgatcctgtcaatccgttcgtgattttcccggaagtagccgaactgtatgcaaagagagcagcagaattaaagaaaatcgtagctgaaagatatgcaaagaaggccaaatggaccaaagccaatccggaactggcagctaaactggaagcattcttctccggcaaagctcctaaagtagactgggctgccatcgaacaaaaagcaggtactgccactcgtgccgcttctgcaactgttctgggtgctcttgcaatgcaggtagaaaatatgatcgttgcttctgccgacctttctaactctgacaagactgacggtttcctgaagaaaactcattctttcaagaagggcgatttcagcggtgcattcttccaggccggtgtatctgaattatcaatggcttgtatctgtatcggtatgtcacttcacggtggtgtgatcgctgcttgcggtaccttcttcgtattctccgactatatgaaacctgccgtacgtatggctgctctgatggaacagcctgtgaagttcatctggactcatgatgcattccgcgtaggtgaagacggtcctactcatgaaccggtagaacaggaagctcaaatccgcctgatggagaaactgaaaaaccacaagggacacaactctatgttggtacttcgtccggctgatgcggaagaaacgactatcgcatggaaacttgccatggaaaatatgtctactccgacaggtctgatcttctcccgtcagaatatcgctaacctgcctgccggaactgattacgaacaagcagccaagggtgcttatatcgtagccggttcagacgaaaatccggatgtaatcctggtagcttcaggttccgaagtgtctactttggtagccggtacagagttgcttcgcaaggatggcgtaaaagttcgtatcgtatctgcaccatcagaaggtctgttccgcagccagtctaaggaatatcaggaatcagttcttccggctgatgccaagatattcggtcttactgccggtttgcctgtcactcttcaaggtctggtaggttgccacggcaaagtatggggattggaatctttcggtttctctgctccttacacagtattggatgaaaaacttggatttactgccgagaacgtatataatcaggtaaaagcaatgatttaa

SEQ ID NO: 9761 - protein, 669 aa, Bacteroides thetaiotaomicron VPI-5482
MNDNKLMNRAADNIRILAASMVEKANSGHPGGAMGGADFVNVLFSEFLVYDPENPRWEGRDRFFLDPGHMSPMLYSTLALTGKFTLDELKEFRQWGSPTPGHPEVDIMRGIENTSGPLGQGHTFAVGAAIAAKFLKARFNEVMNQTIYAYISDGGIQEEISQGAGRIAGALGLDNLIMFYDSNDIQLSTETKDVTVEDTAMKYEAWGWNVLSINGNDPDEIRAAIKEAQTEKERPTLIIGKTVMGKGARKADGSSYEANCATHGAPLGGDAYVNTIKNLGGDPVNPFVIFPEVAELYAKRAAELKKIVAERYAKKAKWTKANPELAAKLEAFFSGKAPKVDWAAIEQKAGTATRAASATVLGALAMQVENMIVASADLSNSDKTDGFLKKTHSFKKGDFSGAFFQAGVSELSMACICIGMSLHGGVIAACGTFFVFSDYMKPAVRMAALMEQPVKFIWTHDAFRVGEDGPTHEPVEQEAQIRLMEKLKNHKGHNSMLVLRPADAEETTIAWKLAMENMSTPTGLIFSRQNIANLPAGTDYEQAAKGAYIVAGSDENPDVILVASGSEVSTLVAGTELLRKDGVKVRIVSAPSEGLFRSQSKEYQESVLPADAKIFGLTAGLPVTLQGLVGCHGKVWGLESFGFSAPYTVLDEKLGFTAENVYNQVKAMI

SEQ ID NO: 9762 - DNA, 1995 bp, Coxiella burnetii RSA 493
  CDS (1)..(1995): transl_table=11
atgccttcacgccgagactgtgccaatgcgattcgtgcgttggcgatggacgctgttcaaaaagccaattcagggcacccagggatgcccatggggatggcagatattgccgaagttttgtggcgggattttttgaaattcaatcccgctaatcttaattgggtcgatcgcgatcgttttgtcttatccaatggtcatggcgctatgctgcaatacgcgttgctgcatttgaccggggccggtttaaccattgaggatattaaacaatttcgtcaatggcattcgcgcactcccggccacccggagttcggtgacaccccgggtgtggagaccaccactgggcctctgggccaagggctagccactggcgttggcatggcaatggctgagcaaatgctggcggcaacgttcaatcgcgaaaatttccccatcgtggatcattacacttatgtttttgccggcgacggcgatttaatggaaggtatttcccacgaggcgtgttcgttagcggggacatggggacttggcaaattgatcgtcttctacgacgacaatgggatttctatcgacggtgaagtcagcggttggttcaccgacgatacgcccaagcgctttgaagcttatcattggcatgtagtgccgaatgtcgacggtcatgaccccgatgcaattttgaaagcgattgaggcagcccaaaacgtaacggacaaacccagtctcatttgttgtaaaaccatcatcggttatggcgcacccattttagcgggcaaagctgtcacgcatggggcccccttaggcgaagaagaagtcgctggggttcgtaaaattttaaattggccgcatccgccttttgaaatccccgaggagatttatgcagcgtgggattgtaaagaaaaaggcgaaaaaaacgaaacgcaatggaatcgactgtttaccgagtacgaaaaacagcatcccgacttggccaaagaatttcgtcggcggcaagaaaaagagttgccggaacaatgggaacaaacagggaaagagttactagcaacgatgcaagcatcaaaagaaaataacgccactcgcaaactttctttaaaatgtttaaatacatttgcgccgttattgcctgaattaatcggcggctccgcggatttatctgaatccaattgcactaaatggacgggcgctattattcagggtcaggataatcgttcgggaaattatatcgaatacggcgtgcgtgaattcgccatgacggccataatgaatggcatggcgctgcatggcggatttattcccttcgcggggacctttttaactttctccgattacgcgcgcaatgcggtgcggcttgcagcgatgatgaaagcccatgctattttcatttattctcacgattcaatcggtctaggtgaagacggaccgacgcaccagccgattgaacaattgccttcactacgcatgattccgggtctgcacgtatggcgcccgtgcgatggggtggaaacggcagtggcttggaaaaagataatcgaagaaccgggcgccaattgccttttattaacccgccaaacggtcgctcatcaagaccgagacgaaaaacaaatcgctcaaattgtcaaaggcggttacattttgtgggagtctgctgcaaatcccgaggttattttaatcgcttcgggttcggaagtggctgttacgatcgaagctgcaaaggcattagcgaaggaaaatatttcggttcgtgttgtttccatgccctgttgcgaactatttaaaaagcaaaacaccgattatcgcaactcggtattgcccccgaacgttaaaaaacgagtagccatcgaggccgctcatcccgattattggtatcaatttgtgggttatgaaggcctagtgatcggcattgatcgctttggcgcttctgcgccgtggcaagtggtgtatcgtgaatatgggttcacggtggaaaatattcttaatgtggttaatcaactatataaataa

SEQ ID NO: 9763 - protein, 664 aa, Coxiella burnetii RSA 493
MPSRRDCANAIRALAMDAVQKANSGHPGMPMGMADIAEVLWRDFLKFNPANLNWVDRDRFVLSNGHGAMLQYALLHLTGAGLTIEDIKQFRQWHSRTPGHPEFGDTPGVETTTGPLGQGLATGVGMAMAEQMLAATFNRENFPIVDHYTYVFAGDGDLMEGISHEACSLAGTWGLGKLIVFYDDNGISIDGEVSGWFTDDTPKRFEAYHWHVVPNVDGHDPDAILKAIEAAQNVTDKPSLICCKTIIGYGAPILAGKAVTHGAPLGEEEVAGVRKILNWPHPPFEIPEEIYAAWDCKEKGEKNETQWNRLFTEYEKQHPDLAKEFRRRQEKELPEQWEQTGKELLATMQASKENNATRKLSLKCLNTFAPLLPELIGGSADLSESNCTKWTGAIIQGQDNRSGNYIEYGVREFAMTAIMNGMALHGGFIPFAGTFLTFSDYARNAVRLAAMMKAHAIFIYSHDSIGLGEDGPTHQPIEQLPSLRMIPGLHVWRPCDGVETAVAWKKIIEEPGANCLLLTRQTVAHQDRDEKQIAQIVKGGYILWESAANPEVILIASGSEVAVTIEAAKALAKENISVRVVSMPCCELFKKQNTDYRNSVLPPNVKKRVAIEAAHPDYWYQFVGYEGLVIGIDRFGASAPWQVVYREYGFTVENILNVVNQLYK

SEQ ID NO: 9764 - DNA, 2082 bp, Streptomyces avermitilis MA-4680
  CDS (1)..(2082): transl_table=11
ttgaagatgagcacgcacacccacgacagcttcgagtggaccgacctcgaccggcgtgccgtcgacacggcccgcctgctggccgccgatgccgtgcagaaggtgggcaacggccaccccggcaccgcgatgagcctggcaccggccgcgtacacgatctttcaaaaggtgatgcgacacgaccccgccgatcccgagtggaccggccgtgaccgtttcgtcctctcccccggccacacctcactgactctctacacccagctcttcctcgccggatacgagctggagctcgacgacctgaaggcgttccgtacgcacggctcgaagacacccggccaccccgagtacgggcacacggccggcgtcgagaccaccacgggcccgctgggccagggcgccgccaacgcggtgggcatggcgatggccgcccgctacgagcgcggtctgttcgacccccacgcgcccgagggcgagtcccccttcgaccacaccatctgggcgatcgtctcggacggcgacctggaggagggcatctccgccgaggcgtcctccctcgccggtcaccagaagctgggcaacctggtcttcctctacgacgacaaccacatctccatcgagggcgacaccgccaccgccttctccgaggacgtaccgaagcggtacgaggcgtacggctggcacgtccagcgcatcgagccctccgccgacggcgacatcgacgtccacgcgctgcacgcggcgctcaaggcggcgcaggccgagaccgagcgcccctcgttcatcgcgatgcgcacgatcatcgcctggcccgccccgaacgcgcagaacaccgaggcctcgcacggctcggcgctcggcgccgaggagatcgcggccaccaagcgcgtcctcggctccgaccccgagcagaccttcgaggtcgcggacgaggtgctcgcccacgcccgccgcgccctggaccgcggcgccgaggagcacgccgcctgggacaagcggatcgccgagtggcgcaccgcccagcccgagcgcgcgaagctcttcgaccggatcgtcgccggtcagctccccgagggctgggagcagtccctccccgtcttcgaagcgggcacgtccgtcgcgacgcgtgccgcgtccggcaaggtcctccaggcactcggcgcggtcatccccgagctgtggggcggctccgccgacctcgcgggctcgaacaacaccacgatcgacaagaccagctcgttcctgccgaagggcaacccgctgcccgaggccgacccgtacggccgcaccgtccacttcggcatccgcgagcactccatggccgcggagatgaacggcatcgcgctgcacggcaacacccgtatctacggcggcaccttcctggtgttctccgactacatgcgcaacgccgtccgcctctccgcgctgatgcagctgccggtgacgtacgtgtggacccacgactccatcggcctcggcgaggacggccccacccaccagcccgtcgagcacctcgcctcgctgcgcgccatccccggcctgaacatcgtccgcccggccgacgccaacgagacggcgatcgcctggcgcgagatcctcgagcggcacgccacccacccggccccgcacggccttgcgctgacccgccagggcgtaccgacgtacgaggccaacgaggacgcggcgaagggcggttacgtcctccaggaggcgtccaccggaaccccggacgtggtcctcatcgccaccggctccgaggtgcagctcgccgtcgcggcgcgcgagcggctggaggccgagggcgtcggcacacgcgtggtctcgatgccgtccgtggagtggttcgaggagcagtcgccggagtaccgcgcgagcgtccttccgccgtccgtgaaggcccgcgtcgcggtcgaggccggtatcggtctgacctggcaccggtacgtcggagacgccggacgcatcgtttcgctggagcacttcggcgcctccgccgacgccgagaccctgttcgccgagttcggcttcaccgccgagaacgtcgccgccgcggcccgggaatccatcaccgccgcgcgtggttga

SEQ ID NO: 9765 - protein, 693 aa, Streptomyces avermitilis MA-4680
MKMSTHTHDSFEWTDLDRRAVDTARLLAADAVQKVGNGHPGTAMSLAPAAYTIFQKVMRHDPADPEWTGRDRFVLSPGHTSLTLYTQLFLAGYELELDDLKAFRTHGSKTPGHPEYGHTAGVETTTGPLGQGAANAVGMAMAARYERGLFDPHAPEGESPFDHTIWAIVSDGDLEEGISAEASSLAGHQKLGNLVFLYDDNHISIEGDTATAFSEDVPKRYEAYGWHVQRIEPSADGDIDVHALHAALKAAQAETERPSFIAMRTIIAWPAPNAQNTEASHGSALGAEEIAATKRVLGSDPEQTFEVADEVLAHARRALDRGAEEHAAWDKRIAEWRTAQPERAKLFDRIVAGQLPEGWEQSLPVFEAGTSVATRAASGKVLQALGAVIPELWGGSADLAGSNNTTIDKTSSFLPKGNPLPEADPYGRTVHFGIREHSMAAEMNGIALHGNTRIYGGTFLVFSDYMRNAVRLSALMQLPVTYVWTHDSIGLGEDGPTHQPVEHLASLRAIPGLNIVRPADANETAIAWREILERHATHPAPHGLALTRQGVPTYEANEDAAKGGYVLQEASTGTPDVVLIATGSEVQLAVAARERLEAEGVGTRVVSMPSVEWFEEQSPEYRASVLPPSVKARVAVEAGIGLTWHRYVGDAGRIVSLEHFGASADAETLFAEFGFTAENVAAAARESITAARG

SEQ ID NO: 9766 - DNA, 1851 bp, Streptomyces avermitilis MA-4680
  CDS (1)..(1851): transl_table=11
atgaacacccgtcaactcaccgaactgggacagcagttgcgggtcgacagtgtccgtgccgcggacgccgcgagctccgggcaccccacctcctcgatgtccgccgcggacctgatggccgtactcctcgcccaccacctccgctacgacttcgaccgtcccgcccaccccggcaacgaccgcttcatcctttccaagggacatgcctcgccgctgctgtacgccgcctacaaggcggccggcgccatcgacgacgccgaactgctcaccttccgcgagctcggcagccgcctcgaagggcaccccacgccccgccggctgccctgggtcgagacggccaccggctcgctcggccagggtctgcccgtcggcgtcggcatcgcgctgtccggaaagcggctcgagcgcaccggttaccgtgtctgggtgctgtgcggcgacagcgaactcgccgagggctccgtgtgggaggccgccgagcacgccgggtacgagcacctcgacaacctcaccgcgatcgtcgacgtcaaccgcctcggccagcgcggccccacccggcacggacacgacctggacgcctacgcccgccggttccaggccttcggctggcacaccatcgagatcgacggtcacgacgtggacgccgtcgaccgtgcgtacggcgaggccgagtccaccagcggccagcccaccgtcatcctcgcccgcaccctcaagggcaagggcgtcgcggccgtcgaggaccgcgagggcctgcacggcaaaccgctgccggacgccgaggaggcgatcgccgaactcggcggcgtccgcgagctgcgcatcgaggtccaagatcccccggcggcacgggtgttgcacgccgtggccgcgccgggacaggtggagctcccgcgctacgacaagggtgacgaggtagccacccgcgacgcctacgggcaggcgctcaccgcgctcggcggcgcccgcgaggacgtcgtcgccatcgacggcgaggtcggcgactccacccgctccgagtacttcgccaaggagtatcccgaccgctacttcgagtgctacatcgccgagcagcagatggtcgccgccgccgtcggactcgccgcccgcggctgggtgccgtacgccgcgaccttcgccgcgttcctcacccgcgcccatgacttcgtgcgcatggcgtcgatcagcggtgcgggcatcaacctcgtcggctcgcacgccggcgtgtccatcggccaggacgggccctcgcagatgggactggaggacctcgcgatgttccggtcggtgtacgactcgaccgtcctctacccctgcgacgccaaccagacggcgaagctcgtcgccgcgatggccggcctcgacggcgtccgctatctgcggacctcgcgcggcgcgtcgcccgtcctgtacgggcccgacgaggagttcccggtcggcggcagcaaggtgctgcggtcctccggcgaggaccggctgacgctcgtcgcggccggcgtcaccgtccacgaggcgctggccgccgccgactcgctggccgaggcgggcatccgggcccgggtgatcgacctctactcggtcaagccggtcgaccgcgacaccctgcgccaggccgccgaggacaccggctgcctcctcaccgtcgaggaccaccgcgaggagggcggcatcggtgacgcggtcctcgacgccttcctcgacggacgccccgtgccccgcctggtgcgcctcgccgtccgtacgatgcccggctcggcgtccccggccgagcagttgcacgccgcgggcatcgacgccgagtcgatcgccaccgcggcccggctgctggtggaacaggccgtcgtgcgctga

SEQ ID NO: 9767 - protein, 616 aa, Streptomyces avermitilis MA-4680
MNTRQLTELGQQLRVDSVRAADAASSGHPTSSMSAADLMAVLLAHHLRYDFDRPAHPGNDRFILSKGHASPLLYAAYKAAGAIDDAELLTFRELGSRLEGHPTPRRLPWVETATGSLGQGLPVGVGIALSGKRLERTGYRVWVLCGDSELAEGSVWEAAEHAGYEHLDNLTAIVDVNRLGQRGPTRHGHDLDAYARRFQAFGWHTIEIDGHDVDAVDRAYGEAESTSGQPTVILARTLKGKGVAAVEDREGLHGKPLPDAEEAIAELGGVRELRIEVQDPPAARVLHAVAAPGQVELPRYDKGDEVATRDAYGQALTALGGAREDVVAIDGEVGDSTRSEYFAKEYPDRYFECYIAEQQMVAAAVGLAARGWVPYAATFAAFLTRAHDFVRMASISGAGINLVGSHAGVSIGQDGPSQMGLEDLAMFRSVYDSTVLYPCDANQTAKLVAAMAGLDGVRYLRTSRGASPVLYGPDEEFPVGGSKVLRSSGEDRLTLVAAGVTVHEALAAADSLAEAGIRARVIDLYSVKPVDRDTLRQAAEDTGCLLTVEDHREEGGIGDAVLDAFLDGRPVPRLVRLAVRTMPGSASPAEQLHAAGIDAESIATAARLLVEQAVVR

SEQ ID NO: 9768 - DNA, 2088 bp, Streptomyces avermitilis MA-4680
  CDS (1)..(2088): transl_table=11
gtgagcaccaagccgaccaccacagacctcgagtggaccgagttggaccagcgggccgtggacaccgcccgcgtcctggccgccgatgccgtacagaaggtcggcaacggccatcccggtacggcgatgagcctcgcgcctgccgcgtacaccctcttccagaaggtgatgcggcacgacccggcggatcccgactgggtcgggcgcgatcgtttcgtcctttccgcgggccactcgtccctgaccctctacaccgagctctacctggccgggttcggcctggagctggacgacctcaagtccttcaggacctggggcagccggactcccggccaccccgagtacgggcacacgcccggcgtggagacgacgaccggcccgctgggccagggtgtcgccaacgcggtgggcatggccatggcctcccgctacgagcgcggtctgttcgacccggacgccgcacccggcacctccccgttcgaccacttcatctacgcgatcgccggtgacggctgcctccaggagggcatctcccacgaggcgtcctcgctggccggccaccagaagctcggcaacctggtcctgctgtgggacgacaaccacatctcgatcgagggcgacaccgagacggccgtctccgaagacacggtgaagcgctacgaggcgtacggctggcatgtgcagcgcgtggccccgaagccggacggcgacctcgacccgcacgccctctacgacgcgatccaggccgccaaggcggtcacggacaagccgtcgttcatcgcgatgcgctcgatcatcgcctggcccgcgccgcacgcgcagaacaccgaggccgcgcacggctcggcgctcggcgaggacgaggtcgcggccaccaagcgcgtcctcggcttcgacccggagaagagcttcgaggtcgccgaggaggtcctcgcccacacccgtgaggccctcgaccgcggccgcgaggccaaggccgagtgggagaagggcttcgccgcctggcgcaccgcccagccggagcgcgccgccgagtacgagcgcatcgccgcgaccgagctgccggccggctgggaggagaagctcccggtcttcgaggtgggcaagggcatcgcgacgcgtgccgcgtccggcaaggtcctccaggcactcggcgcggtcatccccgagctgtggggcggctccgccgacctggccggctcgaacaacaccacgatcgacaagaactcctcgttcctgccggcggacaacccgctgccggaggccgacccgtacggccgcacgatccacttcggcatccgcgagcactccatggccgcggagatgaacggcatcgcgctgcacggcaacacccgtatctacggcggcaccttcctggtgttctccgactacatgcgcaacgccgtccgcctctccgcgctgatgcacctgccggtgacgtacgtgtggacccacgactccatcggtctcggcgaggacggccccacccaccagcccgtcgagcacctcgcctcgctgcgcgccatccccggcctcaacgtcgtgcgtcccgcggacgccaacgagacggcgatcgcctggcgcgagatcctcaagcgctacaccaaggtgttcggcaagggcgccccgcacggcctcgcgctgacccgtcagggcgtaccgacgtacgagcccaacgaggacgcggccaagggcggttacgtgctcttcgaggccgagggcggcgctcccgaggtcattctcatcggcaccggctccgaggtgcacgtcgccgtcgaggcgcgcgagcagctccaggccgcgggcgtgccgacccgggtggtgtccatgccgtccgtggagtggttcgaggagcaggaccaggggtaccgggacagcgtcctgccgccgtcggtgagggcgcgggtcgcggtcgaggcaggtatcggtcttacctggcaccggttcgtcggagacgccggacgcattgtttcgctggagcacttcggtgcttcggccgatggcaaggtgctcttccgggagttcggtttcactcccgagaacgtcgccgacgccgcccgggaatcgatcgccgcagcccagcgctga

SEQ ID NO: 9769 - protein, 695 aa, Streptomyces avermitilis MA-4680
MSTKPTTTDLEWTELDQRAVDTARVLAADAVQKVGNGHPGTAMSLAPAAYTLFQKVMRHDPADPDWVGRDRFVLSAGHSSLTLYTELYLAGFGLELDDLKSFRTWGSRTPGHPEYGHTPGVETTTGPLGQGVANAVGMAMASRYERGLFDPDAAPGTSPFDHFIYAIAGDGCLQEGISHEASSLAGHQKLGNLVLLWDDNHISIEGDTETAVSEDTVKRYEAYGWHVQRVAPKPDGDLDPHALYDAIQAAKAVTDKPSFIAMRSIIAWPAPHAQNTEAAHGSALGEDEVAATKRVLGFDPEKSFEVAEEVLAHTREALDRGREAKAEWEKGFAAWRTAQPERAAEYERIAATELPAGWEEKLPVFEVGKGIATRAASGKVLQALGAVIPELWGGSADLAGSNNTTIDKNSSFLPADNPLPEADPYGRTIHFGIREHSMAAEMNGIALHGNTRIYGGTFLVFSDYMRNAVRLSALMHLPVTYVWTHDSIGLGEDGPTHQPVEHLASLRAIPGLNVVRPADANETAIAWREILKRYTKVFGKGAPHGLALTRQGVPTYEPNEDAAKGGYVLFEAEGGAPEVILIGTGSEVHVAVEAREQLQAAGVPTRVVSMPSVEWFEEQDQGYRDSVLPPSVRARVAVEAGIGLTWHRFVGDAGRIVSLEHFGASADGKVLFREFGFTPENVADAARESIAAAQR

SEQ ID NO: 9770 - DNA, 1998 bp, Chlamydophila caviae GPIC
  CDS (1)..(1998): transl_table=11
atggtaaacagggaagtagacgtagatatcttggaaaagatctcaggaactcttaaacagttaagtatagagatcattcagaaagcgggttctggtcatccgggattgcctttgggttgtgcggaacttgccgcgtacctgtatagttatgttttgagacataacccaaaagatcctttatggattgatagggacaggtttgttttgtcagcagggcatggttcagcgttactatatgcctgccttcaccttgctggatatgatgtttctttagaggatcttcagcagtttcgtcagttgcattcacgaactcctggtcatccagaatttggagaaactgagggcgttgaagctactacaggacctttaggtcagggtgtaggtaatgctgtaggtatggctttatctatgaagatgcttcaagtgcgctttaatcgccctgaacatgaaatttttaacggtaaggtgtattgcctagccggtgacggatgcatgatggaaggtgttagccatgaagtctgtagcttggcagggacattaggcttagataatcttgtcgttatatatgactacaataacattgttttagacggcttcttaggagaagtaagttctgaagatgttaaaaagcgttttgaatcttacggctgggaagtttatgaaatcgatggctatgatttttcctcgattcatgaaacgtttgtaaaaattaaacagtcgcaacagcgtcctgtattaatagtagcccatacgattatagggcacggctctcctaaggaaggaagtcataaggctcacggatcgcctttaggtgaagatggcgtagaacagacaaaacgtttctggcatcttcctgaggaaaaattcttcatttctcctgcagtgaaatccttcttttcccataaattacaagaagatcgtaaagtgcaagaggaatggcagaatgatttccgtgtttggtcacgtcaattccccgatttacatcaagaatttctttctctaaaagcgccgatatcctctgaaacattagagacaatacttgaaagtgtggaaatgccagaagtcatagctggtcgtgccgcatctaacaagataattcaaaatttagctaagaatatcccttcacttattgggggatcagcagatttatcaagttcagatggaacctggatagcagaggctaaagaaattaatagccaagacttctccggcaggaatattaagtatggtgttcgagaatttggtatgggagccattatgaatggtttagcctattctcaagtatttcgaccttttggaggaacattcttagtattctctgattatttaagaaatgctattcgtttagcagcattggctaagctccctgttatttatcaatttactcatgactctatttttgttggtgaggatggtcctacacatcaacctatcgaacagatcatgtcattaagagctatcccaggtctgcaagttatccgccctggagatgccaatgaagtgaagggggcttggcatgcagcattgcgtcatcttggccctacagcattgattctttctcgacaaaacttgcctacattagcacagacagacagaccatttaaagagggtgtgggacgtggtgcttatattgttttaaaagagaccgaaggtaagcccgactatactttatttgctacgggatcagaattgcatttagcattagctgtagctcaggagctgatttacttagataagaaagttcgagtcatttccttcccatgttgggaattatttgaacaacaagattttgaatatcgagaaagtgtggtcggtggtgatttaggtttgcgagtctccatagaagcgggatctgcattgggttggtataagtatatcggtctcgatggtttggctattgctatggatagatttggctattcgggagctcccgctgatgtagcggaagcttgtggatttactgcggactgtattttacagagaatactttctcaataa

SEQ ID NO: 9771 - protein, 665 aa, Chlamydophila caviae GPIC
MVNREVDVDILEKISGTLKQLSIEIIQKAGSGHPGLPLGCAELAAYLYSYVLRHNPKDPLWIDRDRFVLSAGHGSALLYACLHLAGYDVSLEDLQQFRQLHSRTPGHPEFGETEGVEATTGPLGQGVGNAVGMALSMKMLQVRFNRPEHEIFNGKVYCLAGDGCMMEGVSHEVCSLAGTLGLDNLVVIYDYNNIVLDGFLGEVSSEDVKKRFESYGWEVYEIDGYDFSSIHETFVKIKQSQQRPVLIVAHTIIGHGSPKEGSHKAHGSPLGEDGVEQTKRFWHLPEEKFFISPAVKSFFSHKLQEDRKVQEEWQNDFRVWSRQFPDLHQEFLSLKAPISSETLETILESVEMPEVIAGRAASNKIIQNLAKNIPSLIGGSADLSSSDGTWIAEAKEINSQDFSGRNIKYGVREFGMGAIMNGLAYSQVFRPFGGTFLVFSDYLRNAIRLAALAKLPVIYQFTHDSIFVGEDGPTHQPIEQIMSLRAIPGLQVIRPGDANEVKGAWHAALRHLGPTALILSRQNLPTLAQTDRPFKEGVGRGAYIVLKETEGKPDYTLFATGSELHLALAVAQELIYLDKKVRVISFPCWELFEQQDFEYRESVVGGDLGLRVSIEAGSALGWYKYIGLDGLAIAMDRFGYSGAPADVAEACGFTADCILQRILSQ

SEQ ID NO: 9772 - DNA, 2043 bp, Bacillus cereus ATCC 14579
  CDS (1)..(2043): transl_table=11
atgtataaaacgtttactaatataagcgaagggaagaatagcatgtcacattcaatcgaacaactttctatcaacacgattcgcacattatccatcgatgcgattgaaaaagcaaactctggtcacccaggaatgccaatgggtgcagcaccaatggcttatacattatggactcaatttatgaaacacaatccaaataacccaacgtggtttaaccgtgatcgtttcgtattatctgcaggtcatggttcaatgttattatacagcctacttcacctatctggttatgatgtaacaatggatgacttaaagaacttccgtcaatggggaagcaaaactccaggacatcctgagtatggtcatacagctggtgtagatgcaacaactggtccacttggacaaggtattgcaactgctgtaggtatggcaatggctgaaagacatttagctgctaaatataaccgtgatgcgtataatgtagtagatcattatacatacgctatttgtggtgatggagatttaatggagggcgtttctgctgaagcatcttcattagctgctcatttacaattaggtcgtcttgttgtgctttacgattcaaacgatatttcattagatggcgatttaaatcgttcattctctgaaagtgtagaagatcgttacaaagcatacggatggcaagtaatccgtgttgaggatggaaacgatattgaagcaatcgcgaaagcaattgaagaagcgaaagctgacgaaaaacgcccaacgctaattgaagtaagaacgacaattggtttcggttctccaaacaaatcaggaaaatcagcttcacatggttctccacttggtgtagaagaaacaaaattaacgaaagaagcatatgcttggactgctgagcaagacttccacgtagcagaagaagtatatgacaacttccgtaaaacagtacaagatgttggtgaaactgcgcaagctgagtggaacacgatgctaggtgaatatgcacaagcatacccagaattagcaaacgaattccaagcagcaatgaacggtcaacttccagaaggttgggagcaaaacttaccaacttatgaattaggatcaaaagcagcaactcgtaattcttctggtgctgtaattaatgctattgcagagtctgtaccatcattcttcggtggatctgctgaccttgctggttctaacaaaacatacatgaataacgaaaaagactttacaagagatgattacagcggtaaaaacatttggtacggtgtacgtgagttcgcaatgggtgcagcaatgaacggtattgcactacatggtggtttaaaaacttacggtggtacgttcttcgtattctctgattacttacgtccagcaattcgccttgcagcattaatgcaattgccagtaacgtatgtattcacacatgacagtatcgctgttggtgaagatggtccaacacatgaaccaatcgagcaattagcagcgcttcgtgcaatgccaaacgtttctgttatccgtcctgctgatggtaacgaatctgttgcagcttggagactagctttagaatctacaaacaaaccaactgctttagtattaactcgtcaagaccttccaacattagaaggtgcaaaagatgatacgtatgaaaaagtagcaaaaggtgcatatgtagtttctgcaagcaagaaagaaacggctgacgtaatcttacttgcaactggatctgaagtaagcctagctgttgaagctcaaaaagcattagcagtagacggcgttgacgcagctgttgtcagcatgccatctatggatcgcttcgaagctcaaactgcagagtacaaagaatctgtattaccaaaagcagtaacaaaacgtttcgcaatcgaaatgggtgctacattcggatggcaccgttacgtaggtcttgaaggagatgtgttaggtatcgatacattcggtgcttctgctcctggtgagaagattatggaagagtatggatttactgtagagaacgttgttcgtaaagtaaaagaaatgctttaa

SEQ ID NO: 9773 - protein, 680 aa, Bacillus cereus ATCC 14579
MYKTFTNISEGKNSMSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYDNFRKTVQDVGETAQAEWNTMLGEYAQAYPELANEFQAAMNGQLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDAAVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 9774 - DNA, 2019 bp, Nitrosomonas europaea ATCC 19718
  CDS (1)..(2019): transl_table=11
atgaaggaagcatttaaagatttcagcgcaccagtgttcaagaatttgaccagtgcgattcgtgcactggccatggatgccgtccagaaagcaaattccggccatccgggtatgccaatgggtatggcggaaattgcagaagtattgtggaaccaccacatgcgccacaatccgacaaatcctgactgggtggatcgtgaccggtttgtactatcaaacggccatggttccatgctgatctatgctctgctccacctgaccggctacgatctgtccatcgaagacataaaaaatttccgtcagcttcattccaaaactccaggacaccctgaatacggctacacccccggtgtggaaaccaccacagggccgctgggacaaggtatcaccaatgccgtagggatggcgttggcagaaaaaattctggcagaagaattcaaccggccttatttcccgatcgtcgaccactacacctacgtatttctgggcgatggttgcatgatggaaggcatttcccatgaagcctgttcactggcaggaacattgaagctgggtaaactggtctgcttttatgatgataatggaatttccattgatggacatgtcgaaggatggtttacggacaacacccccaaacgcttcgaatcttatggctggcacgtcgttccagatgtcaacggacatgatcccgtagcaatacaggctgccatcgaagccgcgaagaaagtacaggacaaacccacactgatatgttgcaaaacagtcattggaatgggttcgcccaacaaagccaataccagccatgttcatggtgctgcgctcggaaatgacgaaattgctgcagcccgccctcacatcggctggaattacctgccattcgaaattccgcaagaagtttacgatgcatgggatgcgcgtgccaaaggtcaggcgctggaatccgcatggaacagcatgtttgcggaatacggcaaaaaatatccggcagaagccgctgaatttacccgccgcatggctgacgagttacccgtcgggtgggctgatcacgttgagggcactattagccagatcaatgccagggaagaaaccatcgcgacccggaaagcatcacaaaattcaattgaggcactggcaccggtattacccgaactgattggcggatcagcagacctggccggctccaacctcaccatgtggtctggttccaagggaattagcacagaatctaccggtaactatgttttttacggtgtccgggaatttggcatgagcgccatcatgaatggcctgtcgttgcatggcggaatcatcccctacggcggtactttcctgatgttttccgaatacgcccgcaatgctctgcgcatggcggcattgatgaaaattcgtaacattttcgtgttcactcatgattcgatcgggctaggggaagatggtccgacccatcagccggttgaacaaactgccacactgcgcatgattcccaatatggatgtatggcgtccgtgcgataccgttgaatcgatcgtttcatgggtatccgccattgagcgcagagaaggtccgtcatcccttatattcagccgccagaacctacccttccagaaacgggatgcagtaacgatcagcctgatcagaaaagggggatatatcctctctgaagcagcaaacagaaagccacaggccattatcattgcaaccggctcggaaatcgggttggcaatggctgcacagaaaacactggcagaaagcggtattgcagttcgcgtcgtatccatgccttgtacaaatatttttgacagacaggatcaggcgtaccgggacagtgttctgcccaagggaattgcacgtgtagctgtcgaagcaggggttaccgattactggcgtaaatacgtcggccttgaaggagatgtaatcggaatcgacagattcggtgaatcggctcctgcagaaaaattattcgaatatttcggatttaccgttgagaatgtcgtaaatgccgtgaaaagggttatataa

SEQ ID NO: 9775 - protein, 672 aa, Nitrosomonas europaea ATCC 19718
MKEAFKDFSAPVFKNLTSAIRALAMDAVQKANSGHPGMPMGMAEIAEVLWNHHMRHNPTNPDWVDRDRFVLSNGHGSMLIYALLHLTGYDLSIEDIKNFRQLHSKTPGHPEYGYTPGVETTTGPLGQGITNAVGMALAEKILAEEFNRPYFPIVDHYTYVFLGDGCMMEGISHEACSLAGTLKLGKLVCFYDDNGISIDGHVEGWFTDNTPKRFESYGWHVVPDVNGHDPVAIQAAIEAAKKVQDKPTLICCKTVIGMGSPNKANTSHVHGAALGNDEIAAARPHIGWNYLPFEIPQEVYDAWDARAKGQALESAWNSMFAEYGKKYPAEAAEFTRRMADELPVGWADHVEGTISQINAREETIATRKASQNSIEALAPVLPELIGGSADLAGSNLTMWSGSKGISTESTGNYVFYGVREFGMSAIMNGLSLHGGIIPYGGTFLMFSEYARNALRMAALMKIRNIFVFTHDSIGLGEDGPTHQPVEQTATLRMIPNMDVWRPCDTVESIVSWVSAIERREGPSSLIFSRQNLPFQKRDAVTISLIRKGGYILSEAANRKPQAIIIATGSEIGLAMAAQKTLAESGIAVRVVSMPCTNIFDRQDQAYRDSVLPKGIARVAVEAGVTDYWRKYVGLEGDVIGIDRFGESAPAEKLFEYFGFTVENVVNAVKRVI

SEQ ID NO: 9776 - DNA, 2001 bp, Mycoplasma gallisepticum R
  CDS (1)..(2001): transl_table=4
atctgttttaatatgaacatccaacaacaaaccataaacacaattcgcgttctgggaattgagatgataaacaatgccaaatctggacaccctggcatggttatgtcagcagcgccaatgatgtatgctttgtttcatgatcacttaaactatgatgttagcgatcccaactatcttaatcgtgatcggtttatcttaagtgcaggtcatggtagtgctttgttatatgccacaatgtatgtggctgggtataagacattaagtacaaaggatttaaagaattttagaaagttttcatctaaaacaccaggtcaccctgaatcaacaatgttagcgggtgttgattttggtacagggccattaggtcaaggtgcagcaacatctgttggttttgcgattgctgaagctaatttaagcgctcgctttgataagatcattaaccattatacttattgtttaattggtgatggcgatctgcaagaaggagtgtgtcaagaagctttagcagtagctggaagatataagcttaataaattaatctgactatatgattctaatgatgtgcaattagatggtcgggtagaaaactcaacaaattttgatgttgagatgttacttaaatcttatcgttgaaactacatcttaattaaagatggtaatgattatcaagcgatctcaaatgcgattgctcaagcaaagaaatctgataaaccaacttttattgaagttaaaactaaattaggttttgctagttcagttgagaatacaaacaaagctcacggttcaccttttagtgatgaagagattaaaaatattaaggctaagtttgattataagaacaaaccatttacattaagcactgaggttaaaaaccacttcgaatcagcgatctctcgtggacttaaagcagctgaagaatttaatcaacggttagctaaagctaaaccagaattaaaagaaaaattcattagccaaataaaagaagaaaagattaacttccctaagagtttaattaacgaatttaatgttgatcagtacgattcaacccgtaatttatttgggaaggtgttcaaagaactaaccaagattaatgacaatatccttgttgttaattgtgatctatcaagctcaacaaaagtggtcacgcacaataatgctagatttgatcacggccattatcaaaaccaatttgttgatgttggtgtaagagagttcttagcagggtgtattgttaatggggttgtggctcacaaaggtttaaaagctgtatcttcaacgtttatggcttttagtgattacaacaaacccgctctaagattaggcgcaattaacaagctaagttcattatacgtttattcgcacgactcatttaatgttggtgaagatggtccaactcaccaaccaattgaacaactttcagcactaagactgatcccagatgttttagtttatcgtccagctaatttttacgaactttacatagcgcttaaaactgcttttgataagaagaatcacaaaccagttgtcatatcaacttctagaagtgagtttgatctaactaaggttaatccaaaaacatttgatgagggctattattacctaaataaaactaagagccctaaactaagattaatcgcaactggttcagatgctggtacggctttaaagttagcaaaaatctttaaacaagaagggattgatatcgatgttatctctgtagcttcatttaagaaactaaaagaaaaactagctgatcttgaagttcttaaagaatttaagaaatacaaaaacatcgtgattgaatcaggtgtaagtaatatctggtttcaatttgttagtttagtaattggggttaatgattttggtttatcaggtaatccaaatgaagtggcaacttacttcagtatggatctagaatcattagtaaaatcattagcatcaatcttacataagaattacacacaacaaaagatcgaagaattaatcaaaaatgctaattaa

SEQ ID NO: 9777 - protein, 666 aa, Mycoplasma gallisepticum R
MCFNMNIQQQTINTIRVLGIEMINNAKSGHPGMVMSAAPMMYALFHDHLNYDVSDPNYLNRDRFILSAGHGSALLYATMYVAGYKTLSTKDLKNFRKFSSKTPGHPESTMLAGVDFGTGPLGQGAATSVGFAIAEANLSARFDKIINHYTYCLIGDGDLQEGVCQEALAVAGRYKLNKLIWLYDSNDVQLDGRVENSTNFDVEMLLKSYRWNYILIKDGNDYQAISNAIAQAKKSDKPTFIEVKTKLGFASSVENTNKAHGSPFSDEEIKNIKAKFDYKNKPFTLSTEVKNHFESAISRGLKAAEEFNQRLAKAKPELKEKFISQIKEEKINFPKSLINEFNVDQYDSTRNLFGKVFKELTKINDNILVVNCDLSSSTKVVTHNNARFDHGHYQNQFVDVGVREFLAGCIVNGVVAHKGLKAVSSTFMAFSDYNKPALRLGAINKLSSLYVYSHDSFNVGEDGPTHQPIEQLSALRLIPDVLVYRPANFYELYIALKTAFDKKNHKPVVISTSRSEFDLTKVNPKTFDEGYYYLNKTKSPKLRLIATGSDAGTALKLAKIFKQEGIDIDVISVASFKKLKEKLADLEVLKEFKKYKNIVIESGVSNIWFQFVSLVIGVNDFGLSGNPNEVATYFSMDLESLVKSLASILHKNYTQQKIEELIKNAN

SEQ ID NO: 9778 - DNA, 1959 bp, Helicobacter hepaticus ATCC 51449
  CDS (1)..(1959): transl_table=11
atgcaaaaaacctcaccacatattacagatgaagatatacctttattacaaaaaatgtcgcacacattagggtttttgtgtgcagatatggtgcaaaaagcaaatagcggacatcccggcgcacctatgggactttcagatattgcaagtgtgttacattttcatattaatcttgctccaacacaacctcaatggttaaatcgagatagaattatttttagtggaggacacgcaagcgcactcgtatattcgctccttcatttatggggttttgaggtgagtatggcagatttgcactcttttaggcaattagattctaaaacacccggacaccctgaatatagacatactcaaggtattgagataacaacaggtccccttgggcaaggtatagcaaatgcagtgggtatggctatggcaagtaaatatgcacagaatttgtttgggcgggaaatcatttcgcataatatatattgtttatgtggcgatggggatttacaggagggtatcagctatgaagcagcttctttagctggacatcacgctctttcaaatttgattcttatttatgatagtaatcatatcacaatagaaggcgatacgcaacttgcgatgagtgaggatattgctaaacgttttgaagcacagggttgggaagttttaagctgcgatggacacgactatatacaaattcacaatgtgcttaccaatgctaaaacttcttcaaaacccatacttattattgctcataccattatcgctaagaatgcccttagtcttgagggtagtcataaagcacacggcgcacctttgggtgaagaaattatcgccacagcaaagcaaaaactttcttttcctgcagaatctttttatatacctgatgatgtagcacttgcttttggcacgatgaaggagcgtggtgagttgaactttgcacaatggtataaaaattatgagaatctccctcaaattgcaaaagaacggcttgataaaatgagagagcccgatgtttcccatattgtttatccacaatttgcacttggcgaaagtatggctacacgtgtgagtaatggcaagattcttaatagtatttctcaagcgttagaaggatttattgggggaagtgcagatttagcaccatcaaataatacacagctacaagatgagggtgattttccgcagggtaaaaattggcattttggtatccgagaacacgcaatgggtgcaatttgtaatggtgtggcaaattatggcttatttttacctttttgcgcaacattttttgttttcagtgattatatgagcccaagtgtgcgtgtagcaagccttatgaaagcgaaagtatattatatttggacgcacgatagtataggtgtgggtgaagatggtgcgacacatcagcccattgaacaattaagccattttagagcaatgccaaatctccttgtttttcgtcccgctgatgcaaatgagaatattgcttgttggcaggttggcttagattccaagctaccttgcgcttttgtgcttagtcgtcagaatctccccgttattatggaatccactcctcaattaaaaaagcaagtgcaaaaaggcggttatgtattgcgttcgtgcgacaatgcagttattacccttatggcaagcggaagtgaggtaagtcttgcactcaaagcgtgtgaaacactagaagatttaggtatcaaaacacaagtagtaagtgtaccttgccttgatttgcttttggaacaacctaagggttacatcaaagaattatgcggaaaaagtgcagtgcttgctattgaggcttcaagaggcttagaatggtatgcagtggctgatgaagtgattggtatgcagagttttggtgcttcagggaaaggcgaagccctctttaatcgttttaattttaatatagattatatcatagctgctgcacaaaagcttattcaaaattaa

SEQ ID NO: 9779 - protein, 652 aa, Helicobacter hepaticus ATCC 51449
MQKTSPHITDEDIPLLQKMSHTLGFLCADMVQKANSGHPGAPMGLSDIASVLHFHINLAPTQPQWLNRDRIIFSGGHASALVYSLLHLWGFEVSMADLHSFRQLDSKTPGHPEYRHTQGIEITTGPLGQGIANAVGMAMASKYAQNLFGREIISHNIYCLCGDGDLQEGISYEAASLAGHHALSNLILIYDSNHITIEGDTQLAMSEDIAKRFEAQGWEVLSCDGHDYIQIHNVLTNAKTSSKPILIIAHTIIAKNALSLEGSHKAHGAPLGEEIIATAKQKLSFPAESFYIPDDVALAFGTMKERGELNFAQWYKNYENLPQIAKERLDKMREPDVSHIVYPQFALGESMATRVSNGKILNSISQALEGFIGGSADLAPSNNTQLQDEGDFPQGKNWHFGIREHAMGAICNGVANYGLFLPFCATFFVFSDYMSPSVRVASLMKAKVYYIWTHDSIGVGEDGATHQPIEQLSHFRAMPNLLVFRPADANENIACWQVGLDSKLPCAFVLSRQNLPVIMESTPQLKKQVQKGGYVLRSCDNAVITLMASGSEVSLALKACETLEDLGIKTQVVSVPCLDLLLEQPKGYIKELCGKSAVLAIEASRGLEWYAVADEVIGMQSFGASGKGEALFNRFNFNIDYIIAAAQKLIQN

SEQ ID NO: 9780 - DNA, 2052 bp, Rhodopirellula baltica SH 1
  CDS (1)..(2052): transl_table=11
atgccgatgactgccaccaccactgacaatcaaaccctcgccatcgacaccatccgctgcctcagcatggatgccgttcaaaccgccaacagtggtcaccccggcacgccgatggcgttggcccccatcgcgtatcaattgttccaaaacacaatgaattacgaccctgccaagccgcattggccgggccgggatcgatttgtgttgtcatgcggtcacgccagcatgctgctctacagcacgctgcacttgatcggcgtccaagcgacggaccgttacggcaaaccgaccggcggagaatcgatctcgctggaagacatcaagaatttccgccaaatcggcagcgtttgtgccgggcaccccgaattcgccgaagccgccgggatcgaaaccacgaccggacctctcggtgccggcgtcagcaacagcgtcggaatggcgatggccgaaaaatggttggccgccaactacaacaccgacgatctgacgctcttcaactacaacacctacgccatctgcagcgacggcgacttgatggaaggcatcgcgaccgaagctgcctccgtcgccggtcacttgaaactcgacaacctctgctggttgtacgacgacaacaacatcaccatcgaaggcgacaccgaactggccttcagcgaagacatgggcaagaagttcgaagggctcggatggaacgtccttcacgtggacgatgccaacgacgtcgaagcgctcggcaaagcgatcgcgaaattccaagcctgcggcgacaaacccactttgatcgtggtcaagtcgatcatcggctacggtgcgcccaacaagcaaaacacacacggagcccacggggcacctctgggttgggacgaagttgctctggccaagaagtcttacggtttgccggaagacgaaaagttctatgtccccgaaggtgttcggaagcacttcgccgaaggcgttggcaaacgcggcgcgactgcatcgagccaatgggaagacgtttggaccaagtaccaagctgccgagccagccaaggctgctgaattgaaagccatgttcgctggcgaattgcctgaaggttgggacaaagacatccctgtcttcgaagccgatgccaagggcgacgcaactcgcaacagcagcggcaaagtcctcaacgcgatcgccaagaacgttcccttcatgatcggcggaagtgctgacttggcaccgtcgaacaagtcggacttgaagttcgaaggtgccggcgaattcctgcctcgccagtacaaaggccgcaacttgcacttcggaattcgcgagcacgcgatgtccggaatcgccaacggtttgtgcttgtccggtttgcgtggttacgccgcgacgttctttgtcttcactgattacatgcgtggcggaatgcggttgtccagcatcatgcatcaaccaaccatgtacatcctgacgcacgattcgatcggcgtcggcgaagacggaccgactcaccaaccggtcgaacacctgaccgcttgccgtgcgatcccaggtttgaacgttttccgccctggtgattccaacgaagtcgctgagtgctatcgcaccgcgatggggatcaacgatcaccccagtgcattcgtcttgtcacgtcaaaacatgcccaccctggaccgcagcaagtacgccgcggcctcgggatgtgctcgcggtggttacatcctcagcgactgcgaaggcacgcccgacgtgatcctgatgggcagcggcagcgaactgtacatggccgttgatgcgggcgaacaactgaccgcccaaggcaaaaaggttcgcgtcgttagcatgccttgcatggacatctttgctcagcaagacgcctcatacatcaacgaagtcttgccacccgaagttaccaaccgcgttgccatcgaagccggtatccaaatgtgctgggatcgctggattggttcgcaaggcaaattcatcggcatgcactcgtttggtgccagtggcccatttgatgctgtttatgagcacttcggtatcaacgccgacgcggttgttaaagcagctctgtcctga

SEQ ID NO: 9781 - protein, 683 aa, Rhodopirellula baltica SH 1
MPMTATTTDNQTLAIDTIRCLSMDAVQTANSGHPGTPMALAPIAYQLFQNTMNYDPAKPHWPGRDRFVLSCGHASMLLYSTLHLIGVQATDRYGKPTGGESISLEDIKNFRQIGSVCAGHPEFAEAAGIETTTGPLGAGVSNSVGMAMAEKWLAANYNTDDLTLFNYNTYAICSDGDLMEGIATEAASVAGHLKLDNLCWLYDDNNITIEGDTELAFSEDMGKKFEGLGWNVLHVDDANDVEALGKAIAKFQACGDKPTLIVVKSIIGYGAPNKQNTHGAHGAPLGWDEVALAKKSYGLPEDEKFYVPEGVRKHFAEGVGKRGATASSQWEDVWTKYQAAEPAKAAELKAMFAGELPEGWDKDIPVFEADAKGDATRNSSGKVLNAIAKNVPFMIGGSADLAPSNKSDLKFEGAGEFLPRQYKGRNLHFGIREHAMSGIANGLCLSGLRGYAATFFVFTDYMRGGMRLSSIMHQPTMYILTHDSIGVGEDGPTHQPVEHLTACRAIPGLNVFRPGDSNEVAECYRTAMGINDHPSAFVLSRQNMPTLDRSKYAAASGCARGGYILSDCEGTPDVILMGSGSELYMAVDAGEQLTAQGKKVRVVSMPCMDIFAQQDASYINEVLPPEVTNRVAIEAGIQMCWDRWIGSQGKFIGMHSFGASGPFDAVYEHFGINADAVVKAALS

SEQ ID NO: 9782 - DNA, 2010 bp, Wigglesworthia glossinidia endosymbiont of Glossina brevipalpis
  CDS (1)..(2010): transl_table=11
atgaaaatttctagaaaaatattagctaatgctgtaagaatcttaagcatggatatagttgaaaacgctaaatctggacatccaggagctccaatgggtatgtcagatattgcagaagttttatggagaaattatttcaatcataatccaaataatcctaaatgggtgaacagagatcgttttgttttatctaatggacatgcatcatctttgatgtatagcattcttcatcttacagggtatgatttatcaatagaagatttaaaaaaatttcgtaaaattaattctaagactccaggtcatccagaaattggagtaactgaaggtgtagatatgactactggccctttagggcaaggaatatcaagcgcagtaggattagcaattagcgaaaaagttttatctcatcaatttaacaaaccagattgcgaaataataaatcattatacatacgtatttcttggagatggatgtatgatggagggtgtatcacatgagtcttgttctttagctggtactatgaaattaggaaaattaatagcattttatgacagtaataaaatttctatagatggtaaagtgcaagattggtttgatgaagatacttacaatagatttacatcatatggatggcatgtaataaaagacatagatggtcatgatcataaaaaaattgatttagcaattaaagaggcgattaataaaaaagataaaccatctttattgatatgtaatactattatcgcttttggatctccaaataaatctggaaattgcatttcccatggatcccctttagggaaaaaagaagttatatgtactagaaaagaattaaaatggaaacatcctccattttttattcctgaaaaaatttatgaatattggaatcataaatataaaggaaatttattagaaaataaatggaaaaaaaaatttgatatatattctgctagatatcctggattaagcaaagatctaacaagaaggttaaataatcttcttccaaaagattggagtaaaaaaataaacaatataataactagcatgaatttaaaaattaaaaacatttctaccagacaagcttctaataatttattagaaaaaataggaccaattcttccagagttattaggaggttctgctgatttaactcctagtaatttaacaaaatggtcaaagtctatttctataaaatctgatttttcaggaaattatatccattatggagcaagagaattcggaatgacgtctatagcaaatggaatatatactcatggagggtttattccttatacttcaacatttttagtgttttctgaatacgctagaagtgccattcgtactgcagcgttaatgaattctaaacatataatgatttatacgcatgattctataggtttaggggaagatggtcctacacatcagccaatagagcaattgagttgtttgagaatgatcccaaatttaagcgtatggcgtccatgcgatcaattagaaactgcaatatcttggaaatatgcaatagaaagaaacggacccacagctataatattatctcgtcaggatcttgttcaacaaaatcgttgcattgataaaatagatgatatatgtaaaggaggatatataattaaagattgtaaaagcattcctgatcttattttgatttcaactggatcagaagtacaaattgctattgatgcatgtagtattctttctaaaaataaatataaaattagagtagtttctatgccatcttcggatttatttgattctcagttagaatcttataaaaactttgttttacccattaaagttcctaaaatagttatagaagctggtagttcagtattttggaataaatatattggatataatgataaaataataggaatagatgaattcggaaaatctggatcatgcgaagatttatttaagttttttaaaattactaaaaataacgtagtaaataaatctaaagatttaataaataaaacaaaaattatgttttaa

SEQ ID NO: 9783 - protein, 669 aa, Wigglesworthia glossinidia endosymbiont of Glossina brevipalpis
MKISRKILANAVRILSMDIVENAKSGHPGAPMGMSDIAEVLWRNYFNHNPNNPKWVNRDRFVLSNGHASSLMYSILHLTGYDLSIEDLKKFRKINSKTPGHPEIGVTEGVDMTTGPLGQGISSAVGLAISEKVLSHQFNKPDCEIINHYTYVFLGDGCMMEGVSHESCSLAGTMKLGKLIAFYDSNKISIDGKVQDWFDEDTYNRFTSYGWHVIKDIDGHDHKKIDLAIKEAINKKDKPSLLICNTIIAFGSPNKSGNCISHGSPLGKKEVICTRKELKWKHPPFFIPEKIYEYWNHKYKGNLLENKWKKKFDIYSARYPGLSKDLTRRLNNLLPKDWSKKINNIITSMNLKIKNISTRQASNNLLEKIGPILPELLGGSADLTPSNLTKWSKSISIKSDFSGNYIHYGAREFGMTSIANGIYTHGGFIPYTSTFLVFSEYARSAIRTAALMNSKHIMIYTHDSIGLGEDGPTHQPIEQLSCLRMIPNLSVWRPCDQLETAISWKYAIERNGPTAIILSRQDLVQQNRCIDKIDDICKGGYIIKDCKSIPDLILISTGSEVQIAIDACSILSKNKYKIRVVSMPSSDLFDSQLESYKNFVLPIKVPKIVIEAGSSVFWNKYIGYNDKIIGIDEFGKSGSCEDLFKFFKITKNNVVNKSKDLINKTKIMF

SEQ ID NO: 9784 - DNA, 1998 bp, Haemophilus ducreyi 35000HP
  CDS (1)..(1998): transl_table=11
atgacagaacgtaaagtgctcgcgaatgcaattcgttttttaagtatggatgcagtacaaaaagctaattcaggccaccccggtgcgccgatgggaatggctgatattgctgaagtattatggcgtgatttcttgaagcataatccgactaatcctaaatgggcagatcgcgaccgctttgtgctctccaacggtcatggctccatgttaatttatagtttattgcatttgagcggttatgatctttcaattgaagatttaaaacaattccgtcaattgcactctaaaacacctggacatcctgaatatggttatgcacccggtgtagaaacaacgaccggtccgttaggtcaaggtattactaatgcggtaggaatggccattgctgaaaaaacattagcggctcaatttaaccgtgaaggccacaaaattgttgatcattatacttatgcctttttaggtgatggctgtctaatggaaggtatttcacatgaagcttgttcattagcgggcacattaggtttaggtaaactaattgctttttatgatgataataatatttctatcgatggccatgtagatggttggtttgctgatgatactgcacaacgttttgaagcctatggttggcaagtgattcggaatgtagatggacacgatgcaacccaaatcaaaatagcgattgaaaatgcacaagcggaaaaagatcgcccaacgttaattatctgtaaaacaattattggttatggttcaccaaacaaatctgcatcacacgattgccacggtgctccattaggtaatggggagattgcattaactcgccaagcattaaattggcaatatgcgccattcgaaattcctgcggatatctatgcagactgggatgctaaggcaaaaggttgcttaatcgaaaaagaatgggatgcaaaatttgttgcttatcagaccgcttatccagcgcttgctgctgaatttaaacgccgtatggcgggtgatttaccggcaaattggaaaacagaagccagtcactttattgaaacattacaagctaatcctgcttcaattgcaagccgtaaagcatcacaaaatgcgatcgaagcttatgcacatttattgcctgaacttttaggtggctctgcagatttagccagttcaaacttaacgctttggtctggttcaaaaccaattcgtgcggatcataatgttgatgggaattatatcaattatggggttcgtgaattcggtatgtctgccattatgaatggtattgcgttgcacggtggttttatcccttatggtgcgactttcttgatgttctatgaatatgcacataatgctgtacgtatggcagcattaatgaaacaacgtgccttatttgtttatacccatgattctatcggtttaggagaagatggtccaacgcatcaacccgtagaacagaccgcttcattacgttacattccaaatttagaaacgtggcgcccttgtgaccaagttgaatcagccattgcgtggaaatccgctattgaacgtcaagatgggccaactgcattgatctttacacggcaaaatttagcacagcaggcgcgtatggcagaacaattagcgaatgttgctcgtggcggttatgtattgaaagaggcatctggcactccagatttaatcttaattgcgacaggatctgaagtcgaacttgcaattaaagccgctgaagtgcttgaaaatgaaggtaaaaaagtacgcgtagtgtcgatgccatcaacgaatattttcgataaacaaagcgaagcttatcgtgagtcagtgttacctcgcgctatcaccaaacgcatagcgattgaagcacaattatctgatttctggtacaaatacgttggctttgaaggccgtattatcggtatgaatagttttggtgaatcagcacctgcagatcaattattcaaattatttggttttagcgtggaaaacgtggtggccaaagcaaaagaaatgtggtaa

SEQ ID NO: 9785 - protein, 665 aa, Haemophilus ducreyi 35000HP
MTERKVLANAIRFLSMDAVQKANSGHPGAPMGMADIAEVLWRDFLKHNPTNPKWADRDRFVLSNGHGSMLIYSLLHLSGYDLSIEDLKQFRQLHSKTPGHPEYGYAPGVETTTGPLGQGITNAVGMAIAEKTLAAQFNREGHKIVDHYTYAFLGDGCLMEGISHEACSLAGTLGLGKLIAFYDDNNISIDGHVDGWFADDTAQRFEAYGWQVIRNVDGHDATQIKIAIENAQAEKDRPTLIICKTIIGYGSPNKSASHDCHGAPLGNGEIALTRQALNWQYAPFEIPADIYADWDAKAKGCLIEKEWDAKFVAYQTAYPALAAEFKRRMAGDLPANWKTEASHFIETLQANPASIASRKASQNAIEAYAHLLPELLGGSADLASSNLTLWSGSKPIRADHNVDGNYINYGVREFGMSAIMNGIALHGGFIPYGATFLMFYEYAHNAVRMAALMKQRALFVYTHDSIGLGEDGPTHQPVEQTASLRYIPNLETWRPCDQVESAIAWKSAIERQDGPTALIFTRQNLAQQARMAEQLANVARGGYVLKEASGTPDLILIATGSEVELAIKAAEVLENEGKKVRVVSMPSTNIFDKQSEAYRESVLPRAITKRIAIEAQLSDFWYKYVGFEGRIIGMNSFGESAPADQLFKLFGFSVENVVAKAKEMW

SEQ ID NO: 9786 - DNA, 2010 bp, Prochlorococcus marinus subsp. marinus str. CCMP1375
  CDS (1)..(2010): transl_table=11
atggtcgctgcgcctgtttctcttgaatcgctctgcattaacagcataagaatgctcgctgtagatgcagtaaataaatccaaaagtgggcatcctggcctgcctatgggatgtgcacctatggggtataccctatgggacaaatttctcagacataatcctaaaaatcctaagtggttcaatcgagaccgttttgttctttctgcaggtcatgggtgcatgcttttatatgcactgttgcatttaactggctatgactcagtcacgatcgatgatataaaacaatttcgtcaatggggtgcaagaactcctggtcaccctgaaacatttgaaactgctggtgtagaagtaaccgcggggccattgggagcaggcatatcaaacgcagtaggccttgcaatagcagaagcccatcttgctgccaaattcaataaagcagatgccaaaatcgttgatcacttcacatacgtgataatgggagatggatgcaatcaagagggagttgcatcagaagcttgctctcttgcaggccatctcaagttaggtaaattaattgcgttatatgacgacaatcacataacaattgatggtcgaactgatgtttcattcacagaggatgtactaaaacgctatgaatcctatggatggcatgttcaacatgttcaagaaggtaatactgatgtagatgcaattgccaaagcaattgagtcagcaaaagcaatttctgacaaaccatccattatcaaagttacaacaacaattggttttggatctcctaacaaaagtgataccgcaggagttcatggtgcgcctctaggcgaggaagaggctgaactgactaggaaatcattggattggccatatgaaccctttgaaattcctaatgaggtttatcagcaatatcaaaaagcaatagtgcgtggcgagagcttagaaaaagaatggaatcaattgttagataattatcgaaaaaaatattctaatgaagctgaagaattcgaaagaatgttaagaggtgaactcccttcagactgggataaagacttaccttcatacacccctaaagacaatggactagcaactcgaaaacattctcaaatatgtctaggtgcaattggtcccaatcttcctgaactaattggtggttctgctgatttaactcactcaaattacacagacatcaagggtgaaagtggttctttccagcctgaaacacctgagaaacgttaccttcactttggtgtcagagaacatgcgatggcagcaatactgaatggaattgcttatcacaacagtggattaataccctatggaggaactttcctcgttttcgctgattacatgagagggtcgatgcgattatctgctctcagtgaacttggcgttatctacgtattgactcatgactccattggtgttggagaggatggtcctactcatcaacccattgaaactattccttctctacgagcaataccaaatatgcttgtttttagaccaggagatggcaatgaaacttctggaagctataaacttgcaatagaaaatcgcaaacgtcctagttctctttgtctcagcagacaaggcatgcctaatcaagcaaattcatcaagtaaaaaagttgcattaggaggatacgttattgaggattgtgtaggcacaccagatctcattttgattggtacaggttccgaattaaatctatgtattgaagctgctcaagagctaacaaatcaaggtaaaaaaattagagttgtttcaatgccttgtatggaactttttgaagagcaaagcgcatcatacaaagaagaggttttacctcctcttgttagaaaaaggttagttgtagaagctgcactgtcattcggatggcataaatatataggccttgatggagacagcgttactatgaatagtttcggcgcatctgcacccggaggaacatgtatggaaaaatttgggtttacagttgaaaatgttatcaataaagcaaagaaacttcttaactaa

SEQ ID NO: 9787 - protein, 669 aa, Prochlorococcus marinus subsp. marinus str. CCMP1375
MVAAPVSLESLCINSIRMLAVDAVNKSKSGHPGLPMGCAPMGYTLWDKFLRHNPKNPKWFNRDRFVLSAGHGCMLLYALLHLTGYDSVTIDDIKQFRQWGARTPGHPETFETAGVEVTAGPLGAGISNAVGLAIAEAHLAAKFNKADAKIVDHFTYVIMGDGCNQEGVASEACSLAGHLKLGKLIALYDDNHITIDGRTDVSFTEDVLKRYESYGWHVQHVQEGNTDVDAIAKAIESAKAISDKPSIIKVTTTIGFGSPNKSDTAGVHGAPLGEEEAELTRKSLDWPYEPFEIPNEVYQQYQKAIVRGESLEKEWNQLLDNYRKKYSNEAEEFERMLRGELPSDWDKDLPSYTPKDNGLATRKHSQICLGAIGPNLPELIGGSADLTHSNYTDIKGESGSFQPETPEKRYLHFGVREHAMAAILNGIAYHNSGLIPYGGTFLVFADYMRGSMRLSALSELGVIYVLTHDSIGVGEDGPTHQPIETIPSLRAIPNMLVFRPGDGNETSGSYKLAIENRKRPSSLCLSRQGMPNQANSSSKKVALGGYVIEDCVGTPDLILIGTGSELNLCIEAAQELTNQGKKIRVVSMPCMELFEEQSASYKEEVLPPLVRKRLVVEAALSFGWHKYIGLDGDSVTMNSFGASAPGGTCMEKFGFTVENVINKAKKLLN

SEQ ID NO: 9788 - DNA, 2052 bp, Chlamydophila pneumoniae TW-183
  CDS (1)..(2052): transl_table=11
ttggggatttcctatagttgctgcttttacatagaaggtctccagggtttacttatgatcaataaagaattagatattggtattttaggaaaaattgctggggctattaaacaaattagtattgaatccatccaaaaggcctcttctggtcatccaggacttcccctaggatgcgcagaacttgctgcctatttatatggttatgtcctgcggcaaaatccacgtgatccccattggattaatagggatcggtttgtcttgtcagcaggtcatggatctgttcttctctattcttgtttgcatcttgccggatttgatgtttccttagaggatcttcaggaatttcgccagcttcactcccgaactcccgggcatcccgagtacggcgaaactgtgggagtcgaagcaacgacaggtcctctgggacagggattaggcaatgctgtcggcatggcgctctctatgaagatgttggaatcccgattcaatcgcccaggacatgagatttttaacggaaaaatctattgtttggcaggggatggctgttttatggagggagtcagccacgaagtttgtagctttgcaggctctttaaatttaaataatcttgtggtcatctatgactacaataatgttgttctcgatggatatcttaatgaaattagtgttgaggatacaaaaaaacgttttgaagcctatggctgggatgtatatgaaattgatgggtatgattttacccatattcatgagacattctcgagcatcaaacgggggcaggaacgtcctgtattagtgattgcacatacaattattggtcatggttcgcctaaggaagggacaaataaggctcatggttctcctttaggagtcgaagggactcatgaaacaaaacagttttggcatctccctgaagaaaagttttttgtccctcctgcagtaaagaacttctttgctcataaaatacaagaagatcgaaaagcacaggagcaatggctggatgaagttcgtgtttggtcaaaacagttcccagaattacacgaagaattcgttgcgttgacctctcataagttacctaaaaacttagaatccttggtgcagagtgtagaaatgccagactctatagctggccgggctgcttcaaataaactgatccaagtattagtacagcacattccttatttgattggagggtccgcagatctttcaagctcagatggaacttggattgcgaatgagaaagtcatccatacgtatgacttctctggaaggaacattaaatacggcgttcgtgagtttggtatggccacaatcatgaatggtttagcttatagccaggtatttcgtccttttggtggaacatttttagttttttctgactatatgcgtaatgcaattcgcttggccgcattatctaaattaccagtcatctatcaatttacccatgattctatatttgttggagaagatggacctacgcatcagcctgtggaacaattgatgtctttgcgcgcgatccctggattgtatgtaatacgtcctgccgatgctaatgaagttagaggagcgtggattgcaggattaaagcacacaggtcctacagtcattgtcttgtcgcgacaagcattgcccacactgcctgctgcgcatcggccttttaaagatggtgtaggtcgtggtgcttatattgtcttaaaagagtcaggagaaaaaccagactatactctcttcgctacagggtcagaagtttctttagctctttctgtagctaaagaactcgaacacttggataagcaagtgcgtgtagtttctttcccttgttgggagctttttgaagctcaagatgtggactacaaacagagtattgtaggcggagatcttggaattcgtgtctctatagaagcaggatctgctttggggtggtataagtatatcggatctgaaggtttagctatcgctatggatagattcggatactcaggagcttctgatgatgtatcagaagaatgtggctttactacagagcaaatccttcagaggattctctctcaatag

SEQ ID NO: 9789 - protein, 683 aa, Chlamydophila pneumoniae TW-183
MGISYSCCFYIEGLQGLLMINKELDIGILGKIAGAIKQISIESIQKASSGHPGLPLGCAELAAYLYGYVLRQNPRDPHWINRDRFVLSAGHGSVLLYSCLHLAGFDVSLEDLQEFRQLHSRTPGHPEYGETVGVEATTGPLGQGLGNAVGMALSMKMLESRFNRPGHEIFNGKIYCLAGDGCFMEGVSHEVCSFAGSLNLNNLVVIYDYNNVVLDGYLNEISVEDTKKRFEAYGWDVYEIDGYDFTHIHETFSSIKRGQERPVLVIAHTIIGHGSPKEGTNKAHGSPLGVEGTHETKQFWHLPEEKFFVPPAVKNFFAHKIQEDRKAQEQWLDEVRVWSKQFPELHEEFVALTSHKLPKNLESLVQSVEMPDSIAGRAASNKLIQVLVQHIPYLIGGSADLSSSDGTWIANEKVIHTYDFSGRNIKYGVREFGMATIMNGLAYSQVFRPFGGTFLVFSDYMRNAIRLAALSKLPVIYQFTHDSIFVGEDGPTHQPVEQLMSLRAIPGLYVIRPADANEVRGAWIAGLKHTGPTVIVLSRQALPTLPAAHRPFKDGVGRGAYIVLKESGEKPDYTLFATGSEVSLALSVAKELEHLDKQVRVVSFPCWELFEAQDVDYKQSIVGGDLGIRVSIEAGSALGWYKYIGSEGLAIAMDRFGYSGASDDVSEECGFTTEQILQRILSQ

SEQ ID NO: 9790 - DNA, 1995 bp, Candidatus Blochmannia floridanus
  CDS (1)..(1995): transl_table=11
atgttacatgaacaaatgttagctaatgctatacgcattttaagtatagactgtatacaacatgctaattctggacatccaggagctcctatgggaatggcagatattgctgaagttttatggagagagtacatgaatcataaccccaaaaatccaaactggataaaccgagatagattcattttatctaacggccacgcttccatgttactatatagtattttacatcttactggatataaaatatccatagaagatttaaaaaattttaggcaactacattctaaaacacctggccatccagaatataaacacactgatggagtggaagtaactacaggtccattaggacaaggcttagctaatgctgtaggatttgccatcgccgaacgaactttagcaaatcaatttaaccgcccgttattcaacataattgatcattatacttatgttttcgttggagatggttgtatgatggaaggaatatcacacgaatcttgttcattagcaggaacaatgaaattaaataaattgattgttttatatgataaaaacggaatttccatagacggatctgttgaagaatggttttctgataacactgcagcaagatttgaatcttatgggtggcatgtcatacctgatgtagatggtcataacagaaaatctattaacatcgcaatcaaccaagcaaaatctatattaaataaaccgtctttaataatttttaaaactattatagcctttggctctcctaataaaagtggccaatcttgtactcatggatctcctttgggaacatcagaaattttagctacccgcaataagttatgttggaatgaacaaacaccattccttattccacaaaaaatatataaattatgggatgccacaataataggacaacaaaaagagaatatatggaaccaaatgtttcttcaatatcaaaaaacttatcctgatttagctcaagaacttacaagacgtgtacaatgcaaattacctatttactggaacacaaaaatccaaaaacttatcaaacaattaagtaccaatcctcaaaatattgccactcgccaatcttcacaaattgttatcgaatatatttctaaatatttacctgaactattaggaggatcagcagatttaacttctagcaatttgacaacttattcacagtcttcttctattatacaaaatccttctggcaattatattcactatggtgtacgagaattcggaatgactgctatagccaatggtatatctgtacatggaggttttttaccatatacagcaacttttttaacattcagtgactattcaaaaaatgccattcgtatggcagctttaatgaataatcgacatattatgatttatactcatgattcaatcggattaggagaagatggacctactcatcaacctatcgaacaattatccagtttacgtatgataccaaatctacagatttggagaccttgcgatcaaatagaaacagtaattgcttggaaaacagctatcgaaaatacaggaccaactgttttaatattaactagacaaacactaaaacaacaaaaaaacacaatcataaatatgacaaatatctctaaaggaggatatatattacaagattgttacaacactcctgaattaataatcattgctactggatcagaaatagaacttgcggtaaatatatatcatcaattaactaatgaaggatataaaatacgtatcgtttctatgccttgcactaatatatttgaccaacaaaatgcaacctatcgcgaacaagtactaccacaaacagtaactaaacgattagctatcgaagctggtcacagcgatttatggtataaatatgttggattacatggcaaggttattggtataaacacttttggcaaatctgctccagcacatgatctatttaattttttcggttttacgaaaaatcatattttacaagaaatcaatatattattacaataa

SEQ ID NO: 9791 - protein, 664 aa, Candidatus Blochmannia floridanus
MLHEQMLANAIRILSIDCIQHANSGHPGAPMGMADIAEVLWREYMNHNPKNPNWINRDRFILSNGHASMLLYSILHLTGYKISIEDLKNFRQLHSKTPGHPEYKHTDGVEVTTGPLGQGLANAVGFAIAERTLANQFNRPLFNIIDHYTYVFVGDGCMMEGISHESCSLAGTMKLNKLIVLYDKNGISIDGSVEEWFSDNTAARFESYGWHVIPDVDGHNRKSINIAINQAKSILNKPSLIIFKTIIAFGSPNKSGQSCTHGSPLGTSEILATRNKLCWNEQTPFLIPQKIYKLWDATIIGQQKENIWNQMFLQYQKTYPDLAQELTRRVQCKLPIYWNTKIQKLIKQLSTNPQNIATRQSSQIVIEYISKYLPELLGGSADLTSSNLTTYSQSSSIIQNPSGNYIHYGVREFGMTAIANGISVHGGFLPYTATFLTFSDYSKNAIRMAALMNNRHIMIYTHDSIGLGEDGPTHQPIEQLSSLRMIPNLQIWRPCDQIETVIAWKTAIENTGPTVLILTRQTLKQQKNTIINMTNISKGGYILQDCYNTPELIIIATGSEIELAVNIYHQLTNEGYKIRIVSMPCTNIFDQQNATYREQVLPQTVTKRLAIEAGHSDLWYKYVGLHGKVIGINTFGKSAPAHDLFNFFGFTKNHILQEINILLQ

SEQ ID NO: 9792 - DNA, 2037 bp, Bordetella parapertussis 12822
  CDS (1)..(2037): transl_table=11
atgagcaacccgaccgcccctaaacttgccttggcggatgccatccgcgtacttgcgatggacgccgtgcagaaagcgaattccggacaccccggcgcgcccatgggaatggccgaaatcgcgcaagcgctgtggctgggcaacctgcgccacaacccggccgatccggcctgggccaaccgcgaccgcttcgtgctgtccaatggccacggctcgatgctgatatacgccctgctgcacctgacgggctacgatctgcccctggaagagctgaagaacttccgccagctgcattcgcgcacgccggggcaccccgaagtgggcatcaccccgggcgtggaaaccaccaccggcccgctgggccagggcctggccaacgcggtcggcatggcgctggccgaggccctgctggcggccgaattcaaccgcgccggccacacggtggtggaccaccacacctatgtctttctgggcgacggctgcctgatggaaggcatctcgcacgaggcctgctcgctggccggcacgctcaagctgtccaagctggtggcgctgtacgacgacaacggcatttccatcgacggccatgtcgagcactggttcgccgacgacacggcgacccgcttcgagggctacggctggaatgtgatccgcggcgtggacggccacgacgtggcggcggtggacgcggccatcaagcaggcgcgcgcgcaatccgagaaacccaccctgatcgtctgccgcaccgtgatcggcaagggttcgcccaacatggccggcacgcacaatgtgcacggcgcgccgctgggcaacgacgagatcgccgccacccgcgcggcgctgggctggtcggccggccccttcgaggtgccgcaggatatctacgccgcgtgggacagccgtcccgccggcgcgctggcgcaggccgcctgggaagacaagttccaggcctatgcggcccagtatccggccgaggccgccgaattcacgcgccgcatgaagggcgagctgcccgaaggcttcgccgcccggttcgaggccttcctgcaggccaccgtggccaagggcgagacggtcgccacccgcaaggcgtcgcagttcgccatcgccgagctggccggcctgctgccggagatgctgggcggctcggccgacctgaccggctcgaacttcaccgactggaagggcgtggcgccgctgcgcgccggccatcacggcgtgcatttcggccgccatatcaactacggcgtgcgcgagttcggcatggccgccatcatgaacggcatcgcgctgcatggcggctacctgccgttcggcggcaccttcctgacgttctcggactactcgcgcaacgccatccgcatggcggcgctgatgaagcagcgcgtggtgcacgtgttcacgcacgattccatcggcctgggcgaggacggtccgacccaccagtcgatcgaacacgccgccagcctgcgcctgattcccaacctgtcggtgtggcggccctgcgacaccgtcgagacggccgccgcctggggcgctgccgtgacgcggccggccagcatcggcatggacgtgcacgacggcggcccgaccgcgctgctgctgtcgcgccagaacctgccgttcgtggcgcgcgacgaggccacgcagaaagcgattgttcgcggtggttacgtcttgcgcgacgcacacgacgcgcgtgcggctatcatcgccacgggctcggaagtcgccatcgcgctggccgcgcaggaattgctggccgccgacggcatcgccgtgcgggtggtttccatgcccagcaccgacgtgttcgaccgccaggacgccgaatggaagcgcgaagtgctgccggccggcatgccgcgcgtggccgtcgaggcgggcgtgaccgcgttctggcacaaatacgtgggcctggaaggcgccgtggtgggtatcgaccgctatggcgagtcggcgcccgacggggctttgttcaaattcttcggactgaccgctgaaaaggtggccgaggccgtcaagcaggttttgtaa

SEQ ID NO: 9793 - protein, 678 aa, Bordetella parapertussis 12822
MSNPTAPKLALADAIRVLAMDAVQKANSGHPGAPMGMAEIAQALWLGNLRHNPADPAWANRDRFVLSNGHGSMLIYALLHLTGYDLPLEELKNFRQLHSRTPGHPEVGITPGVETTTGPLGQGLANAVGMALAEALLAAEFNRAGHTVVDHHTYVFLGDGCLMEGISHEACSLAGTLKLSKLVALYDDNGISIDGHVEHWFADDTATRFEGYGWNVIRGVDGHDVAAVDAAIKQARAQSEKPTLIVCRTVIGKGSPNMAGTHNVHGAPLGNDEIAATRAALGWSAGPFEVPQDIYAAWDSRPAGALAQAAWEDKFQAYAAQYPAEAAEFTRRMKGELPEGFAARFEAFLQATVAKGETVATRKASQFAIAELAGLLPEMLGGSADLTGSNFTDWKGVAPLRAGHHGVHFGRHINYGVREFGMAAIMNGIALHGGYLPFGGTFLTFSDYSRNAIRMAALMKQRVVHVFTHDSIGLGEDGPTHQSIEHAASLRLIPNLSVWRPCDTVETAAAWGAAVTRPASIGMDVHDGGPTALLLSRQNLPFVARDEATQKAIVRGGYVLRDAHDARAAIIATGSEVAIALAAQELLAADGIAVRVVSMPSTDVFDRQDAEWKREVLPAGMPRVAVEAGVTAFWHKYVGLEGAVVGIDRYGESAPDGALFKFFGLTAEKVAEAVKQVL

SEQ ID NO: 9794 - DNA, 2037 bp, Bordetella bronchiseptica RB50
  CDS (1)..(2037): transl_table=11
atgagcaacccgaccgcccctaaacttgccttggcggatgccatccgcgtacttgcgatggacgccgtgcagaaagcgaattccggacaccccggcgcgcccatgggaatggccgaaatcgcgcaagcgctgtggctgggcaacctgcgccacaacccggccgatccggcctgggccaaccgcgaccgcttcgtgctgtccaatggccacggctcgatgctgatctacgccctgctgcacctgacgggctacgatctgcccctggaagagctgaagaacttccgccagctgcattcgcgcacgccggggcaccccgaagtgggcatcaccccgggcgtggaaaccaccaccggcccgctgggccagggcctggccaacgcggtcggcatggcgctggccgaggccctgctggcggccgaattcaaccgcgccggccacacggtggtggaccaccacacctatgtcttcctgggcgacggctgcctgatggaaggcatctcgcacgaggcctgctcgctggccggcacgctcaagctgtccaagctggtggcgctgtacgacgacaacggcatttccatcgacggccatgtcgagcactggttcgccgacgacacggcgacccgcttcgagggctacggctggaacgtgatccgcggcgtggacggccacgacgtggcggcggtggacgcggccatcaagcaggcgcgcgcgcaatccgagaaacccaccctgatcgtctgccgcaccgtgatcggcaagggttcgcccaacatggccggcacgcacaatgtgcacggcgcgccgctgggcaacgacgagatcgccgccacccgcgcggcgctgggctggtcggccggccccttcgaggtgccgcaggatatctacgccgcgtgggacagccgtcccgccggcgcgctggcgcaggccgcctgggaagacaagttccaggcctatgcggcccagtatccggccgaggccgccgaattcacgcgccgcatgaagggcgagctgcccgaaggcttcgccgcccggttcgaggccttcctgcaggccaccgtggccaagggcgagacggtcgccacccgcaaggcgtcgcagttcgccatcgccgagctggccggcctgctgccggagatgctgggcggctcggccgacctgaccggctcgaacttcaccgactggaagggcgtggcgccgctgcgcgccggccatcacggcgtgcatttcggccgccatatcaactacggcgtgcgcgagttcggcatggccgccatcatgaacggcatcgcgctgcatggcggctacctgccgttcggcggcaccttcctgacgttctcggactactcgcgcaacgccatccgcatggcggcgctgatgaagcagcgcgtggtgcacgtgttcacgcacgattccatcggcctgggcgaggacggtccgacccaccagtcgatcgaacacgccgccagcctgcgcctgattcccaacctgtcggtgtggcggccctgcgacaccgtcgagacggccgccgcctggggcgctgccgtgacgcggccggccagcatcggcatggacgtgcacgacggcggcccgaccgcgctgctgctgtcgcgccagaacctgccgttcgtggcgcgcgacgaggccacgcagaaagcgattgttcgcggtggttacgtcttgcgcgacgcacacgacgcgcgtgcggctatcatcgccacgggctcggaagtcgccatcgcgctggccgcgcaggaattgctggccgccgacggcatcgccgtgcgggtggtttccatgcccagcaccgacgtgttcgaccgccaggacgccgaatggaagcgcgaagtgctgccggccggcatgccgcgcgtggccgtcgaggcgggcgtgaccgcgttctggcacaaatacgtgggcctggaaggcgccgtggtgggtatcgaccgctatggcgagtcggcgcccgccggggctttgttcaaattcttcggactgaccgctgaaaaggtggccgaggccgtcaagcaggttttgtaa

SEQ ID NO: 9795 - protein, 678 aa, Bordetella bronchiseptica RB50
MSNPTAPKLALADAIRVLAMDAVQKANSGHPGAPMGMAEIAQALWLGNLRHNPADPAWANRDRFVLSNGHGSMLIYALLHLTGYDLPLEELKNFRQLHSRTPGHPEVGITPGVETTTGPLGQGLANAVGMALAEALLAAEFNRAGHTVVDHHTYVFLGDGCLMEGISHEACSLAGTLKLSKLVALYDDNGISIDGHVEHWFADDTATRFEGYGWNVIRGVDGHDVAAVDAAIKQARAQSEKPTLIVCRTVIGKGSPNMAGTHNVHGAPLGNDEIAATRAALGWSAGPFEVPQDIYAAWDSRPAGALAQAAWEDKFQAYAAQYPAEAAEFTRRMKGELPEGFAARFEAFLQATVAKGETVATRKASQFAIAELAGLLPEMLGGSADLTGSNFTDWKGVAPLRAGHHGVHFGRHINYGVREFGMAAIMNGIALHGGYLPFGGTFLTFSDYSRNAIRMAALMKQRVVHVFTHDSIGLGEDGPTHQSIEHAASLRLIPNLSVWRPCDTVETAAAWGAAVTRPASIGMDVHDGGPTALLLSRQNLPFVARDEATQKAIVRGGYVLRDAHDARAAIIATGSEVAIALAAQELLAADGIAVRVVSMPSTDVFDRQDAEWKREVLPAGMPRVAVEAGVTAFWHKYVGLEGAVVGIDRYGESAPAGALFKFFGLTAEKVAEAVKQVL

SEQ ID NO: 9796 - DNA, 2007 bp, Prochlorococcus marinus subsp. pastoris str. CCMP1986
  CDS (1)..(2007): transl_table=11
atggtcgctgcatctgtttcattagaatcactatgtgtaaatagtataagaatgctggctgtagatgcagtaaataaatctaatagcgggcatcctggcttacctatgggttgcgctcctatgggttacgcattatggcacaatatcctcaatcacaatcccaataatccaaagtggtttaatagagatcgctttgtattatcagcgggacatgggtgtatgttgttatattctcttctgcatctgactggatataaatcagtttccattgaagatattaaagaatttagacaatggggatctaagacacctggacacccagaaacatttgaaactgagggtgttgaggtaacagcggggccattaggggcaggaatttccaacgcagttggtttagcaattgcagaagcacacttagcagctaaattcaataaaaaagattgcgaaattgttgatcattatacctatgtaataatgggagacggttgtaatcaagaagggattgcctctgaggcatgttcacttgctggacatcttaagcttggaaaattaatagctctatatgacgataatcaaatcacaattgatggacgtacagatgtttcatttacagaagatgttttaaaaagatacgaagcttatggatggcatgtgcaacatgttgaagatggtaatcatgatgtaaaagggattaccaaagctattgagagtgcgaaatctgtaaaagataaaccttcactaatcaaaatttctacaatcataggttatgggtcaccaaacaagtcagatactgcagggattcatggagctgcggtaggagaagaagaagcttccttaacaagagagtttttaaattgggaatatcctccctttgaaatacctgaggatgtatattctcaatttagacaagctattactaaaggtgaagagtctgaaaaaaaatggaatttaaaatttcaagaatatcaaaacacatatccctctgaaggagcagaattcaaaagaatgatccaaggtgaattaccagagaactgggattcagatctgccttcatatactacagatgataagggtctcgcaacaagaaaacattctcaaatatgcctaggagctcttgggcctaatcttcctgaattaattggaggatctgcggatttaactcactctaattacacagatataaaaggagaaacaggctcatttcaggcacattctccagaaaagagatacttacattttggtgtaagagagcatgctatggcagcaatattaaatggaattgcttatcacgatagtggattaataccttatggagggacttttcttgtttttgcagactatatgagaggttcaatgagactatctgctctcagtgagctgggagttatttatgtacttactcatgattcaattggagtaggcgaagatggtccaacacatcaacctgttgaaacgatcccctcactaagagctatgccaaatatgcttgtatttagacctggagatggtaatgaaacaagtggtgcttataagcttgctattaaaaacagaaaaagaccttctgctctttgcctaagtaggcaagccatgccaaatcaagagaatacctctattgaaaaagttgcattaggtggatatatagtttccgattgtgaggggactcctgatgtaatatttatcggtactggtagtgaactaaacctctgcattgaagcaagtaaagaaatctcaaaattaggtaaaaagactagagttatttccatgccttgcgtagaactatttgaagagcaagatgcttcttataaagaaagtgtcttgccaagtagtatcaaaaaaagagttgtagttgaagccgcccattcattcggatggcacaaatacactggacttgatggaatttgtattactatggacaggtttggtgcatcagctcctggtggaaaatgtatgactagttttggatttacagttgaaaatgttgtaaaaaagactaaagatattttataa

SEQ ID NO: 9797 - protein, 668 aa, Prochlorococcus marinus subsp. pastoris str. CCMP1986
MVAASVSLESLCVNSIRMLAVDAVNKSNSGHPGLPMGCAPMGYALWHNILNHNPNNPKWFNRDRFVLSAGHGCMLLYSLLHLTGYKSVSIEDIKEFRQWGSKTPGHPETFETEGVEVTAGPLGAGISNAVGLAIAEAHLAAKFNKKDCEIVDHYTYVIMGDGCNQEGIASEACSLAGHLKLGKLIALYDDNQITIDGRTDVSFTEDVLKRYEAYGWHVQHVEDGNHDVKGITKAIESAKSVKDKPSLIKISTIIGYGSPNKSDTAGIHGAAVGEEEASLTREFLNWEYPPFEIPEDVYSQFRQAITKGEESEKKWNLKFQEYQNTYPSEGAEFKRMIQGELPENWDSDLPSYTTDDKGLATRKHSQICLGALGPNLPELIGGSADLTHSNYTDIKGETGSFQAHSPEKRYLHFGVREHAMAAILNGIAYHDSGLIPYGGTFLVFADYMRGSMRLSALSELGVIYVLTHDSIGVGEDGPTHQPVETIPSLRAMPNMLVFRPGDGNETSGAYKLAIKNRKRPSALCLSRQAMPNQENTSIEKVALGGYIVSDCEGTPDVIFIGTGSELNLCIEASKEISKLGKKTRVISMPCVELFEEQDASYKESVLPSSIKKRVVVEAAHSFGWHKYTGLDGICITMDRFGASAPGGKCMTSFGFTVENVVKKTKDIL

SEQ ID NO: 9798 - DNA, 2010 bp, Prochlorococcus marinus str. MIT 9313
  CDS (1)..(2010): transl_table=11
atggtcgctgcgactgcttccctagacacgctctgcatcaacagcattcgcatgctggccgtcgatgcggtcaacaaggccaacagcggccaccctggtcttcccatgggctgtgcccccatgggctacaccctctgggaccaatttctgcatcacaaccccaagaatcctcagtggttcaaccgcgaccgctttgtcctctcagcaggtcacggctgcatgttggtttacgcgctgttgcatctcaccgggtatgactcggtaagcatcgaggacatcaagcagttccgccaatggggctcccgcactcctggacatcccgaaacatttgaaacccctggagtcgaagtcaccgcaggcccccttggtgctgggatctctaatgccgttggccttgcgatcgctgaagctcaccttgcggccaaattcaataaacccgaagcaaagatcgttgatcactacacctacgtggtgatgggcgatggctgcaaccaagaaggtattgcctcggaggcctgctcccttgccggccacctcaagctaggaaaactgatcgccctctacgacgacaaccacatcacgatcgacggccgcacagacgtttccttcaccgaagacgtgctcaagcgctacgaggcctatggctggcatgtacaacatgtcgccaatggcgacaccgacgtgaatgccatcgccaaggcgatcgctgccgccaaggccgtgaccgataagccttcgattatcaaggtgaccaccaccattggttacggctcccctaacaaaagcgatactgccggcgtgcacggggccccccttggcgaagaagaagccactctcactcgccaacaactgggatggaactatggcccttttgaaattccccaagaggcctacgaccaataccgcaaggccatcgatcaaggcgctcgccttgaatctgagtggaatcaagcactcgccaactacagaagtcaatacccaaatgaagcagctgaattcgagcggatgttgcgcggtgagcttcccaaggggtgggaaaaagatctaccgacctatacccctgcagacagcggcctcgcaacgcgtaagcactcccagatctgcctgggcgctctcggcccaaacctaccggaactcatcggcggctctgccgacctcactcactccaattacaccgatatcaaaggtgaaaccggctccttccaaccggaaacacccgaaaagcgttatctacatttcggtgtgcgcgagcacgccatggccgccatcctcaatggcatcgcttaccacaacagtggcctaatcccctacggcggaaccttcctggtttttgctgactacatgcgcggatcaatgcgcctttcagccttaagtgagcttggcgtgatctacgtactcacccatgactcaatcggcgtcggtgaagatgggcctacccaccaaccggtcgaaaccattccctccctgcgcgccatgccaaacatgctggtgttccgtcccggagatggtaatgagaccagcggagcgtacaaagtagccatccagaatcgcaaacgccccagctctctttgcctgagccgtcagggcatggccaaccaagccaattcatccatcgaaaatgtcgctctcggcggctacgtgctggaagattgcgaaggcacagctgatctgatcctgatcggtacaggcacagagcttgacctttgcgtgcaagccgccaagcaactcagtgctgaaggccacaagattcgcgtggtctcgatgccttgcgtagaacttttcgaagagcagagcagcgcatacaaacaagaggtgctgccaaacgctgtacgcaagcgcatcgtggtggaagccgccgaatcatttggctggtacaagtacatcggccttgatggcgacagtgtgaccatgaacagctttggcgcttctgcaccaggtggcacatgcatggagaaatttggcttcaccgtagagaatgtggtagcgaagtcaaaagcgttgctgaattga

SEQ ID NO: 9799 - protein, 669 aa, Prochlorococcus marinus str. MIT 9313
MVAATASLDTLCINSIRMLAVDAVNKANSGHPGLPMGCAPMGYTLWDQFLHHNPKNPQWFNRDRFVLSAGHGCMLVYALLHLTGYDSVSIEDIKQFRQWGSRTPGHPETFETPGVEVTAGPLGAGISNAVGLAIAEAHLAAKFNKPEAKIVDHYTYVVMGDGCNQEGIASEACSLAGHLKLGKLIALYDDNHITIDGRTDVSFTEDVLKRYEAYGWHVQHVANGDTDVNAIAKAIAAAKAVTDKPSIIKVTTTIGYGSPNKSDTAGVHGAPLGEEEATLTRQQLGWNYGPFEIPQEAYDQYRKAIDQGARLESEWNQALANYRSQYPNEAAEFERMLRGELPKGWEKDLPTYTPADSGLATRKHSQICLGALGPNLPELIGGSADLTHSNYTDIKGETGSFQPETPEKRYLHFGVREHAMAAILNGIAYHNSGLIPYGGTFLVFADYMRGSMRLSALSELGVIYVLTHDSIGVGEDGPTHQPVETIPSLRAMPNMLVFRPGDGNETSGAYKVAIQNRKRPSSLCLSRQGMANQANSSIENVALGGYVLEDCEGTADLILIGTGTELDLCVQAAKQLSAEGHKIRVVSMPCVELFEEQSSAYKQEVLPNAVRKRIVVEAAESFGWYKYIGLDGDSVTMNSFGASAPGGTCMEKFGFTVENVVAKSKALLN

SEQ ID NO: 9800 - DNA, 2010 bp, Synechococcus sp. WH 8102
  CDS (1)..(2010): transl_table=11
atggtcgctgcgcccgcgtctctcgacacgctctgcatcaacagcatccggatgctggccgtcgatgccatcaacaagtccaagagcggccaccccggcctgccgatgggctgcgcacccatgggttacgcgctgtgggacaagttcctgaagcacaaccccaagaaccccaagtggttcaaccgcgaccgctttgtgctgtcggctggtcacggctgcatgctgctgtacgcgctgctgcacctcaccggctacgactcggtgtcgatcgacgacatcaagcagttccgtcagtggggctccaagacgcccggccaccccgaaacctttgaaactcctggcgtggaagtgaccaccggccccctgggcgctggcatctccaacgccgtgggtctggcgatcgctgaatcccacctggccgccaagttcaacaagcccggcgccaccctcgtggatcactacacctatgtggtgatgggtgatggctgcaaccaggagggcatcgcttcggaagcctgctccctggccggccacctgaaactgggcaagctgatcgccttctacgacgacaaccacatcaccatcgacggccgcacggacgtgtccttcaccgaggacgtgctcaagcgctacgaggcctacggctggcatgtgcagcacgtggccgacggcaacaccgatgtggacgccatcgccaaggcgatcgaagccgccaaggccgtgaccgacaagccgtcgatcatcaaggtgaccaccaccatcggctacggctcccccaacaagggcgacaccgccggcgtgcacggtgcacccctgggtgaagacgaaaccgttctcacccgccagcagctgggctgggagtacggccccttcgaggtgccccaggaggcttacgaccagttccgtcaggcgatcgagcgtggcgccagcctcgaagccgagtggaaccagaccctggccacctatcgcacccaattccccgctgaagcggctgagttcgagcggatgctccgcggtgaactgcccgagggatgggacaaggatctgcccaccgctggccctgacgagaagggtctggccacccgcaagcactcccagatctgcctgggtgccctcggccccaacctgcccgaactgatcggcggctcggctgacctcacccactccaattacaccgatatcaagggtgagaccggctcctaccagcctgaaacccctgagaagcgttacctgcacttcggcgtgcgtgagcacgccatggcggccatcctcaacggcatcgcatatcacgacagcggcctgatcccctacggcggcaccttcttggtgttcgccgactacatgcgcggctcgatgcgcctgtcggccctgagcgagctgggtgtgatctacgtgcttacccacgactccatcggcgtcggtgaagacggccccacccaccagccgatcgagaccatcccctccctgcgcgctatgcccgggatgctggtgttccgtcctggcgatgccaacgagaccagcggcgcctacaagctggcgattcaaaaccgcaagcgccccagcgctctctgcctcagccgccagggcatggccaaccaggccaactcctcgatcgacaaggtcgccaaaggtggttacgtgctggaggattgcgacggcacccctgagctgatcctgatcggcaccggcaccgagctcgacctctgcgtccaggctgccaagcaactgacggaagccggcaaaaaggttcgcgtggtgtccatgccatgcgtagagctgttcgacgagcagagcgacgcctacaaagaaaaggtgctccccaacgccgtacgaaagcgcatggtggtggaagccgctgaatccttcggctggcaccgcttcatcggcctcgacggcgacagcgtgaccatgaaccgctttggtgcttccgcccccggtggcacctgtctgaaggagttcggtttcaccgtggagaacttggtggccaaggccagcgccctattggcctga

SEQ ID NO: 9801 - protein, 669 aa, Synechococcus sp. WH 8102
MVAAPASLDTLCINSIRMLAVDAINKSKSGHPGLPMGCAPMGYALWDKFLKHNPKNPKWFNRDRFVLSAGHGCMLLYALLHLTGYDSVSIDDIKQFRQWGSKTPGHPETFETPGVEVTTGPLGAGISNAVGLAIAESHLAAKFNKPGATLVDHYTYVVMGDGCNQEGIASEACSLAGHLKLGKLIAFYDDNHITIDGRTDVSFTEDVLKRYEAYGWHVQHVADGNTDVDAIAKAIEAAKAVTDKPSIIKVTTTIGYGSPNKGDTAGVHGAPLGEDETVLTRQQLGWEYGPFEVPQEAYDQFRQAIERGASLEAEWNQTLATYRTQFPAEAAEFERMLRGELPEGWDKDLPTAGPDEKGLATRKHSQICLGALGPNLPELIGGSADLTHSNYTDIKGETGSYQPETPEKRYLHFGVREHAMAAILNGIAYHDSGLIPYGGTFLVFADYMRGSMRLSALSELGVIYVLTHDSIGVGEDGPTHQPIETIPSLRAMPGMLVFRPGDANETSGAYKLAIQNRKRPSALCLSRQGMANQANSSIDKVAKGGYVLEDCDGTPELILIGTGTELDLCVQAAKQLTEAGKKVRVVSMPCVELFDEQSDAYKEKVLPNAVRKRMVVEAAESFGWHRFIGLDGDSVTMNRFGASAPGGTCLKEFGFTVENLVAKASALLA

SEQ ID NO: 9802 - DNA, 1989 bp, Chromobacterium violaceum ATCC 12472
  CDS (1)..(1989): transl_table=11
atggttacccgcaccgagcttgccaacgccatccgcttcctctccatggacgccgtggaaaaagccaaatccggccaccccggcgccccgatgggcatggcggacatcgccgaagtcctgtggcgcgatcacctgaagcacaacccggccaacccggcctgggccgaccgcgaccgcttcgtcctctccaacggccacggctcgatgctgatctacagcctgctgcatctgaccggctacgatctttccatcgacgacctcaagaacttccgccagctgcattccaaaaccccgggccacccggaatacggctacgcgccgggcgtggaaaccaccaccggtccgctgggccagggcatcaccaacgccgtcggcatggcgctggccgaaaagatgctggccgcccaattcaaccgcgacggccacgaaatcgtcaaccatcacacgtatgtcttcctgggcgacggctgcctgatggaaggcatcagccacgaggcctgctcgctggccggcacctggggcctgaacaagctggtcgccttctgggacgacaacggcatctccatcgacggccacgtcgaaggctggttcagcgacgacaccccggcccgcttcgaagcctacggctggcaggtgatccgcaacgtcaacggccacgacccggccgagatcgccaccgcgatcgccaccgccaagaagagcgccgacaagccgacgctgatctgctgcaagaccaccatcggcttcggcgcccccaacaagcagggcagccacgactgccacggcgcgccgctgggcgccgccgagatcgccgccgcgcgcgagctgctgaagtggccgcacgcgccgttcgaaatcccgtccgagatctacgccgaatggagcgcccgcgatcagggcgccgtcgccgagatcgaatggaacaagcgcttcgacgcctaccgcgccgcccatccgcagctggccgccgagttcgagcgccggatggcgggcgagctgccggccggctgggccgaagcccaggccgccgccgtcgccaagatcgccgacgccgcccagaccgtggccacccgcaaggccagccagatcgcgctggaagcgttctccccgtccctgccggagttcgtcggcggctccgccgacctgaccggctccaacctgaccaactggtccggcagccagtggatagacggcgaaggcaacggcaactacatcagctacggcgtgcgcgagttcggcatggccgccatcatcaacggcatgacgctgcacggcggcctgcgcccgtacggcggcaccttcctgatgttcagcgaatacgcccgcaacgcgctgcgcatggcctcgctgatgaagatcaacccgatcttcgtgttcacccacgattcgatcggcctcggcgaagacggcccgacccaccagccggtggagcagaccgccacgctgcgctacatccccaaccaccacacctggcgcccgtgcgacaccaccgagaccgcggtggcctgggcgcacgccatcgagcagaaaaccaccccgtccagcctggtgctgagccggcagaacctgcccttcgtcgcccgcgacgccgcgcagaccgccgcgatcaagaagggtggctacgtgctgcgcgacgccgagaacgcgcgcgcggtgctgatcgccaccggctccgaagtggagctggcgctgaaggcgcaggaaacgctggccgccgagggcgtgccggtgcgcgtggtgtccatgccctgcaccaatgtgttcgacgcccaggacaaggcctggcagcagagcgtgctgccggctggcctgccgcgcgtggcggtggaggccggccatccggacttctggcgcaagtacgtcggcctggaaggcgacgtggtcggcatcgaccacttcggcgaatccgcgccggccggccagctgttcaaggaattcggcttcaccgtggaaaacgtggtcgccaagatccgcgccgttctgcgttaa

SEQ ID NO: 9803 - protein, 662 aa, Chromobacterium violaceum ATCC 12472
MVTRTELANAIRFLSMDAVEKAKSGHPGAPMGMADIAEVLWRDHLKHNPANPAWADRDRFVLSNGHGSMLIYSLLHLTGYDLSIDDLKNFRQLHSKTPGHPEYGYAPGVETTTGPLGQGITNAVGMALAEKMLAAQFNRDGHEIVNHHTYVFLGDGCLMEGISHEACSLAGTWGLNKLVAFWDDNGISIDGHVEGWFSDDTPARFEAYGWQVIRNVNGHDPAEIATAIATAKKSADKPTLICCKTTIGFGAPNKQGSHDCHGAPLGAAEIAAARELLKWPHAPFEIPSEIYAEWSARDQGAVAEIEWNKRFDAYRAAHPQLAAEFERRMAGELPAGWAEAQAAAVAKIADAAQTVATRKASQIALEAFSPSLPEFVGGSADLTGSNLTNWSGSQWIDGEGNGNYISYGVREFGMAAIINGMTLHGGLRPYGGTFLMFSEYARNALRMASLMKINPIFVFTHDSIGLGEDGPTHQPVEQTATLRYIPNHHTWRPCDTTETAVAWAHAIEQKTTPSSLVLSRQNLPFVARDAAQTAAIKKGGYVLRDAENARAVLIATGSEVELALKAQETLAAEGVPVRVVSMPCTNVFDAQDKAWQQSVLPAGLPRVAVEAGHPDFWRKYVGLEGDVVGIDHFGESAPAGQLFKEFGFTVENVVAKIRAVLR

SEQ ID NO: 9804 - DNA, 2028 bp, Porphyromonas gingivalis W83
  CDS (1)..(2028): transl_table=11
atgaatgacaaaaagctgatgaacaaggctgcggacaatattcgagtattggccgctgcaatggtggaaaaagccaaaagcggtcacccgggcggagccatgggcggagcggactttgtaaacgtactcttctccgagtatctgatctttgacccgaagaacccgcaatgggccggtcgcgatcgcttcttcttggatccgggacatatgtccccgatgctgtatgctcagctggcattgacgggcaagtactccatggatgacctcaaagcattccgccaatggggcagcatcacacccggacaccccgaagtagatgtcatgcacggagtggagaacacatccggccccttgggacaaggccacacctatgctgtcggtgcagccatcgcagccaaattcctcgctcatcgcttcggctggatgatgagccaaacgatctatgcctacatttccgatggaggaatacaggaggaagtatcacaaggagccggccgaatcgccggacaccttgggctgaacaatctgattatgttctacgactcgaacgacgtacagctttctacgacagtgaaagaggtggcaagcgaagacgtagccatgaaatatcgtgcatggggttggaaggtaatagagattgcaggtaacgatgcggatgaaattcgcaaggccctgaccgaagccaagggagagggcgagcgtcccacacttatcatcgggcacacccttatgggcaaaggtgccgtaggcgaggatggcagttcgtatgagaatatggtgagcacgcatggacagccgctatcggctgccggagcatcattcgccgaaacggtcaagaacctcggaggcaatcccgaagagccgttcgccatcttccccgaagttcgggaaatgtatgccgctcgcttggcagaactggagcagatcatggcagagcgtcgcgaagaagagcaacgttggcgcagcacccatcctgatttggcagccaagttcgatgcgtggtttgccggtcaaacgccccaaatcgactggaaagctatagagcagaaacccaatcaggctacccgctccgcttctgccaccgtgttgggtactcttgccggagaagtggagaatatgattgtaacctctgccgacctttccaattcagacaagaccgatggcttcttgaagaaaacccacgccatgaagaaaggagatttcagtggagcattcctgcagatgggtgtatcggagctgaccatggcctgcctctgtatcggtatggctcttcatggaggcgtcattccggcttgcggtaccttcttcgtattttccgactacatgaaaccggccgttcgtatggctgccctgatggaattgcccgtcaagtttatctggacgcacgatgctttccgtgtgggcgaggatggtcctactcacgaaccggtggaacaggaggcgcaaattcgcctgatggagaagctgcacaatcacagcggccgtcgctccatgctggtccttcgtccggccgatgtgcaagagactaccgtagcttggaagatggctatggagaatacgcatactcctacagctctgatcctttcgcgtcagaatatcaccgatctgcctgctaacgacagtcggtacgaagaagcgttgcaggctgaaaagggagcttatatcgtcaatacggatcagaatatcgaagtagttctcctggccagcggatctgaggtgtccacattggtcgagggtgcagagctgctgcgcaaacgcggtgtaaaacttcgtatcgtgtcggtaccttccgaaggacttttccgttcgcagagtgccgagtatcaggaggaagtgcttcccatcggtatcaggcgtttcggcctgacagccggattgcccgtcaacctggaaggccttgtgggtgaaagcggtgccgtctggggattgaactctttcggattctccgctccctataaggtgctggacgagaaactcggctttacggcagagaatgtgtacgaacaagtgttgaaaatactccactga

SEQ ID NO: 9805 - protein, 675 aa, Porphyromonas gingivalis W83
MNDKKLMNKAADNIRVLAAAMVEKAKSGHPGGAMGGADFVNVLFSEYLIFDPKNPQWAGRDRFFLDPGHMSPMLYAQLALTGKYSMDDLKAFRQWGSITPGHPEVDVMHGVENTSGPLGQGHTYAVGAAIAAKFLAHRFGWMMSQTIYAYISDGGIQEEVSQGAGRIAGHLGLNNLIMFYDSNDVQLSTTVKEVASEDVAMKYRAWGWKVIEIAGNDADEIRKALTEAKGEGERPTLIIGHTLMGKGAVGEDGSSYENMVSTHGQPLSAAGASFAETVKNLGGNPEEPFAIFPEVREMYAARLAELEQIMAERREEEQRWRSTHPDLAAKFDAWFAGQTPQIDWKAIEQKPNQATRSASATVLGTLAGEVENMIVTSADLSNSDKTDGFLKKTHAMKKGDFSGAFLQMGVSELTMACLCIGMALHGGVIPACGTFFVFSDYMKPAVRMAALMELPVKFIWTHDAFRVGEDGPTHEPVEQEAQIRLMEKLHNHSGRRSMLVLRPADVQETTVAWKMAMENTHTPTALILSRQNITDLPANDSRYEEALQAEKGAYIVNTDQNIEVVLLASGSEVSTLVEGAELLRKRGVKLRIVSVPSEGLFRSQSAEYQEEVLPIGIRRFGLTAGLPVNLEGLVGESGAVWGLNSFGFSAPYKVLDEKLGFTAENVYEQVLKILH

SEQ ID NO: 9806 - DNA, 1956 bp, Wolinella succinogenes DSM 1740
  CDS (1)..(1956): transl_table=11
atgaatgcactccttcaagagcaagacctgcctgttttagagttgatggccaagaccgtccgattcctcgctgccgatatggttcaagctgccaatagcgggcatcccggagcccccatgggattggccgatgtggtgagcgtcctctcctttcacctgcgccactctcctaaaaatccccagtggctcaatcgcgatcgtctcgtctttagcgggggtcatgcaagtgcgatgatctattcgctcctccatctttggggctatgatctgcccctagaggagctcaagcgatttcgccaaaaagattccaagacgcccggtcaccctgagtttggacatacagcgggtgtagagatcaccacgggacctctagggcagggcgtggccaatgcagtgggctttgcaatggcgtctaaatatgccgctcacctgctcaatagcgaagaaacaacgctcattgatcataaggtctattgtctttgtggtgatggagatttggaggagggaatcagctatgaggcctgctctctagcgggacaccaccaattggacaatttgattctcatttatgattctaacaatatcaccattgagggcgagctctctttggcctttagcgaagatgtgaaggggcgatttgaggcgcaaggatgggaggtctttgaggtgtgcggtcatgacgttttggcgattcataaagtgtttagcgaggccaagcgagcggataaacctgtgctcatcatcgccaagactacgattgctaaagggtgcaagacaatggaggggtatgctaaaacgcatggagcacccctaggcgaggaggagattcgtgcctctaaggagaaaaacggctttgacccaagcgagaagttctatatccctgaggcggctcttttgcgttttaggaatgctcttgagatgggggagacgatggagaatctctggaatgagaaactccaaaaggccccaaaagagaagaaacaactccttgagcagctcctctcccctgatttctcggcggtcgatttccccgtttttgaagagggcaaaaagatcgccacgcgaagtagcaatggagagattctcaatcgcctctctagtgctcttccgggctttatcggggggagtgctgatctagccccctctaacaacaccgaccttaaaggggcgggcaacttccctatggggaaaaatttccactttggaatcagggagcactctatggcggcgatcactaatgcgattgccaattatgggctctttatgcctttttgcgcgaccttttttgtctttagcgactacatggcgccctcagtgagggtcgcctccatcatgggtgcgaaaaattacttcatttggacgcacgatagcatcggcgtaggcgaagatggagcgactcaccagcctattgagcagctcacccacttccgtgccatgcctggactctatctctttagacccgctgatgccaatgaaaatgtcgcctgctggcaggtcgccctccgcctcaaagccccttgcgccttcgtcctctccaggcagaatctccccgtgcttccaagggttgagagtgagaaagtggccaagggagcctacacgattagggcgtgtgaaaatccagcgatcgtgcttctagccacgggtagcgaggtctctcttgctctggagacggcggaagttttggccaaagagggggtgagtgttaatgtggtgagcgccccttgctttgatcttttggtcgcacaggataagcgctatctccgctccctctttcctgaaggagccaaggtgatcgccatcgaggcctctaggggattggagtggtatcgttttgcggatgaggtgataggaatggatagctttggcgcttcagcccctggggatgagctttttgcacactttggattcacagtggagaatcttctctccaaagccaaagagcttttgggacgctaa

SEQ ID NO: 9807 - protein, 651 aa, Wolinella succinogenes DSM 1740
MNALLQEQDLPVLELMAKTVRFLAADMVQAANSGHPGAPMGLADVVSVLSFHLRHSPKNPQWLNRDRLVFSGGHASAMIYSLLHLWGYDLPLEELKRFRQKDSKTPGHPEFGHTAGVEITTGPLGQGVANAVGFAMASKYAAHLLNSEETTLIDHKVYCLCGDGDLEEGISYEACSLAGHHQLDNLILIYDSNNITIEGELSLAFSEDVKGRFEAQGWEVFEVCGHDVLAIHKVFSEAKRADKPVLIIAKTTIAKGCKTMEGYAKTHGAPLGEEEIRASKEKNGFDPSEKFYIPEAALLRFRNALEMGETMENLWNEKLQKAPKEKKQLLEQLLSPDFSAVDFPVFEEGKKIATRSSNGEILNRLSSALPGFIGGSADLAPSNNTDLKGAGNFPMGKNFHFGIREHSMAAITNAIANYGLFMPFCATFFVFSDYMAPSVRVASIMGAKNYFIWTHDSIGVGEDGATHQPIEQLTHFRAMPGLYLFRPADANENVACWQVALRLKAPCAFVLSRQNLPVLPRVESEKVAKGAYTIRACENPAIVLLATGSEVSLALETAEVLAKEGVSVNVVSAPCFDLLVAQDKRYLRSLFPEGAKVIAIEASRGLEWYRFADEVIGMDSFGASAPGDELFAHFGFTVENLLSKAKELLGR

SEQ ID NO: 9808 - DNA, 2013 bp, Gloeobacter violaceus PCC 7421
  CDS (1)..(2013): transl_table=11
atgactggcactttgcttgacaagaccgccgcccagttggacgagttgagcgtcaataccatccgttttttggccgttgatgctgtccagaaggccaactccggtcaccccggcctgccgatgggggccgccccgatggcctacgtgatctggacgaagttcctcaagcacaatcccaccaacccgaagtggttcgaccgcgatcggttcatcctttcggcgggtcacggttcgatgctgctctacgccctgctgcacctgaccggttacgacctggccatagatgatctcaagcaatttcgccagctgcactcgagaaccccaggccacccggagaacttcatgaccccgggggtggaggtgaccaccggccccctcggtcagggcctcggcaacggcatcggtatcgctgtcgccgaagcgcacctcgcggcccgttacaaccgtcccggccacgagattatcgaccataccacctacgccatcgtctccgacggcgacctgatggaaggggtagcttccgaggccgcttcgctcgggggccacctgggtctgggcaaggtcatctatctctacgacgacaaccacatctcgatcgacggcgagaccgagttgtcctttaccgaagaccgcatgcagcgcttcgacgcctacggctggcacacccaggcggtggccgacggcaatgatatcgccgccatcgagcaggccatccacaacgcccgcgccgtcaccgacaagccttcgatcatcgccgtgcgcacgatcatcggttacggttcacccaacaaagccaacagccacgacgtgcacggctcgcccctgggtggggacgaagtcaaagcgaccaaagaaaacctcaagtggcccctggagcccgagttttatattcccgaggagaccctcgcccagtttcgcaaagccgttgaggcgggcaaagaagccgaagcggactggaatgcccgctttgccgcctacaaagccgaatttccagaactggccgctgaactcgaatcgctcatcgaaggccgtctgccggaaggctgggagtcgtccctgcccagcttcagccccgccgacaagccgcttgccacccgcgccgcctcaggcaaagtgctcaatgccgtcactgccgccctccctggcctgattggcggctcggcggacctggcgccctccaacaacacctacgtcaaagccttcgtagactttcaaaaagcgactcccgagggccgcaacttccacttcggcgtgcgcgagcacggcatgggggcggtcatgaacggcatggccatgcacggcggactcaaagtttacggcggcacctttctcatcttcatggactacatgaagggggctgtgcgcgttgcggcgctttcgcactcgccggtggtctacgtgttcacccacgattcaatcggcctcggtgaagacggtcccacgcaccagccggtcgagcagattctcaccctgcgcgccacaccgcagctcacggtcatccgccccggcgacgccgtcgagacggtcggtgcctggaaggtggccatcgagagcaatcgcgacccggtcgccctcatcctcacccgccagaatctgcccatccagcccggctctacggtcgaggcggtggcaaagggcgcctacacgctggtggaagccgacaatcccgaaatcatcctgattggcaccggctccgaggtgcaactggtggtcgaagcccaaaagcaactggccgagcagggcatcgctgcccgcgtcgtctccttcccgagctgggaactgttcgaagcccagccccaggagtataaagacagcgtcctcacccccggcgtcaagcgcctggcggtggaagcgggcaccagcctgggctggcacaagtacgtcggcctcgaaggggcggtgattggcgtcgatcgctacggcgcttcggctccgatcaaagcggtcatgcccgagtacggatttacgatcgacaatgtcgtcgcccatgccctgaaggtgctgggccgctag

SEQ ID NO: 9809 - protein, 670 aa, Gloeobacter violaceus PCC 7421
MTGTLLDKTAAQLDELSVNTIRFLAVDAVQKANSGHPGLPMGAAPMAYVIWTKFLKHNPTNPKWFDRDRFILSAGHGSMLLYALLHLTGYDLAIDDLKQFRQLHSRTPGHPENFMTPGVEVTTGPLGQGLGNGIGIAVAEAHLAARYNRPGHEIIDHTTYAIVSDGDLMEGVASEAASLGGHLGLGKVIYLYDDNHISIDGETELSFTEDRMQRFDAYGWHTQAVADGNDIAAIEQAIHNARAVTDKPSIIAVRTIIGYGSPNKANSHDVHGSPLGGDEVKATKENLKWPLEPEFYIPEETLAQFRKAVEAGKEAEADWNARFAAYKAEFPELAAELESLIEGRLPEGWESSLPSFSPADKPLATRAASGKVLNAVTAALPGLIGGSADLAPSNNTYVKAFVDFQKATPEGRNFHFGVREHGMGAVMNGMAMHGGLKVYGGTFLIFMDYMKGAVRVAALSHSPVVYVFTHDSIGLGEDGPTHQPVEQILTLRATPQLTVIRPGDAVETVGAWKVAIESNRDPVALILTRQNLPIQPGSTVEAVAKGAYTLVEADNPEIILIGTGSEVQLVVEAQKQLAEQGIAARVVSFPSWELFEAQPQEYKDSVLTPGVKRLAVEAGTSLGWHKYVGLEGAVIGVDRYGASAPIKAVMPEYGFTIDNVVAHALKVLGR

SEQ ID NO: 9810 - DNA, 1995 bp, Photorhabdus luminescens subsp. laumondii TTO1
  CDS (1)..(1995): transl_table=11
atgaccactcgtaaaacccttgctaatgctattcgcttcctgagcatggatgctgtgcagaaagcaaaatcagggcaccctggtgcacctatgggaatggcggatatcgctgaagttttatggcgtgattatttgaatcataacccaactgatccacattgggtcgatcgtgatcgttttgtattgtctaacggtcatggttctatgctgatttatagtctgttgcatctcaccggttatgatgtttcagtcgatgatctgaaaaatttccgtcagttacactctaaaaccccaggccatcctgagtatggctatactccaggcgtagaaactacgacaggtcctttagggcaggggattgccaacgcagtcggttttgcgattgctgaacgcactctggccgcgcaatttaaccgtcctggtcatgagatcgttgaccataatacttatgtctttatgggtgatggctgcatgatggagggcatttctcatgaagtttgctctctggcgggaacgttaaagttaggcaagttggttgctttctatgatgacaatggcatttccattgatggtcatgttgaaggctggtttacggatgatacggcaagccgttttgaggcgtatggctggcatgtgattcgcggtgttgatggtcataatgcagattcagttaaagctgctatcgaagaagcacgtaaagtgacggataaaccttctctgttaatgtgcaaaacgattatcggttttggtgcgccaaccaaagcgggtacccatgattctcatggcgcgccattgggtgatgcggaaattgctgcgactcgtgaagcactcggttggaattatccggcatttgaaattccagcggaaatctattctgagtgggatgccaaagaagctggcaatgtgaaacaagccgcttggaatgaaaaattcgctgcctatgaaaaggcgtatcctgaattagcggctgaatttaaacgtcgtaccagtggtgagttaccggcaaactgggaagttgaatcaaaagcatttatcgaacagttgcaaaaaaatccagccaatattgccagtcgtaaagcatctcagaatgccttggaagcttttggtaaggtgttgcctgaatttatggggggatctgctgatttggcaccaagtaacctcacgatgtggtcaggttctaatccgttgaacgaagatcaggcaggtaattatatccattatggtgttcgtgaatttggcatgtcagccattatgaatggtatcgctctgcatggtggttttgtgccttatggtgcaaccttcctgatgttcgttgaatatgcccgtaacgccgtgcgtatggcggcattgatgaaaattcgcagcatctttgtttatacccatgactcaattggtttgggtgaagatggtccgactcaccagccagtagaacagctcgccagtttgcgtgtgacgccaaatttgagcacatggcgtccatgtgaccaggttgaatctgcggtggcgtggaaatacgctatcgatcgtaaagcaggtccatcagcacttattttctctcgtcagaatctggcacagcaagaacgtactgctgagcagttggctaatatcgagaaaggggcttacatcctgaaagattgtcaggggcaaccagaactgattttgatcgcaacgggttcagaaattgaattggcggtgagtgcttaccaccaattgactgaggaaggtcgtcaggtgcgcgtagtctcaatgccgtctactgatgcttttgataagcaagatgctgcataccgagaagcggttctgcctgctgcggtttctgcacgtgttgcagtcgaagcgggtatcgccgattactggtttaaatatgtcggtatgaatggcgctatcgttggtatggatacatttggtgagtcagcacctgctgatcagttgtttaaaacgtttggtttcactgtagagaatgtggtcgctaaggctaaagctttgctgaaataa

SEQ ID NO: 9811 - protein, 664 aa, Photorhabdus luminescens subsp. laumondii TTO1
MTTRKTLANAIRFLSMDAVQKAKSGHPGAPMGMADIAEVLWRDYLNHNPTDPHWVDRDRFVLSNGHGSMLIYSLLHLTGYDVSVDDLKNFRQLHSKTPGHPEYGYTPGVETTTGPLGQGIANAVGFAIAERTLAAQFNRPGHEIVDHNTYVFMGDGCMMEGISHEVCSLAGTLKLGKLVAFYDDNGISIDGHVEGWFTDDTASRFEAYGWHVIRGVDGHNADSVKAAIEEARKVTDKPSLLMCKTIIGFGAPTKAGTHDSHGAPLGDAEIAATREALGWNYPAFEIPAEIYSEWDAKEAGNVKQAAWNEKFAAYEKAYPELAAEFKRRTSGELPANWEVESKAFIEQLQKNPANIASRKASQNALEAFGKVLPEFMGGSADLAPSNLTMWSGSNPLNEDQAGNYIHYGVREFGMSAIMNGIALHGGFVPYGATFLMFVEYARNAVRMAALMKIRSIFVYTHDSIGLGEDGPTHQPVEQLASLRVTPNLSTWRPCDQVESAVAWKYAIDRKAGPSALIFSRQNLAQQERTAEQLANIEKGAYILKDCQGQPELILIATGSEIELAVSAYHQLTEEGRQVRVVSMPSTDAFDKQDAAYREAVLPAAVSARVAVEAGIADYWFKYVGMNGAIVGMDTFGESAPADQLFKTFGFTVENVVAKAKALLK

SEQ ID NO: 9812 - DNA, 2031 bp, Vibrio vulnificus YJ016
  CDS (1)..(2031): transl_table=11
atgttatcaattcgcttaatgcactcaggagcagacatgccttctcgtaaacatctcgctaatgcaatccgcgcactcagcatggacggcgtacaaaaagcaaactcaggccacccaggcgcacctatgggtatggcggacatcgctgaagttctttggcgcggccacctaaaccacaacccatcaaaccctgaatgggctgaccgcgaccgtttcgtgttgtctaacggccacggctctatgctgatttactcgctactgcaccttagcggttacgagctatctatcgacgacctaaagaacttccgtcaattgcactctaagactccaggtcacccagagtacggctacgcaccgggcatcgaaacaacaactggcccgctaggccaaggcatcaccaacgcggttggtatggcaatggctgagaaagcgctcgcagcgcaattcaacaaagaaggccacgacatcgttgaccacttcacttacgtgttcatgggagacggctgtctgatggaaggtatctcgcatgaggcatgttctctagcgggtacgctaggccttggtaaactgattgcattctgggatgacaacggcatctctatcgatggtcacgttgaaggttggttctctgacgatacgcctaagcgtttcgaagcttacggctggcacgtcatcccagctgtggatggtcacaatgctgaagcgatcaacgcagcaattgaagccgctaaagcagatcctcgcccaactctaatctgtactaagactatcatcggttttggttcaccaaacaaatcgggttcacacgactgtcacggtgcaccactaggtgcggaagaaatcgcagcggcacgtgaattcctaggttgggagcacccagcatttgaaatccctgctgacgtttacgcagagtgggatgcaaaagcagcaggcgctgcaaaagaagccgcttggaatgcgaagttcgatgcgtacgcagcagcgtacccagccgaagctgccgagtttaaacgccgcgtaaatggcgaactgccagcgcagtgggaagagaaagcaaaccaaatcattgcagatcttcaagcaaacccagcgaacatcgcatcacgtaaagcatcgcaaaacgcgctagaagcgtttggtaaaatgctgccagaattcatgggcggctcagctgacctagcgccttctaacctcaccatgtggtcgggttctaagtctctagaagcaagcgacttctctggtaactacatccactacggtgtgcgtgaattcggtatgactgcgatcatgaacggtatcgcgctgcacggtggtttcgtaccttacggcgcaaccttcctaatgttcatggaatacgcacgtaacgcaatgcgtatggcggctctgatgaaagtgcaaaacatccaagtgtacacgcacgattctatcggtcttggcgaagatggcccaactcaccaacccgttgagcaaatcgcatcgctacgtctaacgccaaacatgagcacatggcgtccatgtgaccaagtggaatctgcagtagcatggaaactggcgattgaacgtaaagatggtccatcagcactgattttctctcgtcaaaacctagcacagcaaccacgcagcgctgagcaagtggcagacatcgccaaaggtggttacatcctgaaagacagcgatggtaagcctgagctcatcctaatcgcaacgggttcagaagttgagctagcagtgaaagccgctgagcaactcacggctgaaggtaagaaagtacgagtggtttcaatgccagctactgatgccttcgacaagcaagacgcggcttaccgtgaatcagtactgccatcagacgtaactgcacgtatcgctatcgaagctggtattgctgacttctggtacaagtatgttggcttcgatggtcgcatcatcggtatgactaccttcggtgaatctgcaccagcagatcaactgttcgaaatgttcggtttcacggtagaaaatgtggtgaacacagcgaaagaacttctcgcgtaa

SEQ ID NO: 9813 - protein, 676 aa, Vibrio vulnificus YJ016
MLSIRLMHSGADMPSRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAAAREFLGWEHPAFEIPADVYAEWDAKAAGAAKEAAWNAKFDAYAAAYPAEAAEFKRRVNGELPAQWEEKANQIIADLQANPANIASRKASQNALEAFGKMLPEFMGGSADLAPSNLTMWSGSKSLEASDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDAFDKQDAAYRESVLPSDVTARIAIEAGIADFWYKYVGFDGRIIGMTTFGESAPADQLFEMFGFTVENVVNTAKELLA

SEQ ID NO: 9814 - DNA, 2103 bp, Corynebacterium diphtheriae NCTC 13129
  CDS (1)..(2103): transl_table=11
gtgactttatctccggagcttcaggctcttacctcccgtcactaccctagcgactgggacgacctcgatactcaggcagttgacacagcacgtgtactcgctgccgatgcagtccagaattgcggttcgggccacccaggcactgcaatgagcttggcacctctggcttacactcttttccaacgtgtcatgaatgtcgatcctgcggatccgcattgggctggtcgcgatcgttttgtgttgtcatgtgggcacacttcacttacgcaatacatccagctttacttcggcggttacggcctcgaacttgaagaccttaaagccctgcgtacttggggcgcattaactcctggccacccagaataccgccatactaaaggcgttgaaatcacaactggcccattgggtcaaggcttggcatcggctgttggcatggcgatggcctcacgacgtgagcgcgcgttgttcgatcccactgcggcagatggtgcatctccattcgaccactatatttatgtgattgcttctgatggcgaccttcaggaaggtgtcactgcggaggcatgttcgcttgccggaactcaaaagcttggaaatctcatcgttttctgggatgataaccggatctcgatcgaagaagatactgagattgcattcaacgaaaaggttgtcgatcgttaccgtgcttataactggcaagtaatcgaaattgacggcggcgaaaacgttgaagcgattgaaaaggcagtcgcagaggctaaagccgatacttctcgtcctacttttatccgcgtacgtaccgttattggctatcctgcgccaacaaagatgaataccggtgctgtgcatggtgctgctcttggtgctgaagaagtcgccggaactaagaaagcactcggttttaatcctgaggaatccttcgcggtagctccggaggtcatttctcatacacggaaacttctagagcgaggtgctcaacgacatgctgagtggcgtgagcatttcgaatcttgggcggaaacaaaccccgaaaataaagccctctttgaccggatggcttcccgcgaacttccagatggtttcgatgctgatctaccttcgtgggagcctgatgccaaaggcgtcgcaacccgcaaggcttctgaagctacgttacaggcactcggtgcaacgcttccggagctgtggggcggttctgccgacctagcaggctcgaacaacactgttattaagggttctccatcgtttggtccatctacgatttctacgtccacatggactgctgagccaggtggacgtaatctccatttcggtatccgcgaacatgccatgggcgcaattatcaatggcatttctctccacggtggaacccgtccttatggtggaaccttcctgattttctcggattacatgcgccctgctgttcgtctggctgccttgatgggaaccgacgcatactatgtttggacacacgattccatcggattaggcgaagacggccctactcatcaacctgtcgagcagcttgcatcgctgcgtgctattcctggtgtttcgatgcttcgtcccgctgatgctaacgaaactgctgcggcttggcgtgcggcactcctgtataaggaaggtcctaaaggtctagcccttacacgtcaaaacgtccttgttctcgaaggaacaaaagaaaaagcgcgggatggtgtctcacgaggggcatatgttctcgttgaaggatctaagaaaactcctgacgttattttgatggcttcaggctccgaagtacagcttgcagtcgaagcggctaaaactttggaagcagaaaagattgcagctcgagtcgtgtctgtgccttgcttagattggttcgaggaacaagacgccgcttatcaagaagagatacttccgcaggcggttagcgctcgcgtatcggtggaagcgggtgtcgctttgtcttggtatcgccatctgggcacccatggtcgggccgtgtcccttgagcacttcggcgcatctgctccgtatgagaagctcttcagtgaatttggcataaccactgaagcagttattgctgcagctcgcgaatcacttgctgctgctcagcaataa

SEQ ID NO: 9815 - protein, 700 aa, Corynebacterium diphtheriae NCTC 13129
MTLSPELQALTSRHYPSDWDDLDTQAVDTARVLAADAVQNCGSGHPGTAMSLAPLAYTLFQRVMNVDPADPHWAGRDRFVLSCGHTSLTQYIQLYFGGYGLELEDLKALRTWGALTPGHPEYRHTKGVEITTGPLGQGLASAVGMAMASRRERALFDPTAADGASPFDHYIYVIASDGDLQEGVTAEACSLAGTQKLGNLIVFWDDNRISIEEDTEIAFNEKVVDRYRAYNWQVIEIDGGENVEAIEKAVAEAKADTSRPTFIRVRTVIGYPAPTKMNTGAVHGAALGAEEVAGTKKALGFNPEESFAVAPEVISHTRKLLERGAQRHAEWREHFESWAETNPENKALFDRMASRELPDGFDADLPSWEPDAKGVATRKASEATLQALGATLPELWGGSADLAGSNNTVIKGSPSFGPSTISTSTWTAEPGGRNLHFGIREHAMGAIINGISLHGGTRPYGGTFLIFSDYMRPAVRLAALMGTDAYYVWTHDSIGLGEDGPTHQPVEQLASLRAIPGVSMLRPADANETAAAWRAALLYKEGPKGLALTRQNVLVLEGTKEKARDGVSRGAYVLVEGSKKTPDVILMASGSEVQLAVEAAKTLEAEKIAARVVSVPCLDWFEEQDAAYQEEILPQAVSARVSVEAGVALSWYRHLGTHGRAVSLEHFGASAPYEKLFSEFGITTEAVIAAARESLAAAQQ

SEQ ID NO: 9816 - DNA, 1986 bp, Rhodopseudomonas palustris CGA009
  CDS (1)..(1986): transl_table=11
atggcgcaggtcgatcattcccgtatggcaaacgcaatccgggcgctggcgatggatgcggtggaaaaagccaaatccggccatcccgggctgccgatgggcgccgccgacgtcgcgaccgtgctgtggacgcagttcttgaaattcgatgcggtcgacccgcactggccggatcgcgaccgcttcatcctctcggccggccacggctcgatgctgctctatgcgctgctgtatctgaccggcaacgaggagctgacgctcgaccagatcaagaatttccgtcagctcgactccaagacgccggggcatcctgagaactgcatcacctcctcggtcgagaccaccaccggtccgctcggccagggcgtcgcctcctcggtcggcaccgcgctggcagaacgactgttgcaagcggagttcggcgacattgtcgatcactacacctacgtgctgtgctcggacggcgacctgatggaaggcgtcagccacgaagcgatcgcactagccgggcatctcaggctgtcgaagctgatcttcctgtacgacgacaacggcatctcgatcgacgggccgctgtcgctgacagacactgtcgaccaggtcgcgcgcttccaggcgcatggctggaattcgttccggatcgacggccacgaccacaaggcgatcgccgacgcgatccgcaaagcccaagcctccgaccggccgaccatgatcgcctgcaagaccacgatcgggttcggcgcgccgcacaaggccggcacctcaaaggcccatggcgagccgctcggggccgaggagcttgcgggcgccaagaaggcgctcggctgggattacggcccgttcgagattccggacgacgtgctcagcgcctggcgcaatgtcggcaagcagggggcatcggcgcgcgccgactggctggcgcggttcgacgccctgccggcggacaagcgcggcgacttcaagcgccgggtgatcgaccgcaagcggccggcggcgattgcggacgcgatccgtacgctcaaggacaagctggttgccgagccgcagaccatcgcgacccgcaaagccagcgagctggcgctggaagcgctgacgccggtggtgcccgagctgctgctcggctccgccgacctgacgccctccaacaacacccgcgtcaagcaggccaaggacgtgacgccggacgatttctccggccgctacatccactacggcatccgcgagatgggcatggcggcggcgatgaacggcttggcgatgcacggcgggtttgcgcccgcgggcggcaccttcctgtgcttcaccgactacgcgcgcccatcgatgcgggtggcggcgctgtcgcatgtgccggtcgtgtacatcatgacccacgactcgatcgggctcggcgaagacggcccgacgcatcagccggtcgaacatctcgcggcgctgcgggcgatgccgaacatgcgggtattccgcccggccgacgcggtggaaaccgccgagtgctggcagctcgcactggaaaacaccaatgggccaaccttgctggcgctgtcgcggcagaacctcgcccaggtccgcaccgcgacgtccgaggccaacctctgcgccaccggcggctatgagctgatcccggcacccggcaaggcgcaggtttcgatcttcgccaccggctccgaggtcgagatcgcagtcgcggcccagaagctgctcgaggtgcagggcgtcgccgcccgcgtcgtgtcggtgccgtcgctcgatctgctgctggctcaggacgatgccacccgcgcggcgatcatcggcgatgcaccggtcaaggtcgcggtcgaagccgcggtgcggttcggctgggacgcggtgatcggtccggacggcggctttgtcggcatgaccggcttcggcgccagcgcaccggccaaggacctctacaagcacttcggaatcaccgccgaagctgtggcggacgccgctaagcgtcggcttgccgcctaa

SEQ ID NO: 9817 - protein, 661 aa, Rhodopseudomonas palustris CGA009
MAQVDHSRMANAIRALAMDAVEKAKSGHPGLPMGAADVATVLWTQFLKFDAVDPHWPDRDRFILSAGHGSMLLYALLYLTGNEELTLDQIKNFRQLDSKTPGHPENCITSSVETTTGPLGQGVASSVGTALAERLLQAEFGDIVDHYTYVLCSDGDLMEGVSHEAIALAGHLRLSKLIFLYDDNGISIDGPLSLTDTVDQVARFQAHGWNSFRIDGHDHKAIADAIRKAQASDRPTMIACKTTIGFGAPHKAGTSKAHGEPLGAEELAGAKKALGWDYGPFEIPDDVLSAWRNVGKQGASARADWLARFDALPADKRGDFKRRVIDRKRPAAIADAIRTLKDKLVAEPQTIATRKASELALEALTPVVPELLLGSADLTPSNNTRVKQAKDVTPDDFSGRYIHYGIREMGMAAAMNGLAMHGGFAPAGGTFLCFTDYARPSMRVAALSHVPVVYIMTHDSIGLGEDGPTHQPVEHLAALRAMPNMRVFRPADAVETAECWQLALENTNGPTLLALSRQNLAQVRTATSEANLCATGGYELIPAPGKAQVSIFATGSEVEIAVAAQKLLEVQGVAARVVSVPSLDLLLAQDDATRAAIIGDAPVKVAVEAAVRFGWDAVIGPDGGFVGMTGFGASAPAKDLYKHFGITAEAVADAAKRRLAA

SEQ ID NO: 9818 - DNA, 1968 bp, Rhodopseudomonas palustris CGA009
  CDS (1)..(1968): transl_table=11
atggcgaatgcgatccgctttctcgctatcgacggtgtcgagaaggcgaagtccggccacccgggcatgccgatgggcatggccgacgttgccaccgtgctgttcacccgcttcctgaagttcgatccggccgatccggcctgggccgaccgcgaccggttcgtgctgtcggccggccacggctcgatgctgctgtacgcgctgctgcatctgaccggctatccggacgtgacgatcgatcagctgaagtcgttccggcagtggggttcgaagaccccaggccatccggaatacggccacacccagggcgtcgagaccaccaccggcccgctcggccaggggcttgcgacctcggtcggcatggcgcttgccgaacgcatgatgaatgcacgctacggcgacgcgctggtcgatcaccacacctacgtcatcgccggcgacggctgcctgatggaaggcgtcagccacgaggcgatctcgctggccggccacctcaagctcaacaagctgatcgtgctgtgggacgacaaccacatctcgatcgacggcgacacctcgctgtcgtgctcggacgatcagctcgcgcgcttcgccgcgtcgggctgggccaccactcgcgtcgacggtcatgatccggaagcggtcgcggccgcgatcgagcaggccaagaagagcgaccgtccgtcgctgatcgcctgccgcaccacgatcggcttcggctcgccgaaggtcgcgggcaccgagaaggcgcacggcgccccgctcggcgccgacgaggtcgagaagacccgcgccgcgctgaactggccgcatccgccgttcgaaatccccgatccgatcctggcgcgctggcgcgaggccggcggccgcggcaaggcggcgcacgaggcctggacccagcgtctggcagcggccgacgctgcgacccgcaccggcttcaccgatgcgctcgccggaaagctgtcggcggactacgaaggcgcgctgcagggcctgatcgccaagttcgacgccgacaagccgaccatcgccacccgtcaggcgtcgcagctcaccatcgacgccatcgtgccggcgtcgccgaacatcctcggcggctcagccgacctgacgcactccaacctgacgcatgccaagggcaccgcgtcggtgaagccgggtgcgttcggcggctcctacctgcactacggcatccgcgaattcggcatggcggcggcgatgaacggcatcgcgctgcacggcggcttcgtgccgttcggcggcaccttcctggtgttcgccgactatagccgtccggcgatccgccttgcggcgctgatgggcgtccgcgtcatccatgtgatgacccacgactcgatcggcctcggcgaagacggtccgacccatcagccggtcgagcacgttccctcgctgcgcgcgatcccgaacgtcctggtgttccgcccggccgacgcgatcgaaaccgcgcaggcctgggactgcgcgctgaagcagacctcgcgtccgtcggtgctggcgctgtcgcgccagggcctgccggcgctgccgcgtccgaacggcgcgaccggcaacccggtggcgcgcggcgcttacgtcgtggtcgatcccggccagcgcgacgtcaccctgatcgccaccggctcggaagtgtcgctggcgctggatgcggcgtccaagctggaagccgaaggcatcaaggcagcggtggtgtcggccccgtgcttcgaactgttcgccgaccaggacgacgcgtaccgcgccagcgtgctcggcaccgcgccgcggatcggcatcgaagcggcgcgcgacaccgattggcgccgctggatcggcgataccggtgcgttcgtcggcatgaccgggttcggtgcctcggcgccggcgccggttctgtaccagaagttcggcatcaccgcggacgcggtggtggacgccgccaagggcgcgatcgcccgcggtaagcactga

SEQ ID NO: 9819 - protein, 655 aa, Rhodopseudomonas palustris CGA009
MANAIRFLAIDGVEKAKSGHPGMPMGMADVATVLFTRFLKFDPADPAWADRDRFVLSAGHGSMLLYALLHLTGYPDVTIDQLKSFRQWGSKTPGHPEYGHTQGVETTTGPLGQGLATSVGMALAERMMNARYGDALVDHHTYVIAGDGCLMEGVSHEAISLAGHLKLNKLIVLWDDNHISIDGDTSLSCSDDQLARFAASGWATTRVDGHDPEAVAAAIEQAKKSDRPSLIACRTTIGFGSPKVAGTEKAHGAPLGADEVEKTRAALNWPHPPFEIPDPILARWREAGGRGKAAHEAWTQRLAAADAATRTGFTDALAGKLSADYEGALQGLIAKFDADKPTIATRQASQLTIDAIVPASPNILGGSADLTHSNLTHAKGTASVKPGAFGGSYLHYGIREFGMAAAMNGIALHGGFVPFGGTFLVFADYSRPAIRLAALMGVRVIHVMTHDSIGLGEDGPTHQPVEHVPSLRAIPNVLVFRPADAIETAQAWDCALKQTSRPSVLALSRQGLPALPRPNGATGNPVARGAYVVVDPGQRDVTLIATGSEVSLALDAASKLEAEGIKAAVVSAPCFELFADQDDAYRASVLGTAPRIGIEAARDTDWRRWIGDTGAFVGMTGFGASAPAPVLYQKFGITADAVVDAAKGAIARGKH

SEQ ID NO: 9820 - DNA, 2007 bp, Geobacter sulfurreducens PCA
  CDS (1)..(2007): transl_table=11
atggccgcggtaagccttaccaacgaagatgcccgcctgggcgccgataccctcaggatgctggcggtggacgcggttgaagccgccgcctccggtcacccggggctgcccatgggggccgccgactacgcctttctcctctggcactcccacctccgcttcgaccccgccgacccggagtggccggggagggaccggttcatcctctcggcggggcatggttccatgcttctctacggtctgctccacctcttcggcttcgatcttcccctggatgaactgaagcggttccgccagtgggggagccgcaccccgggccatccggaatacggccatacccccggcgtggaggtgaccaccggtcccctggggcaggggttcgccatgggggtcggcatggccctggcggcgcgcatgggctcggcccgctttgccgacgagcggtttgatccctgcgcccaccacatctacgccttggtgagcgacggcgacctcatggagggagtcagccaggaggcggcatccctggccggtcacctgaagctcggcaacctggtctacctgtacgacgacaaccggatcaccatcgagggttccacggacctcgccttttccgaagacacggcggggcgcttcgcggctcttggctggcacgtgcaggccgttgacggccacgatgtccgccaggtggacgaggccctctggcgggcccgggtggaacgggagcggccctccctcatcatcgcccggacccatatcgcccagggctcgcccggcaagcacgactccgccgccgcccacggctcgcccctgggtgccgaggaggccgcagccacgcgcaggagcctggggtggcccgatgagttgtttcacgtgccggagcggattcgggagctctgcgaacagaggcgggaagcgctcgccgaggcgcgcgccgcctggcaggatgagctccgccgctggcgccgccgcaattccgacaagggacggctctgggatctgatggcggaaaagggggtgcccagggatctggagtcccggctgctggcggcggtgggagccgaagccggcgccacgcgctcccttgcgggcaaggtcctccaggcggccgccgccgtagtgccctccctggtcgggggctcggcggacctcgagccctccaccaacacccggatcaaggattcctcctccgtgctccccggtagctacggggggcgcaatcttcacttcggcgtgcgcgagcatgccatggccgcaatcatgaacggcatggcccgccacggcgggttcatcccctacggcgccaccttcctggtctttgccgactactgccggccggctatccggttggcggcgctcatgaagcagcaggcggtgtacgtgttcacccacgattccctcttcgtgggtgaggacggtcccacccaccagcccgtggagcagctctcgtcactgcggctcatccctaacctccgggtgatccggccagcggacggccccgaaacggccttggcctgggctgcggctctgcggcgcacggacggccccacggcccttgtcctgacccgccagaaagtgccggccatcgcccgggaggagacccttgaccccagaacctttgccaaggggggctacgtggtccgttccggcggggcggccccggccgtggttctcatggcgagcgggtccgaggtaggactggctctggccgcggcagagattatggccggtaacggggttgcggctcgcgtggtatctatcccctgtatggaggcattcctggcccagccggaaagctaccggcgccgctgtctgccgggacgtgtcccacgagttgcggtggaggcggggcacggcggcctctggtggcggctcctgggtccggctggcctgttcattggcctggagaccttcggcgcttcggccccggaaaaggtactggccgagcagtacggtttcacccctgagctggttgcccggcgtgtggccgagttcgtggagcgctga

SEQ ID NO: 9821 - protein, 668 aa, Geobacter sulfurreducens PCA
MAAVSLTNEDARLGADTLRMLAVDAVEAAASGHPGLPMGAADYAFLLWHSHLRFDPADPEWPGRDRFILSAGHGSMLLYGLLHLFGFDLPLDELKRFRQWGSRTPGHPEYGHTPGVEVTTGPLGQGFAMGVGMALAARMGSARFADERFDPCAHHIYALVSDGDLMEGVSQEAASLAGHLKLGNLVYLYDDNRITIEGSTDLAFSEDTAGRFAALGWHVQAVDGHDVRQVDEALWRARVERERPSLIIARTHIAQGSPGKHDSAAAHGSPLGAEEAAATRRSLGWPDELFHVPERIRELCEQRREALAEARAAWQDELRRWRRRNSDKGRLWDLMAEKGVPRDLESRLLAAVGAEAGATRSLAGKVLQAAAAVVPSLVGGSADLEPSTNTRIKDSSSVLPGSYGGRNLHFGVREHAMAAIMNGMARHGGFIPYGATFLVFADYCRPAIRLAALMKQQAVYVFTHDSLFVGEDGPTHQPVEQLSSLRLIPNLRVIRPADGPETALAWAAALRRTDGPTALVLTRQKVPAIAREETLDPRTFAKGGYVVRSGGAAPAVVLMASGSEVGLALAAAEIMAGNGVAARVVSIPCMEAFLAQPESYRRRCLPGRVPRVAVEAGHGGLWWRLLGPAGLFIGLETFGASAPEKVLAEQYGFTPELVARRVAEFVER

SEQ ID NO: 9822 - DNA, 2004 bp, Bacillus methanolicus
  CDS (1)..(2004): transl_table=11
gtgctccaacaaaaaatagatattgatcagttatccattcaaactattagaactctatcaattgatgcaattgaaaaggttggatcaggccatccggggatgccaatgggggctgccccgatggcctatacactttggacaaaatttatgaattacaatccaagcaacccgaattggtttaatcgtgaccgttttgtattgtcagcgggacacggatccatgttattatacagcctattacatttaactggttatgatctatcattagaagatttgaaaaacttccgccaatggggaagcaaaacacctggtcaccctgaatttggccatacacctggggttgatgccacaacaggtccgttagggcaaggtattgccatggcagttgggatggcgatggctgaaagacatttagcgtctaaatacaatcgttataaatttaatattattgatcactacacatacagcatttgtggcgatggggacttgatggaaggtgtatctgcagaggcagcttcacttgcagggcaccttaaacttggtcgcttaattgtattatacgattcaaatgatatttctcttgatggcgatcttcatatgtcatttagtgagagtgttcaagatcgttttaaagcatacggctggcaagtacttcgtgttgaggacggcaatgatatcgattcaatcgcaaaagcgatagctgaagcgaaaaacaacgaagaccaaccaacattaattgaagtcaaaacaataattggatacggctcaccgaataaaggtggaaagtctgatgcgcacggctcaccacttggaaaagaggaaataaagcttgtaaaagaacattacaactggaaatatgatgaggatttttatatccctgaagaagtaaaagaatattttagagaattaaaagaagcagcagagaagaaggaacaagcatggaatgagttgttcgcacaatataaagaagcatatccagcacttgcaaaggaattagaacaagcgattaatggtgaactaccagaaggctgggatgctgatgttcctgtttaccgtgtcggagaagataaacttgctactcgttcttccagtggtgcagtgttaaatgctctagcgaaaaatgttccgcaactacttggcggttctgcggatttagcttcatctaataaaacgctactaaaaggggaagcaaatttcagcgctacagattatagcggacgtaatatttggtttggtgttcgtgaatttggaatgggtgctgctgtcaacggaatggccctacacggtggtgtaaaagtatttggagcaacattctttgtattctctgattatttacgtccggccattcgtctctcagcattaatgaaactaccagttatttatgtctttacacatgatagcgttgctgtaggtgaagatggaccaacacatgaaccaattgaacaattggcatccttacgtgcaatgcctggtatctctacaattcgcccggctgatggcaatgagacagctgcagcttggaagttggcgttagaaagtaaagacgaaccaacagctcttatcctctcacgtcaagacttaccaacacttgttgattctgaaaaagcgtatgagggtgttaaaaaaggtgcatatgtgatctctgaagcaaaaggtgaagttgctggtttgttattagcatctggttctgaagttgctttagctgttgaagcacaagcagcgctggaaaaggaaggtatttatgtttcagttgttagtatgcctagctgggatcgttttgaaaaacaatctgatgcatacaaagaaagtgtacttccaaaaaacgtaaaagcacgtcttggtattgaaatgggggcttccttaggttggagtaaatatgttggtgataacggtaacgtcctcgccattgatcaatttggatcctcagcaccaggagataaaataattgaagaatacggttttacagtcgaaaatgtcgtttctcattttaaaaagcttctctaa

SEQ ID NO: 9823 - protein, 667 aa, Bacillus methanolicus
MLQQKIDIDQLSIQTIRTLSIDAIEKVGSGHPGMPMGAAPMAYTLWTKFMNYNPSNPNWFNRDRFVLSAGHGSMLLYSLLHLTGYDLSLEDLKNFRQWGSKTPGHPEFGHTPGVDATTGPLGQGIAMAVGMAMAERHLASKYNRYKFNIIDHYTYSICGDGDLMEGVSAEAASLAGHLKLGRLIVLYDSNDISLDGDLHMSFSESVQDRFKAYGWQVLRVEDGNDIDSIAKAIAEAKNNEDQPTLIEVKTIIGYGSPNKGGKSDAHGSPLGKEEIKLVKEHYNWKYDEDFYIPEEVKEYFRELKEAAEKKEQAWNELFAQYKEAYPALAKELEQAINGELPEGWDADVPVYRVGEDKLATRSSSGAVLNALAKNVPQLLGGSADLASSNKTLLKGEANFSATDYSGRNIWFGVREFGMGAAVNGMALHGGVKVFGATFFVFSDYLRPAIRLSALMKLPVIYVFTHDSVAVGEDGPTHEPIEQLASLRAMPGISTIRPADGNETAAAWKLALESKDEPTALILSRQDLPTLVDSEKAYEGVKKGAYVISEAKGEVAGLLLASGSEVALAVEAQAALEKEGIYVSVVSMPSWDRFEKQSDAYKESVLPKNVKARLGIEMGASLGWSKYVGDNGNVLAIDQFGSSAPGDKIIEEYGFTVENVVSHFKKLL

SEQ ID NO: 9824 - DNA, 2100 bp, Mycobacterium avium subsp. paratuberculosis K-10
  CDS (1)..(2100): transl_table=11
gtgacgacacttgaagagatctctgcgctgacccaaccgcaccttcccgacgactggtccgagctggactcggccgccgtcgacaccattcgggtgctggccgccgacgcggtgcaaaaggtgggcaacggacatcccgggacggcgatgagcctggctcccctggcctacacgctgtttcagcgggtgatgcggcacgaccccagcgacacccactggctgggccgggaccggttcgtgctgtcggccgggcacagcagcctgacgctgtacctgcagctgtacctgggtggcttcggtctggagctgtccgacatcgagtcgctgcgcacctggggctccaagacgcccgggcacccggagttccggcacaccaagggtgtggagatcaccaccggcccgctgggccagggcctggcctccgcggtgggcatggcgatggcctcccgctacgagcgcgggctgttcgacccggacgccgccgccggcaccagcccgttcgaccacttcatctacgtgatcgcctccgacggcgacatcgaggagggcgtcacgtcggaggcctcgtcgctggcggccgtgcagcaactgggcaacctgatcgtgttctacgaccacaaccagatctccatcgaggacgacaccaacatcgccctgtgcgaggacaccgccgcccgctacgaggcctacggctggcacgtgcagcgcgtcgagggtggcgagaacgtcgtcgccatcgaggaggccatcgccgcggccaaggccgtcaccgaccggccgtcgttcatcgagctgcgcacgatcatcggctatccggcgcccaacgcgatgaacaccggcaaggcgcacggcgcggcgctgggcgaggaggaggtggccgcggtcaagaagatcctcggcttcgacccggacaaaacgttccaggtgcgcgacgaggtgatcgcccacacccgcaagctggtcgaccgcggccgggaggcacaccagaagtggcagaccgatttcgacgcctgggcgcagcgcgagcccgagcgcaaggcgctgctggagcggttgacggccgagaagctgcccgacgggtgggacgccgacctgccgcactgggaggcgggttccgacgcgatcgccacccgcaaggcctccggcgcggtgctcaacgccgtggcgccgaaactgcccgagctgtggggcggctcggccgacctggccgagagcaacctcaccaccatcaacaacgcggattcctttgggcccccgtcgatttccaccaaggagttcaccgcctcctggtatggccgggtgctgcatttcggtgtccgcgaacacgccatgggggcgatcctgtccggcatcgtgctgcacggcccgacccgcgcctacggcggcaccttcctgcagttctcggactacatgcgtccggcggtgcggctggcctcgctgatggacatcgacaccatctacgtgtggacgcacgattccatcgggctgggtgaggacgggccgacgcaccagccgatcgagcacctggcggcgttgcgcgccatccccaagctgtcggtggtgcgcccggccgacgccaacgagaccgcctacgcctggcgcaccatcctggcccgcggcaacggcagcggcccggtcggattggtcctgacccgccagggcctgccggtgctcgagggcaccgacgccgacggtgtcgcccgcggcggctacatcctgggctcggacggcgaggaggccggccaggagcccgacgtcatcctgatcgccaccggctcggaggtacagctggccgtcgaggcgcagaagttgttggcggacaaggacattgtggcgcgggtggtgtccatgccgtgcgtggaatggttcgagtcccagcccgacgactaccgcgacagtgtgctgccgccgtcggtgtcggcccgggtggccgtcgaggccggggtggcgcagagctggcacaagctggtcggcgacaccgggaagatcatctcgatcgagcactacggcgaatccgccgactacaaaacgttgttccgtgaattcggattcaccgccgaagccgtcgctgccgccgcggaagaagtcgtggacaactga

SEQ ID NO: 9825 - protein, 699 aa, Mycobacterium avium subsp. paratuberculosis K-10
MTTLEEISALTQPHLPDDWSELDSAAVDTIRVLAADAVQKVGNGHPGTAMSLAPLAYTLFQRVMRHDPSDTHWLGRDRFVLSAGHSSLTLYLQLYLGGFGLELSDIESLRTWGSKTPGHPEFRHTKGVEITTGPLGQGLASAVGMAMASRYERGLFDPDAAAGTSPFDHFIYVIASDGDIEEGVTSEASSLAAVQQLGNLIVFYDHNQISIEDDTNIALCEDTAARYEAYGWHVQRVEGGENVVAIEEAIAAAKAVTDRPSFIELRTIIGYPAPNAMNTGKAHGAALGEEEVAAVKKILGFDPDKTFQVRDEVIAHTRKLVDRGREAHQKWQTDFDAWAQREPERKALLERLTAEKLPDGWDADLPHWEAGSDAIATRKASGAVLNAVAPKLPELWGGSADLAESNLTTINNADSFGPPSISTKEFTASWYGRVLHFGVREHAMGAILSGIVLHGPTRAYGGTFLQFSDYMRPAVRLASLMDIDTIYVWTHDSIGLGEDGPTHQPIEHLAALRAIPKLSVVRPADANETAYAWRTILARGNGSGPVGLVLTRQGLPVLEGTDADGVARGGYILGSDGEEAGQEPDVILIATGSEVQLAVEAQKLLADKDIVARVVSMPCVEWFESQPDDYRDSVLPPSVSARVAVEAGVAQSWHKLVGDTGKIISIEHYGESADYKTLFREFGFTAEAVAAAAEEVVDN

SEQ ID NO: 9826 - DNA, 2028 bp, Treponema denticola ATCC 35405
  CDS (1)..(2028): transl_table=11
atgaaaaacgaactggaagctattgctctttcaatcagaagtctttcgatggacgcaatcgaaaaagccaactcagggcatccggggctgcctttgggagctgccgaattgggtgctgccctgtatgctaaaatcttaaaacacaatcctaaaaatccggattggaaagacagggaccgctttgtgctttctgcaggccacggttcgatgcttttgtattcagccttacatatttcaggctacgatgtttcaatcgaagatataaaaagttttaggcagctcggctccaaatgtccggggcatcccgaatacggcgacactcccggtgttgaaactaccacagggcccttgggtcaaggaatttctacagccgtaggtatggccattgccgaaaaaatgcttgccgcccgctttaacacagccgagcataaaatagtagaccattatacttatgcccttgtaggggagggctgtttgatggagggcgtttcctccgaaagctccagtttggcaggccacttaaaattaggaaagctcattgtttattatgatgaaaataagattacaattgacggttcgaccgacttaacatttaccgaaaacatcgaagaaaggtacaaggcctacggctggcaggtattgcgcggttcgatgtactcctttgaagatattgaacgcctgactcttgaagctaaaaaagatgaaaggccgactcttattatcttaaagtccgttataggtcagggggctccgacggttgcaggcaaaaacaaggcacacggcgctcccttaggaaaagacggcattgccgaagccaagaaaaatcttttactcgaaggaaaaggcgatttctatgttgcagaagaagcttatgctttctttaaaaagagaaatgaagagctggctcttgctgaagccgaatggaataaaacctttgaagtctggtcaaaagccaatcccgaaaaaagaaaagaatgggatctttcctttgcccaaggcggagctgatgaagcccttgtaaaatctgtaaagctccctgagttcaaaaaagatgagagtcttgcaacccgtgccgcttcaaaaaaggccttaaacgagtttgcaaaagtccttcccaatcttgtcggaggttctgccgacttggaaggccccaatgccgtaggcttggacggaatttcagccttttctcatcaaaatccttcgggaagatatatttatttcggtatcagggaatttgcaatggggacaatcacaaacggtattcagcttcacggaggttttagggcattttgtgcgaccttcttggtctttgccgattatttacgcccggctctccgccttgctgcccttatgaagcttccttcaatctatgtatttacccatgattcaatctttgtaggggaggacggccccacccatcagcccatagaacttttagcctcattgcgggctattccgaatgttcttgttttacgccctgccgatgcggaggaaacaggggaagcatggaagcaggctctcttacacaaggacggccccgtatgtttaatcttgagccgccaaaatttacctgtcttggaaaagagcgatcttttttggagggaatcgattaaaaacggtgcatacattgtaaaggatgtagaggcttcggcctcaggctgtacggtaggcaagccggatagaactcctgacgtaacggtcttggctacgggctccgaggtaagtatggcagtaaaggctgcaagtcttgtaaaggataaaaaggtcagagttgtctccgttatgtcgaaagaaaggtttgaaaactcgcctaaggattttaaacatggagttttgggcggatgtaaaaagcatatccgtgttgttaccgccgaggctggagtcgcccaaggctgggaaggctggacaggttgtaagtgcgataatttttcgattgagggtttcggcacctcagcccccggagccaaggtcgcagaacacctaggctttacgtcagaaaacttggcaaagctgatagagaaaaattaa

SEQ ID NO: 9827 - protein, 675 aa, Treponema denticola ATCC 35405
MKNELEAIALSIRSLSMDAIEKANSGHPGLPLGAAELGAALYAKILKHNPKNPDWKDRDRFVLSAGHGSMLLYSALHISGYDVSIEDIKSFRQLGSKCPGHPEYGDTPGVETTTGPLGQGISTAVGMAIAEKMLAARFNTAEHKIVDHYTYALVGEGCLMEGVSSESSSLAGHLKLGKLIVYYDENKITIDGSTDLTFTENIEERYKAYGWQVLRGSMYSFEDIERLTLEAKKDERPTLIILKSVIGQGAPTVAGKNKAHGAPLGKDGIAEAKKNLLLEGKGDFYVAEEAYAFFKKRNEELALAEAEWNKTFEVWSKANPEKRKEWDLSFAQGGADEALVKSVKLPEFKKDESLATRAASKKALNEFAKVLPNLVGGSADLEGPNAVGLDGISAFSHQNPSGRYIYFGIREFAMGTITNGIQLHGGFRAFCATFLVFADYLRPALRLAALMKLPSIYVFTHDSIFVGEDGPTHQPIELLASLRAIPNVLVLRPADAEETGEAWKQALLHKDGPVCLILSRQNLPVLEKSDLFWRESIKNGAYIVKDVEASASGCTVGKPDRTPDVTVLATGSEVSMAVKAASLVKDKKVRVVSVMSKERFENSPKDFKHGVLGGCKKHIRVVTAEAGVAQGWEGWTGCKCDNFSIEGFGTSAPGAKVAEHLGFTSENLAKLIEKN

SEQ ID NO: 9828 - DNA, 2001 bp, Mycoplasma mycoides subsp. mycoides SC str. PG1
  CDS (1)..(2001): transl_table=4
ttgatatatctattaaatataaggagaaaaatgaaaactagtaaaaatgataatttaaatgcattacgtatattaggtgtaagtgcaattaataaagcaaaatctggtcatcctggaattgttttaggagcagctggaatagtttatgttttatttaataaaattatgaattttaatcctaaaaatccagaatgatttaatagagatagatttattttatctgctgggcatggtagtgcattactatattcagctttacatttatctggatatgatttatctattgatgatttaaaacaatttagacaatgagatagtaaaactccaggacatcctgaaaaaactttaacgtgtggagttgaagtgacaacaggtccacttggtcaaggtgttggaatgggagttggaatggctgttgctgaagctcatctagcaagtgtttataataaacatgattttaatttgattcatcattatacttatgttttatgtggtgatggtgatttacaagaaggaattagtcaagaagctatttcttttgctggtaaacataggttaaataaattaattttaattcatgattcaaatgatgtgcaattagattcaaatgtagttgatgtacaaattgaagatatgcacaaacgttttaaagcatgtaattgaaatacaataaaagttagtgatggagaagatttaaattcaatttataaagctattagaaaagctcaactttcagataaaccaacatatattgaagttaaaactgttattggattaggttcaacaaaacaaggaactaaagatattcacggtgctcctttaaatgatgatataactaaagtaaaaaaatattttgattgagattatgatgattttattattccagattcagtttataaacactgatcaattaatgctaaaaaaggtgaaattaaagaagaatattgaaatcaattaaaagctaaatatagtttaaaatatcctgaattaagttcttatttagataatgctattaataaaaatattacttttgatttttctagtttattaaaagatataccaaataatgatgaagcaacaagattaagttcaggaaaaatctttgaaaaaattgcaaatcatgaaaaaatgctaattggaggaagtgctgatttatctagttcaactagaattaaaggtgctgataatcaatttactaatttaaataaaactggtagaaatataatgtatggagtaagagaatttggaatgggtgcaattaataatggaattgcagctcataaaggattaattccagtagctagtgggttttttgtatttgcagattatttaaaaccagcaatgagattagcttcaattatgcaattacaacaattatatgtctttactcatgattcaattgcagttggtgaagatgggccaactcaccaaccaattgaacaactagcaatgttaagaactattccaaatcatgttgttttaagaccagctgattttagtgaaactattgcttgttataaagttgctttaacaaaactaactaaaactcctgcttcaattattttaactagacaaaatgtaaaacaactacaacacaatgatgttttaaatcaagttgaacgtggtgcttatataattagtgatcaaactgatgcaactattagtttaattgctagtggtagtgaagttggattagcaattgatgtgcaaaaagaattattaaatcacaatattaaatcaaaagtgatttcaatggtatcaactaatttatttgataaacaagataaagaatatcaagatctaattattaataaaaatactaaaagaattgctattgaaatgggatcaaacgcaatttgatataaatatgttggtgatgatggtttagtatttggaattgatcgttttggtgaatcagctcctgctaatagtgtcattaaagaatttggatttacaaaagaaaatctaacaaaaaaaatattagaatatttaaataaatag

SEQ ID NO: 9829 - protein, 666 aa, Mycoplasma mycoides subsp. mycoides SC str. PG1
MIYLLNIRRKMKTSKNDNLNALRILGVSAINKAKSGHPGIVLGAAGIVYVLFNKIMNFNPKNPEWFNRDRFILSAGHGSALLYSALHLSGYDLSIDDLKQFRQWDSKTPGHPEKTLTCGVEVTTGPLGQGVGMGVGMAVAEAHLASVYNKHDFNLIHHYTYVLCGDGDLQEGISQEAISFAGKHRLNKLILIHDSNDVQLDSNVVDVQIEDMHKRFKACNWNTIKVSDGEDLNSIYKAIRKAQLSDKPTYIEVKTVIGLGSTKQGTKDIHGAPLNDDITKVKKYFDWDYDDFIIPDSVYKHWSINAKKGEIKEEYWNQLKAKYSLKYPELSSYLDNAINKNITFDFSSLLKDIPNNDEATRLSSGKIFEKIANHEKMLIGGSADLSSSTRIKGADNQFTNLNKTGRNIMYGVREFGMGAINNGIAAHKGLIPVASGFFVFADYLKPAMRLASIMQLQQLYVFTHDSIAVGEDGPTHQPIEQLAMLRTIPNHVVLRPADFSETIACYKVALTKLTKTPASIILTRQNVKQLQHNDVLNQVERGAYIISDQTDATISLIASGSEVGLAIDVQKELLNHNIKSKVISMVSTNLFDKQDKEYQDLIINKNTKRIAIEMGSNAIWYKYVGDDGLVFGIDRFGESAPANSVIKEFGFTKENLTKKILEYLNK

SEQ ID NO: 9830 - DNA, 1995 bp, Bacillus cereus ATCC 10987
  CDS (1)..(1995): transl_table=11
atgacacaaaacataaatcaattagcagtgaatacacttcgtacgttatcgattgatgctattaatgcggcaaattcaggtcatccaggtcttccgatgggcgcagcaccgatggcttatgcattatgggcgaatcatttaaatcataatccgaatcatccaaaatggtttaaccgtgatcgattcgttttatcggctggacatggatctagcttattatatagcctacttcatttagctggatatgacgtttcaattgatgatttgaaaagttttagaaagttaaatagtaaaacaccaggacatcctgagtttggtcacacttctggagttgaagcgactacaggcccgttaggacaaggcattgcaaatgctgttgggatggcaatggcggaagctcatttagcagcgaagttcaataaggatggtcactctattatagatcacaatacgtacgctttagttggagacggtgacttaatggagggtgtcgcttatgaagcgatgtcaatggcaggtcatatgaaacttggtaagttaattgtactgtatgattcaaatgaaatttcacttgatggagaattaaacattgctttctctgaagatatgcagaaaagggtagaatctgcacattggcaatatgtaagagttgaggatggaaacgatgttgatgcgattacaaaagcgattcaattagcgaaagacaatacggaccaacctactcttatagaaattagaacgattataggttacggaagtccaaaagttgctggaacgaacaaagcacatggtaacccgcttggagtagaagaagcgacagcgacaaaacaagcgtatggttggcattatgaggaagatttctttgtacctgaagaagtaacagctcattttaatgaactgaaacaaaaaggtattgaaaaagagaacaaatggaatgagcagttcaacgtatatagagagtcgaatccagcactagcagatgaattagaaaaagcgattacaggtgaggttttaatcgaagcgaaagacattctatcctttgatactgaaaaaacgatttctactcgtgttgcaagtggggaagctattaatcattacgtgaaatcgattccttctattttcggtggaagtgcggatctttctcattctacgatgacagatataaaaggggaagcggtgtacgcagtagaatcgtatgctggccgaaatatatacttcggtgtacgtgaacatgcaatgggcgcggcagcgaatggactggcacttcatggaggagtaaagccgttcgtaagtacattctttgtatttaacgattatcttcgtccatcgattcgactggctgcattgcaaaagttacctgttacgtacgtatttacacatgattcgattgctgtaggagaagatggtccaacgcatgaaccaatcgaacatttggcagctcttcgggcaattcctggtttaacagttatccgcccgtcagatgcaaatgaaacagcaagtgcgtgggcttatgctttacagcaaacggaaggtccagtcgttttagtactgagccgtcaaaatttaccggtgtttcatgaaacgaaagcgaacatagagaatctttctaaaggagcttacgtattaacacaaacgaatgaaaatccggatgtaattttaattgcgacaggttctgaagtatccttagctgctagtgcgaaagcaaaattagaagaagatcaagtttctgttcgcatcgttgcaatgccgagctgggagttattcgatcgtcaatcgaaagaatataaagaatccgttcttccgtcttctgtaacgaaacgagtatctcttgagatgggtgtatctctcggctgggagcgttatgtaggacaagaaggaaaagtgctatcaattgaaacatttggagcttcaggaactggagctgaagtcatgaatctatttggatttacgacagaaaatgttgttcaaattacaaaaaatgtgttgaattcttaa

SEQ ID NO: 9831 - protein, 664 aa, Bacillus cereus ATCC 10987
MTQNINQLAVNTLRTLSIDAINAANSGHPGLPMGAAPMAYALWANHLNHNPNHPKWFNRDRFVLSAGHGSSLLYSLLHLAGYDVSIDDLKSFRKLNSKTPGHPEFGHTSGVEATTGPLGQGIANAVGMAMAEAHLAAKFNKDGHSIIDHNTYALVGDGDLMEGVAYEAMSMAGHMKLGKLIVLYDSNEISLDGELNIAFSEDMQKRVESAHWQYVRVEDGNDVDAITKAIQLAKDNTDQPTLIEIRTIIGYGSPKVAGTNKAHGNPLGVEEATATKQAYGWHYEEDFFVPEEVTAHFNELKQKGIEKENKWNEQFNVYRESNPALADELEKAITGEVLIEAKDILSFDTEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETASAWAYALQQTEGPVVLVLSRQNLPVFHETKANIENLSKGAYVLTQTNENPDVILIATGSEVSLAASAKAKLEEDQVSVRIVAMPSWELFDRQSKEYKESVLPSSVTKRVSLEMGVSLGWERYVGQEGKVLSIETFGASGTGAEVMNLFGFTTENVVQITKNVLNS

SEQ ID NO: 9832 - DNA, 2001 bp, Bacillus cereus ATCC 10987
  CDS (1)..(2001): transl_table=11
atgtcacattcaatcgaacaactttctatcaacacgattcgcacattatccatcgatgcgattgaaaaagcaaactctggtcacccaggaatgccaatgggtgcagcaccaatggcttatacattatggactcaatttatgaaacacaatccaaataacccaacgtggtttaaccgtgatcgtttcgtattatcagcaggtcatggttcaatgttattatacagcctacttcacctatctggttatgatgtaacaatggatgacttaaagaacttccgtcaatggggaagcaaaactccaggacatcctgagtacggtcatacacctggtgtagatgcaactactggtccacttggacaaggtatttcaactgctgtaggtatggcaatggctgaaagacatttagctgctaaatataaccgtgatgcgtataatgtagtagatcattatacatacgctatttgtggtgatggagatttaatggaaggcgtttctgctgaagcatcttcattagctgctcatttacaattaggtcgccttgttgtgctttacgattcaaacgatatttcattagatggcgatttaaatcgttcattctctgaaagtgtagaagatcgttacaaagcatacggatggcaagtaatccgtgttgaggatggaaacgatattgaagctatcgcaaaagcaatcgaagaagcgaaagctgacgaaaaacgcccaacgctaattgaagtaagaacgacaattggtttcggttctccaaacaaatcaggaaaatcagcttcacatggttctccactaggtgtagaagaaacaaaattaacgaaagaagcatatgcttggactgctgagcaagacttccacgtagcagaagaagtatacgacaacttccgtaaaacagtacaagatgttggtgaaactgcgcaagcagagtggaacactatgctaggtgaatatgcacaagcatacccagaattagcaaacgaattccaagcagcaatgaacggtcaacttccagaaggttgggagcaaaacttaccaacttatgaattaggatcaaaagcagcaactcgcaattcttctggtgctgtaattaatgcaattgcagaatctgtaccatcattcttcggtggatcagctgaccttgctggttctaacaaaacatacatgaataacgaaaaagactttacaagagatgattacagcggtaagaacatttggtacggtgtacgtgagttcgcaatgggtgcagcaatgaacggtattgcactacatggtggtttaaaaacttacggtggtacgttcttcgtattctctgactacttacgtccagcaattcgtcttgcagcattaatgcaattgccggtaacgtatgtattcacacacgacagtatcgctgttggtgaagatggtccaacacatgaaccaatcgagcaattagcggcgctacgtgcaatgccaaatgtatctgttattcgtccagctgacggtaacgagtctgttgctgcttggagattagctctagaatctacaaacaaaccaactgctttagtattaactcgtcaagatcttccaacattagaaggtgcaaaagacgatacgtatgaaaaagtagcaaaaggtgcatatgtagtttctgcaagcaagaaagaaacagctgatgtaatcttacttgcaactggatcagaagtaagtctagctgttgaggctcaaaaagcattagcagtagacggtgttgacgcatctgttgtcagcatgccatctatggatcgctttgaagctcaaactgctgagtacaaagaatcggtattaccaaaagcagtaacaaaacgtttcgcaatcgaaatgggtgctacattcggatggcaccgttacgtaggtcttgaaggagatgtgttaggtatcgatacattcggtgcttctgctcctggtgagaagattatggaagagtatggatttactgtagagaacgttgttcgtaaagtaaaagaaatgctttaa

SEQ ID NO: 9833 - protein, 666 aa, Bacillus cereus ATCC 10987
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTPGVDATTGPLGQGISTAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYDNFRKTVQDVGETAQAEWNTMLGEYAQAYPELANEFQAAMNGQLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 9834 - DNA, 1878 bp, Strongylocentrotus purpuratus
  CDS (1)..(1878)
atgacagacccatatcatcgtccagacagcaagaggctccaggcactgaaagacatagcaaacaagttgagaatccacagcatttcgtcgactagtgccgcaggttctggacatccaacatcatgctgctctgctgcagagatcatgtctgtgctcttcttcaacaccatgaggtactccatcagcaagccacgtgaccccggtagtgaccgcttcatcatgtcaaagggtcatgctgctcctatcttgtatgcagcctgggctgaagctgggttggtcggtgtcgacgacctcaacaatctccgcaagattgacaacgatctggagggacatcctactcctagactctcgttcgtagatgtggctactggttcactgggacagggtctgagtgtggctgcaggtatggcctatactgccaagtactttgacaaggccgactatcgcacctattgcttggtcggtgatggtgagagcgcagaggggtccatctgggaggcatgtgcattcgccagctactacaaactggacaatcttgtggccatctttgatgtcaaccgtcttggtcagagtcaaccagcttcccttgagcaccaggtggaagtctaccagaagagattggaagcatttgggatgcatgctattattgttgatggtcatgatgtggaggccttgaacaaggccctctatgatgcttccaccgtcaaggacaagcctactgccattgtagcaaagacattcaagggcaagggctgcccagatgtggaggatcttgagaattggcatgggaaggctcttggtgctaaggctgagggagctctgaatgccatcaaggctcttatctccaaccctggaccccatggtatcgtcccacctgcttcaactcctctggctgagcacgatctctccaaagtgtgtctgagtgagcctccaagctataagactggggataaggttgcaacccgtgttgcgtatggcactgctcttgtcaaactgggcaattccatccccaacgttgtggccttggatggggacaccaagaactccacctttgccatcacctacaagaatgccttcccagaccgattcgttgagtgcttcatcgccgagcagaatctcgttggtgtgggcatcggttgcgcctgtcgtgaccgcaatgtggtgttcgtgagcgccttcgcttgcttcctggcaagggcttacgatcagatccgcatgggtgccatctcccagaccaacgtcaactttgttggctctcattgtggtgtttctattggtgaggacggaccatcccagatggctcttgaggacattgctatcttccgtgccatcccgacctgtactgtcttttaccccagtgatccggtctcttgtgagcgtgccatcgagttggctgccaagaccaagggtatcacgttcacccgtaccagccgcccaaccacggatctcctctatggcaacgatgaagtctttgaggttggaaaggccaaggtgatccgccagtcggctgaagacaaggtggtccttgtaggagcaggaatcactctccatgaggctgtggctgctgctgatctactcgagaacgagggtatcaaggtcaccgtgattgaccccttcaccatcaaacccatcgatgccgccacactcacagcgtgtgctaaggctgcaggtggacgcgtactgacggtcgaggatcactacagagaaggtggtttgggtgaagctgtagccggtgccctagccagccaaccaggcatcgtggtacgccgtctggctgttgacagagttcctcgcagtggaccctcaaaggtcctcatcgacatgtttggcatcagtgcaaactgcattgtcaaggccgtcaaggaaatgttagcctaa

SEQ ID NO: 9835 - protein, 625 aa, Strongylocentrotus purpuratus
MTDPYHRPDSKRLQALKDIANKLRIHSISSTSAAGSGHPTSCCSAAEIMSVLFFNTMRYSISKPRDPGSDRFIMSKGHAAPILYAAWAEAGLVGVDDLNNLRKIDNDLEGHPTPRLSFVDVATGSLGQGLSVAAGMAYTAKYFDKADYRTYCLVGDGESAEGSIWEACAFASYYKLDNLVAIFDVNRLGQSQPASLEHQVEVYQKRLEAFGMHAIIVDGHDVEALNKALYDASTVKDKPTAIVAKTFKGKGCPDVEDLENWHGKALGAKAEGALNAIKALISNPGPHGIVPPASTPLAEHDLSKVCLSEPPSYKTGDKVATRVAYGTALVKLGNSIPNVVALDGDTKNSTFAITYKNAFPDRFVECFIAEQNLVGVGIGCACRDRNVVFVSAFACFLARAYDQIRMGAISQTNVNFVGSHCGVSIGEDGPSQMALEDIAIFRAIPTCTVFYPSDPVSCERAIELAAKTKGITFTRTSRPTTDLLYGNDEVFEVGKAKVIRQSAEDKVVLVGAGITLHEAVAAADLLENEGIKVTVIDPFTIKPIDAATLTACAKAAGGRVLTVEDHYREGGLGEAVAGALASQPGIVVRRLAVDRVPRSGPSKVLIDMFGISANCIVKAVKEMLA

SEQ ID NO: 9836 - DNA, 1884 bp, Aedes aegypti
  CDS (1)..(1884)
atgcccacgtatcacaagcccgaatccaagactatccaggagctgaaggatatcgctcacaaactgcgtattcactcgattacatcgactcaggcgtccaagtccggtcatccgacgtcatgtgcgtcaattgcggaaattatgtcggtgttgtttttcaacacgatgcgctacaaaatctccgccccgcgcgatgcctcttcggatcggttcatcctttcgaagggtcatgcagcgccgattctgtacgccgcgtgggctgaggctggccttttcccaaccagcgacttgatgaatctgcgcaagatcgattcggatctagagggacatccaacgccacgtttgaactttgtcgatgtgggaaccggctctttgggtcagggagtggccgtcgcctgtggaatggcctacattggcaagaacatcgacaaagccgactacaggacctatgtgctggtcggagatggtgaatctgcggaaggttcgatctgggaatcgctgcatttcgctggccattacaaactggataacttgtgtgtgattttcgacgttaaccgactgggacagtcggaaccaacttccctgcagcaccagatggaagtttatcgcaagcgcctggatgctttcggtttcaacgcgatcgtcgtcgatggccacgatgtggaagaattgtgcaaagctttcttcgaagcttccgtgaccaaggatcgcccaacggctatcgttgccaagaccttcaagggcaagcatttccccaacattgaggatttagaaaattggcatggaaagcctctgggtgagaacgccaatggtgtcattgaacatttgcagtcgttgattcgcaacggtggaccacttcagattgctcctccttcgccacagaaagagggtgctaagaaggtcaacatcggtaatgttcaactggcgactcctccagcctatcagctcggagaatcggtggccacccgtttggcttacggtacggctttggctaagatcgctatgaacaacgatcgcgtaattgccttggatggagacaccaagaattcgacctattctgacaaactgcgcaaggccttcccagagcgattcatcgagtgtttcattgccgagcagaacttggttggtgtggccattggagctgcctgccgtgaccgtactattgctttcgtgtccacctttgccacgttcttcacgcgtgccttcgatcagatccgtatgggagccatttctcagacgaatgtcaactttgttggatcccattgcggtgtgagcattggagaggatggacctagccagatgggtctggaagatattgccatgttccgaaccattcctggtagcaccgtcttctacccgtcggatgccgtcagtacggaacgagcggttgaactggccgccaatactaaaggagtgtgctttatccgtacctccagaccgaatactgctgtcctttacgagaacaacgagccattccaggttggcaaagccaaggttgtcaagcagtccgccaacgacaccgttcttctgatcggcgctggtgtgactttgtacgaagccctcaatgcagctactgagctggagaaatctggcgtgcacgctcgtgtgctggatccgttcaccatcaagcccatcgacaaggaagccattgtccacaacgctgctcagtgcggtggacgcatcgttgtcgtcgaggatcactacaagcaaggcggcattggtgaagccgtgctttcggccgtcgctgatcagcgcaacgttgttgtcaaacatttgggtgtcgagcaagttccacgctccggaccgccaactgttctgattgacatgttcggtatctctgctcgttgcatcgtcgctgccgtcaacgatatcctcaagatgtaa

SEQ ID NO: 9837 - protein, 627 aa, Aedes aegypti
MPTYHKPESKTIQELKDIAHKLRIHSITSTQASKSGHPTSCASIAEIMSVLFFNTMRYKISAPRDASSDRFILSKGHAAPILYAAWAEAGLFPTSDLMNLRKIDSDLEGHPTPRLNFVDVGTGSLGQGVAVACGMAYIGKNIDKADYRTYVLVGDGESAEGSIWESLHFAGHYKLDNLCVIFDVNRLGQSEPTSLQHQMEVYRKRLDAFGFNAIVVDGHDVEELCKAFFEASVTKDRPTAIVAKTFKGKHFPNIEDLENWHGKPLGENANGVIEHLQSLIRNGGPLQIAPPSPQKEGAKKVNIGNVQLATPPAYQLGESVATRLAYGTALAKIAMNNDRVIALDGDTKNSTYSDKLRKAFPERFIECFIAEQNLVGVAIGAACRDRTIAFVSTFATFFTRAFDQIRMGAISQTNVNFVGSHCGVSIGEDGPSQMGLEDIAMFRTIPGSTVFYPSDAVSTERAVELAANTKGVCFIRTSRPNTAVLYENNEPFQVGKAKVVKQSANDTVLLIGAGVTLYEALNAATELEKSGVHARVLDPFTIKPIDKEAIVHNAAQCGGRIVVVEDHYKQGGIGEAVLSAVADQRNVVVKHLGVEQVPRSGPPTVLIDMFGISARCIVAAVNDILKM

SEQ ID NO: 9838 - DNA, 3126 bp, Chlamydomonas reinhardtii
  CDS (93)..(2249)
cgcgcaaccaacttccttacttttaagtcagtacctttcaaactaggtacttgtagactatctctaggtagtctcacacagtcgcagctaaaatgcagaccatgctgaagcagcgctgccagccggccgtcggcaagcaggccaaggctgtgcccgctgtggcccccaaggtcggccgtgcccgcaacgtggtggttgctcaggctgcccccgctgctgccaaggccgctgccccgtcgatctctcgcgatgaggtggagaagtgcatcaatgccatccgcttcctggctatcgacgccatcaacaagtccaagtcgggccaccccggcatgcccatgggctgcgctcctatgggctacgttctgtggaacgaggtcatgaagtataaccccaagaaccccgacttcttcaaccgcgaccgcttcgtgctgtccgccggccacggctccatgttccagtactccatgatgcacctgactggctacgactccgtgccgctggaccagatcaagcagttccgccagtggaactccctgacccccggccacccggagaacttcgtgactcccggcgtggaggtgaccactggtcccctgggccagggtatctgcaacgccgtcggcctggccgtggctgaggcccacctggctgcccgcttcaacaagccggacgtcaagcccatcgtggaccactacacctactgcatcctgggtgacggctgcatgatggagggcatctccaacgaggcctgctcgctggccggccactggggcctgggcaagctgattgccctgtatgacgacaacaagatctcgatcgacggccacaccgacatctcgttcaccgaggacgtggccaagcgctacgaggcgctgggctggcacgtgatccacgtgatcaacggcaacaccgacgtggacggcctgcgcgccgccattgctcaggccaaggccgtcaaggacaagcccactctgatcaaggtgtccaccctgatcggctacggctcgcccaacaaggccgactcgcacgacgtgcacggcgcccccctgggccccgatgagaccgccgccacccgcaagaacctgaactggccctacggcgagttcgaggtgccccaggacgtgtacgacgtcttccgcggcgccatcaagcgcggtgccgaggaggaggccaactggcacaaggcctgcgccgagtacaaggccaagtaccccaaggagtgggctgagttcgaggccctgaccagctgcaagctgcccgagaactgggaggctgctctgccccacttcaagcccgaggacaagggcctggccacccgccagcacagccagaccatgatcaacgccctggcgcccgcgctgcccggcctgatcggtggctcggccgacctggccccctccaacctgaccctgatgaagatctctggcgacttccagaagggcagctatgccgagcgcaacctgcgcttcggtgtgcgtgagcacgccatgggcgccatctgcaacggcattgccctgcacaagtcgggcctgatcccctactgcgccaccttctacatcttcaccgactacatgcgcaacgccatgcgcatgtctgccctgtcggaggccggagtcgtctacgtcatgacccacgactctatcggcctgggcgaggacggccccactcaccagcctattgagcacctggcgtcgttccgcgccatgcccgacatgctgatgatccgccccgccggcggcaacgagaccgccggtgcctacaaggtggccattgccaaccgcaagcgccccaccaccatcgccctgtctcgccagaacatgccgaacatccccaactgctcggttgagggcgtggccaagggtgcctacaccatccacgacaccaaggccggcgtcaagcccgacgtgatcctgatgggcaccggctctgagctggagctggccaccgccgccgccggcatcctggagaaggagggcaagaacgtgcgcgtcgtgtccttcccctgctgggagctgttcgaggagcagtcggccgagtacaaggagagcgtgctgccctccgacgtgaccgcccgcgtgtccgttgaggccgccaccagcttcggctgggccaagtacatcggcctgaagggcaagcacgtcggcattgacaccttcggtgcctcggcccccgcccccaccctgtacgagaagttcggcatcaccgtgaaccacgtggtggaggccgccaaggccaccctgcagcactaagcggctcatggttggaaggcgcctgtggtgatgataacgccggcatgtccgcaggagcagcagcggcgcgagcagtggctgcggatgcggtagcggcggcgtcagagaaccggcgccggcggagcagcgcgttgcagcggtgttggggaggtggagaagctggcacagcgatcagactcgcgtttgcatggcggcgtggctgttgggcggcgcatgtgttgaagagacattgcgtggccctggcctgcgttgtggatggggttggagcatttgttggttgcggcggcggctgggatgcccgccacctcggttccacagcaatctgcctcgagcgcacccggttttagtgtggtgtgcgccagggcagtggggtggtgggcattgcgctgcgtgtaggcacaggagaaggcgtcttggtggcgcggcgtggctaggtgatgcgccggcggcgcagcagcgcgggaccatccgagccctccaatcatggtgatgggccgtgctgcaactccggacgaggagtgagagtgtgtggtgtggttggttaaactcgggagaatagtaggacctatgatagaggagtcggtgtatccgctgattttgaagggccccgcttttttgcggcgggtgtcgatagtggtgcaccctcccccctgcagacggatgggatgccatcagccatatcgccctgcgtggctccgtggcgcggtgttgtggcgttccgttgtctgggggcctggtcgagcgtggggcgaagagctctgtcggaactgcatcctcctggctcgaatgggagtgtccggataaatgcctcggattgaacgcctgtaacggcagcaggctgaatggtttttgctccatgaattttccattggtgttc

SEQ ID NO: 9839 - protein, 718 aa, Chlamydomonas reinhardtii
MQTMLKQRCQPAVGKQAKAVPAVAPKVGRARNVVVAQAAPAAAKAAAPSISRDEVEKCINAIRFLAIDAINKSKSGHPGMPMGCAPMGYVLWNEVMKYNPKNPDFFNRDRFVLSAGHGSMFQYSMMHLTGYDSVPLDQIKQFRQWNSLTPGHPENFVTPGVEVTTGPLGQGICNAVGLAVAEAHLAARFNKPDVKPIVDHYTYCILGDGCMMEGISNEACSLAGHWGLGKLIALYDDNKISIDGHTDISFTEDVAKRYEALGWHVIHVINGNTDVDGLRAAIAQAKAVKDKPTLIKVSTLIGYGSPNKADSHDVHGAPLGPDETAATRKNLNWPYGEFEVPQDVYDVFRGAIKRGAEEEANWHKACAEYKAKYPKEWAEFEALTSCKLPENWEAALPHFKPEDKGLATRQHSQTMINALAPALPGLIGGSADLAPSNLTLMKISGDFQKGSYAERNLRFGVREHAMGAICNGIALHKSGLIPYCATFYIFTDYMRNAMRMSALSEAGVVYVMTHDSIGLGEDGPTHQPIEHLASFRAMPDMLMIRPAGGNETAGAYKVAIANRKRPTTIALSRQNMPNIPNCSVEGVAKGAYTIHDTKAGVKPDVILMGTGSELELATAAAGILEKEGKNVRVVSFPCWELFEEQSAEYKESVLPSDVTARVSVEAATSFGWAKYIGLKGKHVGIDTFGASAPAPTLYEKFGITVNHVVEAAKATLQH

SEQ ID NO: 9840 - DNA, 1884 bp, Anopheles gambiae str. PEST
  CDS (1)..(1884)
atgccgacctatcacaagccggaagccaaaaccatccaggagctgaaggatatcgctcacaagctgcgtatcgattcgatcaacgcaacgcaagcgtcaaagtctggccacccgacatcatgtgcgtcgattgcggaaatcatgtcggtgctgttcttcaacacgatgcggtacaaactctctgctccacgcgatccctcctccgaccggttcatcctgtcgaagggtcacgcggcccccatcctgtacgcggcctgggccgaggctggcctgttcccggtcgaggatctgatgaatctgcgcaagatcgactcggatctggagggccatccgacgccgcgcctcaactttatcgatgtgggcacgggctcgctcgggcagggggtggccgtcgcctgcggcatggcgtacgtcggcaagaacctcgacaaggcggactaccgcacgtacgtgctggtcggggacggtgaatcggccgaaggttcgatctgggagtcgctgcactttgccggctactacaagctgaacaacctgtgcgttatcttcgacgtgaaccggctcggccagtcggaggcgacctcgctgcagcaccagatggaggtgtaccgcaagcggctggacgcgttcggcttcaacgcgatcgtcgtcgacgggcacgacgtggaggagctgtgcaaggcgttcttcgaggcggcgtccacgaccgaccggcccacggccatcatcgccaagacgtacaagggcaagcacttcccgaacattgaggatctggagaactggcacggcaagccgctgggcgatgcggccgccgatgtggtggcgcatctgcagaagcaaatccgcaacccgggaccgatcgcgctggcgccaccgtcgccgcagaaggagagcgccccgaaggtcagcatcaagggggtggagttggccaccccgccagcgtaccagaagggggagcaggtggcaacgcgacttgcctacggtaccgcgctggccaagatcgcgatgaacaacgatcgcgtcattgcgctggacggtgacacgaagaactcgacctactcggacaagctgcgcaaagcgttcccggagcgcttcatcgagtgcttcatcgcggagcagaatctggtcggggtggcgattggggcggcgtgccgtgaccggaccgtggcgttcgtgtccacctttgccacgttcttcacgcgtgcgttcgaccagatccgcatgggtgcgatctcgcagacgaacgttaactttgtcggctcgcactgtggcgtgagcatcggcgaggacggcccgagccagatgggcctggaggacattgcgatgttccgggcgatcccgggcagcaccgtgttctatccggcggatgccgtcagcacggagcgtgcggttgagatggccgccaacacgccgggcgtgtgctttatccgtacgtcgcgcccgaacactgccgtcatctatgagaacaacgagaaattcgagattggaaagtgtaaggtggtgaagcaaaacgccaacgattcggtactgctcatcggtgccggtatcacgctgtacgaagcgctgaaggctgccgaggagctggagaagagcggaattcactgccgcgtcatcgatccgttcacggtgaaacccctcgaccaggaaggtatcatcaagcatggtgcccagtgcggtggacgtgtcgtcgtcgtcgaggatcactacaaacaaggtggccttggcgaggcggtcctgtctgccctggccgaacagcgcaactttgtcgtgaagcatctcggcgtggacaagttgccccgctccggaccgcccaccgtgctcgtcgatatgtttggcatttcggcacgttccgttgcggccgccgtgcaggagatcattaagatgtaa

SEQ ID NO: 9841 - protein, 627 aa, Anopheles gambiae str. PEST
MPTYHKPEAKTIQELKDIAHKLRIDSINATQASKSGHPTSCASIAEIMSVLFFNTMRYKLSAPRDPSSDRFILSKGHAAPILYAAWAEAGLFPVEDLMNLRKIDSDLEGHPTPRLNFIDVGTGSLGQGVAVACGMAYVGKNLDKADYRTYVLVGDGESAEGSIWESLHFAGYYKLNNLCVIFDVNRLGQSEATSLQHQMEVYRKRLDAFGFNAIVVDGHDVEELCKAFFEAASTTDRPTAIIAKTYKGKHFPNIEDLENWHGKPLGDAAADVVAHLQKQIRNPGPIALAPPSPQKESAPKVSIKGVELATPPAYQKGEQVATRLAYGTALAKIAMNNDRVIALDGDTKNSTYSDKLRKAFPERFIECFIAEQNLVGVAIGAACRDRTVAFVSTFATFFTRAFDQIRMGAISQTNVNFVGSHCGVSIGEDGPSQMGLEDIAMFRAIPGSTVFYPADAVSTERAVEMAANTPGVCFIRTSRPNTAVIYENNEKFEIGKCKVVKQNANDSVLLIGAGITLYEALKAAEELEKSGIHCRVIDPFTVKPLDQEGIIKHGAQCGGRVVVVEDHYKQGGLGEAVLSALAEQRNFVVKHLGVDKLPRSGPPTVLVDMFGISARSVAAAVQEIIKM

SEQ ID NO: 9842 - DNA, 2154 bp, Magnaporthe grisea 70-15
  CDS (1)..(2154)
atggcgtcgtctgagcaaagctctacggctctatccagccagagaaagcccctggatctgcctcagctcaagtcagaagaagaccatgatgttgttctcaagaccatccggatgttggtagcggatctatgccagcagtttggtggcggtcacccaggtggcgctattggtatggcagcgatcggggttgctttatggaaatacgttatgcggtactcgcccgaagagccggaatattttaaccgcgaccgcttcgttctctcaaatggacatacctgccttttccaatacgtcttcttgcacttgagcggctacaaagccatgacctttgaccagctcaagtcataccactcgaaacgtacagatgccctttgcccaggtcaccccgagattgagcacgagggcgtcgaggttaccacaggtccactgggacagggcgtggccaacgccgtcggccttgccatggcgaccaagaacctcgcctccacctacaaccgacctggttttcccgtcgtcgacaaccacacttggtgcatgattggcgacgcctgtctgcaggaaggcgtggccctcgaggccatatccctggccggtcacctggcgctcgacaacctgactatcatctacgacaacaatcagattacctgcgacgggtccgtggacctgacgaataccgaggatgtcaacgccaagatgagggcgtgcgggtggcatacagtggatgttgaagacggctgcttcgacattgggggcatcgtcagggccctggctgaggcgcgacaggccgcgcatgggaaacccacgttcataaacgtccggaccgtcatcgggttgggcagcgccgtcgctggcaaggctgaggcgcatggcgcagcgttcggggctgccgacgtcgcaaatatgaagcgcagcgttgggttcgacctggaacagcactttgtcatcggcgacaaggtacgcgacttctttgccgacattcccaagaggggccacaatcttgtcgccgattggaagggtcttgttagcaagtacgccgaagcgcaccccgaggtggctagtgagtttgataggagaacgaagggcgagctcccggagaactggagggaacttattcccaagagcttttctgacaagcccacggcaacgcgggcttcttccggattggtgctcaacccgattgccaaggatgtaaaatccttcatggttgggactgcagacctgacgccgtctgttcacatgacatgggatgggatggaggacttccagaaccccaacatccggccaacctgcggcatcaacggttcctacacaggacgctacattcactacggcgtccgcgagcatgccatgtgcgccatctccaacgggctcgctgccttcaatccgggcacctttgtgccggtgacttcgtcctttttcatgttctacctatacgcggcacccgcggtgcgcatgggcgccctccagaagttgcaggtaatccacgctgcgacgcatgacagcattggcatgggcgaggatggacctactcaccagcccattgagctggcgacgcttttccgcgcaatgccgaacctgctgtacatgcgaccagccgacagcgaggagactgcgggtgcctgggaggtcgccatcgccgagaggaccaggccgagcatcgtcagcacaagcagacacaagctaccgcagttggttggcaagtcgagccgtaaaggcgtggccaagggcgcctacgtcgtgtcggagccggcggacggcaaggcggacgtgacaatcctgggtgttggggcagaactttgcctggcgctggacgtggccgaagccttggcggggaagaatatcaaggtccgcgttgtaagctttccttgctggcggctgtttgacgagcagccagttgcatataggcgggagacgcttcggcggcatgagggcattcctgccgtcgtcgtggagccctacgcgccgaacgggtgggagcggtatgctgacgccggcgtgtgtctacggcgatttggacactcactgccgggaccagaagcgtacaagtactttgagtatgaaacgccaaaggttactgaaaagattgaggggtatctaaagggcctggagacgggagagtggttgaggggggagtttgcggacttgcaaatttga

SEQ ID NO: 9843 - protein, 717 aa, Magnaporthe grisea 70-15
MASSEQSSTALSSQRKPLDLPQLKSEEDHDVVLKTIRMLVADLCQQFGGGHPGGAIGMAAIGVALWKYVMRYSPEEPEYFNRDRFVLSNGHTCLFQYVFLHLSGYKAMTFDQLKSYHSKRTDALCPGHPEIEHEGVEVTTGPLGQGVANAVGLAMATKNLASTYNRPGFPVVDNHTWCMIGDACLQEGVALEAISLAGHLALDNLTIIYDNNQITCDGSVDLTNTEDVNAKMRACGWHTVDVEDGCFDIGGIVRALAEARQAAHGKPTFINVRTVIGLGSAVAGKAEAHGAAFGAADVANMKRSVGFDLEQHFVIGDKVRDFFADIPKRGHNLVADWKGLVSKYAEAHPEVASEFDRRTKGELPENWRELIPKSFSDKPTATRASSGLVLNPIAKDVKSFMVGTADLTPSVHMTWDGMEDFQNPNIRPTCGINGSYTGRYIHYGVREHAMCAISNGLAAFNPGTFVPVTSSFFMFYLYAAPAVRMGALQKLQVIHAATHDSIGMGEDGPTHQPIELATLFRAMPNLLYMRPADSEETAGAWEVAIAERTRPSIVSTSRHKLPQLVGKSSRKGVAKGAYVVSEPADGKADVTILGVGAELCLALDVAEALAGKNIKVRVVSFPCWRLFDEQPVAYRRETLRRHEGIPAVVVEPYAPNGWERYADAGVCLRRFGHSLPGPEAYKYFEYETPKVTEKIEGYLKGLETGEWLRGEFADLQI

SEQ ID NO: 9844 - DNA, 2064 bp, Magnaporthe grisea 70-15
  CDS (1)..(2064)
atgggttactccgaagtggacaagaaagctatcaacaccatccgtgttcttgctgcagacgctacattcaatgccaactccggacatcccggtgcccccatgggtatggcgccggtcgcccacgtcctctgggacaagatcatgaagttcaaccctaagaaccctagctggttgaaccgtgatcgctttgttttgtccaacggccatggttgcatgctgcaatatgctctcctgcacctctttggctatgctgtgtccatggacgacctcaagaagttcaggcaagtcgacagcatcacacccggtcaccccgaggcccacgacactcccggcattgaggtcacaaccggtccccttggtcagggtatctgcaacgccgtcggtctggccatggcacaagcacacactgctgctacatttaacaaggacggtttcaacctgattgacaactatacatactgcttcctcggcgatggttgcttgatggagggtgtctcgagcgaggcctgctctctggctggtcaccttcagctcggaaacctgattgccatctgggacgacaaccacatttccatcgatggtgacaccaaccaggctttcactgaggatgttgccaagcgctacgagtcttacggttggcacgtcgaggtcgtcaaggacggcgacaacgacctggaaggcattgaggctgccatcaagaagtgccagcaggtcaaggacaagccgtccctgatccagctcaggaccatcattggatttggctccactcagcagggaactcacggagtccacggctcccctctgaaggctgatgacctgaagcagctcaaggagaagtttggcttcaaccccgacgagagctttgctgtcccccaggaggtttacgacctttacaacaagaaggccgcggagggcgctgctcttgagcaggagtgggaccagctgttcgccaagtacggcgagcagtacaaggctgagcatgacgacctcgtccgccgtcaaacaggcgaacttccccagggctgggagaagaaccttcccacttacacgccctcagaccccgccatcgcctcgcgtaagctgtctgagaccgtcctcaccaagattgaggctgccattcccgagcttgttggaggatcggccgatcttactggctccaacctgacaaggtggaagggtgccgttgacttccagccccccgcgttgaagctgggtgactccaactacgctggtcgctacattcgctacggtgtccgtgagcacggtatgggtgccatcatgaacggtttggctgcctatggtaccatccttcccttcgctggtaccttcctgaacttcgtgtcgtacgccgctggtgccgtccgtctctcggctctctcgcaggtccgcatgatctgggttgccacccacgactcgattggtctgggtgaggacggccctacccaccagcctattgagactctggcacacttccgtgctctccccaactgcatggtttggaggcctgccgacggtaacgagacgagcgctgcttactatgttgctcttacctccaagcacacccccagtatcattgcgctttcgcgccagaaccttcctcagctcgcgggctcgaccatcgagaaggccatcaagggaggctacgtcgctcacgaggttgagggcgctcaggtcacccttgtttcgaccggttccgaagtcggcatctgcattgacgccgtcaagtacctcgccgataaccacaacatcaaggcccgtgttgtctctatgccctgcttcgaggtgttcgacactcagtccaaggagtacaggctctcggtcctccctgacggcatcccgtcgatgtctgttgaggtcatgagcacaatgggctgggagaggtatacccatgagcagttcggtctcaaccgcttcggtgcttcaggcccgtacaaggacgtctacaagaaattcgagttcacgccggagggcatcgccaagcgcgctgccgccacggtcgacttctggaaggacgttcccaacgttcgctcacctatcaaccgtgcgttccagcagatcatctaa

SEQ ID NO: 9845 - protein, 687 aa, Magnaporthe grisea 70-15
MGYSEVDKKAINTIRVLAADATFNANSGHPGAPMGMAPVAHVLWDKIMKFNPKNPSWLNRDRFVLSNGHGCMLQYALLHLFGYAVSMDDLKKFRQVDSITPGHPEAHDTPGIEVTTGPLGQGICNAVGLAMAQAHTAATFNKDGFNLIDNYTYCFLGDGCLMEGVSSEACSLAGHLQLGNLIAIWDDNHISIDGDTNQAFTEDVAKRYESYGWHVEVVKDGDNDLEGIEAAIKKCQQVKDKPSLIQLRTIIGFGSTQQGTHGVHGSPLKADDLKQLKEKFGFNPDESFAVPQEVYDLYNKKAAEGAALEQEWDQLFAKYGEQYKAEHDDLVRRQTGELPQGWEKNLPTYTPSDPAIASRKLSETVLTKIEAAIPELVGGSADLTGSNLTRWKGAVDFQPPALKLGDSNYAGRYIRYGVREHGMGAIMNGLAAYGTILPFAGTFLNFVSYAAGAVRLSALSQVRMIWVATHDSIGLGEDGPTHQPIETLAHFRALPNCMVWRPADGNETSAAYYVALTSKHTPSIIALSRQNLPQLAGSTIEKAIKGGYVAHEVEGAQVTLVSTGSEVGICIDAVKYLADNHNIKARVVSMPCFEVFDTQSKEYRLSVLPDGIPSMSVEVMSTMGWERYTHEQFGLNRFGASGPYKDVYKKFEFTPEGIAKRAAATVDFWKDVPNVRSPINRAFQQII

SEQ ID NO: 9846 - DNA, 2190 bp, Gibberella zeae PH-1
  CDS (1)..(2190)
atggcacccagtgcaattgccccagagacacaatatgaccacacagccctatccaacgtcgtcaaattgatcaagaacgatgacgcccggacaattgatcttgctttgcggcaattccgttgcttgattgctgatctatgcgaacaattcaagggcggccatcctggcttcagaggtgccatgggaatggctgctattggcctcgccctctggaaatacataatgcagtactcgcctaacgacccggactacttcaaccgcgatcgcttcgttctctcaaacggccacacatgtctcttccagtacacattccttcatctcgtcggctacaaggccatgacatttgaccacctcaagtcctatcactcttccaactacgactctctagcgccaggacatcccgaaatcgagcatgaaggaattgaagtgacgaccggtcctctcggtcaaggcattgccaacgcagtcggtctcgccatggctaccaagaacctcgccgccacttacaacaagcccaatttcgaactcgtcaataacatgacttactgcatgattggagacgcatgccttcaagaaggagttgctcttgaagctatccagttggcgggccactggaagctcaacaacctcgtcgtcatgtacgacaataaccaaatcacctgcgacggtagcgttgatctctgcaacaccgaagatgtcaacgccaagatgcgtgcttgcggctgggatgtgattgaggtcgaggacggctgctacgatgttgagggtatcgtcaaggccctcattaaagccaaagccagcactgacaagcccacattcatcaacatccacactgtcatcggtgttgggagcaaggttgctggtgatgccaaggctcacggtgttgcctttagtcctgaaggtgtcaaggccgtaaaggagcacttcggcatggataccgacaagcagtatgtcgtctctgatgaggtctataccttcttccgtgaccgcaaagcccgcggcgatcgccttgtagaagactggaacattctcgtcgattgctacgccaaagagtaccctgagctccaccaagagttcatcaagcgggttgagggtcgtttcactgaagattggcggagtattatccccgccaaggagtccctgcctactactcccaccccttctcgaaagtctgccggaataatctgtaaccccctggctgctaagctcaagaacttcatggttggcacagctgatctgtcgccctctgttaacatgatctggaaagacaaggtcgacttccaacatcccgagctcaggaccacatgcggcatcaatggagactactccggccgctatatccactggggaattcgtgagcacgcaatggcctccatctcgaacggtctggccgcctacagcaaaggcaccatcctccctgtcacatctagcttcttcatgttttacatctacgccgcccctggtgtccgcatgggtgcgctccaaaacctccaggccatccatatcgccacccatgactctattggtaccggtgaagatggccctactcaccaacctatcgctttgcctgctctctatcgttcaatgcccaacatactttacatccggccttgcgacacggaggagacggccggtgcctttatcaccgccctggaggcgaaggacaccccatctatcatctccctctcccgacaaaaccttgagcagtaccctcagcactcgagccgtgaaggtacccagaaaggtgcatatgtctttatcgaggatgaggatgccgatgtcaccctgatcggcgttggtgctgagatggtctttgccgtcaagactcgcgaggtcctcaagaacaagttcggcatcagagcccgtatcgtctcctttccctgccaacgcctcttcaactctcagcctcttgaatacaagaggcaggttctccagtatcgctccaacgctccccgcgttgtaatcgaagcatatgccgttaatggctgggagagatacgccgatgctggctattccatgtcaacattcggcaagtcgctacctggaaaggacgcatacaagtactttggttttgacgagactgtgattgctccagaggttgctagacttgtagaagaggtcaaggaggagggcatcgagagtctgcggggcgagtttcgggaccttaacaatgtgacacatgaacactaa

SEQ ID NO: 9847 - protein, 729 aa, Gibberella zeae PH-1
MAPSAIAPETQYDHTALSNVVKLIKNDDARTIDLALRQFRCLIADLCEQFKGGHPGFRGAMGMAAIGLALWKYIMQYSPNDPDYFNRDRFVLSNGHTCLFQYTFLHLVGYKAMTFDHLKSYHSSNYDSLAPGHPEIEHEGIEVTTGPLGQGIANAVGLAMATKNLAATYNKPNFELVNNMTYCMIGDACLQEGVALEAIQLAGHWKLNNLVVMYDNNQITCDGSVDLCNTEDVNAKMRACGWDVIEVEDGCYDVEGIVKALIKAKASTDKPTFINIHTVIGVGSKVAGDAKAHGVAFSPEGVKAVKEHFGMDTDKQYVVSDEVYTFFRDRKARGDRLVEDWNILVDCYAKEYPELHQEFIKRVEGRFTEDWRSIIPAKESLPTTPTPSRKSAGIICNPLAAKLKNFMVGTADLSPSVNMIWKDKVDFQHPELRTTCGINGDYSGRYIHWGIREHAMASISNGLAAYSKGTILPVTSSFFMFYIYAAPGVRMGALQNLQAIHIATHDSIGTGEDGPTHQPIALPALYRSMPNILYIRPCDTEETAGAFITALEAKDTPSIISLSRQNLEQYPQHSSREGTQKGAYVFIEDEDADVTLIGVGAEMVFAVKTREVLKNKFGIRARIVSFPCQRLFNSQPLEYKRQVLQYRSNAPRVVIEAYAVNGWERYADAGYSMSTFGKSLPGKDAYKYFGFDETVIAPEVARLVEEVKEEGIESLRGEFRDLNNVTHEH

SEQ ID NO: 9848 - DNA, 2049 bp, Gibberella zeae PH-1
  CDS (1)..(2049)
atgggttacggcgaacttgatcagaaggctatcaacaccatccgtgtcctcgcggccgatgcgaccgctcacagcaactcgggacaccctggtgctcccatgggaatggccccagttgctcacgttctgttcaacaagttcatgaacttcaaccccaagaaccccgactggttgaaccgtgaccgtttcgttctctccaacggacacggctgcatgcttcagtatgctatcctccacctcttcggttacgacctcagcatcgatgacctgaaggctttccgatccgttgacagccgaactcccggtcaccccgaggctcacgacactcccggagttgaggtcaccactggtcctcttggccagggtatttccaacgctgttggtctggccatggctcaggctcacactgccgccaccttcaacaaggacggttttgagcttgtcaacaactacacctactccttcctcggcgatggttgcttgatggagggtgtctccagcgaggcttgctctctggctggccacctccagcttggcaacctcattgccatctgggacgacaaccagatcaccattgacggtgacaccgctgttgccttcaccgaggacgtccccaagcgatatgaggcttacggctggcacgtcatcaaggtcgatgacggtgaccacgaccttgctgccatcgaggctgccatcaaggaggccaagtccgttaccgacaagcctactcttatccagctcaagaccaccattggtttcggctccctcaaccagggcacccacggtgtccacggttctcctctcaaggctgatgacatcaagcagctgaaggagaagtggggtttcaaccccgacgagagcttcgccgttccccaggaggtctacgacttctacggcaagcgatcttctgagggcgccgcccgtgagcaggagtggaaccagctcctcgccaagtacaaggagcagtaccccaaggagcacgccgaccttgtccgccgattgaccggcgagcttcccgagggttgggagaagagcctccccgtctacaccccctccgaccccgccattgcctcgcgaaagctgtccgagaccgtcctcgccaagatcgagggtgtcatccccgagctcttcggtggttccgccgatttgaccggctccaacctgacccgctggaaggaggctgtcgacttccagcccaagtccactggtctcggtgactactctggccgatacgtccgatacggtgtccgtgagcacggtatgggcgctatcctcaacggtctggctgcttacggtaccattctcccctactctggtaccttcctgaacttcgtttcttacgctgccggatccgtccgcttgtctgctctttctcgcgtccgcaccatctgggtcgccactcacgactcaattggtctcggagaggatggtcctactcaccagcctattgagactcttgctcacttccgcgctctccccaacaccatggtctggcgacctgctgacggtaacgagaccagtggtgcttactacgtctgcttgacttccaagcacacccctagcatcattgctctgtctcgtcagaaccttccccagctcgagggctctaccatcgagaaggccgccaagggtggttacgtcctgcacgaggttgagggtgctgacatcaccctggtttctaccggttctgaggtttccattgccgtcgacgccgccaagtacctcgaggagaagaagaacatcaaggctcgcattgtctccatgccctgcttcgaggccttcgacctccaggacaaggagtaccgcctgtctgtccttcccgacggtgtcccctctctgtccattgaggtcatgagcaccatgggctgggagcgctacactcacgagcagttcggtatcaaccgattcggtgcttctggtgcctacaaggataagttcgagttcacccccgagggtatcgccaagcgtgccgttgccaccatcgacttctggaaggatgttcccaacgtccgatctcccatcaaccgcgccttccagcagatcatctag

SEQ ID NO: 9849 - protein, 682 aa, Gibberella zeae PH-1
MGYGELDQKAINTIRVLAADATAHSNSGHPGAPMGMAPVAHVLFNKFMNFNPKNPDWLNRDRFVLSNGHGCMLQYAILHLFGYDLSIDDLKAFRSVDSRTPGHPEAHDTPGVEVTTGPLGQGISNAVGLAMAQAHTAATFNKDGFELVNNYTYSFLGDGCLMEGVSSEACSLAGHLQLGNLIAIWDDNQITIDGDTAVAFTEDVPKRYEAYGWHVIKVDDGDHDLAAIEAAIKEAKSVTDKPTLIQLKTTIGFGSLNQGTHGVHGSPLKADDIKQLKEKWGFNPDESFAVPQEVYDFYGKRSSEGAAREQEWNQLLAKYKEQYPKEHADLVRRLTGELPEGWEKSLPVYTPSDPAIASRKLSETVLAKIEGVIPELFGGSADLTGSNLTRWKEAVDFQPKSTGLGDYSGRYVRYGVREHGMGAILNGLAAYGTILPYSGTFLNFVSYAAGSVRLSALSRVRTIWVATHDSIGLGEDGPTHQPIETLAHFRALPNTMVWRPADGNETSGAYYVCLTSKHTPSIIALSRQNLPQLEGSTIEKAAKGGYVLHEVEGADITLVSTGSEVSIAVDAAKYLEEKKNIKARIVSMPCFEAFDLQDKEYRLSVLPDGVPSLSIEVMSTMGWERYTHEQFGINRFGASGAYKDKFEFTPEGIAKRAVATIDFWKDVPNVRSPINRAFQQII

SEQ ID NO: 9850 - DNA, 2040 bp, Candida glabrata CBS 138
  CDS (1)..(2040)
atgtctttcggtgaaattgataagctagctgtttccactatcagattgctatctgttgaccaagtctccaaggctaactctggtcaccctggtgccccattgggtatggctcctgctgcccacgtcgtctggtcccagatgagaaccaacccaaagaacccagactggatcgccagagacagatttgtgttgtctaacggtcacgcctgtgctttgctgtactccatgttgcacttgactggcttcgacttctccatcgacgacttgaagaacttcagacaattgaactccagatgtccaggtcaccctgaattcgagttgccaggtgtcgaagtcaccaccggtccattgggtcaaggtatctccaacgctgtcggtatggccatcgcccaagccaacttcgccgctacttacaacaagccagacttcaccttgtctgactcttacgtctacactttcttgggtgacggttgtctgcaagaaggtgtctcttccgaagcctgctctttggccggtcacttgaagctaggtaacatcattgccatctacgacgacaacaagatcaccatcgatggtaacaccaccgtctccttcgatgaagacgtctgcaagagatacgaagcctacggctgggaagtcctacacgtcgagaacggtaacgaggacctaaacgccatcgctcaagccgtcaacaaggctaagcaatccaaggacaagccaaccttgatcaagatgaccaccaccatcggttacggttccctaaacgctggctctcactccgtccacggttccccattgaaggaagacgacttgaagcaactaagaaagaagttcggtttcgacccagagaagtccttcgtcgtcccacaagaagtctacgactactaccaagccaagatcgccaccccaggtgccaaggctaaccaagaatgggacgccaagttcgccaagtaccaacaaaagtacccagaacagggtaaggaattggctagaagattggccggtgaattgccagctggctggtgctctaagttgccaacttacactccagctgactccgccgtcgctaccagaaagttgtccgaaatcgtcttccaaagcatctacgatgaattgccagaaatgatcggtggttccgctgacttgaccccatccaacttgaccagatggaaggaggccgtcgacttccaaccaccatcctccggcttgggtgactactccggtagatacatcagatacggtatcagagaacacggtatggccgctatcatgaacggtatctccgccttcggtgccaactacaaggcttacggtggtactttcttgaacttcgtttcctacgccgccggtgccgtcagattgtccgctctatccggccacccagtcatctacgttgccacccacgactccatcggtgtcggtgaggatggtccaacccatcaacctatcgaaaccttggctcacttcagagctttgccaaacttgcacgtctggagaccagctgacggtaacgaaacctccgctgcttacaaggtcgctttggaatccaagcacaccccatccgtcattgccctatccagacaaaacttgccacaattggaaggttcctctgttgaaaaggctctaaagggtggttacgtcttgaaggaagccaacaacgccgacatcactttggtctctaccggttccgaagtttacttgaccgttgacgctgtcaaggtcttggctgctaagggtatcaccgcccgtgttgtctccttgccagacttcctagccttcgaccaacaaccagaagattacaagttgtccgtcctaccagacggtgctccagtcatgtctgtcgaagtcttgtccaccaagagttggggtaagtacgctcacgaatctttcggtatcgacagattcggtgcttccggtaaggcaccagaagtttacgactacttcggcttcactccagaaggtatcgctgaaagagctgaaaaggtcgttaagttctaccacggccaaaagctatcttctccattgaagaaggctctataa

SEQ ID NO: 9851 - protein, 679 aa, Candida glabrata CBS 138
MSFGEIDKLAVSTIRLLSVDQVSKANSGHPGAPLGMAPAAHVVWSQMRTNPKNPDWIARDRFVLSNGHACALLYSMLHLTGFDFSIDDLKNFRQLNSRCPGHPEFELPGVEVTTGPLGQGISNAVGMAIAQANFAATYNKPDFTLSDSYVYTFLGDGCLQEGVSSEACSLAGHLKLGNIIAIYDDNKITIDGNTTVSFDEDVCKRYEAYGWEVLHVENGNEDLNAIAQAVNKAKQSKDKPTLIKMTTTIGYGSLNAGSHSVHGSPLKEDDLKQLRKKFGFDPEKSFVVPQEVYDYYQAKIATPGAKANQEWDAKFAKYQQKYPEQGKELARRLAGELPAGWCSKLPTYTPADSAVATRKLSEIVFQSIYDELPEMIGGSADLTPSNLTRWKEAVDFQPPSSGLGDYSGRYIRYGIREHGMAAIMNGISAFGANYKAYGGTFLNFVSYAAGAVRLSALSGHPVIYVATHDSIGVGEDGPTHQPIETLAHFRALPNLHVWRPADGNETSAAYKVALESKHTPSVIALSRQNLPQLEGSSVEKALKGGYVLKEANNADITLVSTGSEVYLTVDAVKVLAAKGITARVVSLPDFLAFDQQPEDYKLSVLPDGAPVMSVEVLSTKSWGKYAHESFGIDRFGASGKAPEVYDYFGFTPEGIAERAEKVVKFYHGQKLSSPLKKAL

SEQ ID NO: 9852 - DNA, 2100 bp, Debaryomyces hansenii CBS767
  CDS (1)..(2100)
atgactgtatcgtctaaacagcacttagcggatcaaggacaaattcatgataaagttttgaaggtatttagattacttattgcagatttggttcaaaactttaatggtggtcacccgggtggtgctatggatatggctgcaattggaattgcattatggagatatgttttaaattatgcacctaataatccaacatttttcaaccgggatagatttgtcttatcaaatggacatacttgtttgtttcaatatgcatttcaccatttagtcggttatcagcacatgaccatgaaacagttaaaaacttaccattcacctaatctcgaatcgtattgcccgggccacccagaaattgaacatcctggtatcgaagtaactactggacctttagggcagggcataacgaatgcagttggattagctatagcgtctaagaatttacaagccacatataataaaccagaatttccagttgtttctaatcatacgttttgcatagtcggtgatgcttgtttgcaagaaggtgtagcattagagtcaatatcttttgctggacacttaggtctaaataaccttacagctatttatgataataatcaaatttcatgtgatggctcggtggatttgactaatacggagaatattggtgaaaaatttaaagcatgtaattggaatgtaattgaggttgaaaatggatgttatgatgttattgcaattgtgaatgctctagaatcttccaaaaagtcagaaaataaacccacacttattaatgtttatacaaatattggaattggttctaatgtagaagggaaagcagctgctcatggtgctgcttttggcgagactgaagttgacagattacatagagtaaacggttttagacccgaagataaattcttcatccctaaagatgtgtatacctttttcgaagatcttccggccaaaggtgaccagattgtaaatgattggttaagattagtcaagtcatataaagaatcttatccagacttaggaacggatttcgaaaggaggatttctggaaaattaccttgtgattgggagtctttaattcccgcctcattccctaccaaccctactgcttcaagaaaatcgagcgggttagttataaatccattagcaaaagaaattaataattttattgttggttcagcagatctttcgccatctgtaaatttggtttgggaaggtaagaaagattttcaaaacccgagaataaaagtatcttgcaatatcaacggggattattctggaagatatattcattacggaattcgtgagcacgcaatggctggaattgcaaacggaattgccgcttttaatgaagggacatttataccaatcacatcatcatttttcatgttttatttgtatgcatctccagctgttagatatggtgcattatcaaaacttcaagttatacatgtcgcaactcacgactcaattgggacaggggaggatgggccaactcatcaacctattgctctagcagcattgtaccgagctatgccaaatattaattatattcgcccatgtgattcagaagaaacagcaggtgcttgggaaatcgctataaagtcgcaaggtatgccaaccatcatttctttatcaagacaaaatttacctcagtaccctggaatgtcaaatcgttctctagttaaaaagggggcatatatttttcaagagagaattgatgctgttttaaatattgtaggcgtgggtgctgaattgaagtttgctttagagacagcaaacatattaaatgaaaaaggtattaaaactagagtaatctcatttccatctcataatttattcgaaatgcagcctgatgagtacaaacgttctatattgaaaagaggaaagataccaactgtagttatagaggcatttgctccaaatggctgggaaagatacgctaccgctggaattaatatgaagacttatggcaaatcattgcctggtgctgccgcttatgaatactttggtttcaactcgactgttatcgcctccaaagttgaaaaatatttctccaggtggaaccaagaacatgaaattcgttacgaatttctagacttaaattag

SEQ ID NO: 9853 - protein, 699 aa, Debaryomyces hansenii CBS767
MTVSSKQHLADQGQIHDKVLKVFRLLIADLVQNFNGGHPGGAMDMAAIGIALWRYVLNYAPNNPTFFNRDRFVLSNGHTCLFQYAFHHLVGYQHMTMKQLKTYHSPNLESYCPGHPEIEHPGIEVTTGPLGQGITNAVGLAIASKNLQATYNKPEFPVVSNHTFCIVGDACLQEGVALESISFAGHLGLNNLTAIYDNNQISCDGSVDLTNTENIGEKFKACNWNVIEVENGCYDVIAIVNALESSKKSENKPTLINVYTNIGIGSNVEGKAAAHGAAFGETEVDRLHRVNGFRPEDKFFIPKDVYTFFEDLPAKGDQIVNDWLRLVKSYKESYPDLGTDFERRISGKLPCDWESLIPASFPTNPTASRKSSGLVINPLAKEINNFIVGSADLSPSVNLVWEGKKDFQNPRIKVSCNINGDYSGRYIHYGIREHAMAGIANGIAAFNEGTFIPITSSFFMFYLYASPAVRYGALSKLQVIHVATHDSIGTGEDGPTHQPIALAALYRAMPNINYIRPCDSEETAGAWEIAIKSQGMPTIISLSRQNLPQYPGMSNRSLVKKGAYIFQERIDAVLNIVGVGAELKFALETANILNEKGIKTRVISFPSHNLFEMQPDEYKRSILKRGKIPTVVIEAFAPNGWERYATAGINMKTYGKSLPGAAAYEYFGFNSTVIASKVEKYFSRWNQEHEIRYEFLDLN

SEQ ID NO: 9854 - DNA, 2112 bp, Debaryomyces hansenii CBS767
  CDS (1)..(2112)
atgaatcaaattgaagatttatcgttaaaaactattaggtgtttggtgagtgacctagtacaacaatataatggcggccatccagggggtgcaatgggaatggctgccattggtatagcactttggaaatatatattaaagtacaacccaaaaaatgccaattggtttaatagagataggtttgttttgtctaatggacatacttgtcttttccagtacgttttcttacatcttgttggatatgagtcattcaccatgaatcagttgaagaagtaccacgccccagaagtgtctcaatgtgctggacatccggaaattgagtttgaaggtattgaggttaccacgggtccattaggtcaaggtattgccaacgcagtcggtttggctattgcctcgaagaacttagctgcaaattataacaaacctgatttggatttggttgataacaaaatttattgtatggttggtgatgcttgtattcaagaaggtgtcggcttagaagccatttcgcttgctggtcatttgggtttagataatttgattgtgatttacgataacaatcaaatcacttgtgatggttccgttgatttagcaaactctgaagacatcaatgctaagtttatggcccaaaaatggcatgtgttaactgttgacgacggaagctttgatcttagatctatattggctgcgattgagcaggcaaagtcagtaaagggtctgcctatcttgattaatataagaacaatcatcggtgtggatacaaatgttgctaataatgccaaagcacacggtgctgcgtatggtgtagaagaaggcagaaggcttaaggccctttatggctttgatcctgaccaatttattgaagttccaaaattagtctatgacttttttagagaaggcaacgaaggggccatttcaaaaggtgtctttcatcaggaacaatgggaaaaaaagttggaggcatatagcaagaaatatcctcaattatacgaagaggtcgtatccagaattaatggaaagttgccaaccgattggaaagaatctttaccgcactcacttccaacagatgcgactgcttctagaaaggcatcgggattagtatttactccacttgctgccaaatatccacaattcctcgtcggcacagcggacttatctccatcagtgaacttgttatggccacataaaaaagattttcaaaaccctgaaatcaaaactgactgtggtatcaatggcgattacagcggaagatacttacactatggtatccgggaacatgccatgtgtgcgatttctaatggtatctcagcttactccaaaggtgcttttattccaatcacatcttcgtttttcatgttttatctttattctgcaccagccgtaagaatgggtgcgttgcagaatttacaggttattcatgtagcaacccatgactcaattggaactggtgaagatggtcctacacatcagcctattgcgttagcatcattctacagatcactaccgaactgtttgtatgtgagaccagcggacaacgaagaagttgcaggcgcatgggaacttgctattgaaaccactaataaaccgacaattatatccttgtccagacagaatctcaagcagtaccctggtatcacggaccgtaacaaagtgaaatttggtgcatacgtattgaaggaatttgactcatcatcagacagccaaaagttacaaattatatccgttggtgcagaaagtcaatttgctattgatgctgccgaaatattgattgagtcaaacattaatgttaaaattatttcatttccatgccagcgacttttcgaatgtcaatccacagagtataagagatccgtcttggatccccaaatcgtgaccgttgctattgaagcctatgcttccaatggatgggaaaggtatgctaatgctggtttccacctaaacgaatttggtatatcattacctggtaaaaatgcatatgagcatttcggatttaatggcgcttatatcgccagcaaaattcaaaaatacttagatgatttgcaaaaggatgatattatgaagtttgaatatcaagaattgaatattacgaaaaatcatcattcttcttcttga

SEQ ID NO: 9855 - protein, 703 aa, Debaryomyces hansenii CBS767
MNQIEDLSLKTIRCLVSDLVQQYNGGHPGGAMGMAAIGIALWKYILKYNPKNANWFNRDRFVLSNGHTCLFQYVFLHLVGYESFTMNQLKKYHAPEVSQCAGHPEIEFEGIEVTTGPLGQGIANAVGLAIASKNLAANYNKPDLDLVDNKIYCMVGDACIQEGVGLEAISLAGHLGLDNLIVIYDNNQITCDGSVDLANSEDINAKFMAQKWHVLTVDDGSFDLRSILAAIEQAKSVKGLPILINIRTIIGVDTNVANNAKAHGAAYGVEEGRRLKALYGFDPDQFIEVPKLVYDFFREGNEGAISKGVFHQEQWEKKLEAYSKKYPQLYEEVVSRINGKLPTDWKESLPHSLPTDATASRKASGLVFTPLAAKYPQFLVGTADLSPSVNLLWPHKKDFQNPEIKTDCGINGDYSGRYLHYGIREHAMCAISNGISAYSKGAFIPITSSFFMFYLYSAPAVRMGALQNLQVIHVATHDSIGTGEDGPTHQPIALASFYRSLPNCLYVRPADNEEVAGAWELAIETTNKPTIISLSRQNLKQYPGITDRNKVKFGAYVLKEFDSSSDSQKLQIISVGAESQFAIDAAEILIESNINVKIISFPCQRLFECQSTEYKRSVLDPQIVTVAIEAYASNGWERYANAGFHLNEFGISLPGKNAYEHFGFNGAYIASKIQKYLDDLQKDDIMKFEYQELNITKNHHSSS

SEQ ID NO: 9856 - DNA, 2037 bp, Debaryomyces hansenii CBS767
  CDS (1)..(2037)
atgtcccaagatcttgatcaattagctattagtactatccgtttgttatcggtagattcagtcgataaggcccaatctggtcaccctggtgctccattaggtttggctccagcagcccacgctgtgtggcaaaaaatgaagttcaacccaaaggacaccaattggatcaacagagatagatttatcttatccaatggtcatgcctgtgctttattatactccttattggtgttgtacggttacgatttgactgttgaagacttgaagcaattcagacaattgaactccaagactccaggtcaccctgaagctttggatgttccagggtgtgaagtgaccactggtccattaggtcaaggtatttccaatgctgttggtttggccatggcccaaaagcaatttggtgctacctacaacaagccagaccacaagatctccgacagttacacttatgctttcttaggtgacggttgtttgatggaaggtgttgcttctgaaacctgttctttagccggtcacttgcaattgaataacttgattgctttctgggatgataaccatatctctattgatggtaacactaatgttgctttcaccgaagatgttatgctcagattcaaggcttacggatggcacttaattgaaatcgccgagggtgacactgacttggatgccattgctaaggctatcgatgaagctaagaaggttgaagacaagccaactttgatcagattaaccaccacaattggtttcggttctttagcacaaggtacccacggtgtccacggtgctccattgaaggctgatgacatcaagcaattgaaggaaagtatgggcttcaacccagaagaaaccttcgttattccaaaggaagttaccgactacttgaagaaacacgttgaagaaaaccaaaaggtccaagaagactggaagaagttatttgaatcatacaagcaaaagtacccagaattaggtgctgaattgcaacgtcgtcttgacggtaagttaccagaaaactggtccgacgctttgccaacctactctccttctgacagcgctgttgctaccagaaagttatccgaaactgtattaaccaaaatcttaccagttattcctgaaattatcggtggttctgctgatttgactggttctaacttaaccagagccgctggttctgttgattttcaaccacctgccactggcttaggtgactattctggtagatacatcagatacggtgttagagaacacggtatgggtgctatcatgaacggtattgctgcattcggtgccaactacaagaactacggtggtactttcttgaacttcgtttcctatggtgctggtgccgtcagattgtctgctttatctcaccatccagttatctgggttgctacccacgattccatcggtttaggtgaagatggtccaacccatcaacctatcgaaactttagctcacctcagagctattccaaacttatctgtctggagaccagctgatggtaatgaaacttctgctgcttacttacaagctattgaatctacttctactccttcaattattgctttaactagacaaaacttacctcaattagaaggttcatctattgaaaaggctgctaagggtggttacactttagttaagcaagataagccagatgtcatcattgtctcttccggttccgaagtctctatttctgctgatgctgctaagaaattagaatctgaaggtttcaaggctggtgttgtctccatgccagatttcttaaccttcgataagcaaccattagactaccgtttatctgttttaccagatggtgtcccaatcatgtccgtcgaagttatgtcctcgttcggatggtctaaatactctcatgaacaatttggtttgaacagattcggtgcttccggtaagggtccagaaatttacaaattcttcgaattcaccccagaaggtgttgctgatagagccgccaagactattcaattttacaagggtaagccattattatctccattaaacagagctttttaa

SEQ ID NO: 9857 - protein, 678 aa, Debaryomyces hansenii CBS767
MSQDLDQLAISTIRLLSVDSVDKAQSGHPGAPLGLAPAAHAVWQKMKFNPKDTNWINRDRFILSNGHACALLYSLLVLYGYDLTVEDLKQFRQLNSKTPGHPEALDVPGCEVTTGPLGQGISNAVGLAMAQKQFGATYNKPDHKISDSYTYAFLGDGCLMEGVASETCSLAGHLQLNNLIAFWDDNHISIDGNTNVAFTEDVMLRFKAYGWHLIEIAEGDTDLDAIAKAIDEAKKVEDKPTLIRLTTTIGFGSLAQGTHGVHGAPLKADDIKQLKESMGFNPEETFVIPKEVTDYLKKHVEENQKVQEDWKKLFESYKQKYPELGAELQRRLDGKLPENWSDALPTYSPSDSAVATRKLSETVLTKILPVIPEIIGGSADLTGSNLTRAAGSVDFQPPATGLGDYSGRYIRYGVREHGMGAIMNGIAAFGANYKNYGGTFLNFVSYGAGAVRLSALSHHPVIWVATHDSIGLGEDGPTHQPIETLAHLRAIPNLSVWRPADGNETSAAYLQAIESTSTPSIIALTRQNLPQLEGSSIEKAAKGGYTLVKQDKPDVIIVSSGSEVSISADAAKKLESEGFKAGVVSMPDFLTFDKQPLDYRLSVLPDGVPIMSVEVMSSFGWSKYSHEQFGLNRFGASGKGPEIYKFFEFTPEGVADRAAKTIQFYKGKPLLSPLNRAF

SEQ ID NO: 9858 - DNA, 2085 bp, Yarrowia lipolytica CLIB122
  CDS (1)..(2085)
atggctccccaattttcaaagactgacgagactgccatcaacaccatccgaaccttggctattgatgctgtggccaaggctaactccggccaccccggtgcccccatgggtctggctcctgttgcccacgttctgtggaactactacatgaacttcacctcctccaaccccgagtggatcaaccgagaccgattcattctctccaacggacacgcctgcatgctgcactactccctgttgcacctgtttggctacgacatcactatcgatgatctcaagaacttccgacagctcaactccaagactcccggccaccccgaggctgagactcccggtatcgaggtcaccaccggtcccctgggtcagggtgtctccaacgctgttggtttcgccattgcccaggcccaccttggcgccacctacaacaagcctggctacgacatcatcaacaactacacttactgcatcttcggagatggttgcatgatggagggtgttgcctccgaggctatgtctcttgccggacatctgcagctcggtaacctcatcaccttctacgatgataaccacatttccattgacggtgacaccaacgtggccttcaccgaggacgtcagccagcgacttgaggcctacggatgggaggtcatctgggtcaaggacggtaacaacgatctggccggcatggctgctgccatcgagcaggccaagaagtccaaggacaagcccacttgtatccgactcaccaccatcattggttacggctctctgcagcagggtacccacggtgttcacggctctcctctcaagcctgatgatatcaagcagttcaaggagaaggttggcttcaaccccgaggagacctttgccgtccccaaggagaccactgatctctacgccaagactattgaccgaggcgccaacgccgagaaggagtggaacgagctcttcgccaagtacggtaaggagtatcccaaggagcactctgagatcatccgacgattcaagcgagagctgcccgagggatgggagaaggctctgcctacctacacccccgccgacaatgccgttgcttctcgaaagctgtccgagattgtcctcaccaagatccacgaggtcctccccgagcttgttggtggttccgccgatctgaccggctcaaacctgacccgatggaaggacgctgttgatttccagcctcctgtcacccaccttggtgactactccggccgatatatccgatacggtgttcgagagcacggcatgggcgctatcatgaacggtatgaacgcttacggaggtatcatcccctacggaggtactttccttaacttcgtctcctacgccgctggtgccgtccgactgtctgccctgtctggccaccacgttatctgggttgctacccatgactccattggtctgggtgaggatggccctacccatcagcccattgagactgtcgcctggctccgagccacccccaacctctctgtgtggcgacctgccgacggtaacgagacctccgctgcttactacaaggccatcaccaactaccacactccctctgtcctgtctctgacccgacagaacctgcctcagcttgagggctcttccatcgagaaggcctccaagggtggttaccagctcatctccgaggacaagggtgacatctaccttgtgtccactggttctgaggttgccatctgtgttgctgccgccaagctcctcaaggagaagaagggtatcactgccggtgtcatctctctgcccgactggttcaccttcgagcagcagtctctcgagtaccgaaagtctgttttccccgatggcatccccatgctttccgtcgaggtctactccgactttggctggtctcgatactctcaccagcagtttggtctggaccgattcggtgcttctgctcccttccagcaggtctacgatgcctttgagttcaatgccgagggtgtcgccaagcgagctgaggccaccattaactactacaagggccagactgtcaagtctcctattcagcgagccttcgaccccattgacgtcaacacccgacccggccacggtgtctaa

SEQ ID NO: 9859 - protein, 694 aa, Yarrowia lipolytica CLIB122
MAPQFSKTDETAINTIRTLAIDAVAKANSGHPGAPMGLAPVAHVLWNYYMNFTSSNPEWINRDRFILSNGHACMLHYSLLHLFGYDITIDDLKNFRQLNSKTPGHPEAETPGIEVTTGPLGQGVSNAVGFAIAQAHLGATYNKPGYDIINNYTYCIFGDGCMMEGVASEAMSLAGHLQLGNLITFYDDNHISIDGDTNVAFTEDVSQRLEAYGWEVIWVKDGNNDLAGMAAAIEQAKKSKDKPTCIRLTTIIGYGSLQQGTHGVHGSPLKPDDIKQFKEKVGFNPEETFAVPKETTDLYAKTIDRGANAEKEWNELFAKYGKEYPKEHSEIIRRFKRELPEGWEKALPTYTPADNAVASRKLSEIVLTKIHEVLPELVGGSADLTGSNLTRWKDAVDFQPPVTHLGDYSGRYIRYGVREHGMGAIMNGMNAYGGIIPYGGTFLNFVSYAAGAVRLSALSGHHVIWVATHDSIGLGEDGPTHQPIETVAWLRATPNLSVWRPADGNETSAAYYKAITNYHTPSVLSLTRQNLPQLEGSSIEKASKGGYQLISEDKGDIYLVSTGSEVAICVAAAKLLKEKKGITAGVISLPDWFTFEQQSLEYRKSVFPDGIPMLSVEVYSDFGWSRYSHQQFGLDRFGASAPFQQVYDAFEFNAEGVAKRAEATINYYKGQTVKSPIQRAFDPIDVNTRPGHGV

SEQ ID NO: 9860 - DNA, 1869 bp, Apis mellifera
  CDS (1)..(1869)
atggtgcgcgatataaatgtggaaaatctccaagatcttgcgaacaggcttcgcattcagtgtattaaagcaacagaagcatcgaaaagcggacatccaacatcatgttcttctatggcagaaattatgtccgtcttattttttcatacgatgcgttacaaagtatcagcaccacgtgatttaagtagcgatagatttgtattgagcaaaggtcatgctgctcctattttatatgcagcatgggcagaagcaggactttttccaacaagtgaattgctaaatttaagaaaacttgatagtgatttagaaggacatcctacgccaagacttaattttattgatgtaggaactggttccttgggacaaggactttcagtttctgcaggaatggcttatgtgggaaaaaattttgacaaagccaattatcgtgtatattgtctgattggtgatggagaagctgcagaaggatcaatatgggaagcacttcattttgcatcatattacaagttggataatctttgtgctatttttgatataaatcgtttaggtcaaagtgaaccaacatctcttcaacataatatggaagtttaccgcaaaagacttgaagcttttggatttaatgcattggttgttgatggtcacgatgtagaagaattagccaaggctttccatgaagcacaaaatacgaaaggacgacctacagctatactagcaaaaacatacaaaggtaaatattttcctaccattgaagatcaagaaaattggcatggaaaacctcttggtaataaagcaaatgaagtcattcaacatttaactggaatgttgaaaaatcctggtcctttaggattacatcctcagaaaccattagttgatgatgtttcagtagtagatgttaataatattaaattagcatcacctccgaattataaattaggagaacaagttgctacaagactggcttatggtactgctttggttaaggtttcgaagaacaattctcgtgtcattgctctagatggggatacaaaaaattcgacatatgctgaaaaaatcaagacagtcgatccatctagatttatcgaaggttttattgccgagcaaaatgtagtaggagtagcaatcggtgctgcatgcagagacagaactgttgcatttgtatctgcgtttgcaacattttttactcgtgcttttgaccagattcgtatgggtgctatttcacaaacaaatgttaattttgttggttcccattgcggtgtttcgatcggagaagatggtccatcacaaatgggtttagaagatatagctatgttccgtacaattcctggttctactgtcttttatccagccgatgctgttgctacggagcgcgccatcgaattggcagctaatacaaaaggaatttgtttcatacgcacttctcgtcctgctacggcagttatatataaaaacgaagaaccttttgttattggaaaaggcaaagtggttaaatcttctgcgaaagatcaagttcttgtaattggagctggcgtaactttgtatgaagcacttaaagctgctgatgaattatctaaagtaggaataaatattcgagtgattgatccatttacaattaaaccactcgatgcccaactaattgtaaaaaatgccaaagaagttggaggaagagttattacagttgaagatcattatgcggaaggtggtctgggtgaagctgtactttcagcagttgctttggaaagaaatgttgtagttaagaagctagctattcctgaagtaccacgttctggtcctccaactgcattattggataaatatggaattagttcgaacaaaattgttgctgcagttcaagaaatattaaagttataa

SEQ ID NO: 9861 - protein, 622 aa, Apis mellifera
MVRDINVENLQDLANRLRIQCIKATEASKSGHPTSCSSMAEIMSVLFFHTMRYKVSAPRDLSSDRFVLSKGHAAPILYAAWAEAGLFPTSELLNLRKLDSDLEGHPTPRLNFIDVGTGSLGQGLSVSAGMAYVGKNFDKANYRVYCLIGDGEAAEGSIWEALHFASYYKLDNLCAIFDINRLGQSEPTSLQHNMEVYRKRLEAFGFNALVVDGHDVEELAKAFHEAQNTKGRPTAILAKTYKGKYFPTIEDQENWHGKPLGNKANEVIQHLTGMLKNPGPLGLHPQKPLVDDVSVVDVNNIKLASPPNYKLGEQVATRLAYGTALVKVSKNNSRVIALDGDTKNSTYAEKIKTVDPSRFIEGFIAEQNVVGVAIGAACRDRTVAFVSAFATFFTRAFDQIRMGAISQTNVNFVGSHCGVSIGEDGPSQMGLEDIAMFRTIPGSTVFYPADAVATERAIELAANTKGICFIRTSRPATAVIYKNEEPFVIGKGKVVKSSAKDQVLVIGAGVTLYEALKAADELSKVGINIRVIDPFTIKPLDAQLIVKNAKEVGGRVITVEDHYAEGGLGEAVLSAVALERNVVVKKLAIPEVPRSGPPTALLDKYGISSNKIVAAVQEILKL

SEQ ID NO: 9862 - DNA, 2091 bp, Aspergillus nidulans FGSC A4
  CDS (1)..(2091)
atggccggctctctggtgaacggttctagcagcaagcatgatatcgtcctcaagacctttcggcttctcatcgctgatctatgccagcagtttggtggcggccaccctggcggggccattggcatggctgcgatcggagttgcgctctggcgatacgtgatgcgatacgcaccgcatacccccaacttcttcaaccgtgaccgtttcgtcctgtcgaatggccacacctgcctctttcaatacacgttcctgcacctgaccggctacaaagccatgacctttgagcagctcaagtcgtaccactcggagcgcgaggacgcgctgtgtcccggccacccggagatcgagcacgagggcatcgaggtaacaacgggcccactcggccagggagtcgccaatgcggtgggtctagcaatggctacgaagaacctggctgcgacgtacaaccggccgggatacgaggttgtcaataatcacacctggtgcatgatcggcgatgcgtgtttgcaggagggtgtcgctcttgaggccatctcgctggccggccactggaagttgaacaacctgaccatcatgtacgacaataaccaaatcacctgcgacggctcagtggacctcaccaacactgaagatatcaacgccaagatgcgcgcctgcggatgggacgtgattaatgtagaggacggctgctacgatgtcgaagggatcgtggaggcgctttcaaaggctcgtgcgtccacagagaagcccacctttatcaatattcgcacggtcatcggtctcgacagcaaggtggctggccaagcagctgcccatggtgcggcgttcggtgtcgaagatgttgcagctatgaagcgcaagctcggtttcaacccagaggagcactttgttattggtgagacggtgcgtgaattctttgctgacctgcctgcccgcggcgagggttatgtaaaagagtggaaagacctcatccagcgctatagcgaggcgcacccagaactggccgatgagtttcagcgtcgcgtgcgcggcgagctgccaaccgactggcagaagctgatccccagtgagctccccgacaagccgactgcgacgcgtgtctcatctggcctcgtcttcaatcccatcgcacaatatatcaaatcatttatggtcggcaccgccgatctgtcgccctctgtgaacatgatctggaagggcaaggttgacttccaacaccccgatcttcgaacaacatgcggtataaacggcaactactctggccggtacatccactacggtgtccgtgagcacgccatggccgccatatccaacggactggccgcgttcaaccccaacacattcattccggtcacctcatccttcttcatgttctatctgtacgccgcgccagcagtgcgcatgggggcgttacagcacctccaggtaatccacgccgcaacccacgattccattggtatgggcgaggacggtcccacgcaccaacccattgaactcgcctcgctataccgcgccatgccgaaccttctcttcatccggcctggagacagcgaagaaacggctggtgcctggatcgccgccatcaacgcgaagaagtcctccactatcatctctacctcccgtcacgcactcccccaacttaagcagacccgtcgtgagggtgtgataaagggcgcctacgtccttgaagaggcttccaatgcagacgtaaccatcatcggcgtcggcgccgagctctccttcgcgctggacgtcgccgccagactcaaagaggagaagggcgccaccgcacgggtggtcagtttcccctgccagcggctctttgagcagcaatctctcgagtacaggcgtagcgttctgcaacggcataaaggcattccggcggttgtaatcgagccgtatgcaccgaacggatgggagcggtatgcggacgcggggatctcagtgaggcggtttggacacagtcttcctggcaaggcagcgtataagttctttggctttgatattggggtcatgacggagaaggttggacattaccttcagcagctgaaggaagatgaggcgctgagaggcgaattcgttgatctatga

SEQ ID NO: 9863 - protein, 696 aa, Aspergillus nidulans FGSC A4
MAGSLVNGSSSKHDIVLKTFRLLIADLCQQFGGGHPGGAIGMAAIGVALWRYVMRYAPHTPNFFNRDRFVLSNGHTCLFQYTFLHLTGYKAMTFEQLKSYHSEREDALCPGHPEIEHEGIEVTTGPLGQGVANAVGLAMATKNLAATYNRPGYEVVNNHTWCMIGDACLQEGVALEAISLAGHWKLNNLTIMYDNNQITCDGSVDLTNTEDINAKMRACGWDVINVEDGCYDVEGIVEALSKARASTEKPTFINIRTVIGLDSKVAGQAAAHGAAFGVEDVAAMKRKLGFNPEEHFVIGETVREFFADLPARGEGYVKEWKDLIQRYSEAHPELADEFQRRVRGELPTDWQKLIPSELPDKPTATRVSSGLVFNPIAQYIKSFMVGTADLSPSVNMIWKGKVDFQHPDLRTTCGINGNYSGRYIHYGVREHAMAAISNGLAAFNPNTFIPVTSSFFMFYLYAAPAVRMGALQHLQVIHAATHDSIGMGEDGPTHQPIELASLYRAMPNLLFIRPGDSEETAGAWIAAINAKKSSTIISTSRHALPQLKQTRREGVIKGAYVLEEASNADVTIIGVGAELSFALDVAARLKEEKGATARVVSFPCQRLFEQQSLEYRRSVLQRHKGIPAVVIEPYAPNGWERYADAGISVRRFGHSLPGKAAYKFFGFDIGVMTEKVGHYLQQLKEDEALRGEFVDL

SEQ ID NO: 9864 - DNA, 2160 bp, Aspergillus nidulans FGSC A4
  CDS (1)..(2160)
atggctcctggattagaactgctccctaagaccacggccttgccgacaaaggctgccaatgccatcaacaatgccgtctatggcagagactctgatgtgaagtttgagagtgccgagaagcaccagcgggtgttaaatgtcttcagagctttcattgccgacctggttcagcaatatggtgacggacaccctggagcgcccatgggcatggcggccatcgggattgcgctgtggaaatacgtcatgaaatactcgcccacgaattgcaactacttcaaccgcgatcgctttgttctttcgaatggtcacgcctgtctctggcagtacctcttcatgcaccttgtcggcgtcaagagcatgacccttgagcagttgaaatcctaccactccacagactccagttccctatgccccggccatccagagatcgagaacgaaggtgttgaggtaacgaccggcccactgggtcagggtgtcgcgaacgcagttggactcgccatggcgaccaagaacctcgccgcaacgtacaacaagcctggctatgaagtcgtgaacaacatgacctggtgtatggttggcgacgcttgtttgcaggagggcgtcggtcttgaagctctgtctctggctgggcactggcggctcaacaacctttgtgtgatctttgacaacaataatgtaacctgcgatggaacggcagatgttgccaatacggaagacatcaacaccaagatgcgcgcgacaggcttcaaggtgattgacgtgtatgacggggattcggacgttgttgccatcaccaatgcgctcctcgctgctcgctcctccaccaagccaactttcatcaacattcgcaccaccatcggcgtaggctccaagcaagccggcacggccgatgcgcacggcgccgccctgggcgtcgacgaagtcgccaaaatcaagcgcgcctttggcctgaaccctgaggaacacttccacatcccccaagacgtttacgacttcttcagcgatctaccatcgcgcgggaagacccatgaggcagaatggcacgcggctgttgccgcataccgcgaagctgagcccgtgctcgcctctgaatttgacctccgtgtcgcaggaaaaatgccagcagactggacaaagtacaagctcggccaaaacgtcaagaacttcctcgtcggcacagcggatcttaccccctccgtcaacgtggcctacaagaacaaagtcgacttccagtcccccgacctcaagaccgcgtgcggtatgagtggaaattatgcaggccggtatatccactacgggatccgcgagcacgccatgtgcgcgatctccaacggtctggcggcgttcaacaagggcaccttcatcccgatcacaagcacctacctcgttttccacctgtacgctgccgccgctgtacgcatggccgctctacaggggctgcaccagatccacatcgccactcacgacagcattggcgttggagagaatggaccaacgcatcagcccatcgccgtaccggcactctaccgtgcaatgccaaacatccttttcattcggccctgtgatgcagaggagacggttggggcgtacatcgcagcaatccagcacgacacaactccctccgttctggcactgtcgcgccagaaccttacgcagtaccctgctcactcctctcgagaaggcgtgcagaagggagcctacgtcttcgtcgaggaagagaactttgacgtcactctcctcagcgtgggctctgaaatggcttataccatggcagcgcgcgagatccttgcggccgagcacggtatcaaagcgcgtgtcgtttcattcccttgcgcacggctcttcgagcttcagtcccgcgagtacaagcactccgtcttgaaaccacgcgcgggcaaacccgctgtcgcgatcgaggcgtacccttctgttggctgggagcggtatgctgatgcggcaattgcgcagaaccagtttgggaagagtctgccgtgtaaggaggtgtatgagcactttggatttagtggaaaaatcattgcagataaggtgaaaggattagtggatgaggtgagacgcgatggtgttgaggtgttaagaggtgactttcgggatctgaatgggggtcctagtgtcggtgtggagcatccaaatgtgccttag

SEQ ID NO: 9865 - protein, 719 aa, Aspergillus nidulans FGSC A4
MAPGLELLPKTTALPTKAANAINNAVYGRDSDVKFESAEKHQRVLNVFRAFIADLVQQYGDGHPGAPMGMAAIGIALWKYVMKYSPTNCNYFNRDRFVLSNGHACLWQYLFMHLVGVKSMTLEQLKSYHSTDSSSLCPGHPEIENEGVEVTTGPLGQGVANAVGLAMATKNLAATYNKPGYEVVNNMTWCMVGDACLQEGVGLEALSLAGHWRLNNLCVIFDNNNVTCDGTADVANTEDINTKMRATGFKVIDVYDGDSDVVAITNALLAARSSTKPTFINIRTTIGVGSKQAGTADAHGAALGVDEVAKIKRAFGLNPEEHFHIPQDVYDFFSDLPSRGKTHEAEWHAAVAAYREAEPVLASEFDLRVAGKMPADWTKYKLGQNVKNFLVGTADLTPSVNVAYKNKVDFQSPDLKTACGMSGNYAGRYIHYGIREHAMCAISNGLAAFNKGTFIPITSTYLVFHLYAAAAVRMAALQGLHQIHIATHDSIGVGENGPTHQPIAVPALYRAMPNILFIRPCDAEETVGAYIAAIQHDTTPSVLALSRQNLTQYPAHSSREGVQKGAYVFVEEENFDVTLLSVGSEMAYTMAAREILAAEHGIKARVVSFPCARLFELQSREYKHSVLKPRAGKPAVAIEAYPSVGWERYADAAIAQNQFGKSLPCKEVYEHFGFSGKIIADKVKGLVDEVRRDGVEVLRGDFRDLNGGPSVGVEHPNVP

SEQ ID NO: 9866 - DNA, 2064 bp, Ustilago maydis 521
  CDS (1)..(2064)
atgtcttttactaaggctgctagcgacgagaaggctatcgctgccatccgtgtcttggccgccgatgtggtcgccaagtccaactccggtcaccctggtgctcccatgggtatggctcccatggcccacaccctcttctctcgattcatgaatgtgaaccccgctcactctaagtggatcaaccgtgaccgattcgttctttcgaacggccacgcttgcgctctcatctacatcctcaaccacctcctcggttacaaggacttgcccatggagcagctcaagcagttccgtcagctcgactccaagaccccaggtcaccccgaacacggtcacaccgagggtatcgaggtcaccactggtccccttggtcagggtttcgccaactcggtcggtctcgccatcgcccaggctaaccttgctgccaccttcaacaaggacggcttccccctcttcaccaaccacacatacatgttcaccggtgacggttgcttgcaggagggtatctcgtccgaggccgcttcgctcgctggtcacctcaagctcggaaacctcatcgccctctacgatgacaaccacatctcgatcgacggtgacaccgcctgctccttcaccgaagacgtcgagcagcgcttcctcgcctacggatggcacgtttcgcacgtccttgacggtgacaaggacctcgagggtctcttcaaggccatcaccgaggccagaaacgtcaccgacaagccctcgatcatccgtgtcaagaccaccatcggcttcggttccaagctccagggtctcgccgccacccacggtgctcccctcaaggccgacgacattgaagctgtcaagaccaagttcggcatggaccccaagcagagcttcgttgtcccagacgatgtctacgccgcttacaaggaaatcgctgaccgtggtgccaaggccgacaaggagtggaccgagctcttcaaggcctacggcgagaagtaccccaacgagcacgccgagattgcccgccgaatcgccggaaagcttcccgagggctgggagaagtctctccccacctaccagcccagcgatgccgccgttgcctcgcgaaagctttccgagactgtcctcgccaaggtcgctgacgctgttcccgaacttcttggtggttccgccgatttgaccggctccaacttgacccgttggggcaacgctgtcgacttccagcaccccagcacccagctcggtgactactcgggcaagtacatccgatacggtgtccgtgagcacgccatgggtgcaatcatgaacggtctcgccgcctacggcatgcacatccccaccgccggaactttcctcaactttgtctcgtacgctatcggcgctgtgcgtctctcggccctctcgcagcaccgcgtcatctgggtcgccactcacgactcgattggtctcggtgaggacggtcccacccaccagcctatcgagactgccatcgctcttcgtgccatccccaacctcatgttctggcgccctgctgacggtaacgagacctcgggtgcttaccttgttgccatcgagtccaagtcaaccccttccgtccttgccctcactcgtcagaatctgccccaactcgagggcagctctatcgagaaggccgccaagggtggttacgttgtcgtagagaacgagtcggccgacatcaccctcgttgcctctggttccgaggtcgctctctgcgtcgaagccgtcgccaagctcggcgagaagggcatcaaggctcgtgttgtttccatcccatgcttctcggtctttgatgctcagcccatcgagtaccgtctctcggttctcccctcgggcaagcccatcctctccgtcgaggcctactcgacgctcggctggtccaagtactcgcacgcccagcacggtatcaacacctttggtgcctcagcccctgccaatcaactcttcaagaagttcaagatgactggcgacgacgttgtcgccaaggccgagcacgtcaccaaggttttccagggccagacccttgtgagccccatcgagctcgaagccaagctcctgcagtactaa

SEQ ID NO: 9867 - protein, 687 aa, Ustilago maydis 521
MSFTKAASDEKAIAAIRVLAADVVAKSNSGHPGAPMGMAPMAHTLFSRFMNVNPAHSKWINRDRFVLSNGHACALIYILNHLLGYKDLPMEQLKQFRQLDSKTPGHPEHGHTEGIEVTTGPLGQGFANSVGLAIAQANLAATFNKDGFPLFTNHTYMFTGDGCLQEGISSEAASLAGHLKLGNLIALYDDNHISIDGDTACSFTEDVEQRFLAYGWHVSHVLDGDKDLEGLFKAITEARNVTDKPSIIRVKTTIGFGSKLQGLAATHGAPLKADDIEAVKTKFGMDPKQSFVVPDDVYAAYKEIADRGAKADKEWTELFKAYGEKYPNEHAEIARRIAGKLPEGWEKSLPTYQPSDAAVASRKLSETVLAKVADAVPELLGGSADLTGSNLTRWGNAVDFQHPSTQLGDYSGKYIRYGVREHAMGAIMNGLAAYGMHIPTAGTFLNFVSYAIGAVRLSALSQHRVIWVATHDSIGLGEDGPTHQPIETAIALRAIPNLMFWRPADGNETSGAYLVAIESKSTPSVLALTRQNLPQLEGSSIEKAAKGGYVVVENESADITLVASGSEVALCVEAVAKLGEKGIKARVVSIPCFSVFDAQPIEYRLSVLPSGKPILSVEAYSTLGWSKYSHAQHGINTFGASAPANQLFKKFKMTGDDVVAKAEHVTKVFQGQTLVSPIELEAKLLQY

SEQ ID NO: 9868 - DNA, 1998 bp, Cryptococcus neoformans var. neoformans B-3501A
  CDS (1)..(1998)
atgggagcggctgccatcgccacggccctttggaaatacagcatgcgatataaccctgctaatcctgactggatcaaccgagatcgattcgtgctctctgctggccatgcgtgcctgcttcaatacatcatgcttcatctttctggatattcttcttggacccttgaccagatcaagaagtaccatgccccgaccatggacgggattgctgctggccaccccgagatcgagttcccaggtgtcgaattgaccaccggtcttctcggtcaaggtattgccaacgccgtcggactcgccgtcgccaataagaacatggctgcaacttacaacaaggacggatttccgatcatccagaacaaggtctggtgtttcaccggtgacggttgtctgcaggagggtgttggccaggaagccctctccatggccggacattggggtcttgacaacatgattcttgtatatgacaacaactctgtcacagtggacggtaacattgacatctgcttcaccgatgacacttccgccaagctcaagagccttgggtggcatgttctcgaggtcgaggatggatccaacgacctggccgcaattgtcgatgctttcgagcaggctcagaagctcaccggcaagcccgtcttcatcaatattaagaccatcatcggtatcggctccattaaccagaatagtggcaaagtacacggcgccgctttgggtgaggatgacgtcgctagagtcaagaccgccctcggctttgaccccaaggacaagttcatcgtgcccgacgccgtctatgactattttaaggagaccaaaatcaagggtgcccaatatgagcaggaatggaacgaccttttcaagcggtacaaagaatctttcccctccgaagcggcagagttccaaaggcgattggacggaaagctcgaagaggcttgggagaacaagttcccttcgaaggatgctctccccaaagaccccaaagctaccaggcagagcagcggtatcgcgcttcgatcggtcatcccggaggacaagtcatttttggtcggaagtgccgatttgtgcgagtcgacgtttgtcaactgggacggaatggtcgagttccaaaaccccaagtcgggctatggcgattattctggtcgacagatccgatacggtatccgagagcatgccatggtggctgccgccaacggtctcgccgcttggcacaagggtgccatcgtccccatcatgtcgagttacttcatcttctggctttacgccgctccttcgctccgaatggccgctttgatgaagcttcgattcatcgccattgccactcacgactccatcggtgtcggcgaggacggacctacccaccagccgatcgcgttccctctttttctccgtgcccttcccaatttcaactacatccgacctgccgacgctgaggaagtgatcggcgcttggatcttgggcctcagggacgccgatcaccccagtttgctttcgctcactcgacagccagtaccccttctttcaggtacggaccgcaacaaggtacaatacggtggatacgtcgtctacggcgacgagaacagcatccccgatatcaccctcgtcgccactggttccgaggttgcacgtgcggttgatacagccgagctgttgaaggacaaatattctgtaagggtcgtatcgatgcctcacaccggtcgattcgacgcacaaccgctcgagtaccgacgatccgtcatcccttctaccaagtctcttgtcgtatctatcgagccctatgcttcgttcggttgggccaaatacgcccacgcaggcgctcacatgacaggcttcggtcactctgctccttactctgtgctgttcgagcacttcggtttcggccccaagaccctggcggagaagattagagcctgggccgagccaaagaggaacggagatggctgggacatccccggcgttggagagttcgaggagctgttggttaacagcggtaacggtcattag

SEQ ID NO: 9869 - protein, 665 aa, Cryptococcus neoformans var. neoformans B-3501A
MGAAAIATALWKYSMRYNPANPDWINRDRFVLSAGHACLLQYIMLHLSGYSSWTLDQIKKYHAPTMDGIAAGHPEIEFPGVELTTGLLGQGIANAVGLAVANKNMAATYNKDGFPIIQNKVWCFTGDGCLQEGVGQEALSMAGHWGLDNMILVYDNNSVTVDGNIDICFTDDTSAKLKSLGWHVLEVEDGSNDLAAIVDAFEQAQKLTGKPVFINIKTIIGIGSINQNSGKVHGAALGEDDVARVKTALGFDPKDKFIVPDAVYDYFKETKIKGAQYEQEWNDLFKRYKESFPSEAAEFQRRLDGKLEEAWENKFPSKDALPKDPKATRQSSGIALRSVIPEDKSFLVGSADLCESTFVNWDGMVEFQNPKSGYGDYSGRQIRYGIREHAMVAAANGLAAWHKGAIVPIMSSYFIFWLYAAPSLRMAALMKLRFIAIATHDSIGVGEDGPTHQPIAFPLFLRALPNFNYIRPADAEEVIGAWILGLRDADHPSLLSLTRQPVPLLSGTDRNKVQYGGYVVYGDENSIPDITLVATGSEVARAVDTAELLKDKYSVRVVSMPHTGRFDAQPLEYRRSVIPSTKSLVVSIEPYASFGWAKYAHAGAHMTGFGHSAPYSVLFEHFGFGPKTLAEKIRAWAEPKRNGDGWDIPGVGEFEELLVNSGNGH

SEQ ID NO: 9870 - DNA, 2178 bp, Cryptococcus neoformans var. neoformans B-3501A
  CDS (1)..(2178)
atgtcacctgtagctgtacataataaacatggcgattctgcctctcacggcacagcgctgagcaagaaccctcacgtcaagtcttcagaggttgataccgagaagctcgtaatcaacgccatccgatgtttggcagccgatctatgtcagcagtacaagggtggtcatcccggcacagtcatgggagcggctgccatcgccacggccctttggaaatacagcatgcgatataaccctgctaatcctgactggatcaaccgagatcgattcgtgctctctgctggccatgcgtgcctgcttcaatacatcatgcttcatctttctggatattcttcttggacccttgaccagatcaagaagtaccatgccccgaccatggacgggattgctgctggccaccccgagatcgagttcccaggtgtcgaattgaccaccggtcttctcggtcaaggtattgccaacgccgtcggactcgccgtcgccaataagaacatggctgcaacttacaacaaggacggatttccgatcatccagaacaaggtctggtgtttcaccggtgacggttgtctgcaggagggtgttggccaggaagccctctccatggccggacattggggtcttgacaacatgattcttgtatatgacaacaactctgtcacagtggacggtaacattgacatctgcttcaccgatgacacttccgccaagctcaagagccttgggtggcatgttctcgaggtcgaggatggatccaacgacctggccgcaattgtcgatgctttcgagcaggctcagaagctcaccggcaagcccgtcttcatcaatattaagaccatcatcggtatcggctccattaaccagaatagtggcaaagtacacggcgccgctttgggtgaggatgacgtcgctagagtcaagaccgccctcggctttgaccccaaggacaagttcatcgtgcccgacgccgtctatgactattttaaggagaccaaaatcaagggtgcccaatatgagcaggaatggaacgaccttttcaagcggtacaaagaatctttcccctccgaagcggcagagttccaaaggcgattggacggaaagctcgaagaggcttgggagaacaagttcccttcgaaggatgctctccccaaagaccccaaagctaccaggcagagcagcggtatcgcgcttcgatcggtcatcccggaggacaagtcatttttggtcggaagtgccgatttgtgcgagtcgacgtttgtcaactgggacggaatggtcgagttccaaaaccccaagtcgggctatggcgattattctggtcgacagatccgatacggtatccgagagcatgccatggtggctgccgccaacggtctcgccgcttggcacaagggtgccatcgtccccatcatgtcgagttacttcatcttctggctttacgccgctccttcgctccgaatggccgctttgatgaagcttcgattcatcgccattgccactcacgactccatcggtgtcggcgaggacggacctacccaccagccgatcgcgttccctctttttctccgtgcccttcccaatttcaactacatccgacctgccgacgctgaggaagtgatcggcgcttggatcttgggcctcagggacgccgatcaccccagtttgctttcgctcactcgacagccagtaccccttctttcaggtacggaccgcaacaaggtacaatacggtggatacgtcgtctacggcgacgagaacagcatccccgatatcaccctcgtcgccactggttccgaggttgcacgtgcggttgatacagccgagctgttgaaggacaaatattctgtaagggtcgtatcgatgcctcacaccggtcgattcgacgcacaaccgctcgagtaccgacgatccgtcatcccttctaccaagtctcttgtcgtatctatcgagccctatgcttcgttcggttgggccaaatacgcccacgcaggcgctcacatgacaggcttcggtcactctgctccttactctgtgctgttcgagcacttcggtttcggccccaagaccctggcggagaagattagagcctgggccgagccaaagaggaacggagatggctgggacatccccggcgttggagagttcgaggagctgttggttaacagcggtaacggtcattag

SEQ ID NO: 9871 - protein, 725 aa, Cryptococcus neoformans var. neoformans B-3501A
MSPVAVHNKHGDSASHGTALSKNPHVKSSEVDTEKLVINAIRCLAADLCQQYKGGHPGTVMGAAAIATALWKYSMRYNPANPDWINRDRFVLSAGHACLLQYIMLHLSGYSSWTLDQIKKYHAPTMDGIAAGHPEIEFPGVELTTGLLGQGIANAVGLAVANKNMAATYNKDGFPIIQNKVWCFTGDGCLQEGVGQEALSMAGHWGLDNMILVYDNNSVTVDGNIDICFTDDTSAKLKSLGWHVLEVEDGSNDLAAIVDAFEQAQKLTGKPVFINIKTIIGIGSINQNSGKVHGAALGEDDVARVKTALGFDPKDKFIVPDAVYDYFKETKIKGAQYEQEWNDLFKRYKESFPSEAAEFQRRLDGKLEEAWENKFPSKDALPKDPKATRQSSGIALRSVIPEDKSFLVGSADLCESTFVNWDGMVEFQNPKSGYGDYSGRQIRYGIREHAMVAAANGLAAWHKGAIVPIMSSYFIFWLYAAPSLRMAALMKLRFIAIATHDSIGVGEDGPTHQPIAFPLFLRALPNFNYIRPADAEEVIGAWILGLRDADHPSLLSLTRQPVPLLSGTDRNKVQYGGYVVYGDENSIPDITLVATGSEVARAVDTAELLKDKYSVRVVSMPHTGRFDAQPLEYRRSVIPSTKSLVVSIEPYASFGWAKYAHAGAHMTGFGHSAPYSVLFEHFGFGPKTLAEKIRAWAEPKRNGDGWDIPGVGEFEELLVNSGNGH

SEQ ID NO: 9872 - DNA, 2163 bp, Cryptococcus neoformans var. neoformans B-3501A
  CDS (1)..(2163)
atgacggccaccagaaacacgaatgggcacggagagctgaaccgggaggctcacacaaccaacaaagtagtttccgaaaaagaagaacaattggtgctgaacacgatacgatgccttgcagcagacttgtgtcagcagtacaaaggcggtcatcccggtactgttatgggtgcctcagccatagggattgccttgtggagatatgagatgagatacaaccctctaaaccccgactggttcaatcgagaccgcttcgtcctttcggctggacatgcttgtcttttccaatatattttcctccatctttccggctacgaagcttggacattggaccaaatcaagatgtatcactccccagcgacttcgggatctatggccgcaggacaccctgagatagaatacccaggtatcgaggtgacaactggacccctcggacagggtatctctaacgcggtcgggatggcaattgcatcaaagcagcttgcggcgacatacaacagggaagggctggatatagtggacaacaaaatctggtgtttcaccggtgatggctgtttacaagaaggtgttggccaggaagccatttcgctggcagggcatttgggattggataatttgatcctggtatatgacaacaatgctgtcacggtagacggccgaatcgacaactgttttaccgagaacacttcgaaaaaactacaagctcaaggctggaatgtcatcgacgtctatgatggctcgaacgatcttgccgcgatcctagaagggtttgacaaagccaagcagttcaaagggaaaccaagtctggttaatatacgtacagtcattggttactcctcacgaaaagccaacactggaccggcccatggtcaagccttgggagacgatgaagtggcatatgtcaaaactcaactcggattcgatcctgctcagaaattcgttattcccgacaaggcatacgaatatttcgctgaatgcaaaatcaagggtgcaaaggcaaacgaagaatggaacgaaaaattcgaagcctactcaaaggcgtatccagacttgtataaacagctgactgatcgaatgaacggcagatttgctccagatggttgggaaactctgttaccggcgaaaaaggatcttccgcaaggggaccagcctaccaggaagtcaagtggaatcgcagttcaaactttggtgcccaagaataataccttcatcgctggttcagcggacctcctcgaatccacctttgtcaatttcgatggtcaagtagagttccagaacccttcttcgggtctgggagactacactggcagacaaattcgcttcggcattagggagtttgcaatggtgggtttgggcaacggtatggcagcatatcacaagggaatgttcatccctatcatgtctacgttcttcatgttttggatctacgctgccccggccgcccgaatggccgctttacaacatctgcgattcatcggagttgccactcatgattccatcggtataggggaagatggtcccacccatcagcccatcgctctggctgctttctacagagccttaccgaacatcaaccttatccgacctgccgatgcagaggaatgtatgggaatgtggctcttggctctatcggatcaatcagcaaacacccccagcatcttcgccttgtctcgacaacccgtgccccttctttccggaaccgaccgtacaaaggtcgcacaaggggcttacattgtttacggtgatgacagaagtccggatatgacgattattgcaaccggtgctgaagtcgcccgagcaatcgagtctgccaagctgctgaagtcggtcaagaaggtccgagtagtctcgatgccttcccagaaacacttcgacattcaaactgcagaatacaaagaattggttctaaagagctccaccgccctcgtggtcgcaattgaagcatgggcttcttacggttgggctagatacgcacatgcttcgttgtccatgcagactttcggtcactcggcacctcaacagcagctgtatgagcatttcggattctctccgaaagccatggcagagaagattgatgagtgggcggccaggtggcaaacgaaaggaggccggccaggacttggtgatttcgaagagctgttgctgcgctatacgcaacattga

SEQ ID NO: 9873 - protein, 720 aa, Cryptococcus neoformans var. neoformans B-3501A
MTATRNTNGHGELNREAHTTNKVVSEKEEQLVLNTIRCLAADLCQQYKGGHPGTVMGASAIGIALWRYEMRYNPLNPDWFNRDRFVLSAGHACLFQYIFLHLSGYEAWTLDQIKMYHSPATSGSMAAGHPEIEYPGIEVTTGPLGQGISNAVGMAIASKQLAATYNREGLDIVDNKIWCFTGDGCLQEGVGQEAISLAGHLGLDNLILVYDNNAVTVDGRIDNCFTENTSKKLQAQGWNVIDVYDGSNDLAAILEGFDKAKQFKGKPSLVNIRTVIGYSSRKANTGPAHGQALGDDEVAYVKTQLGFDPAQKFVIPDKAYEYFAECKIKGAKANEEWNEKFEAYSKAYPDLYKQLTDRMNGRFAPDGWETLLPAKKDLPQGDQPTRKSSGIAVQTLVPKNNTFIAGSADLLESTFVNFDGQVEFQNPSSGLGDYTGRQIRFGIREFAMVGLGNGMAAYHKGMFIPIMSTFFMFWIYAAPAARMAALQHLRFIGVATHDSIGIGEDGPTHQPIALAAFYRALPNINLIRPADAEECMGMWLLALSDQSANTPSIFALSRQPVPLLSGTDRTKVAQGAYIVYGDDRSPDMTIIATGAEVARAIESAKLLKSVKKVRVVSMPSQKHFDIQTAEYKELVLKSSTALVVAIEAWASYGWARYAHASLSMQTFGHSAPQQQLYEHFGFSPKAMAEKIDEWAARWQTKGGRPGLGDFEELLLRYTQH

SEQ ID NO: 9874 - DNA, 2064 bp, Cryptococcus neoformans var. neoformans B-3501A
  CDS (1)..(2064)
atggccaacttttccagcaacgacatcaccgctgtcaacaccatccgaacccttgccgctgatgttgtggccaaggctaactctggtcaccccggtgcccccatgggtatggcccctgctgcccacgtgctcttcacccgatttatgaggttcaactccaagaaccccaagtggattaacagggaccgattcgtcctttctaacggtcatgcttgtgctctccagtacattcttcttcaccttgctggctacgaagtctctatggaggacctcaagcaattccgtcagattgactctatcacccccggtcaccccgaagttggtgttacccccggtattgaggttaccactggtccccttggtcagggtattgccaacgctgtcggtcttgccatttcccaggcccacatgggtgccgtcttcaacaaggagaacttctctttgattgacaactacacctactgtttccttggtgacggttgtctccaggagggtgttgcctctgaggcctgttctcttgccggtcatttgaagttgggtaacttggttgccatctacgatgacaacaagatcaccattgatggtgacactgctgtgtctttcactgaggacgtcgagatgcgattcaagtcttacggctggaatgtcctccacgttgagaagggtgacgatgaccttgctgccatcgagaaggccatcaccgaggctaagaagagcaaggatgcccctaccatcattaacctcaagactaccattggtttcggttctcttcacgccggtggccacgacgtccacggttctcctctcaagaaggatgacattgttcagctcaagaagaagttcggctttaaccccgaggagacctttgtcgttcccaaagagacttccgacctctaccacaaggttgccgagagcggtgccaaggccgaggctgagtggcaggctcttttcaagtcttatagcgagaagtaccccaaggaggctgctgagcttcagcgacgagttgaaggccgtcttcccgacggttgggagaaggctctccccacctacaccacctctgacgctgctgtcggttccaggaagttgtccgagactactatcaccaaactcgttgaggtgttgcccgagttggtcggtggttctgccgacttgaccggttccaacttgaccaggtggaagggcgctgaggacttccagcacccctctaccggtctcggaagctacgctggccgatatttccgatttggtgttagggagcacggtatgactgccgtctgtaacggtatcgctgcctatggtggtatcattcctttcactgccactttccttaacttcgtctcttacgctgccggtgccgtccgactttccgccttgtctcaccttcgagtcctcaacgttgccacccacgactctattggtctcggtgaagatgggcctacccaccagcccgtcgagactgctgcttggctccgagctatccctaaccttgctttctggaggcccgctgacggtaacgagacttctgccgcctatcttgtcgccatcttgtctcagcacactccttccgtcttcgccttttcccgacagaatttgcctcaactcgccaactcttccattgagaaggctactaagggtggttatgttgttgaggaggttgagaatgccgatgtgaccctcgtctccactggttctgaggttatcctttgtcttcaagctcttgagcagctcaaatccaagggcatcaaggcccgattggtttccttgccttgtttcgaggtcttcaacaaccagcccaaggactacaagctcagcgttcttccttccggtgctcccatcctctcagtcgaggcttactctaccttcggctggggaacttactctcacgaccacttcggtctcaaggcttggggtgcctccggtccttacaacaaggtctatgagaagttcgacatcactcccgagggtattgccaggagggctgagaaggttgttgacttctacaagaagcgtggccagcccgtattctctcctttgatctctgctttggatgacatctctgagtaa

SEQ ID NO: 9875 - protein, 687 aa, Cryptococcus neoformans var. neoformans B-3501A
MANFSSNDITAVNTIRTLAADVVAKANSGHPGAPMGMAPAAHVLFTRFMRFNSKNPKWINRDRFVLSNGHACALQYILLHLAGYEVSMEDLKQFRQIDSITPGHPEVGVTPGIEVTTGPLGQGIANAVGLAISQAHMGAVFNKENFSLIDNYTYCFLGDGCLQEGVASEACSLAGHLKLGNLVAIYDDNKITIDGDTAVSFTEDVEMRFKSYGWNVLHVEKGDDDLAAIEKAITEAKKSKDAPTIINLKTTIGFGSLHAGGHDVHGSPLKKDDIVQLKKKFGFNPEETFVVPKETSDLYHKVAESGAKAEAEWQALFKSYSEKYPKEAAELQRRVEGRLPDGWEKALPTYTTSDAAVGSRKLSETTITKLVEVLPELVGGSADLTGSNLTRWKGAEDFQHPSTGLGSYAGRYFRFGVREHGMTAVCNGIAAYGGIIPFTATFLNFVSYAAGAVRLSALSHLRVLNVATHDSIGLGEDGPTHQPVETAAWLRAIPNLAFWRPADGNETSAAYLVAILSQHTPSVFAFSRQNLPQLANSSIEKATKGGYVVEEVENADVTLVSTGSEVILCLQALEQLKSKGIKARLVSLPCFEVFNNQPKDYKLSVLPSGAPILSVEAYSTFGWGTYSHDHFGLKAWGASGPYNKVYEKFDITPEGIARRAEKVVDFYKKRGQPVFSPLISALDDISE

SEQ ID NO: 9876 - DNA, 1878 bp, Tribolium castaneum
  CDS (1)..(1878)
atgccggctcaaatcactcaagctgatatcaaagtcttgcaagacattgccaatagaatcagaattcacagtgtcacctccacggcggcttgcaactcagggcatccaacatcatgctcgtcaatcgccgaaattttatcggtcctttttttcaacacaatgcgatacaaaatatcagcaccgaaagacccctcaagtgaccgctttgtcctttctaaaggtcacgccgctccggcgctgtacgcagtatgggccgaggcgggtcttttccccgttgctgatttacaaaacttgaggaaattggggtcggacctcgagggtcatccaactcctcgcttgaatttcattgatgtagggacaggctcgctgggccaagggctggccattgcgtgcggcatggcctacgtgggcaaaaacttcgacaaggccagttatagggtgtactgcctggtcggggatggggagagcgccgagggttcaatctgggaatcgctccattttgcgacttactacaagctcgataatctctgcgttatctttgatgtgaaccgtctcgggcaatctgagcccacttctctgggtcatgatatcgacacttacaggaaacggttggaagcgttcggtttcaatgtagttgccgtcgatggacacgacgtcgaagagctggtgaaagccttccacgtgtcgtgcaacaccaaagggaagcctaccgcaatcattgcgaaaactttcaaagggaagaacttccccaaaattgaagatttggaaaactggcacgggaaaccactaggagatcaggccgatcgtgtcctccaacacctcaaatctcttgttaaaaacacggggcctttgcaactccacccccagaagcccctcaccgacgatgctcccattgttgacatcagcaatattaaactatcctcgcctccatcttacaaaatcggcgatagtattgctacgagagtggcctacggcactgctttggtcaagctcggccaaagcaacccccgagtcattgcccttgacggcgatatgaaaaattcaacatattcggaagcccttaaaaaatttgaccccacgagatacatcgaatgtttcatcgccgaacagaaccttgtcggggttgccattggtgctacttgtcgcgaccgcacagttgccttcgtttccacctttgctactttcttaacccgtgcttatgaccagattcgtatgggggctatttctcagacaaatgtcaatttctgcggctctcattgtggtgtcagtataggcgaagacggaccaagccagatggggctggaagacatcgctatgttccggaccatccccggaagcactgtcttctaccccgctgatgcggtctccactgaacgtgccgtcgaactggccgcgaacaccaaaggagtcactttcatcagaaccaacagaccggccactgctgtcatctaccccaacaatcacgtattccaggtgggcaagtcgcacgtggtgaagaagtcgaacaacgaccaagtcctggttattggtggcggagtgaccctgcaggaggccatcggggccgccaacgaattggctaaagccggtgttggtgtccgtgttttggatctgttcaccatcaagccaattgacaaggagggaataatcaaaaacgcgaaagaatgcggtgggcgtattctcgtcgttgaagaccactactacgaggggggcattggcgaggctgtcctttcggcggtcgctcaggagcgcaacatcgccgtgaaacacgtggcagtgcccaaagtgccccgctccgggagccccaccgcccttttggactactacggcctcaacagcaaacacattgtcaattacgtgcaagaagcaatgaagttgtaa

SEQ ID NO: 9877 - protein, 625 aa, Tribolium castaneum
MPAQITQADIKVLQDIANRIRIHSVTSTAACNSGHPTSCSSIAEILSVLFFNTMRYKISAPKDPSSDRFVLSKGHAAPALYAVWAEAGLFPVADLQNLRKLGSDLEGHPTPRLNFIDVGTGSLGQGLAIACGMAYVGKNFDKASYRVYCLVGDGESAEGSIWESLHFATYYKLDNLCVIFDVNRLGQSEPTSLGHDIDTYRKRLEAFGFNVVAVDGHDVEELVKAFHVSCNTKGKPTAIIAKTFKGKNFPKIEDLENWHGKPLGDQADRVLQHLKSLVKNTGPLQLHPQKPLTDDAPIVDISNIKLSSPPSYKIGDSIATRVAYGTALVKLGQSNPRVIALDGDMKNSTYSEALKKFDPTRYIECFIAEQNLVGVAIGATCRDRTVAFVSTFATFLTRAYDQIRMGAISQTNVNFCGSHCGVSIGEDGPSQMGLEDIAMFRTIPGSTVFYPADAVSTERAVELAANTKGVTFIRTNRPATAVIYPNNHVFQVGKSHVVKKSNNDQVLVIGGGVTLQEAIGAANELAKAGVGVRVLDLFTIKPIDKEGIIKNAKECGGRILVVEDHYYEGGIGEAVLSAVAQERNIAVKHVAVPKVPRSGSPTALLDYYGLNSKHIVNYVQEAMKL

SEQ ID NO: 9878 - DNA, 2007 bp, Prochlorococcus marinus str. AS9601
  CDS (1)..(2007): transl_table=11
atggtcgctgcatctgtttcattagaatcactttgtgtaaatagtataagaatgcttgctgtagatgcagtaaataaatctaatagtggtcatcctggattgccaatgggatgtgcacctatgggttatgcattatggcaaaacatacttaatcacaaccctaacaaccctaaatggttcaatagagaccgttttgttttatcagctggtcatggctgtatgctgttgtattccttgcttcatttgacaggatataaatcagtttccatagaagatattaaagaatttaggcaatggggatcaaaaactcctggacatccagaaacattcgaaactgaaggtgttgaagttacagctgggcctcttggagcaggaatttcaaatgcagttggtttagcaatagctgaaacacacttagcagctaaatttaataagcctgattgcaatattgttgatcactatacttacgtaataatgggtgatggctgtaatcaagaaggtatcgcatcagaggcctgctcattagctggtcatcttaagcttgggaaattaattgcactttatgacgataatcaaattacaattgatggacggaccgacgtttcttttactgaagatgtcttaaaaagatacgaagcttatggatggcatgtgcaacatgttgaagatgggaatcatgatgttaaaggaatcaccgaagctatcgaaaaagcgaaattaattacagacaagccttcaattataaaaatttctacaaccataggttacggttctccaaataaatcagatactgctggaattcatggagcagctgtcggagaagaagaagctgcattaactagagagtttctaaactgggaatatcctccttttaaaatacccgatgaagtatatacgcattttagaaaatcaataaacaaaggtgaaaatttagagcaagaatgggattctaaatttgaagaatatcaaaaaaaatatccctctgaaggagccgaattaaaaagaatgttagagggtcaattacctgagaattgggactcagacctcccctcttattcgcctaatgataaaggtttagccacaagaaagcattcacaaatatgtttgggtgctctaggtcctaacctacctgaattaattggcggatcagcagatttaactcactctaattacacagatataaaaggagaaactggatcattccagccacatagccctgaaaaaagatatttacattttggtgtacgagagcatgcaatggcagctgtacttaatggtattgcctatcacaatagtggtcttatcccttatggtggaaccttccttgttttcgccgattatatgaggggctcaatgaggctttcagcacttagcgaattaggagtaatctatgtcttaacacatgattcaattggtgtaggagaagatgggccaacacatcaacctattgagactatcccttctcttcgcgcaatgcctaacatgctagttttcagacctggagatggcaacgagacgagtggggcttataagcttgctattcaaaatcgaaaaagaccttctgccctttgtttaagtagacaaggtatgccaaatcaagaaaatacttcgatagacaaagttgctctaggaggatatgtagtttccgattgtgaaggaacaccagacttaatatttattggtactggaagcgaactgaatctttgcattgaagcaagtaaggaactttcaagcttgggtaaaaaaattagagttgtctctatgccttgtgtagaactttttgaagagcaagaagaatcttataaagaaagtgttttacctagtagtgtgaaaaagagagttgtagtagaagcagctcattcatttggttggcataaatatacaggttttgatggtctttgtatcactatggataggtttggtgcatcagcaccaggtggagaatgtatgaaaaattttggatttacagtagaaaacgtagttaataagactaaggaaattctataa

SEQ ID NO: 9879 - protein, 668 aa, Prochlorococcus marinus str. AS9601
MVAASVSLESLCVNSIRMLAVDAVNKSNSGHPGLPMGCAPMGYALWQNILNHNPNNPKWFNRDRFVLSAGHGCMLLYSLLHLTGYKSVSIEDIKEFRQWGSKTPGHPETFETEGVEVTAGPLGAGISNAVGLAIAETHLAAKFNKPDCNIVDHYTYVIMGDGCNQEGIASEACSLAGHLKLGKLIALYDDNQITIDGRTDVSFTEDVLKRYEAYGWHVQHVEDGNHDVKGITEAIEKAKLITDKPSIIKISTTIGYGSPNKSDTAGIHGAAVGEEEAALTREFLNWEYPPFKIPDEVYTHFRKSINKGENLEQEWDSKFEEYQKKYPSEGAELKRMLEGQLPENWDSDLPSYSPNDKGLATRKHSQICLGALGPNLPELIGGSADLTHSNYTDIKGETGSFQPHSPEKRYLHFGVREHAMAAVLNGIAYHNSGLIPYGGTFLVFADYMRGSMRLSALSELGVIYVLTHDSIGVGEDGPTHQPIETIPSLRAMPNMLVFRPGDGNETSGAYKLAIQNRKRPSALCLSRQGMPNQENTSIDKVALGGYVVSDCEGTPDLIFIGTGSELNLCIEASKELSSLGKKIRVVSMPCVELFEEQEESYKESVLPSSVKKRVVVEAAHSFGWHKYTGFDGLCITMDRFGASAPGGECMKNFGFTVENVVNKTKEIL

SEQ ID NO: 9880 - DNA, 2007 bp, Prochlorococcus marinus str. MIT 9515
  CDS (1)..(2007): transl_table=11
atggtcgctgcatctgtttcattagaatctttatgtgtcaatagtataagaatgttagctgtagatgcagtaaataaatctaatagtgggcatcccggtttaccgatgggttgcgctcctatgggttatgcattatggcaaaatattcttaatcacaatcccaataatccaaagtggttcaatagagatcggtttgtattatctgcgggacatggatgtatgttgctttattccctattgcatctaactgggtataaatcagtttccattgaagatatcaaggaatttagacaatgggggtctaaaacacccgggcatccagaaacatttgagactgagggggttgaagtaacagcaggaccattaggtgcggggatttctaatgcagttggtttagcaattgctgaaacccacttagccgcaaaatttaacaagccagactgtgaaattgttgatcattacacttacgtcataatgggcgacggatgtaatcaggagggtattgcatcagaagcatgttcacttgctggacatcttaagcttggcaaattaattgctttgtatgatgataatcaaatcacaattgatggacgtacagatgtttcatttacagaagatgttttaaaaagatatgaagcgtatggatggcatgttcaacatgttgaagatggcaatcatgatgtacaaggaattaccaaagcgattgaaagtgctaaatctgtaaaagataaaccttctctaatcaaaatttctacaacgataggttatgggtctccaaataaatctgatactgcaggtattcatggcgctgctgtaggcgaagaagaagcttctttgactagagagtttttaaattgggaataccctccttttgaaatccctgatgaagtttatacccaattcagacaagctattacaaaaggtgaagaatctgagaaagaatggaatttaaaattcaagggttatcaaaattcatatccttctgaaggtaatgaattaaaaagaatgatacaaggtgatttaccagagaattgggactcagacctgccttcatatactccggacgataagggtttagcaacaagaaaacattctcaaatatgcttgggagctcttggccctaatctacctgaattaattggagggtctgctgatttaacacactcaaattacacagacataaaaggagaaacaggctcatttcaggcacattctccagaaaagagatatttacattttggtgtaagagagcatgccatggcagcaatattaaatggaattgcttatcacgacagtggactaataccttatggaggtacttttctcgtttttgcagattacatgagaggttcaatgagactttctgctctcagtgaacttggtgttatttatgtacttactcatgattcaattggagtaggcgaagatggtccaacacatcaacctgtcgaaaccattccttctcttagagcaatgccaaatatgctagtttttagaccaggagatggtaatgaaactagtggtgcttataagattgctattaaaaacagaaaaaggccttcagcactctgcttaagtagacaagccatgcctaatcaagagaacacctctattgaaaaagttgcattaggtggatacatagtttccgattgtgaagggactcctgaagtaatatttatcggtactggtagtgaactaaatttgtgcattgaggcaagtaaagaaatctcaaaatcagggacaaaaacaagagttatttcaatgccatgcgtagagctatttgaagagcaggatccctcttacaaagaaagtattttacctagcagtgtcaaaaaaagagttgtagttgaagcagcacattcattcggatggcataaatatactggacttgatggcatttgtataactatggatagatttggtgcctctgctcctggcggaaaatgtatgaccagtttcggatttacagttgaaaatgttataaataaaactagagaaattttatag

SEQ ID NO: 9881 - protein, 668 aa, Prochlorococcus marinus str. MIT 9515
MVAASVSLESLCVNSIRMLAVDAVNKSNSGHPGLPMGCAPMGYALWQNILNHNPNNPKWFNRDRFVLSAGHGCMLLYSLLHLTGYKSVSIEDIKEFRQWGSKTPGHPETFETEGVEVTAGPLGAGISNAVGLAIAETHLAAKFNKPDCEIVDHYTYVIMGDGCNQEGIASEACSLAGHLKLGKLIALYDDNQITIDGRTDVSFTEDVLKRYEAYGWHVQHVEDGNHDVQGITKAIESAKSVKDKPSLIKISTTIGYGSPNKSDTAGIHGAAVGEEEASLTREFLNWEYPPFEIPDEVYTQFRQAITKGEESEKEWNLKFKGYQNSYPSEGNELKRMIQGDLPENWDSDLPSYTPDDKGLATRKHSQICLGALGPNLPELIGGSADLTHSNYTDIKGETGSFQAHSPEKRYLHFGVREHAMAAILNGIAYHDSGLIPYGGTFLVFADYMRGSMRLSALSELGVIYVLTHDSIGVGEDGPTHQPVETIPSLRAMPNMLVFRPGDGNETSGAYKIAIKNRKRPSALCLSRQAMPNQENTSIEKVALGGYIVSDCEGTPEVIFIGTGSELNLCIEASKEISKSGTKTRVISMPCVELFEEQDPSYKESILPSSVKKRVVVEAAHSFGWHKYTGLDGICITMDRFGASAPGGKCMTSFGFTVENVINKTREIL

SEQ ID NO: 9882 - DNA, 2013 bp, Prochlorococcus marinus str. NATL1A
  CDS (1)..(2013): transl_table=11
atggttgccttgactacttccctagacacactttgcatcaacagcatcaggatgctcgctgttgatgcaattaataaatccaaaagtggtcacccaggtttacctatgggttgcgcacctatgggttatgcattatgggacaagcacttacgacacaatccaaaaaacccgaaatggtttaatcgagacagatttgttctttcagcgggacatggatgcatgcttttgtatgctctcttgcatttgactggctatgactctgtcaccattgaagatataaaagaatttagacagtggggagctaaaactccagggcatccagaaaccttcgaaactccgggagttgaagtaactgcaggacctttgggagcaggaatttcaaatgcagttggattagctattgcggaagctcaccttgctgcaaaattcaacaaacctgattcaacagttgtagaccattacacctatgtgatcatgggggatggatgtaatcaagaaggtatttcctcagaagcatgttctcttgctgggcatttaaaacttggaaaattaatagctctctatgacgataatcacataactattgatggaagaactgatgtctcatttacagaggatgtcttaaaaagatatgaagcatatggatggcatgtacaagaaattcctgaggggaatacagatgttgaaggcatatctcaagcaatcgaaaaggccaaatcagtcactgataagccatccatcatcaaagtaacaacaactatcggttacggttctccaaataaaagtgatactgcaggtattcacggcgccccattgggcgaagaagaggcagagctcactagaaaacaattaggttggtcatacaaacctttcgaggttccccaagatgcttatgatcaatatcgacaagccattcaaaaaggtgcacagctagaagaagagtggaatcaaagcctagctaaatacaaagaaaaatatcctaatgaagcaactcaatttgagcgcatgttgagaggtgagctccctgaaggctgggataaagatttacctacctatacatccgatgataaaggggttgctactagaaaacattctcaaatatgtctaggtgctcttggtccaaacatccctgaactaataggaggttctgctgatttaactcattcaaactacacagatataaaaggagaaactggatcttttcaatatgaaagtcctgaaaaacgttatttacattttggtgtcagagagcatgctatggcagccatattgaatggcattgcttatcacgacagtggtttaattccttatggtggaaccttcttagtcttcgcagattacatgagaggatcgatgcgtctttctgctcttagtgagcttggagttatttatgttttaacccatgattccataggtgttggtgaagatggcccaacacatcaacctatagaaaccatcccatcattgagagcaatgccaaatatgatggttttccgtcctggcgatggcaatgaaaccagtggtgcttataaagttgcaattaaaaatcgtaagagaccaagttccttatgcctaagtaggcagggtatggcaaatcaacaaaattcatccgtagacaaagttgctttaggtggatatgtacttgaggagtgcgatggcaccccagaactaatacttatcggaaccggaactgaacttgatttatgtgttcaagcagcgaaaaagttaactaaggaaggtcgaaaagtgcgtgttgtttctatgccatgcgttgaactttttgaagaacaaagcgatagttataaagaagaagttttgccttcaaatatcagaaaacgcctagtagttgaagccgcagagagtttcggatggcacaaatatattggtcttgatggtgacagcgtaactatgaatagctttggagcatctgctccaggtggattatgtatggaaaaatttggatttacagttgaaaacgtactagaaaaatctaaaagtctgctcaacaaataa

SEQ ID NO: 9883 - protein, 670 aa, Prochlorococcus marinus str. NATL1A
MVALTTSLDTLCINSIRMLAVDAINKSKSGHPGLPMGCAPMGYALWDKHLRHNPKNPKWFNRDRFVLSAGHGCMLLYALLHLTGYDSVTIEDIKEFRQWGAKTPGHPETFETPGVEVTAGPLGAGISNAVGLAIAEAHLAAKFNKPDSTVVDHYTYVIMGDGCNQEGISSEACSLAGHLKLGKLIALYDDNHITIDGRTDVSFTEDVLKRYEAYGWHVQEIPEGNTDVEGISQAIEKAKSVTDKPSIIKVTTTIGYGSPNKSDTAGIHGAPLGEEEAELTRKQLGWSYKPFEVPQDAYDQYRQAIQKGAQLEEEWNQSLAKYKEKYPNEATQFERMLRGELPEGWDKDLPTYTSDDKGVATRKHSQICLGALGPNIPELIGGSADLTHSNYTDIKGETGSFQYESPEKRYLHFGVREHAMAAILNGIAYHDSGLIPYGGTFLVFADYMRGSMRLSALSELGVIYVLTHDSIGVGEDGPTHQPIETIPSLRAMPNMMVFRPGDGNETSGAYKVAIKNRKRPSSLCLSRQGMANQQNSSVDKVALGGYVLEECDGTPELILIGTGTELDLCVQAAKKLTKEGRKVRVVSMPCVELFEEQSDSYKEEVLPSNIRKRLVVEAAESFGWHKYIGLDGDSVTMNSFGASAPGGLCMEKFGFTVENVLEKSKSLLNK

SEQ ID NO: 9884 - DNA, 2010 bp, Prochlorococcus marinus str. MIT 9303
  CDS (1)..(2010): transl_table=11
atggtcgctgcgactgcttccctagacacgctctgcatcaacagcattcgcatgctggccgtcgatgcggtcaacaaggccaacagcggccaccctggtcttcccatgggctgtgcccccatgggctacaccctctgggaccaatttctgcatcacaaccccaagaatcctcagtggttcaaccgcgaccgctttgtcctctcagccggtcacggctgcatgttggtttactcgctgttgcatctcaccgggtatgactcggtgagcatcgaggacatcaagcagttccgccaatggggctcccgcactcctggacatcccgaaacatttgaaacccctggggtcgaagtcaccgcaggcccccttggtgctgggatctctaatgccgttggccttgcgatcgctgaagctcaccttgcggccaaattcaataaacccgaagcaaagatcgttgatcacttcacctacgtggtgatgggcgatggctgcaaccaagaaggtatttcctctgaggcctgctcccttgccggccacctcaagctaggaaaactgatcgccctctacgacgacaaccacatcacgatcgacggccgcacagacgtttccttcaccgaagacgttctcaagcgctacgaggcctatggctggcatgtacaacatgtcgccaatggcgacaccgacgtgaatgccatcgccaaggcgatcgctgccgccaaggccgtgaccgataagccttcgattatcaaggtgaccaccaccattggttacggctcccctaacaaaagcgatactgccggcgtgcacggggccccccttggcgaagaagaagccactctcactcgccaacaactgggatggaactatggcccttttgaaattccccaagaggcctacgaccaataccgcaaggccatcgatcaaggcgctcgccttgaatctgagtggaatcaagcactcgccaactacagaagtcaatacccaaatgaagcagctgaattcgagcggatgttgcgcggtgagcttcccaaggggtgggacaaagatctaccgacctatacccctgaagacagtggcctcgcaacgcgtaagcactcccagatctgcctgggcgctctaggcccaaacctaccggaactcatcggcggctctgccgacctcactcactccaattacaccgatatcaaaggtgaaaccggctccttccaaccggaaacacccgaaaagcgttatctacatttcggtgtgcgcgagcacgccatggccgccatcctcaatggcatcgcttaccacaacagtggcctaatcccctacggcggaaccttcctagtttttgctgactacatgcgcggatcaatgcgcctttcagccttaagtgagcttggcgtgatctacgtactcacccatgactcaatcggtgtgggagaagacggcccgacccaccaaccggtcgaaaccattccctccctgcgcgccatgccaaacatgctggtgttccgtcccggagatggtaatgagaccagcggagcgtataaattagccatccagaatcgcaaacgccccagctctctttgcctgagccgtcagggcatggccaaccaagccaattcatccatcgaaaatgtcgctctcggcggctacgtactggaagattgcgaaggaacagctgatctgatccttatcggtacaggcacagagcttgacctttgcgtgcaagccgccaagcaactcagtgctgcaggccacaagattcgcgtggtctcgatgccttgcgtagaacttttcgaagaacagagcagcgcatacaaacaagaggtgctgccaaacgctgtacgcaagcgcatcgtggtggaagccgccgaatcatttggctggcacaagtacatcggcattgatggcgacagtgtgaccatgaacagctttggcgcttctgcaccaggtggcacatgcatggagaagtttggcttcaccgtagagaatgtggtagcgaagtcaaaagcgttgctgaattga

SEQ ID NO: 9885 - protein, 669 aa, Prochlorococcus marinus str. MIT 9303
MVAATASLDTLCINSIRMLAVDAVNKANSGHPGLPMGCAPMGYTLWDQFLHHNPKNPQWFNRDRFVLSAGHGCMLVYSLLHLTGYDSVSIEDIKQFRQWGSRTPGHPETFETPGVEVTAGPLGAGISNAVGLAIAEAHLAAKFNKPEAKIVDHFTYVVMGDGCNQEGISSEACSLAGHLKLGKLIALYDDNHITIDGRTDVSFTEDVLKRYEAYGWHVQHVANGDTDVNAIAKAIAAAKAVTDKPSIIKVTTTIGYGSPNKSDTAGVHGAPLGEEEATLTRQQLGWNYGPFEIPQEAYDQYRKAIDQGARLESEWNQALANYRSQYPNEAAEFERMLRGELPKGWDKDLPTYTPEDSGLATRKHSQICLGALGPNLPELIGGSADLTHSNYTDIKGETGSFQPETPEKRYLHFGVREHAMAAILNGIAYHNSGLIPYGGTFLVFADYMRGSMRLSALSELGVIYVLTHDSIGVGEDGPTHQPVETIPSLRAMPNMLVFRPGDGNETSGAYKLAIQNRKRPSSLCLSRQGMANQANSSIENVALGGYVLEDCEGTADLILIGTGTELDLCVQAAKQLSAAGHKIRVVSMPCVELFEEQSSAYKQEVLPNAVRKRIVVEAAESFGWHKYIGIDGDSVTMNSFGASAPGGTCMEKFGFTVENVVAKSKALLN

SEQ ID NO: 9886 - DNA, 2007 bp, Prochlorococcus marinus str. MIT 9301
  CDS (1)..(2007): transl_table=11
atggtcgctgcatctgtttcattagaatcactttgtgtaaatagtataagaatgcttgctgtagatgcagtaaataaatctaatagtggtcatcctggtttgccaatgggatgtgctcctatgggttatgcattatggcaaaacatacttaatcacaaccctaataacccaaaatggttcaacagagaccgttttgtattatcagctggtcatggctgtatgctgttatattccttacttcatttgacaggatataaatcagtctcaatagacgatattaaagaatttaggcaatggggatcaaagactcctgggcatccagaaacattcgaaactgaaggtgttgaagttacagcagggcctcttggagccggaatttcaaatgcagttggtttagcaatagctgaaactcacttggcagctaaatttaataagcctgattgtaagatcgttgatcactatacttacgtcataatgggtgacggctgtaatcaagaaggcatcgcatctgaggcctgctcactagctggtcaccttaagcttggaaaattaattgcactctatgacgataatcaaattacaattgatgggcgaaccgatgtttcttttactgaagatgtattaaaaagatacgaagcttatggatggcatgtacaacatgtggaagatgggaatcatgatgttaaaggaataactgaagctatcgaaaaagcaaaattaatcacagacaaaccttcaattataaaaatttctacaacaataggttatggttcgcctaataaatcagatactgctggaattcatggagcagctgttggagaagaagaagctgctttaactagagagtttctaaattgggaatatcctccatttgaaataccagatgaagtatatgcccattttagaaaatcaatagacaaaggaggaagcctagagaaagaatgggattctaaatttgaagaatatcaaagcaaatatccttctgaaggagccgagttaaacagaatgttgaaaggacaattacctgagaattgggactcagatctcccttcttatacaccagaagataagggtttagcaaccagaaagcattcgcaaatatgtctgggtgctctaggtcctaacctacccgaattaattggtggttcagcagatttaactcactccaactacacagatatcaagggagaatccgggtcattccagcctcatagtcctgaaaaaagatatttgcactttggtgtgcgagagcatgcaatggcagctgtacttaatggaattgcctatcacaatagtggtcttattccttatggtggaaccttccttgttttcgctgattatatgagaggttcaatgagactttcggcactaagcgaactaggagtgatctatgtattaacccatgattcaattggtgtaggagaagacggcccaacacatcaacctattgaaactatcccttctcttcgtgctatgcctaacatgctagttttcagaccaggagatggaaatgagacaagtggtgcttataagcttgctattcaaaatcgaaaaagaccttctgccctttgtttaagtagacaaggaatgccaaatcaagaaaacacttcgatcgacaaagttgctcttggaggatacgtagtttccgattgcgaaggaacaccagatctaatatttattggtactggaagcgaactgaatctttgcattgaagcaagtaaggaaatttcaagcttagggaaaaaggttagagttgtttctatgccatgtgtagaacttttcgaagagcaagaagattcttacaaagaaagtgttttaccaagtagtgtgaaaaagagagttgtggtagaagctgcccattcatttggttggcataaatatacaggttttgatggaatttgtattactatggataggtttggtgcatcagcaccaggtggagaatgtatgaaaaattttggatttacagtcgaaaacgtagttaataagacgaaggaaattctataa

SEQ ID NO: 9887 - protein, 668 aa, Prochlorococcus marinus str. MIT 9301
MVAASVSLESLCVNSIRMLAVDAVNKSNSGHPGLPMGCAPMGYALWQNILNHNPNNPKWFNRDRFVLSAGHGCMLLYSLLHLTGYKSVSIDDIKEFRQWGSKTPGHPETFETEGVEVTAGPLGAGISNAVGLAIAETHLAAKFNKPDCKIVDHYTYVIMGDGCNQEGIASEACSLAGHLKLGKLIALYDDNQITIDGRTDVSFTEDVLKRYEAYGWHVQHVEDGNHDVKGITEAIEKAKLITDKPSIIKISTTIGYGSPNKSDTAGIHGAAVGEEEAALTREFLNWEYPPFEIPDEVYAHFRKSIDKGGSLEKEWDSKFEEYQSKYPSEGAELNRMLKGQLPENWDSDLPSYTPEDKGLATRKHSQICLGALGPNLPELIGGSADLTHSNYTDIKGESGSFQPHSPEKRYLHFGVREHAMAAVLNGIAYHNSGLIPYGGTFLVFADYMRGSMRLSALSELGVIYVLTHDSIGVGEDGPTHQPIETIPSLRAMPNMLVFRPGDGNETSGAYKLAIQNRKRPSALCLSRQGMPNQENTSIDKVALGGYVVSDCEGTPDLIFIGTGSELNLCIEASKEISSLGKKVRVVSMPCVELFEEQEDSYKESVLPSSVKKRVVVEAAHSFGWHKYTGFDGICITMDRFGASAPGGECMKNFGFTVENVVNKTKEIL

SEQ ID NO: 9888 - DNA, 2007 bp, Herminiimonas arsenicoxydans
  CDS (1)..(2007): transl_table=11
atgactttcacgctcccgactaccaaaatggccaacgcaatccgtgcgctggcaatggatgcagtacaaaaggccaattccggacaccccggcgcgccaatggggatggcagatattgccgtcgctttgtggtcgaatcactattcgcacaatccggccaatcctaaatggattaaccgcgaccgctttgtcttgtcgaacggtcacggttcgatgctgcattacgcgctcctgcatctgaccggttacgacctgtcgatggacgagatccgcaacttccgtcaaatgcactctaagacgcccggtcatccggaagtcgatatcaccccaggcatagaaaccacgaccggtcctctgggccagggcattaccaatgcggtcggcatggcgctggctgaaaagctgctcgcggccgaattcaatcgcccgaatttcaacgttgtcgatcatcacacttacgtcttcctcggtgacggctgcctgatggaaggcatttcgcacgaagcctgttcgctggccggcacgctgcgcctgcccaagctaatcgcgttttacgacgataacggcatttcgatcgacggtcatgttgaaggctggttccaggacgatacgccgaagcgttttgaagcttacggctggaacgtggtacgcgccatcgacggccacgatgtcaatgcagtcgatgcagcgatcaagcaggcgaaagcatccgacaagccaaccctgatctgctgcaaaaccgtgatcggcaaaggttcaccgaatatggccggcacgcacaatgtgcacggcgccgctctgggtgacaaggaaatcgcggccacccgcgccgctatcggctggggatatgcgccgtttgaagtgcctgccgatgtgtatgccgcatgggatgccaaggccaaaggtgcagcgcaagaatccgcatggaacacattgcagcaggcttacgcagcgcaatacccggaactggcaagcgaattgacacgccgcatgagcggtgaattgccggcgaatctggagcagactgtcgctgcttatatcgcgacttgcgtagagaaaaaggaaaccatcgctacgcgcaaagccagccagaacgcgattcaggccctggcgccggtgttgccggaattcctgggcggttcggccgacctgaccggctccaacctgaccaactggaaagagtgcgtcgccgtgcgcgccgaccagtggggcaaccacatcaactacggtgtgcgcgaattcggcatgagcgcgatcatgaacggtatcgccctgcatggcggccacatcccgttcggcgccaccttcctgacgttctccgattacagccgtaatgccttgcgcatggcggcgctgatgaagctgcgttcgatttttgtattcacccacgattcgatcggcctcggcgaagacggtcctacccatcaatcggtggaacatgtttcgagcctgcgcctgattccgaatctggataactggcgtccgtgcgataccgttgaatcggcagtggcgtgggaacaggcggtcaaacgtcacaatggcccgacgacgctgatcttctcgcgtcagaacctgccgttccaggaacgaagcgcagaacagatagccaacatcaaacgcggcggctacgtattgcgcgatgcgcctaacgctcaagtcatcctgatcgccaccggttcggaaatcgaactggctgtcaaatccgccgacgagctggcgcaacacggtatggcggtgcgtatcgtctcgatgccatcgaccgacgtattcgatcgtcaggacgccgcttacaaggctgccgtgctgaccaaaggcgtgccgcgcgtggcgatagaagctggtgtgaccgacttctggcacaagtatgtcggtctggaaggcgccgtcatcggtattgacaccttcggcgaatcggcgccggccggcgtgttgttcaagcatttcggcttcacggtcgagaacgtcgttgccgctgccaaaaacgtcgttcaaagcgcgcaggcgtga

SEQ ID NO: 9889 - protein, 668 aa, Herminiimonas arsenicoxydans
MTFTLPTTKMANAIRALAMDAVQKANSGHPGAPMGMADIAVALWSNHYSHNPANPKWINRDRFVLSNGHGSMLHYALLHLTGYDLSMDEIRNFRQMHSKTPGHPEVDITPGIETTTGPLGQGITNAVGMALAEKLLAAEFNRPNFNVVDHHTYVFLGDGCLMEGISHEACSLAGTLRLPKLIAFYDDNGISIDGHVEGWFQDDTPKRFEAYGWNVVRAIDGHDVNAVDAAIKQAKASDKPTLICCKTVIGKGSPNMAGTHNVHGAALGDKEIAATRAAIGWGYAPFEVPADVYAAWDAKAKGAAQESAWNTLQQAYAAQYPELASELTRRMSGELPANLEQTVAAYIATCVEKKETIATRKASQNAIQALAPVLPEFLGGSADLTGSNLTNWKECVAVRADQWGNHINYGVREFGMSAIMNGIALHGGHIPFGATFLTFSDYSRNALRMAALMKLRSIFVFTHDSIGLGEDGPTHQSVEHVSSLRLIPNLDNWRPCDTVESAVAWEQAVKRHNGPTTLIFSRQNLPFQERSAEQIANIKRGGYVLRDAPNAQVILIATGSEIELAVKSADELAQHGMAVRIVSMPSTDVFDRQDAAYKAAVLTKGVPRVAIEAGVTDFWHKYVGLEGAVIGIDTFGESAPAGVLFKHFGFTVENVVAAAKNVVQSAQA

SEQ ID NO: 9890 - DNA, 2073 bp, Burkholderia vietnamiensis G4
  CDS (1)..(2073): transl_table=11
atgccgccgtgctcccgtttcctcgactcgttctccggactcgacatgacgacttcgtctcccgcctctaccactttgatggccaacgcgatccgtgcgctcgcgatggacgccgtccagcaagcgaactccggccaccccggcatgccgatgggcatggccgaaatcggcgtggcgctgtggtcgcgtcacctcaagcacaacccgacgaacccgcattgggcagaccgcgaccgtttcgtgctgtcgaacggtcatggctcgatgctgctgtactcgctgctgcacctgaccggctacgacctgccgatcgaagagctgaagaacttccgccagctgcactccaagacgccgggccatccggaatacggcatcacgccgggcgtcgagacgaccaccggcccgctcggccagggtctcgcgaacgccgtcgggatggcgctcggcgaagcgctgatggccgacgagttcaaccgtgacggcgcgaagatcgtcgaccaccacacctacgtgttcctcggcgacggctgcctgatggaaggcatctcgcacgaagcctgctcgctggccggcacgctgaagctgaacaagctgatcgcgctgtacgacgacaacggcatctcgatcgacggcgacgtcgtcaactggttccatgacgacacgccgaagcgcttcgaggcgtacggctggaacgtgatcccgaacgtgaacggccacgacgtcgacgcggtcgacgccgcgatcgcgaaggccaagctgtcggacaagccgacgctgatctgctgcaagacggtgatcggcaagggcgcggccaccaaggcgggcggccacgacgtgcacggcgcggcgctcggcgcggaagaaatcgcgaagacgcgcgcagccctcggctggacctgggagccgttcgtgattccgcaggaagtctatgcggcatgggacgcgaaggacgccggccagcgcgccgaagcggcttggagcgacacgttcgcgcagtaccgcgcgaagtacccggccgaagcagccgaattcgagcgccggatggccaacaagctgccggccgactgggccgagaaggctgcagcgatcgtcgccggcgcgaaccagcgcggcgagacggtcgcgacccgcaaggcgtcgcagcaggcgatcgaagggctcgccgcggtgctgccggaactgctcggcggctcggccgacctgaccggctcgaacctgaccaactggaaggcgtcgaaggcggtgcgcgcgaatccggaaggcgcgggcgtcgtgctcggcaaccacatcaactacggcgtgcgcgaattcggcatgagcgccgcgatcaacggcctcgcgctgcacggcggccacaagccgttcggcggcacgttcctgacgttctccgactacagccgcaacgcgctgcgcgtcgcgtcgctgatgaaggtgccgtcgatcttcgtgttcacgcacgactcgatcggcctcggcgaagacggcccgacgcaccagtcgatcgaacacgtatcgagcctgcgcctgatcccgaaccacgacgtgtggcgtccggccgacacggtcgagacggccgtcgcatggacccacgcggttgccgccgaccgtccgtcgagcctgatcttcagccgccagaacctcgcgttcaactcgcgtaccgatgcgcagatcgcgaacatcgagaagggcggctacgtgctgaaggactgggacgacgagatcgtcgcgcgcaagatcatcctgatcgcgacgggctccgaagtcgaactcgcgatgaaggccgtcgagccgctcgcgcagcagggcatcgcggcgcgcgtcgtgtcgatgccgtcgaccaacgtgttcgaccgccaggacgccgagtaccgcgagcgcgtgctgccgcacggcgtgcgccgcgttgcgatcgaagcgggcgtgaccggcttctggcacaagtacgtcggcctcgaaggcggcgtcgtcgggatcgacacgttcggcgaatcggcgccggccggcgtgctgttcaagtacttcggcttcaccgtcgagcacgtgatcgagacggcgaaggccgtgctggcctaa

SEQ ID NO: 9891 - protein, 690 aa, Burkholderia vietnamiensis G4
MPPCSRFLDSFSGLDMTTSSPASTTLMANAIRALAMDAVQQANSGHPGMPMGMAEIGVALWSRHLKHNPTNPHWADRDRFVLSNGHGSMLLYSLLHLTGYDLPIEELKNFRQLHSKTPGHPEYGITPGVETTTGPLGQGLANAVGMALGEALMADEFNRDGAKIVDHHTYVFLGDGCLMEGISHEACSLAGTLKLNKLIALYDDNGISIDGDVVNWFHDDTPKRFEAYGWNVIPNVNGHDVDAVDAAIAKAKLSDKPTLICCKTVIGKGAATKAGGHDVHGAALGAEEIAKTRAALGWTWEPFVIPQEVYAAWDAKDAGQRAEAAWSDTFAQYRAKYPAEAAEFERRMANKLPADWAEKAAAIVAGANQRGETVATRKASQQAIEGLAAVLPELLGGSADLTGSNLTNWKASKAVRANPEGAGVVLGNHINYGVREFGMSAAINGLALHGGHKPFGGTFLTFSDYSRNALRVASLMKVPSIFVFTHDSIGLGEDGPTHQSIEHVSSLRLIPNHDVWRPADTVETAVAWTHAVAADRPSSLIFSRQNLAFNSRTDAQIANIEKGGYVLKDWDDEIVARKIILIATGSEVELAMKAVEPLAQQGIAARVVSMPSTNVFDRQDAEYRERVLPHGVRRVAIEAGVTGFWHKYVGLEGGVVGIDTFGESAPAGVLFKYFGFTVEHVIETAKAVLA

SEQ ID NO: 9892 - DNA, 1986 bp, Bradyrhizobium sp. ORS278
  CDS (1)..(1986): transl_table=11
atgacgcaggtcgatcattcccgcatggccaacgccatccgcgcgctcgcaatggacgccgtcgaaaaggcgaaatccggccatccgggcctgccgatgggcgccgccgacgtcgccaccgtgctgttcacccgcgtgctgaaatatgatgcggccgtgcccgcctggcccgaccgcgaccgcttcgtgctgtccgccggccacggctcgatgctgctctacgcgctgctgtatctgaccggcaacgaggagatgacgctcgaccagatcaagcgcttccgccaggtcgattcgctgacccccggccatccggagaatttccgcaccaagggcatcgagaccaccaccggcccgctcggccagggcatttccaccgcggtcggcatggcgctggccgaaaagatgctgcaggcggagtacggcaagaagatcgtcgaccatcacacctatgtgctggcctccgacggcgacctgatggagggcatctcccaggaagcgatcgcgatggccgggcactggaagctcaacaagctgatcgtgctgtgggatgacaacggcatctcgatcgacggcccgctgtcgatcgccgattcggtcgaccaggtgaagcgcttcaaggcgtgcggctgggccgccgagctgatcgacggccatgatcccgaggcgatcgccgcggcgatcgcgcgggcgcagaagtcgagccggccgtcgctgatcgcctgcaagaccacgatcggctacggcgcgccgaccaaggctggcacctccaaggtgcatggcgaggcgctcggcgcggaggagctgaagggcgcgaaggagaagctcggcatttcccaggagccgttctcggtgcccgatgacgtgctcgcggcctggcgcgaggccggccgccgcggcgcgccggcgcgcgccgaatgggagacccggctcggcgagatgggcccgcgcaagcgcgcggagttcgagcgccggctgcgccacgagcggcccgcggcgctggcaaaggcgctgaaggaccacaagaaggcgctgctggagaacccgctgaacatcgccacgcgcaaatcgtcggaagccgcgatcgaggtgattgcagctgcgatgcctttcgagttcgtcgctggctcggccgatctcaccggctccaacaacaacaaggcgaagtcggccacctcgttctcggccaagacgccgaagggccgcttcatccattacggcatccgcgagcacggcatggccgctgccatgaacggcatcttcctgcatggcggcttcgcgccgaacggcgccacattcctggtgttctcggactacgcgcgcggcgcaatgcggctgtcggcgctgatgggcgccggcgtggtctatgtgatgacccacgattcgatcggcctcggcgaggacggcccgacgcaccagccggtcgagcatctcgccgcacttcgcgcgatcccgaacatgcgcgtgttccgcccggccgacgcggtcgagaccgccgaatgctgggagctggcgctcaaccgcaccaacggcccgaccgtgctggcgctgacgcggcagaacctcccgcagctgcgcacctcagcaccggcggacaatccctgcagccatggcggctacgagctggtagcggcgcagggcgacgccaaggtctcgctgttcgccaccggctcggaggtcgagatcgcggtcgccgcgcagaagcagcttgccgagcgcggcatccccgcgcgcgtcgtctcggtcccctcgctggagctgctgctggagcagccagccgaggccaaggccaagatcatcggccacgcgccggtcaagatcgccatcgaggccgcggtgcgctggggctgggacgcggtgatcggcaccgacggcatcttcatcggcatgcattcgttcggcgagagcggcccctacaaggagctgtacaagcatttcggcatcaccgcggaagcggcggtggaagcggcggtgaagcggctggggtga

SEQ ID NO: 9893 - protein, 661 aa, Bradyrhizobium sp. ORS278
MTQVDHSRMANAIRALAMDAVEKAKSGHPGLPMGAADVATVLFTRVLKYDAAVPAWPDRDRFVLSAGHGSMLLYALLYLTGNEEMTLDQIKRFRQVDSLTPGHPENFRTKGIETTTGPLGQGISTAVGMALAEKMLQAEYGKKIVDHHTYVLASDGDLMEGISQEAIAMAGHWKLNKLIVLWDDNGISIDGPLSIADSVDQVKRFKACGWAAELIDGHDPEAIAAAIARAQKSSRPSLIACKTTIGYGAPTKAGTSKVHGEALGAEELKGAKEKLGISQEPFSVPDDVLAAWREAGRRGAPARAEWETRLGEMGPRKRAEFERRLRHERPAALAKALKDHKKALLENPLNIATRKSSEAAIEVIAAAMPFEFVAGSADLTGSNNNKAKSATSFSAKTPKGRFIHYGIREHGMAAAMNGIFLHGGFAPNGATFLVFSDYARGAMRLSALMGAGVVYVMTHDSIGLGEDGPTHQPVEHLAALRAIPNMRVFRPADAVETAECWELALNRTNGPTVLALTRQNLPQLRTSAPADNPCSHGGYELVAAQGDAKVSLFATGSEVEIAVAAQKQLAERGIPARVVSVPSLELLLEQPAEAKAKIIGHAPVKIAIEAAVRWGWDAVIGTDGIFIGMHSFGESGPYKELYKHFGITAEAAVEAAVKRLG

SEQ ID NO: 9894 - DNA, 2013 bp, Bradyrhizobium sp. ORS278
  CDS (1)..(2013): transl_table=11
gtgcaaaaggcagccgccaaagttgatccggcccacgccgaaatggcgaacgcgatccgcttcctggccatcgatgccgtggagaaggcgaagtcgggtcaccccggcatgccgatgggcatggccgacgtcgcgaccgtgctgttctcccgcttcatgaagttcgatccggccgaccccgcctggcccgatcgcgaccgcttcgtgctgtcggccggccacggatcgatgctgctctacgcgctgctgcatctcacgggctatgaggcggtcacgatcgacgaaatcaaggcgttccggcaatggggcgccaagacgccggggcatccggaatatggtcacacgccgggcgtcgaaacgaccacggggccgctggggcagggcatcgcgacagccgttggcatggcgctcgccgagcgcctgatgaacgcgcgctatggcgacgaattggtcgatcactacacttatgtcatcgccggcgatggttgcctgatggagggcatcagccatgaggcgatctcgcttgccggccatctccggctcaaccgactgatcgtgctgttcgacgacaacggcatctcgatcgacggctcgaccgggctcgcgtgttccgacgatcagcccgcgcgtttcgccgcctcgggctgggcgaccagccgcatcgacggccatgatccccaggcgatcgaagccgccatcgccgccgcgcggcagagcgaccgcccgagcatgatcgcgtgccgcaccacgatcggcttcggctcgccgggacggcagggctcggagaaggcgcatggcgcgccgctcgggccggaggaggtcgacaagacccgcgccgcgctgcactggccgcaccggccgttcgaagttccggccgatgttctggtcagctggcgcgagatcggcgcgcgtggccgcagcgtccgccaggcctggaaggagcgcgcgcgcaagctcggcacggccgaccgctcgccctgtcacgatgcgctgaacaagaaactgccggcggcctacatcgagcgcatggcgcaattcatcgcgcagttgacggttgagaagccgaagatcgccacgcgtcaggcgtcgcagaacgtcatcgacgtgatcgcgacggtgctgccgaatttgctcggcggctcggcggacctgacccactccaacctgaccaaggcgaagacgcacaaatcagtgacgccgtcgagcatggacggcaactacgtccattacggtgtgcgcgagcacgcgatggccgcggccatgaacggcgtcgcgctgcatggcggcttcattccctatggcggcaccttcctggcgtttgccgactacaaccggccggccatccgtctcgccgcgctgatgggcatccgcgtcattcacgtgatgacgcacgactccattggtctcggcgaggatggcccgacgcaccagccagtcgagcatgtcccgagcctgcgcgccattcccaatctcctggtgtttcgtccggccgatgccgtcgagaccgcggaagcctgggattgtgcgctccgggccgagacgtcgccatccgtgctgtgcctgtcacgtcaggcgctgccggccttccgcaccgaggcctcggatcacaacaaggtggcgctcggcgcctatgttgtggtcgagccggatggcggccgtaacgtcacgttgatcgcgaccgggtcggaagtggcgattgcactggaggcggcaaagctgctggcggcggagaatgtccgcgcggccgtggtgtcggcaccttgcttcgaactgttccgcaagcaaagcgcggagtatcgcgcggacgtgctcggcagcgcgccgcggatcggcgtcgaggccgccatcgagggcgagtgggcgcgctggctcggcgatgccggtgagttcgtcggcatgcacggcttcggcgcctccgcgccggccgatgtgctgtaccgcgagttcggcatcacgccggcagccgtcgtggacgccgccaagcgcaacatcacccggtcgcgcgcgtcctga

SEQ ID NO: 9895 - protein, 670 aa, Bradyrhizobium sp. ORS278
MQKAAAKVDPAHAEMANAIRFLAIDAVEKAKSGHPGMPMGMADVATVLFSRFMKFDPADPAWPDRDRFVLSAGHGSMLLYALLHLTGYEAVTIDEIKAFRQWGAKTPGHPEYGHTPGVETTTGPLGQGIATAVGMALAERLMNARYGDELVDHYTYVIAGDGCLMEGISHEAISLAGHLRLNRLIVLFDDNGISIDGSTGLACSDDQPARFAASGWATSRIDGHDPQAIEAAIAAARQSDRPSMIACRTTIGFGSPGRQGSEKAHGAPLGPEEVDKTRAALHWPHRPFEVPADVLVSWREIGARGRSVRQAWKERARKLGTADRSPCHDALNKKLPAAYIERMAQFIAQLTVEKPKIATRQASQNVIDVIATVLPNLLGGSADLTHSNLTKAKTHKSVTPSSMDGNYVHYGVREHAMAAAMNGVALHGGFIPYGGTFLAFADYNRPAIRLAALMGIRVIHVMTHDSIGLGEDGPTHQPVEHVPSLRAIPNLLVFRPADAVETAEAWDCALRAETSPSVLCLSRQALPAFRTEASDHNKVALGAYVVVEPDGGRNVTLIATGSEVAIALEAAKLLAAENVRAAVVSAPCFELFRKQSAEYRADVLGSAPRIGVEAAIEGEWARWLGDAGEFVGMHGFGASAPADVLYREFGITPAAVVDAAKRNITRSRAS

SEQ ID NO: 9896 - DNA, 2001 bp, Dichelobacter nodosus VCS1703A
  CDS (1)..(2001): transl_table=11
atgaatcaatctgtttttcatgatattgccaacactattcgcgcgctgacacttgatgcggtagacaaagcgcattccggacattgcggcgcgccgttaggtatggcagaaattgcggcagttttatggcaaaaacatctcaatgtgaatccgcaacacccgaattgggataatcgcgatcggtttgtgttgtcaaacggtcacgcttcgatgttgttatacgcgctgctgcatttaagcggttttgatttatcgttggaagatttgaaaaatttccgcacgtggcacagcaaaaccgccggtcacccagaagttgatcacaatttaggtattgaaacgaccactggtccactcgggcaaggtattgctaatgccgttggtttggcactcgcggaagcgcgtttggcagcgcaatataatcgagaacattttaatatcgttgatcattacacttattgctttttaggcgatggctgtttgatggaaggcattgcgcacgaagcgtgctcattggctggaacgctcggtttgggcaaactgatcattttttacgatgctaacggcatttctattgacggcaacattgatgcgtggtttgcagaagacgtcgcgcaacgttttgctgcttacggttggcaggtaatcggtgccatcgatggtcacgatccccaagctatcgatgccgcaattactgccgcgcaaagagaaaccacgcgccccagcattatcatttgtcacaccacaattggttttggttcgccgaaattcgccggcagtgaacaagctcacggttcgccttttgatcaaaatgaaattgaagcgactaaaaaagcgttatcactaccgcttgagccgtttagcgttgcggaagcggtttatcgccacgcggatttacgcgcaaaaggcgcggctttggaaaaatcatggcaagaaaaattaacacattatgcgcaaacgtatccagaactttttaaacaatatcaacgctgtatgcgtcacgaattgccggaaacgtttagcaaaaccattcatcaacaattgcaattttggcaaaatgctgacgaaaaaatcgcaagccgcaaagcttctgaaaacgcgctgacggttttaacacctttattgcccgaattaatcggcggttcggcggatttgagttcgtctaataatacgatttgtgcggaaagtcgcgcgatttatccgcggcaatttaacggcaattatattcattacggcgtgcgcgaatttgcgatggcggcgatgatgaacggcttatatttgcacggcggtttgcgtccgtacggcggcactttcctcgttttttcggattatatgcgcaacgccattcgtttatcggctttgatgcgcctgccagtgatttatgttttaacgcacgattccatcggtttgggcgaagacggtcccacgcatcaaccaattgaacaattagcctctttgcggttaatgcccaatttgcatgtatggcgcccttgtgatgccgttgaaacgcttgccgcgtggcaatcggctttaaccgctgaagaaacgccgagcgttttggcattatcacggcaagcattggtaccgcaaaaacgcacgcccgaacaaattgctgcaattgcgcgcggcggctatgttttgcacgaaaacgcttccgctgttttaacgttgattgcgaccggttctgaagtggaattagcgatgaacgcggcgcgtcaattagccgcggaacagattattgcgcgcgtggtttccatgccgtgcgttgaaatttttcaaaagcaatccgatgattaccgcgaaagtgttttgccaaatcatttgcctaaattggcaattgaagcgggtgccaccgcattatggcaaggaatggttgcgccgacgggtgccgttatcggcattgattgttttggggcttcggcgccggcgtcggtattatttacgcagtttggtttgacgactgaagccgtcgttcaacgcgcaaaaagtttattaattatttaa

SEQ ID NO: 9897 - protein, 666 aa, Dichelobacter nodosus VCS1703A
MNQSVFHDIANTIRALTLDAVDKAHSGHCGAPLGMAEIAAVLWQKHLNVNPQHPNWDNRDRFVLSNGHASMLLYALLHLSGFDLSLEDLKNFRTWHSKTAGHPEVDHNLGIETTTGPLGQGIANAVGLALAEARLAAQYNREHFNIVDHYTYCFLGDGCLMEGIAHEACSLAGTLGLGKLIIFYDANGISIDGNIDAWFAEDVAQRFAAYGWQVIGAIDGHDPQAIDAAITAAQRETTRPSIIICHTTIGFGSPKFAGSEQAHGSPFDQNEIEATKKALSLPLEPFSVAEAVYRHADLRAKGAALEKSWQEKLTHYAQTYPELFKQYQRCMRHELPETFSKTIHQQLQFWQNADEKIASRKASENALTVLTPLLPELIGGSADLSSSNNTICAESRAIYPRQFNGNYIHYGVREFAMAAMMNGLYLHGGLRPYGGTFLVFSDYMRNAIRLSALMRLPVIYVLTHDSIGLGEDGPTHQPIEQLASLRLMPNLHVWRPCDAVETLAAWQSALTAEETPSVLALSRQALVPQKRTPEQIAAIARGGYVLHENASAVLTLIATGSEVELAMNAARQLAAEQIIARVVSMPCVEIFQKQSDDYRESVLPNHLPKLAIEAGATALWQGMVAPTGAVIGIDCFGASAPASVLFTQFGLTTEAVVQRAKSLLII

SEQ ID NO: 9898 - DNA, 2001 bp, Dehalococcoides sp. BAV1
  CDS (1)..(2001): transl_table=11
atgtcaaatacgaaattagatagtttatgcataaacgcccttcgctttctttcggtagacgctgttcagaaggcaaattcggggcatcccggagcgcctatgggtatggccgctatggcatatgccctgtggcaaaattttctcaagcataacccgcaggaccccgcttggcctaaccgtgaccgttttatactttcagccggccatgcctctgccctgctttattcactactccacctgaccggttatgacctgccgctggacgaacttaaaaatttccgccagtggggcagtaaaacaccgggacatccggaatacggcctgactcccggggttgaaatgactaccggcccgcttgggcagggttttgcaagcggtgtgggtatggctatggccgaagctcatttggcagcggtttttaaccagccggattgcaaaattatagaccattatacctacggcatagtctctgacggagacctgatggaaggcgtagcttcagaagcggcctctctggccgggcatttagcccttggcaagctgatttatctgtatgatgacaatgatatatctattgaaggttcaaccgagctggcttttaccgaaaacgcagctctgcgctttgaaagttacggctggcaggttatagaccatgtagacgggcttgacccggaggcggtatctcaggctattaaacaagcccagtcagataccacccgccccagcctgattatctgcaaaacaatcatcggctttggtagcccgaataaggccggcaaggcctctgcccatggcgagccgctgggaacagatgaggtatccaagagccgtaaatctctggggtgggactatgaaccgtttgtaataccagttgaggctctaacagagttccgcgaagcactgggcaagggcaaaacagcccagcaggtttggttgtccaagctggactactatttaagccattatcccgaaaaagcctccctgctgcaggacatgctttcgggcaacttacctgaagactgggacaaagatctggatagactctttgacaaagctatggccagccgcgaggcttcaggcctgctgataaatgccttggcttcccgcctgccttctctcatgggtggttcggcagacctcagcccgtctaacaagaccgttatcaaagacggcggggaatacgaacctcactattacgagggacggaatatccatttcggagtgagggagcacgccatgggggcaatagctaacggactggctctccacgggggcataataccttacgttgccactttcctcatattttatgactacatgcgtccggctgtacggttggcttcacttatggggcaaagagtgatttatatttttacccatgattccatcggtctgggagaagacggccctacccaccaacccattgaacagctggccggtctgcgttcggtacccggtctggttactatccgtccggcagattcatatgagactgctcaggcatggaaaacggctatactccgtaagaacggccctaccgccattgccctgtcccgtcagaaactgccgcttttagataactctcagacaaaatccttaaacctgcctaaaggggcatatatactgcaggaaacagactcccacccgcaggtagctctagttgccagcgggtctgaagtaactatagcggttgaagcggctgaaatacttaaggggaaaggcatatcctcaagggtagtatctttcccttcatggcagctttttgataaccaaccccaaacctaccgccagagtgtcctgccttcttccctgccacgggtaataatggaagctggcaactcacagggctggtgcaaatatctgggtacaaacggaactgttatttcaattgaccacttcggggcatcagccccggcgcccctgctttacaaaaaattcggcctgacccctgaaaacatggctgaaaaagctttaaagcttttggagaatgaacatgagtaa

SEQ ID NO: 9899 - protein, 666 aa, Dehalococcoides sp. BAV1
MSNTKLDSLCINALRFLSVDAVQKANSGHPGAPMGMAAMAYALWQNFLKHNPQDPAWPNRDRFILSAGHASALLYSLLHLTGYDLPLDELKNFRQWGSKTPGHPEYGLTPGVEMTTGPLGQGFASGVGMAMAEAHLAAVFNQPDCKIIDHYTYGIVSDGDLMEGVASEAASLAGHLALGKLIYLYDDNDISIEGSTELAFTENAALRFESYGWQVIDHVDGLDPEAVSQAIKQAQSDTTRPSLIICKTIIGFGSPNKAGKASAHGEPLGTDEVSKSRKSLGWDYEPFVIPVEALTEFREALGKGKTAQQVWLSKLDYYLSHYPEKASLLQDMLSGNLPEDWDKDLDRLFDKAMASREASGLLINALASRLPSLMGGSADLSPSNKTVIKDGGEYEPHYYEGRNIHFGVREHAMGAIANGLALHGGIIPYVATFLIFYDYMRPAVRLASLMGQRVIYIFTHDSIGLGEDGPTHQPIEQLAGLRSVPGLVTIRPADSYETAQAWKTAILRKNGPTAIALSRQKLPLLDNSQTKSLNLPKGAYILQETDSHPQVALVASGSEVTIAVEAAEILKGKGISSRVVSFPSWQLFDNQPQTYRQSVLPSSLPRVIMEAGNSQGWCKYLGTNGTVISIDHFGASAPAPLLYKKFGLTPENMAEKALKLLENEHE

SEQ ID NO: 9900 - DNA, 2010 bp, Synechococcus sp. WH 7803
  CDS (1)..(2010): transl_table=11
atggtcgcagcgcccgcctctctcgacacgctctgcatcaacagcatccggatgctggccgtcgatgccatcaacaaatccaagagcggccatcccggcctgccgatgggctgcgcacccttgggttatgcgctgtgggacaagtttctcaagcacaaccccaagaaccccaagtggttcaaccgcgaccgctttgtgctctcggcgggtcacggctgcatgctcctgtacgcgctgctgcacctcaccggctacgactcagtgtcgatcgacgacatcaagcagttccgccagtggggctccaagacgcccggccaccccgaaacctttgaaactcctggtgttgaagtaaccaccggccccctgggcgccggcatctccaacgccgtgggtctggcgatcgctgaatcccacctggccgccaagttcaacaagcccggcgccaccctcgtggatcactacacctatgtggtgatgggggatggctgcaaccaggaaggcatcgcttcggaagcctgctccctggccggccacctgaagctgggcaagctgatcgccctctacgacgacaaccacatcaccatcgacggccgcacggacgtgtccttcaccgaggacgtgctcaagcgctacgaggcctacggctggcatgtgcagcacgtggccgacggcaacaccgatgtggacgccatcgccaaggcgatcgaagccgccaaggccgtgaccgacaagccgtcgatcatcaaggtgaccaccaccatcggctacggctcccccaacaagggcgacaccgccggcgtgcacggtgcacccctgggtgaagacgaaaccgtcctgacccgtcagcagctgggctgggagtacggccccttcgaagtgccccaggaggcttacgaccagttccgccaggcgatcgagcgtggcgccagcctcgaagccgagtggaaccagaccctggccacctaccgcacccagttccccgctgaagcggctgagttcgagcgcatgctgcgcggtgaactgcccgagggttgggacaaggatctgcccaccgctggccccgacgagaagggtctggccacccgcaagcactcccagatctgcctgggcgccctcggccccaacctgcctgagctgatcggtggctccgccgacctcacccactccaactacaccgacatcaagggcgaaaccggttcctaccagccggaaacccctgagaagcgctacctgcacttcggtgtgcgtgagcacgccatggcggccatcctcaacggcatcgcctatcacgacagcggcctgatcccctacggcggcaccttcctggtgttcgccgactacatgcgcggctccatgcgcctgtcggccctaagtgaactgggtgtgatctacgtgctcacccacgactccatcggcgtcggcgaagacggtcccacccaccagccgatcgagaccattccctccctgcgcgccatgcccgggatgctggtgttccgtcctggcgatgccaacgaaaccagtggtgcctacaagctggcgattcaaaaccgcaagcgccccagcgccctgtgcctcagccgtcagggcatggccaaccaggccaattcctcgatcgacaaggtggctctgggcggctatgtgctcgaagactgcgaaggcacccccgatctgatcctgatcggcaccggcaccgagctcgacctctgcgtgcaggccgccaagcagctcagcgccgaaggcaagaaggtgcgcgtggtgtccatgccctgcgtggaactgttcgatgagcaaagcgacgcctacaaggaagaagtgctccccaacgctgtgcgcaagcgcatggtggtggaagctgctgaatccttcggctggcaccgtttcatcggcctcgatggtgacagcgtcaccatgaaccgcttcggtgcatccgcccccggtggaacctgcctcaaggagttcggcttcacggttgagaacgttgtggcaaaatccaaagccctgcttggatga

SEQ ID NO: 9901 - protein, 669 aa, Synechococcus sp. WH 7803
MVAAPASLDTLCINSIRMLAVDAINKSKSGHPGLPMGCAPLGYALWDKFLKHNPKNPKWFNRDRFVLSAGHGCMLLYALLHLTGYDSVSIDDIKQFRQWGSKTPGHPETFETPGVEVTTGPLGAGISNAVGLAIAESHLAAKFNKPGATLVDHYTYVVMGDGCNQEGIASEACSLAGHLKLGKLIALYDDNHITIDGRTDVSFTEDVLKRYEAYGWHVQHVADGNTDVDAIAKAIEAAKAVTDKPSIIKVTTTIGYGSPNKGDTAGVHGAPLGEDETVLTRQQLGWEYGPFEVPQEAYDQFRQAIERGASLEAEWNQTLATYRTQFPAEAAEFERMLRGELPEGWDKDLPTAGPDEKGLATRKHSQICLGALGPNLPELIGGSADLTHSNYTDIKGETGSYQPETPEKRYLHFGVREHAMAAILNGIAYHDSGLIPYGGTFLVFADYMRGSMRLSALSELGVIYVLTHDSIGVGEDGPTHQPIETIPSLRAMPGMLVFRPGDANETSGAYKLAIQNRKRPSALCLSRQGMANQANSSIDKVALGGYVLEDCEGTPDLILIGTGTELDLCVQAAKQLSAEGKKVRVVSMPCVELFDEQSDAYKEEVLPNAVRKRMVVEAAESFGWHRFIGLDGDSVTMNRFGASAPGGTCLKEFGFTVENVVAKSKALLG

SEQ ID NO: 9902 - DNA, 2007 bp, Klebsiella pneumoniae subsp. pneumoniae MGH 78578
  CDS (1)..(2007): transl_table=11
atgaagacgacaaaaaccattcgctgccaatgcgccaacgcgctgcgcgccctgagcatggacgctgtacagaaagccaaatccggccacccgggggccccgatgggtatggctgacattgccgaagtgctgtggcgtgatttcctgaaccataacccgaacaatccggcctgggctgaccgtgaccgttttgtgttgtcaaatggccatggttcgatgctgatttacagcctgctgcacctcactggctacgatctgccgatatccgagctgaaaaacttccgccagctgcactccaaaaccccgggtcacccggaagtcggctacaccgcaggcgtggaaaccaccaccggtccgctgggccagggtatcgctaacgcggtcgggatggctatcgccgagaaaaccctggcggcgcagttcaaccgtccgggacacgatatcgtcgaccactacacctacgccttcatgggcgacggctgcatgatggaaggcatttctcacgaagtgtgctccctggccggtaccctgaaactgggtaaactggtggcgttctatgatgacaacggcatctccatcgacggccacgttgaaggctggttcaccgacgacaccgccaaacgctttgaagcctacggctggcacgtggtgcgcggcgtggacggtcacgacgctgacgccatcaaacgcgcggtagaagaagcgcgggcggtcaccgacaaaccgtccctgctgatgtgtaaaaccatcatcggtttcggttcgccgaacaaagccggtacccacgactcccacggcgcgccgctgggcgacgccgaaatcgccctgacccgcgaagcgctgggctggaaacacgcgccgtttgacatcccgtctgacatctatgcccagtgggatgccaaagaagccggccaggcgaaagaagccgcatggaacgagaagtttgcggcttacgccaaagccttcccgcaggaagcagccgaattcacccgccgtatgaaaggcgagatgccgtctgacttcgacgcgaaagctaacgagttcatcgcgaagctgcaggccaacccggcgaaaatcgccagccgtaaagcctcgcagaacgccatcgaagccttcggcccgctgctgccggaattcctcggcggctccgcagatctcgcgccgtccaacctgaccctgtggtccggctctaagccgatcaacgaagacgctgccgggaactacatccactacggcgtgcgcgagttcggtatgaccgctatcgccaacggtatcgcgctgcacggcggcttcctgccgtacacctccaccttcctgatgttcgtggaatacgcgcgtaacgcggtacgtatggccgcgctgatgaaacagcgtcaggtgatggtctacacccacgactcgatcggtctgggcgaagacggcccgactcaccagccggtagagcaggtggcttccctgcgcgtgaccccgaacatgtccacctggcgtccgtgtgaccaggttgaatccgcgattgcgtggaaatatggcgtggagcgtcaggacggcccgaccgcgctgatcctctcccgtcagaacctggcgcagcaggagcgtaccgcagagcagctggcgaacgtggcccgcggcggttatgtgctgaaagagtgcaccggctcgcagccggagctgatcttcatcgccaccggttcagaagtggagctggcggttgccgcatgggacaaactgactgccgaaggcgtgaaggcgcgcgtggtttccatgccgtccaccgacgcgttcgacaagcaggatgcggcttatcgcgaatccgtactgccgaaagccgtgaccgcgcgcgttgccgtggaagcgggtatcgctgactactggttcaaatacgttggcctgaacggcgctatcgttggcatgaccaccttcggtgagtctgcgccggctgagcagctgttcgaggagtacggcttcaccgtcgataacgtggttgctaaagcgaaagcgctgctgtaa

SEQ ID NO: 9903 - protein, 668 aa, Klebsiella pneumoniae subsp. pneumoniae MGH 78578
MKTTKTIRCQCANALRALSMDAVQKAKSGHPGAPMGMADIAEVLWRDFLNHNPNNPAWADRDRFVLSNGHGSMLIYSLLHLTGYDLPISELKNFRQLHSKTPGHPEVGYTAGVETTTGPLGQGIANAVGMAIAEKTLAAQFNRPGHDIVDHYTYAFMGDGCMMEGISHEVCSLAGTLKLGKLVAFYDDNGISIDGHVEGWFTDDTAKRFEAYGWHVVRGVDGHDADAIKRAVEEARAVTDKPSLLMCKTIIGFGSPNKAGTHDSHGAPLGDAEIALTREALGWKHAPFDIPSDIYAQWDAKEAGQAKEAAWNEKFAAYAKAFPQEAAEFTRRMKGEMPSDFDAKANEFIAKLQANPAKIASRKASQNAIEAFGPLLPEFLGGSADLAPSNLTLWSGSKPINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAIAWKYGVERQDGPTALILSRQNLAQQERTAEQLANVARGGYVLKECTGSQPELIFIATGSEVELAVAAWDKLTAEGVKARVVSMPSTDAFDKQDAAYRESVLPKAVTARVAVEAGIADYWFKYVGLNGAIVGMTTFGESAPAEQLFEEYGFTVDNVVAKAKALL

SEQ ID NO: 9904 - DNA, 1995 bp, Klebsiella pneumoniae subsp. pneumoniae MGH 78578
  CDS (1)..(1995): transl_table=11
atgtcccgaagagagcttgccaacgccatccgcgccctgagtatggacgccgtgcagaaagccaactccggccaccccggtgcgccgatggggatggctgatattgccgaagtgctgtggaacgattttctcaagcacaatccgcagaaccctgactgggtggaccgcgaccgtttcatcttgtccaacggccacgcgtcgatgctgctctacagtctgctgcacctgaccggctacgatctgccgctgtctgaactgaagcagttccgtcagctgcactctaaaacgcccggccacccggagcatggctatacccctggggtggaaaccaccaccggcccgctgggccaggggctggcgaacgccgtcgggatggccatcgccgaacggacgctggcggcgcagtttaatcgccccggccatgagatcattgaccatcacacctgggtgttcatgggcgatggctgtttgatggaggggatctcccatgaggcctgttcgctggccggcacgctcggactgggcaagctgatcggtttttacgatcacaacggcatctccatcgacggcaaaaccgaaggctggttttccgatgatacggcggaacgcttccgcgcctatcactggcacgtcataggcgatatcgacggccacgatccgcaggctatcaaacaggcgataacggaagcgcaggcggtgaaagataaaccgtcactgattatctgccggaccatcatcggcttcggttcgcccaacaaagccggctcagaggagtctcacggggcggcgcttggcgaaaaagaggtagcgctagcccgccagcagcttggctggaaatatcctccgttcgagatcccgaaagagatctacgcgggctgggatgcgcgtccgcgcggggaaaaagcggagcacgcctggaacgagaaattcgccgcctaccagcagcagttcccggagctggccgctgagctgacccgacgtatgaatggcgccctgccggaagactttgccgcgaccgcccgcgactacgtggcgaaactgcaggccgagccggcgaaaatcgccagtcgcaaggcttcgcaaaacgcgctgaacgcctacggcccgcaccttccggaactgctgggcggttctgcggatcttgcgccgagtaacctgaccatctggtctggatcgacatcgattaaagaagatcctgcgggcaattatatccactacggggtgcgcgagtttggcatgaccgcggtggccaacggcattgccctgcacgggggctttattccttatacctcgaccttcctgatgtttgtggagtacgcccgcaacgccgcgcgcatggcggccctgatgaaggcccggcagatcatggtctatacccatgactcgatcggtcttggggaagacgggccgacgcaccaggcggtggaacagctggccagtctgcggctgacgcccaacttcagcacctggcgcccctgcgaccaggtggagaccgccgtcgcctggcaggcggctatcgcgcgacagggcgggccgacggcgctgatcctgtcgcgacaaaacctggcgcagatgccgcgtaccccggaacaggtgcaggatatcgcccggggtggctacgtgcttaaggatgccggcggaaaacccgacctgatcctcatcgccaccggctcggaagtggagatcaccgtcctggccgcggaaaaactgttggccaaaggggtaaatgtgcgggtcgtctcgctcccttccactgatgtgtttgacgcccaggatgaggcctggcgcgaatcggtgctgccgtcggacgtcagcgcccgggtggcggtcgaagccgggatagcggactactggtataaatatgtcggcttaaaaggcaagatcgtcggcatgaccggctatggcgaatccgccccggcagagcagttgttcccgttctttggctttacggtcgaccatatcgtcgccaccgccgaacaggtgcttaacgggtga

SEQ ID NO: 9905 - protein, 664 aa, Klebsiella pneumoniae subsp. pneumoniae MGH 78578
MSRRELANAIRALSMDAVQKANSGHPGAPMGMADIAEVLWNDFLKHNPQNPDWVDRDRFILSNGHASMLLYSLLHLTGYDLPLSELKQFRQLHSKTPGHPEHGYTPGVETTTGPLGQGLANAVGMAIAERTLAAQFNRPGHEIIDHHTWVFMGDGCLMEGISHEACSLAGTLGLGKLIGFYDHNGISIDGKTEGWFSDDTAERFRAYHWHVIGDIDGHDPQAIKQAITEAQAVKDKPSLIICRTIIGFGSPNKAGSEESHGAALGEKEVALARQQLGWKYPPFEIPKEIYAGWDARPRGEKAEHAWNEKFAAYQQQFPELAAELTRRMNGALPEDFAATARDYVAKLQAEPAKIASRKASQNALNAYGPHLPELLGGSADLAPSNLTIWSGSTSIKEDPAGNYIHYGVREFGMTAVANGIALHGGFIPYTSTFLMFVEYARNAARMAALMKARQIMVYTHDSIGLGEDGPTHQAVEQLASLRLTPNFSTWRPCDQVETAVAWQAAIARQGGPTALILSRQNLAQMPRTPEQVQDIARGGYVLKDAGGKPDLILIATGSEVEITVLAAEKLLAKGVNVRVVSLPSTDVFDAQDEAWRESVLPSDVSARVAVEAGIADYWYKYVGLKGKIVGMTGYGESAPAEQLFPFFGFTVDHIVATAEQVLNG

SEQ ID NO: 9906 - DNA, 1995 bp, Klebsiella pneumoniae subsp. pneumoniae MGH 78578
  CDS (1)..(1995): transl_table=11
atgtcctcacgtaaagagcttgctaacgctattcgtgcgctgagcatggacgctgtacagaaagccaaatccggccacccgggggccccgatgggtatggctgacattgccgaagtgctgtggcgtgatttcctgaaccataacccgaacaatccggcctgggctgaccgtgaccgttttgtgttgtcaaatggccatggttcgatgctgatttacagcctgctgcacctcactggctacgatctgccgattgaagagctgaaaaacttccgccagctgcactccaaaaccccgggtcacccggaagtcggctacaccgcaggcgtggaaaccaccaccggtccgctgggccagggtatcgctaacgcggtcgggatggctatcgccgagaaaaccctggcggcgcagttcaaccgtccgggacacgatatcgtcgaccactacacctacgccttcatgggcgacggctgcatgatggaaggcatttctcacgaagtgtgctccctggccggtaccctgaaactgggtaaactggtggcgttctatgatgacaacggcatctccatcgacggccacgttgaaggctggttcaccgacgacaccgccaaacgctttgaagcctacggctggcacgtggtgcgcggcgtggacggtcacgacgctgacgccatcaaacgcgcggtagaagaagcgcgggcggtcaccgacaaaccgtccctgctgatgtgtaaaaccatcatcggtttcggttcgccgaacaaagccggtacccacgactcccacggcgcgccgctgggcgacgccgaaatcgccctgacccgcgaagcgctgggctggaaacacgcgccgtttgacatcccgtctgacatctatgcccagtgggatgccaaagaagccggccaggcgaaagaagccgcatggaacgagaagtttgcggcttacgccaaagccttcccgcaggaagcagccgaattcacccgccgtatgaaaggcgagatgccgtctgacttcgacgcgaaagctaacgagttcatcgcgaagctgcaggccaacccggcgaaaatcgccagccgtaaagcctcgcagaacgccatcgaagccttcggcccgctgctgccggaattcctcggcggctccgcagatctcgcgccgtccaacctgaccctgtggtccggctctaagccgatcaacgaagacgctgccgggaactacatccactacggcgtgcgcgagttcggtatgaccgctatcgccaacggtatcgcgctgcacggcggcttcctgccgtacacctccaccttcctgatgttcgtggaatacgcgcgtaacgcggtacgtatggccgcgctgatgaaacagcgtcaggtgatggtctacacccacgactcgatcggtctgggcgaagacggcccgactcaccagccggtagagcaggtggcttccctgcgcgtgaccccgaacatgtccacctggcgtccgtgtgaccaggttgaatccgcgattgcgtggaaatatggcgtggagcgtcaggacggcccgaccgcgctgatcctctcccgtcagaacctggcgcagcaggagcgtaccgcagagcagctggcgaacgtggcccgcggcggttatgtgctgaaagagtgcaccggctcgcagccggagctgatcttcatcgccaccggttcagaagtggagctggcggttgccgcatgggacaaactgactgccgaaggcgtgaaggcgcgcgtggtttccatgccgtccaccgacgcgttcgacaagcaggatgcggcttatcgcgaatccgtactgccgaaagccgtgaccgcgcgcgttgccgtggaagcgggtatcgctgactactggttcaaatacgttggcctgaacggcgctatcgttggcatgaccaccttcggtgagtctgcgccggctgagcagctgttcgaggagttcggcttcaccgttgataacgtggtcgctaaagcgaaagcgctgctgtaa

SEQ ID NO: 9907 - protein, 664 aa, Klebsiella pneumoniae subsp. pneumoniae MGH 78578
MSSRKELANAIRALSMDAVQKAKSGHPGAPMGMADIAEVLWRDFLNHNPNNPAWADRDRFVLSNGHGSMLIYSLLHLTGYDLPIEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLVAFYDDNGISIDGHVEGWFTDDTAKRFEAYGWHVVRGVDGHDADAIKRAVEEARAVTDKPSLLMCKTIIGFGSPNKAGTHDSHGAPLGDAEIALTREALGWKHAPFDIPSDIYAQWDAKEAGQAKEAAWNEKFAAYAKAFPQEAAEFTRRMKGEMPSDFDAKANEFIAKLQANPAKIASRKASQNAIEAFGPLLPEFLGGSADLAPSNLTLWSGSKPINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAIAWKYGVERQDGPTALILSRQNLAQQERTAEQLANVARGGYVLKECTGSQPELIFIATGSEVELAVAAWDKLTAEGVKARVVSMPSTDAFDKQDAAYRESVLPKAVTARVAVEAGIADYWFKYVGLNGAIVGMTTFGESAPAEQLFEEFGFTVDNVVAKAKALL

SEQ ID NO: 9908 - DNA, 2094 bp, Kineococcus radiotolerans SRS30216
  CDS (1)..(2094): transl_table=11
gtgagccagcccagcctcgagtggagcgacttggaccagaggacggtcgacaccgcccgcgtcctcgcgatggacgcggtgcagcgcgccggcaacggtcacccgggtacggccatgagcctcgccccggtggccaccctgctgttccagaaggtcctgcggcacgaccccgccgacccggactgggtcggtcgcgaccggttcgtgctgtcctgcgggcactccagcctgacgctgtacaaccagctctacctgtccggctacggcctggagctcgacgacctcaaggcgctgcgcaagtggggttcgaagacccccggccaccccgagcacgggcacaccgccggcgtcgagatgaccaccggcccactgggccaggggctgtcctccgcggtcggcatggccatggccgcccgccgcgagcgcggtctgttcgaccccgaggccgccccgggcaccagcccgttcgaccaccacgtctacgtgctgtgctccgacggcgacatcgaggagggcgtgacctccgaggcctccgccatcgccggggtccaggagctgggcaacctggtcgtcatctacgaccagaaccacatctccatcgaggacgacaccgcgatcgccctgggcgaggacaccggcaagcgctacgagtcctacggctggcacgtccagaccatcgactggaccaacggcggcgagggcccctacaccgaggacctcgccggcctgcacgccgcgatcgaggcggccaaggccgagacgggcaagccctcgatcatcgtgctgcgcacgatcatcgcctaccccgcgccgaacctgcagaacaccggcaagtcgcacggctccgccctgggcgaggccgaggtcaaggccaccaaggaggtcctcggcttcgaccccgagaagaccttcgaggtctccgacgaggtcatcggcttcgcccgccaggtccgcgagcgcggcaagacggcccacgaggcctggcagcgcgagttcgacgcctggcgcgagggcgccggcgagcgcgcggagctcttcgaccgcatgcgcacccgcaccctgcccgccggctgggagcagtcgctgccggtcttcgagcccggcaaggccatggcctcgcgcaaggcctccggtcaggtcctcaacgccatcgcctcctccctgccggagctgtggggcggttcggccgacctggccgagtccaacctcacctcgctgaagggcgagccgtccttcctgccgccgagccgcaccacgaagacctgggacggcaacgtctacggccgcgtgctgcacttcggcatccgcgagcacgcgatgggctcgatcctcaacggcatcgcgctgcacggcgggacccgcccctacggcggcacgttcctcgtcttcagcgactacatgcgtcccgcggtgcgcctggcctcgatcatgcggctgccggtgacctacgtgtggacccacgactccatcggcctgggcgaggacggcccgacccaccagccgatcgagcacctcgcctcgctgcgcgccatccccggcttcgacgtggtgcgccccggcgacgccaacgagaccgcgtgggcgtggaagacgatcctggagacgaccgaccggcccgccggcctggccctctcccgccaggacctgccgaccttcgaccgctcccagccgggctggggcgcggccgacggcgtcgccaagggcgcctacgtcctcgtcgaggcctccaccgccaacccggaggtcatcctcatcggcaccgggtccgaggtgcagatcgccgtggccgcccgcgagaagctcgaggccgagggcatccccacccgcgtcgtctccatgccgtgccgcgagtggttcgacgcccagccgcagtcctaccgcgacaccgtcctcatccccggggtgaaggcgcgcgtggccgtcgaggccggcatcgcccagggctggcacgacctgaccggcgacgccgggcgcgtcgtgggcatcgagcacttcggcgcctcggccgactaccaggacctctaccgcgagttcggcatgaccgacaccgcggtcgtcaccgcggccaaggaatccctcgccggtctgcagtga

SEQ ID NO: 9909 - protein, 697 aa, Kineococcus radiotolerans SRS30216
MSQPSLEWSDLDQRTVDTARVLAMDAVQRAGNGHPGTAMSLAPVATLLFQKVLRHDPADPDWVGRDRFVLSCGHSSLTLYNQLYLSGYGLELDDLKALRKWGSKTPGHPEHGHTAGVEMTTGPLGQGLSSAVGMAMAARRERGLFDPEAAPGTSPFDHHVYVLCSDGDIEEGVTSEASAIAGVQELGNLVVIYDQNHISIEDDTAIALGEDTGKRYESYGWHVQTIDWTNGGEGPYTEDLAGLHAAIEAAKAETGKPSIIVLRTIIAYPAPNLQNTGKSHGSALGEAEVKATKEVLGFDPEKTFEVSDEVIGFARQVRERGKTAHEAWQREFDAWREGAGERAELFDRMRTRTLPAGWEQSLPVFEPGKAMASRKASGQVLNAIASSLPELWGGSADLAESNLTSLKGEPSFLPPSRTTKTWDGNVYGRVLHFGIREHAMGSILNGIALHGGTRPYGGTFLVFSDYMRPAVRLASIMRLPVTYVWTHDSIGLGEDGPTHQPIEHLASLRAIPGFDVVRPGDANETAWAWKTILETTDRPAGLALSRQDLPTFDRSQPGWGAADGVAKGAYVLVEASTANPEVILIGTGSEVQIAVAAREKLEAEGIPTRVVSMPCREWFDAQPQSYRDTVLIPGVKARVAVEAGIAQGWHDLTGDAGRVVGIEHFGASADYQDLYREFGMTDTAVVTAAKESLAGLQ

SEQ ID NO: 9910 - DNA, 2079 bp, Xanthobacter autotrophicus Py2
  CDS (1)..(2079): transl_table=11
atgtcgctcattgcctccactggcttcgccgaagccggtaacgccctcgcgcgcccgaattccggagacggcaccccatccgctcgcctgaactccggtgacggcttcgcttccgctcgccgtatggccgacgccatccgcttcctcgccctcgacgccatcgccaaggccgaggatggccatcccggcgcgccgctgggtggggcggaactcgccacggcgctgttcacccgccacttcaaatgcaatccggccgacccggcatggttcgaccgcgaccgcttcgtgctgtcgaacggccacggctccatgctgatctatgccgtgctccacctcgccggctatgcgggcatgcccatggaggagatccgccgcttccgcgagctgggcgcccacacccacggccatcccgagcgcgacgtggcgctgggcatcgaggtcaccaccgggccgctgggccagggcatcgccaatgcggtggggatggcggttgcggaagccttcctgtccgccacctacggccccgagctggtggatcaccgcacctatgcggtggtcggcgacggctgcctgatggagggcatcgcccatgaggtgatctcgctggccggccacctgaagctcggcaagctcaccttcctgtgggacgacaaccgcatgaccgacgatggcggcacgcacttcgccatctccgaggacgtgcgcgcccgcttccgcatcgccggctggcaggtgatcgacgccgacggccacgacgtggaggcggtgagcgccgccctcatcctcgcccaccaggatccgcgcccgaccatgatcgcctgcaccacggtgctgggcaaaggcctgccgcgcctcgaaggcaagcgcggcgcccacggcggacgggtgttccctgaggatgtggtggaagcccgcgccgccgccggctggacccatggcccgttcgaggtgccgcaggatgtcgccgccgcatggcaggccggcaccggcgagcgcaatcgcccctcctatgaggcctggcaggcgcgcgtcgccgccttgccggccgacaagcgcgccgagttcgagcggctggtccgtggcgaactgccggcgggcgtgctatcggcgctttccgcccatgccgaggccctcgcggcggcggcccccgcccagtcctccaaccagtccaccgccgacatcgtggacctcctcgccggcctcgtgcccgagctgctgcccggcgcgccggatctggaaggccccaccaactgcaagcgcggactcgacgccttcaccgccgaaaacccggccgggcgctacatccactatggcatccgcgagcatgccatggggtccatgatgaacggcatggtggcccatggcggcgtgctgcccctgggcgcgacctatctggtgttctccgactacatgcgcccgtccttgcgcatgtcggcgctgatggagctgccggtcattacactctacagccacgacagcatcggcatcggcaagaacgggccgacccaccagccggtggagttcctcgcgtcgctccgcgccatgccgaacatggcggtgttccgtcccgccgacgcggtggagaccgccgaatgctggcagctggcgctcgcccgccgcgacggcccctcctccatcatctgctcccggcaggcccttccggcccagcgcagcgacgctggcgagaaccgctccgcccgcggcgcctacgtgctgcgcgcggccgagggcggcccacgccgggtgacgctgatcgccaccggctcggaggtggacgtggcggtgaaggcgcgcgatcttctccaggcggagggcattcccaccgccgtggtttcgatgccctgctgggagatcttcggagagcaggacgaggcctatgtgtgggaggtcctcgggccgggcacggtgcgggttgcggtggaggcggcggtgaagctgggctgggaacgctggatcggcgcggacggcgccttcgtggggatgaacagcttcggtgcctcgggaccggccgacgagttgttccgccatttcggcatcacccccgccgccgtgggggatgcggcgcgggcgcggctgtga

SEQ ID NO: 9911 - protein, 692 aa, Xanthobacter autotrophicus Py2
MSLIASTGFAEAGNALARPNSGDGTPSARLNSGDGFASARRMADAIRFLALDAIAKAEDGHPGAPLGGAELATALFTRHFKCNPADPAWFDRDRFVLSNGHGSMLIYAVLHLAGYAGMPMEEIRRFRELGAHTHGHPERDVALGIEVTTGPLGQGIANAVGMAVAEAFLSATYGPELVDHRTYAVVGDGCLMEGIAHEVISLAGHLKLGKLTFLWDDNRMTDDGGTHFAISEDVRARFRIAGWQVIDADGHDVEAVSAALILAHQDPRPTMIACTTVLGKGLPRLEGKRGAHGGRVFPEDVVEARAAAGWTHGPFEVPQDVAAAWQAGTGERNRPSYEAWQARVAALPADKRAEFERLVRGELPAGVLSALSAHAEALAAAAPAQSSNQSTADIVDLLAGLVPELLPGAPDLEGPTNCKRGLDAFTAENPAGRYIHYGIREHAMGSMMNGMVAHGGVLPLGATYLVFSDYMRPSLRMSALMELPVITLYSHDSIGIGKNGPTHQPVEFLASLRAMPNMAVFRPADAVETAECWQLALARRDGPSSIICSRQALPAQRSDAGENRSARGAYVLRAAEGGPRRVTLIATGSEVDVAVKARDLLQAEGIPTAVVSMPCWEIFGEQDEAYVWEVLGPGTVRVAVEAAVKLGWERWIGADGAFVGMNSFGASGPADELFRHFGITPAAVGDAARARL

SEQ ID NO: 9912 - DNA, 1992 bp, Xanthobacter autotrophicus Py2
  CDS (1)..(1992): transl_table=11
atgctgagccgcacgagtcacgaccgcatggccaacgccatccgcttccttgccatggacgccgtggaagctgccaatagcggtcatcccggcctgccgatgggtgctgcggacatcgccaccgtcctgttcaccaaggtcctgaagtacgatcccacgcgccccttctggcccgatcgcgaccgcttcgtgctgtccgccggccacggctccatgctgctctattcggtgctgcatctggccggctacgagaaggtgacgatcgaggagatcaagcgcttccgcaagctcggctcgcttacccccggccatcccgagaacttcgtcaccgaaggcatcgagaccaccaccggcccgctcgggcagggcatcgccaccgccgtgggcatggccatggccgagcgcgcgctcgccgcccgcttcggcaaggacgtggtggaccaccacaccttcgtgctctgctccgacggcgacctgatggagggcatcagccaggaggcggcggaccttgccggccacctgaagctctccaagctcatcgtcatgtgggatgacaacggcatctccatcgacggcgccacctccatctccggttccaccgaccagctggcgcgcttcgccgcctcggggtgggcgaccacgcgcatcgatggccacgatccggacgccatccttgccgcgctgaccgccgccaaggcctcggaccggccgaccctgatcgcctgccgcaccgtcatcggcttcggcagtcccaagaaggccggctcggagaaggtgcacggttctccgctcggtgccgacgagatcgccgccacccgcgcggcgctgggctgggaggctgcgcccttcgagattcccgccgacgtgctcgccggctggcgcgccgccggtgccgccggatccgccgcccgcgcggcctgggaggcgcgcttggccgccgcccccgaagccgaccgggccgagttcgagcgccgcatcgccggcacgctgccgcaggcgctggaaggcgccatcgtcgccgtcaagcagaaggcggtggcggacggtggcgcggtggccacccgcaagtcgtccgagctggtgctggatttcatcaccccggtggtgccggagatgctgggcggctcggccgacctcaccggttccaacaacaccaaggccaagggcgcgaaggccatcacgccggacgatttcgccggctccttcgtgcactggggcgtgcgcgagcacggcatggcggcagccatgaacgggatcaccctgcacaagggcctcattcccttctccggcggcttcctggtgttctcggattattgccgcccctccatccgcctggccgcgctcatgggcgagcgggtcatccatgtgctgacccacgattccatcggccttggcgaagatggccccacccatcagccggtggagcacctggccgccctgcgcgccatcccgaacctcctggtgatgcgccccgccgacacggtggagacggccgagtgctggcagattgcacttcaatcggaaggtcggccctccgccctcatcctgtcgcggcagaacctgccgatcctgcgcaccgatgccaccgcagagaaccgctcggcgggcggcgcctatgagatcgtcgcggcctcggccaaggcgcaggccagcctgttcgcaaccggctcggaagtctcgcttgcggtggaagccgccaagcttctggaggcgcagggtgtgcccacccgcgtcgtctccatcccttcgttcgaactcttcctcgaaaggcctgccgcagagcgggccaaggtgatcggggacgctccggccaaggtggcggtggaagccgccatccgcatggggtgggacgccatcgtcggttcggatgccgccttcgtgggaatgacctcgttcggcgcctcggcgcctggaaaggaccttttcgcccatttcggactgaccccggacaaggtcgcggccaaggccctcgaccagctccggcaggtgtga

SEQ ID NO: 9913 - protein, 663 aa, Xanthobacter autotrophicus Py2
MLSRTSHDRMANAIRFLAMDAVEAANSGHPGLPMGAADIATVLFTKVLKYDPTRPFWPDRDRFVLSAGHGSMLLYSVLHLAGYEKVTIEEIKRFRKLGSLTPGHPENFVTEGIETTTGPLGQGIATAVGMAMAERALAARFGKDVVDHHTFVLCSDGDLMEGISQEAADLAGHLKLSKLIVMWDDNGISIDGATSISGSTDQLARFAASGWATTRIDGHDPDAILAALTAAKASDRPTLIACRTVIGFGSPKKAGSEKVHGSPLGADEIAATRAALGWEAAPFEIPADVLAGWRAAGAAGSAARAAWEARLAAAPEADRAEFERRIAGTLPQALEGAIVAVKQKAVADGGAVATRKSSELVLDFITPVVPEMLGGSADLTGSNNTKAKGAKAITPDDFAGSFVHWGVREHGMAAAMNGITLHKGLIPFSGGFLVFSDYCRPSIRLAALMGERVIHVLTHDSIGLGEDGPTHQPVEHLAALRAIPNLLVMRPADTVETAECWQIALQSEGRPSALILSRQNLPILRTDATAENRSAGGAYEIVAASAKAQASLFATGSEVSLAVEAAKLLEAQGVPTRVVSIPSFELFLERPAAERAKVIGDAPAKVAVEAAIRMGWDAIVGSDAAFVGMTSFGASAPGKDLFAHFGLTPDKVAAKALDQLRQV

SEQ ID NO: 9914 - DNA, 2007 bp, Prochlorococcus marinus str. MIT 9215
  CDS (1)..(2007): transl_table=11
atggttgctgcatctgtttcattagaatcactttgtgtaaatagtataagaatgctcgctgtagatgcagtaaataaatctaatagtggacatcctggattgccaatggggtgtgctcctatgggttatgcattatggcaaaacatacttaatcacaaccctagcaatccaaaatggtttaatagagaccgttttgtattgtccgcaggtcatggctgtatgcttttatattccttgcttcatttgacaggatacaaatcagtatcaatagaagatattaaagaattcagacaatggggatccaaaactccgggacatcccgaaacattcgaaactgaaggagttgaagttacagccgggcctcttggagccggaatatctaatgcagttggtttagcaatagctgaaactcacttggcagctaaattcaacaaggctgattgcaacatcgttgatcactttacttacgtcattatgggtgatggctgtaatcaagaaggtatcgcatcagaggcttgctcattagctggtcatctgaagcttggaaaattaattgctctctatgacgataatcaaattacaattgatggacgtaccgatgtttctttcactgaagatgttttaaaaagatacgaagcttatggatggcatgtacaacatgttaaagatgggaatcatgatgttaaaggaataactgaagctatcgaaaaagcaaaattaattacagacaaaccttcgattataaaaatttctacaaccataggttatggttcgccaaataaatcagatactgcgggaattcatggagcagctgttggagaagaagaagctgcattaacacgtaagtttctaaattgggaatatcctccatttgaaataccagatgaaatatatgcgcattttagaaaatcaataaaaaaaggcgaaaacttagagagagaatgggattctaaatttgaagaatatcaaaaaaaatacccctctgaaggagctgagttaaacagaatgttaaaaggacaattacccgataattgggattcagatctcccttcttatacacctgatgataaggggttagccacaagaaagcattcacaaatatgtttaggtgctttaggacctaacctgcctgaattaattggtggatccgcagatttaactcactcaaactacacagatatcaagggggaaacaggttcattccagcctcatagccctgaaaaaagatatttacactttggagttcgagagcatgcaatggcagctatacttaatgggattgcttatcacaatagtggtcttattccttatggtgggacattccttgttttcgccgattatatgagaggttcaatgaggctttcggcactcagcgaactaggagtaatctatgttttaacccatgattcaattggtgtaggagaagacggcccgactcatcaacctatcgaaactatcccttctcttcgagcgatgcctaacatgctagtttttagaccaggagatggaaatgaaacaagtggagcttacaagcttgcgattcaaaatagaaaaagaccttctgccctttgtttaagtaggcaaggaatgccaaatcaagaaaatacttctatcgataaagttgccttaggaggatatgtagtttccgattgcgaaggaacaccagatctaatatttattggcactggaagtgaactaaatctttgcattgaagcaagtaaggaaatttcaagcttaggtaaaaaaattagagttgtttctatgccatgtgtagaacttttcgaagaacaagaagaatcttacaaagaaagtgttttaccaagtattgtgaaaaagagagttgttgtagaagctgcccattcctttggttggcataaatatacaggttttgatgggatttgtattactatggatagatttggggcatcagctccaggaggagaatgtatgaaaaattttggatttacagtagaaaacgtagtcaataagacgaaggaaattttataa

SEQ ID NO: 9915 - protein, 668 aa, Prochlorococcus marinus str. MIT 9215
MVAASVSLESLCVNSIRMLAVDAVNKSNSGHPGLPMGCAPMGYALWQNILNHNPSNPKWFNRDRFVLSAGHGCMLLYSLLHLTGYKSVSIEDIKEFRQWGSKTPGHPETFETEGVEVTAGPLGAGISNAVGLAIAETHLAAKFNKADCNIVDHFTYVIMGDGCNQEGIASEACSLAGHLKLGKLIALYDDNQITIDGRTDVSFTEDVLKRYEAYGWHVQHVKDGNHDVKGITEAIEKAKLITDKPSIIKISTTIGYGSPNKSDTAGIHGAAVGEEEAALTRKFLNWEYPPFEIPDEIYAHFRKSIKKGENLEREWDSKFEEYQKKYPSEGAELNRMLKGQLPDNWDSDLPSYTPDDKGLATRKHSQICLGALGPNLPELIGGSADLTHSNYTDIKGETGSFQPHSPEKRYLHFGVREHAMAAILNGIAYHNSGLIPYGGTFLVFADYMRGSMRLSALSELGVIYVLTHDSIGVGEDGPTHQPIETIPSLRAMPNMLVFRPGDGNETSGAYKLAIQNRKRPSALCLSRQGMPNQENTSIDKVALGGYVVSDCEGTPDLIFIGTGSELNLCIEASKEISSLGKKIRVVSMPCVELFEEQEESYKESVLPSIVKKRVVVEAAHSFGWHKYTGFDGICITMDRFGASAPGGECMKNFGFTVENVVNKTKEIL

SEQ ID NO: 9916 - DNA, 2016 bp, Desulfococcus oleovorans Hxd3
  CDS (1)..(2016): transl_table=11
atggccaccagaaaaaccgcgggcaacaagccgatcgacgaacgatgcatcaacaccattcgatgccttgccatggacgccattcagcaggccaactccggccatcccggggcgcccatgggtcttgcgccggcgggatatgttctgtggacaaaggtgatgaagcacaatccgaaaaatccccagtggttcaaccgggaccggttcgttctgtccggtggccatgcctccatgctgctctacagcctgcttcacctgaccggttatgagctttccttaaaagacattcagcagtttcgccaactgggcagcaaaaccccgggccatccggagtacggccacacccccggcgtggagaccactaccggtcctttgggccaggggtttgccaatgccgtgggcatggccatggccgagcgtcacatggcggcccggtttaaccgcaagggtgcgaccattgtggaccactttacctacgtgatgtgcggcgacggggacctgatggagggcctctcctatgaatcggcttccctggccggacacctgggcctgggcaaactgatctgcctgtatgacgacaacgacatctccattgagggccacaccgatatcacctttaccgaaaacgtggcggcccggttcaaggcctgcaactggcatgtggtgccggtcaaagacggcagcagcgtggaccagattctcgacgcgctgaaagcggcccaggccgagactgaaaagccgtcgctcatcatccttaaaacccatatcgcccacggcagccccaacaagcaggacagtgccgacgcccatggcgcgcccctgggaaaagaggaaattgttctgacaaaaagaaacctggggttccccgaagacgtggtctgccacatcacagaagacgctttgaaggttttcagaaaatgcatggaaaaaggggaaaaggcccagggaaaatggcgggccatagtagaccgctacgcagaaaagtttcccgacctggccgcccagtggaccgcggcaattacacaccggctgcccaaagggtgggacaaaaacctttccggttttttaccgtccgacaagcccatggccacccggtccgcatcgggaaaggtcttaaacaagctggccgaagccattcccgcgatcatcggcgggtccgcggacctggccccgtccaacaacacctttctggcctgttccggcgagtttcagaaaggcacctatgaccagcgcaacatccggttcggggtgcgggagcacgccatggcatccatcatggccggcatgtacctgcacggcggcctgcggccctacggcggcacctttctgatcttttccgattacatgcggcccgccatacgggtggccagcctgatgaaactgcccctgatctatgtgttcacccacgacagcgtggccgtgggcgaagacggccccacccaccagcccgtggaacagctggcctcgctgcgggccatgcccggccttaccgtgatccggccggccgacgccacggaaaccgtggacgcctggaaggtggccgtcaccaacaccgccggcccggtggccctggccttaagccgccagaacctgccggtgcttgatgccgccataacagcgggcaagctggccaaaggcgcctatgtactggaagagtgttccggccggcccgacatcatcctgatcagtaccggcgccgaggtgcatgtcaccctggaggccgccaaactgctggcgcaaaaaaatattgccgcaagagtggtcagtatgcccagctgggagctgtttgaaaaaaccgacgcgacctaccgggagtccgtgctgatccccggggtcccctgttttgccgttgaagcagggtcccccatgggatgggagcggtacacaaaagacagccatgccattctgggcatcgaccggttcggcacatcggccccgggcggcaccgtgctgaaggagtacggctttaccccggaaaacatcgtgaaaaaagtaacggcggtactcggaaaatag

SEQ ID NO: 9917 - protein, 671 aa, Desulfococcus oleovorans Hxd3
MATRKTAGNKPIDERCINTIRCLAMDAIQQANSGHPGAPMGLAPAGYVLWTKVMKHNPKNPQWFNRDRFVLSGGHASMLLYSLLHLTGYELSLKDIQQFRQLGSKTPGHPEYGHTPGVETTTGPLGQGFANAVGMAMAERHMAARFNRKGATIVDHFTYVMCGDGDLMEGLSYESASLAGHLGLGKLICLYDDNDISIEGHTDITFTENVAARFKACNWHVVPVKDGSSVDQILDALKAAQAETEKPSLIILKTHIAHGSPNKQDSADAHGAPLGKEEIVLTKRNLGFPEDVVCHITEDALKVFRKCMEKGEKAQGKWRAIVDRYAEKFPDLAAQWTAAITHRLPKGWDKNLSGFLPSDKPMATRSASGKVLNKLAEAIPAIIGGSADLAPSNNTFLACSGEFQKGTYDQRNIRFGVREHAMASIMAGMYLHGGLRPYGGTFLIFSDYMRPAIRVASLMKLPLIYVFTHDSVAVGEDGPTHQPVEQLASLRAMPGLTVIRPADATETVDAWKVAVTNTAGPVALALSRQNLPVLDAAITAGKLAKGAYVLEECSGRPDIILISTGAEVHVTLEAAKLLAQKNIAARVVSMPSWELFEKTDATYRESVLIPGVPCFAVEAGSPMGWERYTKDSHAILGIDRFGTSAPGGTVLKEYGFTPENIVKKVTAVLGK

SEQ ID NO: 9918 - DNA, 2010 bp, Prochlorococcus marinus str. MIT 9211
  CDS (1)..(2010): transl_table=11
atggtcgctgcgcccgcttcactcgataagctttgcatcaacagcataagaatgcttgcagttgatgctgttaataaatccaaaagcggacatcccggtcttccaatgggatgtgcaccaatgggatatacgctttgggataagttcttaaatcacaaccccaaaaaccccaaatggtttaaccgagacaggtttgttctttcagccggtcatggttgcatgttgctatatgcccttttgcatctcacgggttatgaatcagtaacgattgaagatattaaacaatttcgtcagtggggggccagaacacccggtcatccagaaactttcgaaacgcctggtgtagaggttacagcaggcccattaggagcaggaatttccaatgctgtaggacttgccattgccgaatctcatctggctgcaaaattcaataagccagatttttctttagttgatcatttcacctatgtgatcatgggagacggttgtaatcaagaaggagttgcatcagaagcatgctctcttgcagggcacttgaaattaggaaaattaattgctctttatgacgataatcacatcacaattgatggaaaaactgatgtttcattcacagaagatgtactaaagcgatatgagtcttatggatggcatgttcaacatgtttcagatggcaatacagatgtagatgccattgctaaagcaatccaacaggctaaagaagtaactgacaaaccatccatcattaaaatcacaacaaccattggatatggttcacctaataaaagtgatactgctggagttcatggggcacccctaggcgaggaagaggctgagcttacacgacaagcattgggatggtcttatggcccttttgaagtacctcaagaggcatatgaccaattgcgtcaagcaattgataaaggagcaaagtccgaagctgtatggaatgaattattagaaagttatcgctctaaatatcctgatgaatcaattgaatttgaaagaatgttgaggggcgaactcccaagcaattgggaccaaagtcttcctagttacacccctgaagataaaggtttggctacgagaaaacactctcagatttgtttaggagcattaggccccaatctgcctgagttaattggaggatcagcagacttaacccattcaaattacacagatatccaaggggaaactggttcgtttcaagctgagagtcctgagaaacgctatttacattttggagtcagagaacatgcaatggcagccatcctgaatggaattgcttatcacggcagtggtttaatcccttatggaggaacatttttagtgtttgctgactacatgagagggtcaatgagactgtctgcactcagtgaacttggagtgatctacgtcctcacccatgattcaattggcgtaggtgaagacggcccaacacaccaaccaatagaaacaattccctctttgcgcgcaatgccaaatatgcttgtcttccgcccaggggatggtaatgaaactagtggtgcatacaaattagcgatccaaaaccgcactagacctagtgctctatgtctcagcagacaaggcatgccaaatcaagaaaattcttctattgaaaaagtatcctttggaggatatgttcttgaagattgcgaaggtactcctgagttaatacttataggaacaggaagtgaattgtatctttgtgttgatgcagctaaagagttaacaaaacaagggcgaaaagtgagagttgtttcaatgccatgtgttgaactatttgaggaacaaagctcttcatataaagaagaggttttaccatcagatgtaaggaagcgaattgtcgttgaagcagcggaaacatttggatggcataaatatattggtcttgatggagatagcattacaatgagtggatttggtgcttctgcaccaggtggaacttgtatggagaaatttggatttacgctcgagaatgtattaaatactgcaaataatttattaacttaa

SEQ ID NO: 9919 - protein, 669 aa, Prochlorococcus marinus str. MIT 9211
MVAAPASLDKLCINSIRMLAVDAVNKSKSGHPGLPMGCAPMGYTLWDKFLNHNPKNPKWFNRDRFVLSAGHGCMLLYALLHLTGYESVTIEDIKQFRQWGARTPGHPETFETPGVEVTAGPLGAGISNAVGLAIAESHLAAKFNKPDFSLVDHFTYVIMGDGCNQEGVASEACSLAGHLKLGKLIALYDDNHITIDGKTDVSFTEDVLKRYESYGWHVQHVSDGNTDVDAIAKAIQQAKEVTDKPSIIKITTTIGYGSPNKSDTAGVHGAPLGEEEAELTRQALGWSYGPFEVPQEAYDQLRQAIDKGAKSEAVWNELLESYRSKYPDESIEFERMLRGELPSNWDQSLPSYTPEDKGLATRKHSQICLGALGPNLPELIGGSADLTHSNYTDIQGETGSFQAESPEKRYLHFGVREHAMAAILNGIAYHGSGLIPYGGTFLVFADYMRGSMRLSALSELGVIYVLTHDSIGVGEDGPTHQPIETIPSLRAMPNMLVFRPGDGNETSGAYKLAIQNRTRPSALCLSRQGMPNQENSSIEKVSFGGYVLEDCEGTPELILIGTGSELYLCVDAAKELTKQGRKVRVVSMPCVELFEEQSSSYKEEVLPSDVRKRIVVEAAETFGWHKYIGLDGDSITMSGFGASAPGGTCMEKFGFTLENVLNTANNLLT

SEQ ID NO: 9920 - DNA, 2001 bp, Salmonella enterica subsp. arizonae serovar 62:z4,z23:--
  CDS (1)..(2001): transl_table=11
atgtcccgtaaagaccttgccaatgcgattcgtgcgctgagcatggatgccgttcaaaaagccaattccgggcaccccggcgcgccgatggggatggcggatatcgctgaagtgttatggaacgattttcttaaacataaccccaccgatccggcctggtatgaccgtgaccgttttatcctttccaacggtcacgcctccatgctgctttatagcctgctgcatttaaccggttatgacctgccgctggaggaactgaaaaacttccgtcagttgcattctaaaacgccaggccacccggagattggctatacgcccggcgtagaaaccaccaccgggccgctgggccaggggttggcgaatgccgtcgggctggcgatcgccgagcgtacactgggcgcgcagttcaaccagccggaccatgagattgtcgatcactacacttatgtatttatgggcgacggctgcctgatggaggggatctcgcatgaggtatgttcgctggcaggtacgctgggactgggcaaactgatcggcttttacgatcacaatggcatctccattgatggcgaaaccgaaggctggtttaccgacgataccgccaaacgctttgaagcctaccactggcatgtagtgcatgacattgacgggcacgatccggaagcggtgaaaaaagccattctcgaagcccggagcgtaaaagataaaccttcgctaattatctgtcggacggtgataggttttggttcgccgaataaagccgggaaggaagagtctcacggtgcggcgctgggcgaagaagaggtggcgctgacccgccagaagctagggtggcatcatccggcattcgagatcccaaaagagatttaccgcgcgtgggatggccgtgaaaaaggcgagaaagcgcagcagcggtggcaggaaaagtttgctgcttatgagaaggcttatcctgagctggccgcggagtttacccgccggatgagcggcggactgccggaggcatgggaatccgccacgcaaaaatttattaacgacttgcaggctaatccggccaaaattgccacccgtaaagcatcgcaaaatacgctcaatgcctatggtcccctgttgccggaactgttgggcggatcggcggatctggcgccgagcaacctgactatctggaaaggttcgacctcgttgaaagaggatccggcaggcaattacatccactatggcgtgcgcgaattcggcatgaccgccattgccaacggcatcgcccaccacggcggctttgtaccgtataccgccacgtttctgatgtttgtcgaatatgcgcgtaacgcggcgcgtatggcggcattaatgaaagcccggcagattatggtctatacccatgattccatcggtttgggcgaagatggcccgacgcaccaggcggtggagcaactggcgagtctgcgcttaacgccaaatttcagcacctggcgtccctgcgatcaggttgaggcggcggtgggctggaagctggctatcgaacgtcaccacggaccaacagcgctgattctctcccggcagaatctggcgcaggtggaacgcacgccggaacaggtaaaagcgattgcccgcggcggttatattctgaaagacagcggcggcaagccggatatcattctaatcgccaccggatcggagatggaaattaccctccaggcggcggaaaaattaaccggcgagggccataacgttcgcgtggtgtcgttgccttcaacggatattttcgatgcgcaggaggaggcatatcgcgaatcggtgctaccatcgcatgtgaccgcccgcgtcgcggtggaagcgggtatagccgactactggtataaatatgttggcttaaaaggcgcaattattggcatgacgggatatggcgaatccgccccggctgacaaactgttcccgtactttggctttaccgtggaaaatattgtagaaaaagctcgccgggtgctgagcatgaaaggctaa

SEQ ID NO: 9921 - protein, 666 aa, Salmonella enterica subsp. arizonae serovar 62:z4,z23:--
MSRKDLANAIRALSMDAVQKANSGHPGAPMGMADIAEVLWNDFLKHNPTDPAWYDRDRFILSNGHASMLLYSLLHLTGYDLPLEELKNFRQLHSKTPGHPEIGYTPGVETTTGPLGQGLANAVGLAIAERTLGAQFNQPDHEIVDHYTYVFMGDGCLMEGISHEVCSLAGTLGLGKLIGFYDHNGISIDGETEGWFTDDTAKRFEAYHWHVVHDIDGHDPEAVKKAILEARSVKDKPSLIICRTVIGFGSPNKAGKEESHGAALGEEEVALTRQKLGWHHPAFEIPKEIYRAWDGREKGEKAQQRWQEKFAAYEKAYPELAAEFTRRMSGGLPEAWESATQKFINDLQANPAKIATRKASQNTLNAYGPLLPELLGGSADLAPSNLTIWKGSTSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAIERHHGPTALILSRQNLAQVERTPEQVKAIARGGYILKDSGGKPDIILIATGSEMEITLQAAEKLTGEGHNVRVVSLPSTDIFDAQEEAYRESVLPSHVTARVAVEAGIADYWYKYVGLKGAIIGMTGYGESAPADKLFPYFGFTVENIVEKARRVLSMKG

SEQ ID NO: 9922 - DNA, 2022 bp, Salmonella enterica subsp. arizonae serovar 62:z4,z23:--
  CDS (1)..(2022): transl_table=11
atggccttcaacatccgatctggagtcaaaatgtcctcacgtaaagagcttgccaatgctattcgtgcgctgagcatggacgcagtacagaaagccaaatccggtcacccgggtgccccgatgggtatggctgacattgccgaagtcctgtggcgtgatttcctgaaccataacccgaccaacccgtcctgggtcgaccgcgaccgtttcgtgttgtctaacggccacggctccatgctgatttacagcctgctgcacctcaccggctatgatctgccgatgtccgagctgcaaaacttccgtcaactgcactccaaaaccccgggccacccggaagtagggtacaccgctggcgttgaaaccactactggcccgctgggccagggtattgccaacgccgtcgggatggcgattgccgagaaaactctggcggcgcagtttaaccgtccgggccacgacatcgttgaccactttacctacgtctttatgggcgacggctgcatgatggaaggcatttctcacgaagtgtgctctctggctggtactctgaaactgggcaaactgatcgcgttctatgatgacaacggtatctccatcgacggccacgttgaaggctggttcaccgatgacaccgcgaaacgttttgaagcctacggctggcacgttatccgtggcattgacggtcacgatgccgacgccattaaacgcgccacggaagaagcccgcgccgtgactgacaaaccgtccctgctgatgtgcaaaaccatcatcggtttcggttcgccgaacaaacagggtacccacgattcccacggcgcgccgctgggcgacgcggaaatcgcgctgacccgcgaacaactgggctggaaatacgcgccgttcgaaatcccgtctgaaatctacgcgcagtgggatgcgaaagaagccggccaggcgaaagagtctgcatggaatgagaagttcgcggcttatgagaaagccttcccgcaggaagcggctgaattcacccgtcgtatgaaaggcgatatgccggctgacttcgatgcgaaagcgaacgagttcatcgctaaactgcaggctaacccggcgaaaatcgccagccgtaaagcgtcccagaatgccatcgaagccttcggcccgctgttgccggaattcctcggcggctccgcagacctcgcgccctctaacctgacactgtggtccggctctaaggcaattaacgaagacgcggcgggtaactacattcactacggcgtgcgcgaattcggtatgaccgccattgccaacggcatcgccctgcacggcggcttcctgccgtacacctccaccttcctgatgttcgtggaatatgcgcgtaacgcggtgcgtatggcggcgctgatgaaacaacgtcaggtgatggtctacacccacgactccatcggtctgggcgaagatggcccgacgcaccagccggttgagcaggtggcttctctgcgtgtgacgccgaatatgtccacatggcgtccttgcgaccaggtggaatccgcggtggcgtggaaatacggcgtggagcgtcaggacggcccgacggcgctgatcctgtcgcgtcagaacctggcgcagcaggaacgtaccgaagagcaactggcgaatatcgcccgcggcggctacgtgctgaaagactgcgacggccagccgcagattatcttcattgcgaccggttcggaagtggagctggcggttgccgcttacgaaaaactgactgccgaaggggtgaaggcgcgcgtcgtgtccatgccgtccacggatgcattcgacaagcaggatgcggcttaccgtgaatccgtgctgccgaaggcggtctctgcgcgtgtggctattgaagcgggtatcgctgactactggtacaaatacgtcggcctgaacggcgctattgtcggtatgaccaccttcggtgaatccgcgccggccgagctgctgtttgaagcgttcggctttacggtggacaacgtgatcgccaaagcgaaagcactgctgtaa

SEQ ID NO: 9923 - protein, 673 aa, Salmonella enterica subsp. arizonae serovar 62:z4,z23:--
MAFNIRSGVKMSSRKELANAIRALSMDAVQKAKSGHPGAPMGMADIAEVLWRDFLNHNPTNPSWVDRDRFVLSNGHGSMLIYSLLHLTGYDLPMSELQNFRQLHSKTPGHPEVGYTAGVETTTGPLGQGIANAVGMAIAEKTLAAQFNRPGHDIVDHFTYVFMGDGCMMEGISHEVCSLAGTLKLGKLIAFYDDNGISIDGHVEGWFTDDTAKRFEAYGWHVIRGIDGHDADAIKRATEEARAVTDKPSLLMCKTIIGFGSPNKQGTHDSHGAPLGDAEIALTREQLGWKYAPFEIPSEIYAQWDAKEAGQAKESAWNEKFAAYEKAFPQEAAEFTRRMKGDMPADFDAKANEFIAKLQANPAKIASRKASQNAIEAFGPLLPEFLGGSADLAPSNLTLWSGSKAINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCDGQPQIIFIATGSEVELAVAAYEKLTAEGVKARVVSMPSTDAFDKQDAAYRESVLPKAVSARVAIEAGIADYWYKYVGLNGAIVGMTTFGESAPAELLFEAFGFTVDNVIAKAKALL

SEQ ID NO: 9924 - DNA, 2001 bp, Salmonella enterica subsp. enterica serovar Paratyphi B str. SPB7
  CDS (1)..(2001): transl_table=11
atgtcccgtaaagaccttgccaatgcgattcgtgcgctgagcatggatgccgttcaaaaagccaattccgggcaccccggcgcgccgatggggatggcggatatcgctgaagtgctatggaacgattttcttaaacataaccccaccgatccgacctggtatgaccgtgaccgttttatcctttccaacggtcacgcctccatgctgctctatagtctgctgcatttaaccggttatgacctgccgctggaggagttaaaaaacttccgtcaactgcactctaaaacgcctggtcacccggagattggctatacgcccggcgttgaaaccaccaccgggccgctgggccaggggctggcgaatgccgtcgggctggcgattgccgagcgtacgttaggcgcacagttcaaccggccggaccatgagattgtcgaccactacacctatgtctttatgggcgacggctgtctgatggaggggatctcgcatgaggtgtgttcgctggctggtacgctgggactgggcaaactgatcggcttttacgatcacaacggcatctccattgatggcgaaaccgaaggctggtttaccgacgataccgccaaacgttttgaagcctaccactggcatgtcgtgcatgacattgacgggcacgatccggaagcggtgaaaaaagccattctcgaagcccagagcgtaaaagataaaccttcgctaattatctgtcggacggtgataggttttggctcgccgaataaagccgggaaggaggagtcgcacggcgcggcgctgggcgaagaagaggtggcgctgacccgccagaagctgggatggcaccatccggcgtttgagatcccaaaagagatttaccgcgcgtgggatggccgtgaaaaaggcgagaaagcgcagcagcagtggcaggaaaagtttgctgcttatgagaaggcttatcctgagctggccgcagagtttacccgccggatgagcggcggactgccggaggcatgggaatccgccacgcaaaaatttattaacgacttgcaggctaatccggccaaaatcgccacccgtaaagcatcgcaaaatacgctcaatgcctatggtcccctgttgccggaactgttgggcggatcggcggatctggcgccgagcaacctgactatctggaaaggttcgacctcgttgaaagaggatccggcaggtaattacatccactatggcgtgcgcgaattcggcatgaccgccattgccaacggcatcgcccaccacggcggctttgtaccgtataccgccacgtttctgatgtttgtcgaatatgcgcgtaacgcggcacgtatggcggccttaatgaaagcccggcagattatggtctatacccacgactccatcggtttgggcgaagatggcccgacgcaccaggccgtggaacaactggcgagcctgcgcttaacgccaaacttcagcacctggcgtccctgcgatcaggttgaggcggcggtcggctggaagctggccattgaacgtcaccacgggccgacggcgttgattctctcgcggcagaatctggcgcaggtggaacgcacgccggaacaggtgaaagcgattgcccgcggcggttatattctgaaagatagcggcggcaagccggatatcattctgatcgctaccggatcggaaatggaaattaccctccaggcggcggaaaaattgactggcgaggggcataacgttcgcgtggtgtcgttgccttcaacggatattttcgatgcgcaggacgaggcatatcgcgaatcagtgctaccggcgcacgtgaccgcccgcgtcgcggtggaagccggtatagccgactactggtataaatatgttggcctaaaaggcgcaattatcggcatgacgggatacggtgaatccgccccggctgacaaactgttcccgtattttggctttaccgtggaaaatattgtagaaaaagcccgccgggtgctgaacatcaaaggctaa

SEQ ID NO: 9925 - protein, 666 aa, Salmonella enterica subsp. enterica serovar Paratyphi B str. SPB7
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLGAQFNRPDHEIVDHYTYVFMGDGCLMEGISHEVCSLAGTLGLGKLIGFYDHNGISIDGETEGWFTDDTAKRFEAYHWHVVHDIDGHDPEAVKKAILEAQSVKDKPSLIICRTVIGFGSPNKAGKEESHGAALGEEEVALTRQKLGWHHPAFEIPKEIYRAWDGREKGEKAQQQWQEKFAAYEKAYPELAAEFTRRMSGGLPEAWESATQKFINDLQANPAKIATRKASQNTLNAYGPLLPELLGGSADLAPSNLTIWKGSTSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAIERHHGPTALILSRQNLAQVERTPEQVKAIARGGYILKDSGGKPDIILIATGSEMEITLQAAEKLTGEGHNVRVVSLPSTDIFDAQDEAYRESVLPAHVTARVAVEAGIADYWYKYVGLKGAIIGMTGYGESAPADKLFPYFGFTVENIVEKARRVLNIKG

SEQ ID NO: 9926 - DNA, 1992 bp, Salmonella enterica subsp. enterica serovar Paratyphi B str. SPB7
  CDS (1)..(1992): transl_table=11
atgtcctcacgtaaagagcttgccaatgctattcgtgcgctgagcatggacgcagtacagaaagccaaatccggtcacccgggtgccccgatgggtatggctgacattgccgaagtcctgtggcgtgatttcctgaaccacaacccgaccaacccgtcctgggccgaccgcgaccgcttcgtgctgtccaatggccacggctcaatgctgatttacagcctgctgcacctcaccggttatgacctgccgatgtccgagctgcagaatttccgtcagctacattcaaaaacccctggtcacccggaagtgggctacaccgctggcgttgaaaccactactggcccgctgggtcagggtattgccaacgccgtcgggatggcgattgccgagaaaactctggcggcgcagtttaatcgtcctggccacgatatcgttgaccacttcacctacgtctttatgggcgacggctgcatgatggaaggcatttctcacgaagtttgctctctggctggtactctgaaactgggcaaactgatcgcgttctatgatgacaacggtatctctatcgatggtcatgttgaaggctggttcaccgatgacaccgcgaaacgttttgaagcctacggctggcacgttatccgtggcattgacggtcacgatgccgacgccattaaacgcgccacggaagaagctcgcgccgtgactgacaaaccgtccctgctgatgtgcaaaaccatcatcggtttcggttcgccgaacaaacagggtacccacgattcccacggcgcgccgctgggcgacgcggaaatcgcgctgacccgcgaacagttgggctggaaatacgcgccgttcgaaatcccgtctgaaatctacgcccagtgggatgcgaaagaagccggccaggcgaaagagtctgcatggaatgagaaattcgcggcttatgagaaagccttcccgcaggaagctgctgaattcactcgtcgtatgaaaggcgacatgccggctgacttcgatgcgaaagcgaatgagttcatcgctaaactgcaggcgaatccatccaaaatcgccagccgtaaagcgtcccagaatgccatcgaagccttcggtccgctgttgccggaattccttggcggctctgcagacctggcaccgtctaacctgaccctgtggtctggttctaaggctatcaacgaagatgccgcaggtaactacattcattacggtgtgcgcgaattcggtatgaccgctatcgccaacggtatcgccctgcacggcggtttcctgccgtacacctccaccttcctgatgttcgttgaatatgcccgtaacgcagtgcgtatggcagcgttgatgaaacagcgtcaggtgatggtctatacccacgactccatcggtctgggcgaagatggcccgacgcaccagccggtcgagcaggtggcaagcctgcgcgtaacgccgaacatgtccacatggcgtccgtgcgaccaggtagaatccgcggtggcgtggaaatatggcgtagagcgtcaggatggcccaaccgcgctgatcctctcccgtcagaacctggcgcagcaggaacgtactgaagagcaactggcgaatatcgcccgcggtggttacgtactgaaagattgtgcgggccagccgcagattatcttcattgcgaccggttctgaggttgagctggcggttgccgcttacgaaaaactgactgccgaaggcgtgaaggcgcgcgtggtttccatgccgtccaccgacgcgttcgacaagcaggatgcggcctaccgtgaagctgtcctgccgaaagcggtctctgcacgtgtggcgattgaagcgggtatcgctgactactggttcaaatacgtcggcctgaacggcgctattgtcgggatgaccaccttcggtgaatccgccccggcagagctgctgtttgaagagtttggcttcacggtggacaacgtgatcgccaaagcgaaagcgctgctgtaa

SEQ ID NO: 9927 - protein, 663 aa, Salmonella enterica subsp. enterica serovar Paratyphi B str. SPB7
MSSRKELANAIRALSMDAVQKAKSGHPGAPMGMADIAEVLWRDFLNHNPTNPSWADRDRFVLSNGHGSMLIYSLLHLTGYDLPMSELQNFRQLHSKTPGHPEVGYTAGVETTTGPLGQGIANAVGMAIAEKTLAAQFNRPGHDIVDHFTYVFMGDGCMMEGISHEVCSLAGTLKLGKLIAFYDDNGISIDGHVEGWFTDDTAKRFEAYGWHVIRGIDGHDADAIKRATEEARAVTDKPSLLMCKTIIGFGSPNKQGTHDSHGAPLGDAEIALTREQLGWKYAPFEIPSEIYAQWDAKEAGQAKESAWNEKFAAYEKAFPQEAAEFTRRMKGDMPADFDAKANEFIAKLQANPSKIASRKASQNAIEAFGPLLPEFLGGSADLAPSNLTLWSGSKAINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPQIIFIATGSEVELAVAAYEKLTAEGVKARVVSMPSTDAFDKQDAAYREAVLPKAVSARVAIEAGIADYWFKYVGLNGAIVGMTTFGESAPAELLFEEFGFTVDNVIAKAKALL

SEQ ID NO: 9928 - DNA, 1956 bp, Thermus thermophilus HB27
  CDS (1)..(1956): transl_table=11
atgaaggagacgcgggacctagagaccctttcggtgaacgccatccgcttcctggccattgacgcggtggagaaggcgaggagcggccaccccgggatgcccatgggcatggcgcccctggcctacctcctcttccgggaggtcatgcgccacaaccccttagaccccgactggcccgaccgggaccggttcgtcctctcggcggggcacgggtccatgctcctctacgccgtcctccacctcacgggctacgaccttcccctggaggagctgaaaagcttccgccagtgggggtccaagaccccgggccaccccgagcgcggccacaccccgggggtggaggtgaccacggggcccttggggcaggggatctccaccgccgtggggcttgccctggcggaaaggaagctcgccgccgagttcaaccgcccggggcacgtggtggtggaccactacacctacgtcctcgcctcggacggggacctgatggagggggtctccggggaggccgcctccttggcggggcactggggcctctccaagctcatcgtcttctgggacgacaaccgcatctccattgacggccccacggacctcgccttcaccgaggacgtcctcgcccgttaccgggcctacggctggcagacccttagggtggaggacgtgaacgacctcgaggccctccgcaaggccatcaagctcgccaagctggacgagcgccccaccctcatcgccgtgcggagccacatcggcttcggctcccccaagcaggactccgccaaggcccacggggagcccttgggccctgaggcggtggaggccacccggaggaacctgggctggccctacccgcccttcgtggtgcccgaggaggtctaccgccacatggacatgcgggagaaggggcgggcctggcaggaggcctgggaaaaggccctcgaggcctacgcccgggcgtacccggacctctaccaggagctcatgcggcgcctgcgaggggagcttccgcccttgcccgaagagcccccatcctttgacaagcccatcgccacccgggcggcgagcggccgggccctgaacctcctcgccccccgcctccccgagctccttgggggaagcgccgacctcaccccctccaacaacaccaaggccgaggggatggaggacttctcccgggcgaaccctttgggccgctacctccacttcggggtgcgggagcacgccatgggggccattctgaacggcctcaacctccacggggggtatcgggcctacggcgggaccttcctcgtcttctccgactacatgcgccccgccatccgcctcgccgccctcatgggggttcccacggtcttcgtcttcacccacgactccattgccctgggcgaggacggccccacccaccagcccgtggagcacctcatgtccctcagggccatgcccaacctctttgtgatccgccccgcggacgcctacgagaccttctacgcctggctcgtggccctgaggcgtaaggaaggccccaccgccctcgtcctcacccgccaggcggtgcccctcctctccctggagaaggccagggggcttttgcggggaggctacgtcctggaggacgtggaggagccccaaggggtcctcgtggccacggggagcgaggtgcacctggcccttagggcccaggccctcctccgggagaagggggtgcgggtccgggtggtgagcctgccttcctttgagctcttcgccgcccagcccgaggcctaccggaaggaggtcctgcccccgcggcttccggtggtggccgtggaggcgggggccagcctggggtgggagcggtacgcccacaaggtggtggccctggaccgcttcggggccagcgccccctaccccgaggtctacgagcggctcggcttcaccccggagagggtggcggaggccttcctctccctggtgtaa

SEQ ID NO: 9929 - protein, 651 aa, Thermus thermophilus HB27
MKETRDLETLSVNAIRFLAIDAVEKARSGHPGMPMGMAPLAYLLFREVMRHNPLDPDWPDRDRFVLSAGHGSMLLYAVLHLTGYDLPLEELKSFRQWGSKTPGHPERGHTPGVEVTTGPLGQGISTAVGLALAERKLAAEFNRPGHVVVDHYTYVLASDGDLMEGVSGEAASLAGHWGLSKLIVFWDDNRISIDGPTDLAFTEDVLARYRAYGWQTLRVEDVNDLEALRKAIKLAKLDERPTLIAVRSHIGFGSPKQDSAKAHGEPLGPEAVEATRRNLGWPYPPFVVPEEVYRHMDMREKGRAWQEAWEKALEAYARAYPDLYQELMRRLRGELPPLPEEPPSFDKPIATRAASGRALNLLAPRLPELLGGSADLTPSNNTKAEGMEDFSRANPLGRYLHFGVREHAMGAILNGLNLHGGYRAYGGTFLVFSDYMRPAIRLAALMGVPTVFVFTHDSIALGEDGPTHQPVEHLMSLRAMPNLFVIRPADAYETFYAWLVALRRKEGPTALVLTRQAVPLLSLEKARGLLRGGYVLEDVEEPQGVLVATGSEVHLALRAQALLREKGVRVRVVSLPSFELFAAQPEAYRKEVLPPRLPVVAVEAGASLGWERYAHKVVALDRFGASAPYPEVYERLGFTPERVAEAFLSLV

SEQ ID NO: 9930 - DNA, 1995 bp, Desulfovibrio vulgaris subsp. vulgaris str. Hildenborough
  CDS (1)..(1995): transl_table=11
atgccgtctcgcaaggattttgccaatgccattcgcgtcctgagcatggatgcggtcgaaaaggccaagtcggggcaccccggtgcacccatgggtatggccaacatcgccgaagccctctggagagggccgctgcgccacaaccccgccaacccgcactggcccgaccgtgaccgtttcgtgctctccaacgggcacggttccatgctcatctacgcgctgctgcatctcaccggctatgccgtgagcatggacgacatccgtgattttcgccagatgggctcgcgtacgccgggacaccccgagtacggcatcacccccggggtcgagaccaccaccggccccctcgggcagggcatcgccaccgccgtgggtatggccatggccgagcgtatgctcgccaccgggttcaaccgtgacggcttccccgtggtcgaccaccacacctatgtgttccttggtgacggctgcatgatggaaggcatctcgcacgaggcatgctcccttgcgggcacgctgggcctcggcaagctcatcgccttctacgatgacaacggcatctccatcgatggcgaggtcaagggctggttcgccgacgacacccccgcccgcttcgaagcctacggctggcatgtggtacgcgatgttgatggccacgatgctgcggccctcgatgccgccctcgccgccgcgcgtgcgcagaccggcaagcccagcctcatctgctgcaagacctgcatcggcagtggtgcccccaacaagtgcggcagccacgactgccacggttcgcctctgggcgaggccgagattgccgccgcccgcgaggccatgaactggccgcacccgccgttcgagattcccgccgacatctatgccgcgtgggattgccgcgacaagggtgccaaggacgaagccgcatggcgtgagatgttcgagggctaccgcaaggcgtaccccgaccttgccgccgcattcgaacgccgcatgtccggtgaacttcccgccaactgggaagccgaggtcgaagcctgcatcgccgccaccgacagcgccgcagagaagctggcgacgcgtgtggcttcgcgcaacgccctcaacggcatcgcgccgctgctgcctgaactcgtgggcggttccgccgacctcaccggttcggtgggcacatggcacaaggggtcggttcgcctcacccccgacaactgggacgccaactacatctcctacggggtgcgcgagttcgccatgggggccatcatgaacggcctcaccctgcatggcggcttcatcccctacgccggcaccttcctcatcttctccgactacgccaagaacgccatccgcctttcggccctgatgggcatccgcgtggtgtgggtgctgacccacgactccatcggcgtgggcgaggacggccccacccaccagcctgtcgaacagctgggcgggctgcggctcattcccaacgtctcggtatggcgtccgtgcgacacggtcgagaccgtggccgcttggaagagtgccatcgaatgcgccaccggccccacatgcatctccctcacccgtcagggtgtgccgcacatcgcccgcacagccgaacagcgtgcggccatcgggcgcggcggctacatcctgcgcgactgcgcgggcaagcccgaagccatcatcatggctacggggtctgaagtgcaactggctgtcgaggccgctgccgaacttgagaagcgtggtcgccgcgtgcgcgtcgtttccatgccttcgtcttccgtcttcgaccggcaggatgccgcctaccgtgagagcgtcctgccctccgacgtgcgcgtgcgcgtggccgtggaggccgccgcgtccgacgcatggtggaagtatgtgggtctcgacggcaaggtggtcggcatgaccggtttcggcgagtccgcacccggcggtgtcctgttcaagcatttcggcttcaccgtggacaacgtggtggataccgtcacgtcgcttctctag

SEQ ID NO: 9931 - protein, 664 aa, Desulfovibrio vulgaris subsp. vulgaris str. Hildenborough
MPSRKDFANAIRVLSMDAVEKAKSGHPGAPMGMANIAEALWRGPLRHNPANPHWPDRDRFVLSNGHGSMLIYALLHLTGYAVSMDDIRDFRQMGSRTPGHPEYGITPGVETTTGPLGQGIATAVGMAMAERMLATGFNRDGFPVVDHHTYVFLGDGCMMEGISHEACSLAGTLGLGKLIAFYDDNGISIDGEVKGWFADDTPARFEAYGWHVVRDVDGHDAAALDAALAAARAQTGKPSLICCKTCIGSGAPNKCGSHDCHGSPLGEAEIAAAREAMNWPHPPFEIPADIYAAWDCRDKGAKDEAAWREMFEGYRKAYPDLAAAFERRMSGELPANWEAEVEACIAATDSAAEKLATRVASRNALNGIAPLLPELVGGSADLTGSVGTWHKGSVRLTPDNWDANYISYGVREFAMGAIMNGLTLHGGFIPYAGTFLIFSDYAKNAIRLSALMGIRVVWVLTHDSIGVGEDGPTHQPVEQLGGLRLIPNVSVWRPCDTVETVAAWKSAIECATGPTCISLTRQGVPHIARTAEQRAAIGRGGYILRDCAGKPEAIIMATGSEVQLAVEAAAELEKRGRRVRVVSMPSSSVFDRQDAAYRESVLPSDVRVRVAVEAAASDAWWKYVGLDGKVVGMTGFGESAPGGVLFKHFGFTVDNVVDTVTSLL

SEQ ID NO: 9932 - DNA, 1998 bp, Listeria monocytogenes str. 4b F2365
  CDS (1)..(1998): transl_table=11
atgagcagaattgatgaacaaatggttaactcgattcgcgtattatcaatggatatgattgaaaaagcgaactccggccatcccggtttgccgatgggagccgcaccaatggctttctcgctttggaaaaatcatttaaaattcaatccagaacacccaacttggtttaaccgcgatcgcttcgttttgtcagctggtcacggttcggcaatgctttatagtttgctacatctatttggttatgatttaccaatgagcgagctgaaaaacttccgccaaactggtagtaaaacgcccggtcatcctgaattcggtcatacggttggtgtcgatgcaactaccggtccacttggtcaaggtttcgcaatgggagttgggatggcgatggccgaggctcaccttggcgccaaatttaaccaacctgaattcccggttgttgaccataatacctacgtgctatgcggagacggctgtttgatggaaggtatttcctacgaagctgcatcccttgctggtcatttaaaactgggaaaattagttgttttatatgattcgaatgatatctcactggatggcgatttaaacgagtctttttcagaagacatcgaactcagattccgagcagccggttggcaaacgctacgtgtggacgacggaaatgacttagatgcgcttgatgcagcaatccatctcgcaaaaaccgagaaatcccgccctactttaatcgaagtgaaaacggtcatcggttacggtagccctggtaaagccggaaaatcggcggcacacggctccccacttggcgaaaaagaactcaaacttgcaaaagaagcttacgattggcaaatgccaccttttgaattaccaaaaactgtcgaaaatcagaaagaattttatcattctaaaggtcgcgcgagtgaaagcagctggctccggacattcaatgcttacaaacaaaaatatccagcactcgcagaaagtttgcaacaattaatggatgataatttggatgcggattgggatgcagaacttcctgtcttcgatgaaaatgcggacaaagccgttgcaacccgtgaagtatcaggaattgttctacaagaattggagaaaaaactgcctaacctatttggtggcgcggccgatttggcctcctccaataaaacccatttaaaagctagcgaacggtttgctccaggtaactatgccgccaaaaatatctcattcggcgtccgcgagttcgcaatgggagcagcagtcaacggaatgacgcttcacggcggtgttcaagctttcggcgcaaccttcttcgtattctcggattatctacgttccgcgattcgttcagcagctttaatgggcattccatccactttcatcatgacccatgattccatcgcagtcggtgaagacggtccaacgcacgaaccaatcgagcatctcgcatccttccgcgccatgccgggacttcacgtcatccgaccagctgacggcaacgaaaccgtcgaagcataccgctatgcctttactcaaaaagaacaaccaaccatgctcgttcttagccgccaaaacctgccaattttaccaaatagcgcagcaaaagcgcaaaccggacttgcaaaaggtgcttacatcttagccgattccccgcttgataaactagatattatcttactcgcttctggatccgaagtacacctaatgacagctgtcagagataatctcgctaaaaaaggcttcggagcacgcgtagtcagcatgccaagctttgatttattcgacaaacaaagccctgaatataaagagtccgttttaccaaaagcagtgaaaaatcgcttcgccgcagaaatgggcgcatcatacggctggcacaaatacctcggcgacacaggccaaatcctcgcgattgattcgtttggtatgtctggcccgggagatgagctagcaagacgatttggctttactgtagagaacttgacggagcttgcgttgaagcagttgtag

SEQ ID NO: 9933 - protein, 665 aa, Listeria monocytogenes str. 4b F2365
MSRIDEQMVNSIRVLSMDMIEKANSGHPGLPMGAAPMAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQQLMDDNLDADWDAELPVFDENADKAVATREVSGIVLQELEKKLPNLFGGAADLASSNKTHLKASERFAPGNYAAKNISFGVREFAMGAAVNGMTLHGGVQAFGATFFVFSDYLRSAIRSAALMGIPSTFIMTHDSIAVGEDGPTHEPIEHLASFRAMPGLHVIRPADGNETVEAYRYAFTQKEQPTMLVLSRQNLPILPNSAAKAQTGLAKGAYILADSPLDKLDIILLASGSEVHLMTAVRDNLAKKGFGARVVSMPSFDLFDKQSPEYKESVLPKAVKNRFAAEMGASYGWHKYLGDTGQILAIDSFGMSGPGDELARRFGFTVENLTELALKQL

SEQ ID NO: 9934 - DNA, 1995 bp, Listeria monocytogenes str. 4b F2365
  CDS (1)..(1995): transl_table=11
ttgttcgataacacagatagtttagcagtgaatacaattcgtacattatcaatggacgcaattcaaaaagcaaattctggtcatccaggattaccaatgggagcagcaccaatggcttacgcactttggtcgcgtgtattaaatactaaccctaagaattcacattggtttaaccgagatcgttttgtactttctgctggacacggctcaatgcttttatatagtttattacacttaagtggattcaaattagaattagaagatcttaaaaatttccgtcaatgggaaagtaaaactcctggtcacccagaatatcgttatacagatggtgtagacgcaactactggtccacttggtcaaggtattgcgatggctgttggtatggctatggcagaaagacatttagaagcgaaatataataaagatggtttcccggtagtggatcattatacttatgcactatgcggagatggtgacttaatggaaggtgttgcttcagaagcggcttcttatgcaggtcatcaacaattaggaagattagttgttctctatgattccaatgatatctctcttgatggtgatttagacaaatctttctctgaaaatgtaaaacaacgctttgaagcttatggctgggaacatttattagtaaaagacggtaatgatacagctgaaattttagcagcaatcgaaaaagcgaaacaaaacacttctcaacctactatgattgaagtgaaaactgttatcggttttggtgctccaaatgccggtacaagtaaagttcacggtgctccactaggcgatgaaggtattttagaagcgaaaaaagcttatggttggaactacgaagagaaattctttgttcctgaagaagttactgctcgctttaaagaaacaattggcgaacgtggtgaaaaagcagaaacagcttggaatgagttatttgcttcctataaagcagaatatccagagcttgcgaaacaattagaagatagcttgaacaacaagttaccagctgattgggatgaggatcttccagtatatgatgattcaaaagcacttgctagccgtgcttccagtggagaagttatcaatgcgttagctggaaaaatcccaactatttttggcggatctgctgaccttgcaggttcgaataatacaacaattaaaacagacggtgaatttacaaaagcgactccagctgaaagaaacatttggtttggtgttcgtgaatttgcgatgggcgctgcattaaatggtatggcacttcacggcggattacaagtatacggtggtacattcttcgtattctctgactatgtacgtgctgctattcgtttatcagctattcaacatttaccagtaacctatgtaatgacgcatgatagtattgcagttggggaagatggcccaacacatgagccaatcgaacaacttgcaagcttacgtgcaatgccagggctttctgttattcgtcctgctgatggaaatgaagttgtggaggcttggaaacttgctatcacttctacatctacaccgcatgtacttgttcttactcgtcaaggcctaccaacactaccaaattctgctaaattaactgcagaaggcgttaaaaaaggtgcttatgttatttccccagctaaaggtgacgtgccagaagcaatcatcctagcgagtggttctgaagttaacttagctattgaagcgcaaaaagaacttcaagctcaaggaacagatgtatcagttgtcagtgtgccatcatttgatctattcgagcaacaatctgctgagtacaaagaaagtgtattaccgaatgctgttagaaaacgtgtagcagtagagatgggcgctagctttggatgggaacgttatgttggtttagatggtaaagttatcggaattgacaaatttggtgcttctgctccaggtgaaacagttattaagaattacggctttactgttgaaaacgtagttaatacagtaaaatcactttaa

SEQ ID NO: 9935 - protein, 664 aa, Listeria monocytogenes str. 4b F2365
MFDNTDSLAVNTIRTLSMDAIQKANSGHPGLPMGAAPMAYALWSRVLNTNPKNSHWFNRDRFVLSAGHGSMLLYSLLHLSGFKLELEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTARFKETIGERGEKAETAWNELFASYKAEYPELAKQLEDSLNNKLPADWDEDLPVYDDSKALASRASSGEVINALAGKIPTIFGGSADLAGSNNTTIKTDGEFTKATPAERNIWFGVREFAMGAALNGMALHGGLQVYGGTFFVFSDYVRAAIRLSAIQHLPVTYVMTHDSIAVGEDGPTHEPIEQLASLRAMPGLSVIRPADGNEVVEAWKLAITSTSTPHVLVLTRQGLPTLPNSAKLTAEGVKKGAYVISPAKGDVPEAIILASGSEVNLAIEAQKELQAQGTDVSVVSVPSFDLFEQQSAEYKESVLPNAVRKRVAVEMGASFGWERYVGLDGKVIGIDKFGASAPGETVIKNYGFTVENVVNTVKSL

SEQ ID NO: 9936 - DNA, 2016 bp, Listeria monocytogenes str. 4b F2365
  CDS (1)..(2016): transl_table=11
ttgaaaaaaacattagatagacaagccgtggacacgattcgttcgttatccattgatatgattgagaaagcaaattcaggacacccaggaatgccgatgggagcagctccaatggcgtatatgctatttgcgaaacatttagtattcaacccagccaacccagaatggtttaaccgcgatcgctttgttttatcagcaggacacgggtctgcgctactttatagcatgcttcatttatttggttatgatgtaaaaatggaagacttaaaacagttccgtcaattagatagtttgacaccaggacaccctgaatttggatggactgctggagtcgatgcaacgagtggcccgcttggacaagggattggtatggcggctggaatggcgcttgcagagtctcatttagcggcggagtataaccaaccaaattatccaattgtcgaccattatacgtatgcgatttgtggtgacggagacttgatggaaggcgtggcatcagaaacagcctcacttgcaggacatttaggacttgggaaattaatcgtattgtacgattccaatgatatttgtttagatggagatttaagcgcaacgttcagtgaaaatgcagcagaccgtttccgcgcatacggctggcaagttttacgtgtagaagatggcaacaatttagcggcaattcaagaaaaaattgttcaagcaaaattagaaacatcgaaaccaacgctaatcgaagtgaaaacagtcatcggttacggcgcaccaacaaaagcaggcagctccgcaagtcacggtgctccgctcggtgaaaaagaagcaaatggtgcaaaagagcattacgaatgggcagaagaacctttcacagtaccagccgaagttcgtgattacttaagaaattacaaagctcgcggggaaaaactagagggtgcttggaacacaatgctcgctaattacaaaaaagaattcccagaacttgcaagtcaattagaccgcgtgttagcgggagaagtagctgccgattggaacgctaatttgccaacttttgaagcaggcacaaatgttgcaacgcgctctgcttctgggaaaatgattaacgcaattgcagccgaattaccggaacttttcgggggatccgctgacttaggttgctcgaacaaaacatttattgatgcgagcccagcatacagcattcaagacccagctggtaaaaatatctggttcggtgtgcgcgaatttgcgatgggagcaatgttaaacggaatggcacttcatagcggtttgcgagtgtttggctcgactttcttcgtcttctcagactatgtccgcccagcaatgcggatggctgctttaatgcaacttccagtaacgtatgtattcacgcatgacagtatcgctgtaggtgaagacggcccgacacatgaaccaatcgaacaactagcctcgcttcgtgctatgccaggcctaacagttattcgcccagccgatgccaaagaaacccgcgctgcttgggaaattgccgcaactaacacaaatggtccaatcgcacttgtattatcacgccaagacttaccagtgcttgaaaatgcacaagaagaagtggatgcaggtgtagataaaggtgcttatatcgtagcaccagcaaatagttccaaaccagacgctatcattatcgcaacaggatcagaagtgtcccttgcaattgaagcgaaagccgaacttgcgaaaaaagatatcgacgtttccgttgttagtttatccagctgggaacgctttgaaaaaacaaccgatgcttataaagaaagcattttaccaaaagaagtcacagcgagatttgcgattgaagcaggagcaacattcggttggaaagaatttattgggtcagaaggcgatatgttaggaatcgatcacttcggcgcatctgcccctgcgaaagatttgtttaacgcttatggatttacaccagaaaatgtggcggatcgtgtcgaaactgtgattgcgaaagccggtgtgcgcgtatga

SEQ ID NO: 9937 - protein, 671 aa, Listeria monocytogenes str. 4b F2365
MKKTLDRQAVDTIRSLSIDMIEKANSGHPGMPMGAAPMAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELASQLDRVLAGEVAADWNANLPTFEAGTNVATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTNGPIALVLSRQDLPVLENAQEEVDAGVDKGAYIVAPANSSKPDAIIIATGSEVSLAIEAKAELAKKDIDVSVVSLSSWERFEKTTDAYKESILPKEVTARFAIEAGATFGWKEFIGSEGDMLGIDHFGASAPAKDLFNAYGFTPENVADRVETVIAKAGVRV

SEQ ID NO: 9938 - DNA, 1842 bp, Mycoplasma mobile 163K
  CDS (1)..(1842): transl_table=4
atgaatacaaataaattagatactttagcaattaacacactaaaagtgaatggaattgctcaaattttaaaagcaaatagtggtcatcccggaattgttctaggagctgcaaaaattatgcataaccttttctcaaatcacataaattttaatgtggaaaatccaaattgaattaaccgtgatcgttttatattaagttctggtcatggatcagcattattatatgcacaattaagagcaataggacttttagatgtaaaagaattgcacaattttagacaagtagattctaaaacacctggacatcctgaatatttacatactctaggagtcgaagctacaacaggacctctaggacaaggggttgctattgcagttggaatagctcttgctgaagcaaatttaaatgcaagatttaatgaaataagccattttacatatgttcttttaggagatggtgatttacaagaaggagttgcaaatgaagcaatgcaatttgcaggtacaaatcaattaaataaactaattttaattcatgattcaaatcgtattcaacttgatactcctgttgaaaatgtttctaaagtagatattaaaaaaatggtagaatcttttgggttccaacatatttcagctacaaatgaaaattttaatgaagcagttgaaattgctaaaaagaattcaaaaccttcttttattgaagtaagaacaattattggcgaagattcaattgaagcaggaactacaaaagttcatggtactcctctaacaaaagaagattttagtaatttaaagaaaaaattaaattgagaatatagtgatgattttcatctaccaattgaagtaattgaacactacaaaaaaactttgcatactcgttctaaaaaagcttttaataattttaaagcttctaaatctcttgagactttcttagcaactaaaagtattgacattaaagtagagcttcctaaaaataaagctactcgcgaaactggtggattagtgattgattttctaaataaaaatgatattagatgaatcggaggaagtgctgatgttggctcttcaactaaaggccttggaggagatggagatttttctatttcaaataaaaaaggaagaaatattagatatggtgtaagagaatttgctatggcttcgattgctaatggaattgctttacattctaactttaaaacttttgtaaccacatatttttcttttagtgattatttaaaacctgcagcacgtctaagtgcattaatgaatttacctgttatttacatttttactcatgatagtattcaagtaggtgaagacggaccaacacatcaaccaattgaacaattagcaatgtgaagatctattccaaactttaaagtgtacaggccagctgatgaaaaagaagttttaggagcatttaaattagctcttgaatcaaaatctaatccttctgtattagttttatcaagacaagcaattacttctttagaagaaacaaatgcaaataaagtatctcaaggagcttatcatgttttaaaatcttcaagtgaatgaactttagtttctacaggagcagatttagctaatgcttataaaattgcaaaagaacttaaattaaatttagtttctcttccttcttttgattttaaaaatatttcttgagatataaataaagccatttcaatcgaaacagcaacaacatttggttgaactaaatttgcaaaatataactttggaatcgatacttttggagcttctggaaaacctgatgatgtaatgaaaaaatttgaaatggatttaaattcattacttccaaaaattaaaaaattaattaagtaa

SEQ ID NO: 9939 - protein, 613 aa, Mycoplasma mobile 163K
MNTNKLDTLAINTLKVNGIAQILKANSGHPGIVLGAAKIMHNLFSNHINFNVENPNWINRDRFILSSGHGSALLYAQLRAIGLLDVKELHNFRQVDSKTPGHPEYLHTLGVEATTGPLGQGVAIAVGIALAEANLNARFNEISHFTYVLLGDGDLQEGVANEAMQFAGTNQLNKLILIHDSNRIQLDTPVENVSKVDIKKMVESFGFQHISATNENFNEAVEIAKKNSKPSFIEVRTIIGEDSIEAGTTKVHGTPLTKEDFSNLKKKLNWEYSDDFHLPIEVIEHYKKTLHTRSKKAFNNFKASKSLETFLATKSIDIKVELPKNKATRETGGLVIDFLNKNDIRWIGGSADVGSSTKGLGGDGDFSISNKKGRNIRYGVREFAMASIANGIALHSNFKTFVTTYFSFSDYLKPAARLSALMNLPVIYIFTHDSIQVGEDGPTHQPIEQLAMWRSIPNFKVYRPADEKEVLGAFKLALESKSNPSVLVLSRQAITSLEETNANKVSQGAYHVLKSSSEWTLVSTGADLANAYKIAKELKLNLVSLPSFDFKNISWDINKAISIETATTFGWTKFAKYNFGIDTFGASGKPDDVMKKFEMDLNSLLPKIKKLIK

SEQ ID NO: 9940 - DNA, 2001 bp, Bacillus anthracis str. Sterne
  CDS (1)..(2001): transl_table=11
atgtcacattcaatcgaacaactttctatcaacacgattcgcacattatccatcgatgcgattgaaaaagcaaactctggtcacccaggaatgccaatgggtgcagcaccaatggcttatacattatggactcaatttatgaaacacaatccaaataacccaacgtggtttaaccgtgatcgtttcgtattatctgcaggtcatggttcaatgttattatacagcctacttcacctatctggttatgatgtaacaatggatgacttaaagaacttccgtcaatggggaagcaaaactccagggcatcctgagtacggtcatacagctggtgtagatgcaactactggtccacttggacaaggtattgcaactgctgtaggtatggcaatggcagaaagacatttagctgctaaatataaccgtgatgcgtataatatagtagatcattatacatacgctatttgtggtgatggagatttaatggaaggcgtttctgctgaagcatcttcattagctgctcatttacaattaggtcgtcttgttgtgctttatgattcaaacgatatttcattagatggcgatttaaatcgttcattctctgaaagtgtagaagatcgttacaaagcatacggatggcaagtaatccgtgttgaggatggaaacgatattgaagctatcgcgaaagcaatcgaagaagcgaaagctgacgaaaaacgcccaacgctaattgaagtaagaacgacaattggtttcggttctccaaacaaatcaggaaaatcagcttcacatggttctccacttggtgtagaagaaacaaagttaacgaaagaagcatacgcttggactgctgaacaagacttccatgtagcagaagaagtatatgaaaacttccgtaaaacagtacaagatgttggtgaaactgcacaagctgagtggaatactatgctaggtgaatatgcacaagcatatccagaattagcaaacgaactgcaagcagcaatgaacggtcttcttccagaaggttgggagcaaaacttaccaacttatgaattaggatcaaaagcagcaactcgtaattcttcaggtgctgtaattaatgcaattgcagagtctgtaccatcattcttcggtggatctgctgaccttgctggttctaacaaaacatacatgaataacgaaaaagactttacaagagatgattacagcggtaaaaacatttggtacggtgtacgtgagttcgcaatgggtgcagcaatgaacggtattgcactacatggtggtttaaaaacttacggtggtacgttcttcgtattctctgactacttacgcccagcaattcgtcttgcagcattaatgcaattgccggtaacgtatgtattcacacacgacagtatcgctgttggtgaagatggtccaacacatgaaccaatcgagcaattagcagcgctacgtgcaatgccaaatgtatctgttattcgtccagctgacggtaacgaatctgttgcagcttggagactagctctagaatctacaaacaaaccaactgctttagtattaactcgtcaagatcttccaacattagaaggtgcaaaagacgatacgtatgaaaaagtagcaaaaggtgcgtatgtagtttctgcaagcaagaaagaaacagctgatgtaatcttacttgcaactggatctgaagtaagtctagctgttgaagctcaaaaagcattagcagtagacggcgttgatgcatctgttgtcagcatgccatctatggatcgctttgaagctcaaacagctgagtacaaagaatctgtattaccaaaagcagtaacaaaacgtttcgcaatcgaaatgggtgctacattcggatggcaccgttacgtaggtcttgaaggagatgtgttaggtatcgatacattcggtgcttctgctcctggtgagaagattatggaagagtatggatttactgtagagaacgttgttcgtaaagtaaaagaaatgctttaa

SEQ ID NO: 9941 - protein, 666 aa, Bacillus anthracis str. Sterne
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNIVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYENFRKTVQDVGETAQAEWNTMLGEYAQAYPELANELQAAMNGLLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 9942 - DNA, 2007 bp, Bartonella quintana str. Toulouse
  CDS (1)..(2007): transl_table=11
atgataaataccgagcaacaaaatcagatggctaatgctatccgttttcttgctattgatgcaattgagaaagcgaattctggccatcctggtttgccaatgggagcagccgatattgctaccgttctttatacaaagttccttgcccatgatcccaaaaatcctcattggcccgaccgtgatcgttttgtgttgtcagctgggcatggggctatgttgctttatgctctcttgtatctttctggttatgaagatatctcacttgaggatctcaaaaatttccgccaaatagggtcaaagcttgctggacatccagaatatgggcacgctgcgggaatcgaaacaaccactggtccccttgggcagggattagctaatgccgtgggaatggcgttgggtgagcgcttgcagaatgcacggtttggcgatatcattaaccattatacctatgcgcttgttggtgatggatgcctcatggaaggaattgcccaagaagccatttcttttgctggacatttaaaacttcataagcttatcgtgttatgggatgataataatatttccatcgatggagagatttctcttgctgacagtactgaccagatggcacgttttaaagcgtctggttggaatacatacaaagtcgatggacatgaccaaggagcaatcgctcgtgctattgaagctgcacaaaattccgataaaccaactttgatcgcttgtaaaacaaccattggctttggagcaccaaataaagctggaaccaataaagtccatggggcacctttaggaacgcgcgaaattgctgaaacacgtatcgctttaggatgggaggctgagcctttcgttattccagccgatattctcgataattggcgcttggctggtcttaatgccgctaaaaaacgacaaaaatggaaagaaaaatttgcggatcttcctctgtcagaacggatagagtttgaaaggttgatgcgcggcgatcttgtgggcggatttgatggcgctatcgatgcttataaacaaaagctagttgaagattgtccttgcgttgcaactcgtaaagcttctgaaatggctcttgaagttattaatgaaaccgttattgagaccattggtggttctgctgacttaaccgggtctaataatacaaaaagcagtcagatgaaaagtatctctgctgaagacttttcaggtcgctatctgcattatggaattcgcgaacatgcaatgggagccgtgatgaatggtctagctctgcatggaggctgtattccttatggcggaacctttttatgcttttctgactatatgcgtcccgcaatgcgtttgtcttctctcatgggtttacgggtgatttatgtcatgacccatgattccattggtcttggtgaagatggtccaacccatcaaccagtggagcatttggctgcattgcgtgcacttcccaatcattttgttttccgacccgcggacgctatggagactgttgagtgttggcaattggctttgaaagcacgcaatacaccttctactttggctttgagccgacaaaatttaccgcttttgcgtcaagaatatgaaaaagaaaacctctgtatgctcggtgcttatgaattgctaacagccagtgatgatgcgcaagttactttgttttcttccggatcagaattgcaaattgcagtaaaggcacaggcgctgttagaagaaaacgcaattccaacgcgtgtggtttctgtaccttgttttgaactctttgctcaacaatctctttcctatcagcgtgccctcgttggtgatgcaccaattaaaattgccattgaagctgccattcggcaaggatgggaccgttttattgggagtgatggtatatttattggcatggagggatttggtgcaagtgggacgattgatgcgctttatgcacatttcggtattacttgtgagaatgtggtcgctaccgttgaaaaagagcttgaaaagatcaataaggaaaatgtgagatga

SEQ ID NO: 9943 - protein, 668 aa, Bartonella quintana str. Toulouse
MINTEQQNQMANAIRFLAIDAIEKANSGHPGLPMGAADIATVLYTKFLAHDPKNPHWPDRDRFVLSAGHGAMLLYALLYLSGYEDISLEDLKNFRQIGSKLAGHPEYGHAAGIETTTGPLGQGLANAVGMALGERLQNARFGDIINHYTYALVGDGCLMEGIAQEAISFAGHLKLHKLIVLWDDNNISIDGEISLADSTDQMARFKASGWNTYKVDGHDQGAIARAIEAAQNSDKPTLIACKTTIGFGAPNKAGTNKVHGAPLGTREIAETRIALGWEAEPFVIPADILDNWRLAGLNAAKKRQKWKEKFADLPLSERIEFERLMRGDLVGGFDGAIDAYKQKLVEDCPCVATRKASEMALEVINETVIETIGGSADLTGSNNTKSSQMKSISAEDFSGRYLHYGIREHAMGAVMNGLALHGGCIPYGGTFLCFSDYMRPAMRLSSLMGLRVIYVMTHDSIGLGEDGPTHQPVEHLAALRALPNHFVFRPADAMETVECWQLALKARNTPSTLALSRQNLPLLRQEYEKENLCMLGAYELLTASDDAQVTLFSSGSELQIAVKAQALLEENAIPTRVVSVPCFELFAQQSLSYQRALVGDAPIKIAIEAAIRQGWDRFIGSDGIFIGMEGFGASGTIDALYAHFGITCENVVATVEKELEKINKENVR

SEQ ID NO: 9944 - DNA, 2007 bp, Bartonella henselae str. Houston-1
  CDS (1)..(2007): transl_table=11
atgacaaataccgaaacaaagaaacagatggccaatgctatccgttttcttgcgattgatgcgattgaaaaagcaaattctggtcatcccgggttaccaatgggggcagccgatattgccaccgtcctttatacaaaattccttgcccatgatcccaaaaatcctcattggcctaaccgtgatcgttttgtgttgtccgctggtcatggctctatgttgctttatgccctcttgtatctttctggttatgaagatatttcccttgaagatctcaaaaacttccgccaaataggctctaaggttgccgggcatccagaatatgggcatgctgctggaatcgaaacaaccactggaccactcggacaggggatagctaatgctgtgggaatggctctgggggagcgcctgctcaatgcacgctttggtgatctcatcaaccattatacttacgcgctggttggggatgggtgcctcatggaagggatttcacaagaagctctttcccttgctggacatttaaaactcaataagcttatcgtattgtgggacgataataacatttccatcgatggagaaatttcccttgctgatagtactgaccaaatagcccgttttaaagcgtctggttggaatacacacaaagttgatggacatgatcaagcagcaatcgcacgggctattgaggctgcaagaaattccgataaaccaactttgatcgcttgtaaaacaaccattggttttggagctcccaataaagctgggaccaataaaattcatggggcacctttaggtgcatccgaaattgctgaaacccgtatcgctttgggatgggaggcagagcctttcgttattccagccgatatcctcgataattggcgcttggctggtcttaatgccgctaaaaaacgacaaaaatggaaagaaaaatttgccgctcttccactctcagaacggatagagtttgaaagattgatgcgtggcgatctcgtgggcggatttgatggtgctatcgatgtttataaaaagaaattggttgaggattgtccgtgtgttgccacccgtaaagcttcggaaatggctcttgaagtgatcaatgaagtcgttcttgaaaccattggtggttctgctgacttaaccggatcaaataataccaaaagcagtcagatgaaaactatctctgctgaggatttttcagggcgttatttgcattatggagttcgtgaacatgctatgggagccgtgatgaatggtcttgccctttatggaggttttattccttatggcggaacctttttatgtttttccgactatatgcgtcccgcaatgcgtttgtcttctctcatggggttgcgggtcatttatgtcatgacccatgattccattggtcttggtgaggatggacctactcatcagccggtggagcatttggcttctttgcgtacacttcctaatcatcttgttttccgtcctgctgacgctatggagactgtcgagtgttggcaattggctttgaaaacgcgagggacaccttctactttggctttgagtagacaaaatttaccacttttgcgtcgggaatatgaagaagaaaatctttgtatgctcggtgcttatgaattactcaccgccagtgatgatgcgcaagtgaccctgtttgcttccggttcagaattgcagattgccgtacatgcacatgcagtcttagaagaaaagggaatcccaacgcgtgtggtttctgtaccttgttttgaactctttacacagcaatctccctcctatcagagggctctcattggtgatgcaccgattaaaattgccattgaagctgcactccggcaaggttgggactattttatcggcactaatggggtgtttattggcatgcaaggatttggtgccagtgggaccatcgatgcgctttatgcgcactttggcatcacttgtgaaaatgtggtcgctgccgttgaaaaaaaacttgaagacatccataaggaaaatgtgaaataa

SEQ ID NO: 9945 - protein, 668 aa, Bartonella henselae str. Houston-1
MTNTETKKQMANAIRFLAIDAIEKANSGHPGLPMGAADIATVLYTKFLAHDPKNPHWPNRDRFVLSAGHGSMLLYALLYLSGYEDISLEDLKNFRQIGSKVAGHPEYGHAAGIETTTGPLGQGIANAVGMALGERLLNARFGDLINHYTYALVGDGCLMEGISQEALSLAGHLKLNKLIVLWDDNNISIDGEISLADSTDQIARFKASGWNTHKVDGHDQAAIARAIEAARNSDKPTLIACKTTIGFGAPNKAGTNKIHGAPLGASEIAETRIALGWEAEPFVIPADILDNWRLAGLNAAKKRQKWKEKFAALPLSERIEFERLMRGDLVGGFDGAIDVYKKKLVEDCPCVATRKASEMALEVINEVVLETIGGSADLTGSNNTKSSQMKTISAEDFSGRYLHYGVREHAMGAVMNGLALYGGFIPYGGTFLCFSDYMRPAMRLSSLMGLRVIYVMTHDSIGLGEDGPTHQPVEHLASLRTLPNHLVFRPADAMETVECWQLALKTRGTPSTLALSRQNLPLLRREYEEENLCMLGAYELLTASDDAQVTLFASGSELQIAVHAHAVLEEKGIPTRVVSVPCFELFTQQSPSYQRALIGDAPIKIAIEAALRQGWDYFIGTNGVFIGMQGFGASGTIDALYAHFGITCENVVAAVEKKLEDIHKENVK

SEQ ID NO: 9946 - DNA, 1995 bp, Bacillus thuringiensis serovar konkukian str. 97-27
  CDS (1)..(1995): transl_table=11
atgacacaaaacataaatcaattagcagtgaatacaattcgtacgttatcaattgacgctattaatgcggcaaattcaggtcatccaggtcttccgatgggagcagcgccaatggcttatgcattatgggcgaatcatttaaatcataatcctaatcatccaaaatggtttaaccgtgatcgcttcgttttatcggcgggacatggatctagcttattatatagcctacttcatttagctggatatgacgtttcaattgatgacttgaaaaacttcagaaagttaaatagtaagacaccaggacatcctgagtttggtcatacttctggagttgaagcgacgacaggcccgttaggacaagggattgccaatgctgtcggaatggcaatggcagaagcgcatttagcagcgaagtttaataaggatggtcactctattatagatcacaatacgtacgctttagtcggagacggtgatttaatggaaggtgtcgcttatgaagcgatgtcaatggcaggacatatgaaacttggcaagttaattgtgctgtatgattcaaatgaaatttcacttgatggtgaattaaacattgctttctctgaagatatgcagaaaagggtagaatctgcacattggcaatatgtaagagttgaagatggaaacgatgttgatgcgattacaaaagcgattcaattagcgaaagataatacggaccaacctactcttatagagattagaaccgttataggttacggaagtccaaaagttgctggaacgaacaaagcacatggtaacccgcttggagtagaagaagcgacagcgacaaaacaagtgtatggttggcattatgaagaagacttctttgtacctgaagaagtaacagctcattttaatgaactgaaacaaaaaggtattgaaaaagaacgtggctggaatgagcagttcaacttatacagagagtcaaatcctgcactagcagatgaattagaaaaagcaattacaggtgaagttttaatcgaagcgaaagacattttatccttcgatactgaaaaaacgatttcaactcgtgttgcaagtggggaagctattaatcattatgtgaaatcgattccttctattttcggtggaagtgcagatctttctcattctacgatgacagatataaaaggtgaagcagtgtatgcggtagaatcgtatgctggccgaaatatatactttggtgtacgtgaacatgcaatgggcgcagcagcgaatggactggctcttcatggaggagtaaaaccgtttgtgagtacattctttgtatttaatgactatcttcgtccatctattcgactggctgcattgcaaaagttacctgttacgtacgtatttacacatgattcaattgctgtaggagaagatggtccaacgcatgaacctattgaacatttagcagctcttcgggcaatccctggtttaacagttatccgtccgtcagatgcaaatgaaacagcaagtgcgtgggcgtatgctttacagcaaacggatggtccagtcgttttagtacttagccgtcaaaatttaccggtgtttcatgaaacgaaagcaaacatagagaatctttctaaaggggcttacgtattaacacaaacgaatgaaaatccggatgtaattttaattgcgacaggttctgaagtatccttagctgctagtgcgaaagcgaaactagaagaagacaatgtctctgttcgcatcgttgcaatgccaagctgggagttattcgatcgccaatcgaaagaatataaagaatccgttcttccgtcttctgtaacgaaacgagtatctcttgagatgggtgtatctctcggctgggagcgttatgtaggacaagaaggaaacatattatcgattgaaacatttggagcttcaggaactggggctgaagtcatgaatctatttggatttacgacagaaaatgttgttcaaattacaaaaaatgtattaaattcttaa

SEQ ID NO: 9947 - protein, 664 aa, Bacillus thuringiensis serovar konkukian str. 97-27
MTQNINQLAVNTIRTLSIDAINAANSGHPGLPMGAAPMAYALWANHLNHNPNHPKWFNRDRFVLSAGHGSSLLYSLLHLAGYDVSIDDLKNFRKLNSKTPGHPEFGHTSGVEATTGPLGQGIANAVGMAMAEAHLAAKFNKDGHSIIDHNTYALVGDGDLMEGVAYEAMSMAGHMKLGKLIVLYDSNEISLDGELNIAFSEDMQKRVESAHWQYVRVEDGNDVDAITKAIQLAKDNTDQPTLIEIRTVIGYGSPKVAGTNKAHGNPLGVEEATATKQVYGWHYEEDFFVPEEVTAHFNELKQKGIEKERGWNEQFNLYRESNPALADELEKAITGEVLIEAKDILSFDTEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETASAWAYALQQTDGPVVLVLSRQNLPVFHETKANIENLSKGAYVLTQTNENPDVILIATGSEVSLAASAKAKLEEDNVSVRIVAMPSWELFDRQSKEYKESVLPSSVTKRVSLEMGVSLGWERYVGQEGNILSIETFGASGTGAEVMNLFGFTTENVVQITKNVLNS

SEQ ID NO: 9948 - DNA, 2001 bp, Bacillus thuringiensis serovar konkukian str. 97-27
  CDS (1)..(2001): transl_table=11
atgtcacattcaatcgaacaactttctatcaacacgattcgcacattatccatcgatgcgattgaaaaagcaaactctggtcacccaggaatgccaatgggtgcagcaccaatggcttatacattatggactcaatttatgaaacacaatccaaataacccaacgtggtttaaccgtgatcgtttcgtattatctgcaggtcatggttcaatgttattatacagcctacttcacctatctggttatgatgtaacaatggatgacttaaagaacttccgtcaatggggaagcaaaactccagggcatcctgagtacggtcatacagctggtgtagatgcaactactggtccacttggacaaggtattgcaactgctgtaggtatggcaatggcagaaagacatttagctgctaaatataaccgtgatgcgtataatgtagtagatcattatacatacgctatttgtggtgatggagatttaatggaaggcgtttctgctgaagcatcttcattagctgctcatttacaattaggtcgtcttgttgtgctttatgattcaaacgatatttcattagatggcgatttaaatcgttcattctctgaaagtgtagaagatcgttacaaagcatacggatggcaagtaatccgtgttgaggatggaaacgatattgaagctatcgcgaaagcaatcgaagaagcgaaagctgacgaaaaacgcccaacgctaattgaagtaagaacgacaattggtttcggttctccaaacaaatcaggaaaatcagcttcacatggttctccacttggtgtagaagaaacaaagttaacgaaagaagcatacgcttggactgctgaacaagacttccatgtagcagaagaagtatatgaaaacttccgtaaaacagtacaagatgttggtgaaactgcacaagctgagtggaatactatgctaggtgaatatgcacaagcatatccagaattagcaaacgaactgcaagcagtaatgaacggtcttcttccagaaggttgggagcaaaacttaccaacttatgaattaggatcaaaagcagcaactcgtaattcttcaggtgctgtaattaatgcaattgcagagtctgtaccatcattcttcggtggatctgctgaccttgctggttctaacaaaacatacatgaataacgaaaaagactttacaagagatgattacagcggtaaaaatatttggtacggtgtacgtgagttcgcaatgggtgcagcaatgaacggtattgcactacatggtggtttaaaaacttacggtggtacgttcttcgtattctctgactacttacgtccagcaattcgtcttgcagcattaatgcaattgccggtaacgtatgtattcacacacgacagtatcgctgttggtgaagatggtccaacacatgaaccaatcgagcaattagcagcgctacgtgcaatgccaaatgtatctgttattcgtccagctgacggtaacgagtctgttgcagcttggagactagctctagaatctacaaacaaaccaactgctttagtattaactcgtcaagatcttccaacattagaaggtgcaaaagacgatacgtatgaaaaagtagcaaaaggtgcgtatgtagtttctgcaagcaagaaagaaacagctgatgtaatcttacttgcaactggatctgaagtaagtctagctgttgaagctcaaaaagcattagcagtagacggcgttgatgcatctgttgtcagcatgccatctatggatcgctttgaagctcaaacagctgagtacaaagaatctgtattaccaaaagcagtaacaaaacgtttcgcaatcgaaatgggtgctacattcggatggcaccgttacgtaggtcttgaaggagatgtgttaggtatcgatacattcggtgcttctgctcctggtgagaagattatggaagagtatggatttactgtagagaacgttgttcgtaaagtaaaagaaatgctttaa

SEQ ID NO: 9949 - protein, 666 aa, Bacillus thuringiensis serovar konkukian str. 97-27
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYENFRKTVQDVGETAQAEWNTMLGEYAQAYPELANELQAVMNGLLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 9950 - DNA, 1989 bp, Acinetobacter sp. ADP1
  CDS (1)..(1989): transl_table=11
atgacgacccctttaaacgaacgtcgtattgcaaacgcaattcgtgtattggctatggatgctgtgcaacaagcaaactcagggcatcctggtgctccaatggggatggcagatattgctgatgtggtttggcgtgaatttctaaatcacaatccaacaaatccacaatgggcgaatcgtgaccgttttgtgctttctaatggtcatggttcaatgctgcattatgcattacttcatttaagtggttatgatctttccattgaagaccttaagcagttccgtcagctgcattcaaaaacaccaggtcatccagagctaggttatgcgccaggtattgaaacaacaacaggtccattgggtcaagggatcgcaaatgctataggttttgctttggcagaaagaaccttggcagctcaatttaataaagatgatttgaaagtcgttgatcattatacttactgtttcctgggcgatggttgcttgatggaaggtatttctcacgaagtatgttcactggcaggtacgttaggtctaggtaagttgattgcttattatgatgataatggcatttcaattgatggcgaagttgaaggctggttcagtgatgacactgaacaacgttttaaagcatatggctggcaagttctgcgtgtagatggtcatgacacagatgcgattcgtcaggcgactgttgaagcaaaagcacaaactgctcagccaacgatcattatttgtaagacgattatcggtttaggttcgccaaacaaacagggtaaagaagattgtcatggtgctccattgggtacagatgaaatcaaacttactcgtgaagcactaggctgggaagaagaagcatttgttattccaaaagatgtttattctgcttggaatgcaaaagataaggggcaagctgcagagtctgcatggaatgatgtatttgctcagtatcaagcgaagtatccgtcagaagcagcagaattactccgccgtgttcaaggcgacttgcctgcagaatttcttgcgcaagcagatgcctttattgctgaaaccaatgcaaaagctgaaacaattgcaacgcgtaaagcaagccaaaatactttacaggcatttggtcctttattaccagaattgcttggtggttcggcagatcttgctggttccaacctaacactttggaaagggtgtgaaggcgtacaggataatccagcgggtaactatgtgtactacggtgtacgtgagtttggtatgactgccatcgccaatggtgttgcattgcatggcggttttattccttacgttgcgactttcttaatgtttatggaatatgcgcgtaatgcagtacgtatgtctgccttaatgaaacagcgtgtaattcacgtatatacgcatgattcaattggtttaggcgaagatggcccaacgcatcaacccattgaacagattgcttcattgcgtggtacgccaaacctcaacacatggcgtccagccgatacggtagaaacagcgattgcatggaaatctgcgcttgagcgtaaagatggtccaacagcgctgatcttgtctcgtcagaatttgccattccaatcacgttctgaagctcaaattcaggatgctgcaaaaggtggttatgttttggctcaagaaaagggtgagttaaaagcaattattatcgcgactggatctgaaatttcagtggcaatggatgcttatgtacagcttgaaggtgtacgtgtggtatcgatgccgtgtgctgaagagtttatgaaacaagatgcagcatatcgtgagtcagtattgccttcacagattcgtgctcgtgttgctgtagaagctgctcacgtcgattactggtggaagtttgttggtttagacggtaaagtcattggtatgacaacgtatggcgaatctgccccagcgaaagacttgtttaagcattttggtattaccagtgatgcagttgtagaagcagtgaagagtctaacagcttaa

SEQ ID NO: 9951 - protein, 662 aa, Acinetobacter sp. ADP1
MTTPLNERRIANAIRVLAMDAVQQANSGHPGAPMGMADIADVVWREFLNHNPTNPQWANRDRFVLSNGHGSMLHYALLHLSGYDLSIEDLKQFRQLHSKTPGHPELGYAPGIETTTGPLGQGIANAIGFALAERTLAAQFNKDDLKVVDHYTYCFLGDGCLMEGISHEVCSLAGTLGLGKLIAYYDDNGISIDGEVEGWFSDDTEQRFKAYGWQVLRVDGHDTDAIRQATVEAKAQTAQPTIIICKTIIGLGSPNKQGKEDCHGAPLGTDEIKLTREALGWEEEAFVIPKDVYSAWNAKDKGQAAESAWNDVFAQYQAKYPSEAAELLRRVQGDLPAEFLAQADAFIAETNAKAETIATRKASQNTLQAFGPLLPELLGGSADLAGSNLTLWKGCEGVQDNPAGNYVYYGVREFGMTAIANGVALHGGFIPYVATFLMFMEYARNAVRMSALMKQRVIHVYTHDSIGLGEDGPTHQPIEQIASLRGTPNLNTWRPADTVETAIAWKSALERKDGPTALILSRQNLPFQSRSEAQIQDAAKGGYVLAQEKGELKAIIIATGSEISVAMDAYVQLEGVRVVSMPCAEEFMKQDAAYRESVLPSQIRARVAVEAAHVDYWWKFVGLDGKVIGMTTYGESAPAKDLFKHFGITSDAVVEAVKSLTA

SEQ ID NO: 9952 - DNA, 1995 bp, Erwinia carotovora subsp. atroseptica SCRI1043
  CDS (1)..(1995): transl_table=11
atgtcctctcgtaaagaacttgccaatgctatccgcgcgctgagcatggatggggtgcagaaagccaaatccggtcacccgggcgcaccgatgggcatggccgatatcgccgaagtgctgtggcgtgattatctcaaccataatccggccaaccccaactgggccaaccgcgaccgcttcgtgctgtccaacggtcatgcgtccatgctgatttacagcctgctgcatctctccggttatgacctgccgattgaagaactgaaaaacttccgtcagatgcattccaaaactccgggtcaccctgaatacggctacaccgccggcgtcgaaaccaccaccggcccgctgggtcagggtgttgccaatgcggtggggatggcgattgccgagcgcacgctggcggcgcagttcaaccgcccgggccacgacattgttaaccatcacacctacaccttcctcggtgacggctgcatgatggaagggatttctcacgaagtctgctcgctggcaggcaccatgaagctcggcaaactgaccgcgttttatgatgacaacggcatctccatcgacggtcacgtagaaggctggtttactgatgataccgccgcccgctttgaagcctacggctggcacgtggtgcgcggcgtggacggtcacgatgcggatgccatcaaacgcgccatcggcgaagcacagctggtgaccgacaaaccgtcgctgctgatgtgcaaaactgtgattggcttcggttcaccgaataaggccggcacgcacgactcgcacggtgcgccgttgggccaggcggaagtcgcggcttcccgcgaacagctgggctggacgcacgcgccgtttgatattccggcggatatttatgccgcctgggacgccaaacccgccggtcagcgtaaggaagccgcctgggatgaggccttttctgcctacgccagcgcgtaccctgaactggctgccgaattcacacgccgtaccggcggtgaactgccgacccactggcaggcagatgcacagaaattcatcgaggatttgcaggctaatccggcgaaaatcgccagccgtaaagcctcacagaacgcgctggaagcctatggcaaactgctgccggaattccttggcggctctgccgacctggctccgagcaacctgaccatctggtccggctcggtatcgctggataaagaccacgcgggtaactatatccactacggtgtgcgcgagttcggtatgaccgccattgccaacgggattgcgctgcacggtggctttgtgccgtataccgcgactttcctgatgtttgtggaatacgcgcgtaacgccgtgcgtatggccgcgctgatgaaaatccgcagcatctacgtttacacccacgactccatcggtctgggggaagacggcccgacgcaccagccggttgaacagctggccagcctgcgcgtaacgccgaacatgagcaactggcgtccggcagaccaggtggaaacggcggtggcgtggaaatatgccatcgagcgtcaggacggtccgacgtcacttatcctgtcgcgtcagaatctggcgcagcagacgcgtaccgcagaacaactggcgaacgtggtgaaaggcgggtacgtgctgaaagacagcgacggccagccggaactcatcctgattgccaccggttctgaagtcgaactggctgtcggtgcgtatgacaagctgactgccgccggccgcaaggtgcgcgtggtgtcgatgccgtcaacggatgcgttcgacaagcaggacgccgcctaccgtgaagcggtgctgccgaaagcggtatcggcgcgcgtagccattgaagcgggtattgcagactactggttcaagtatgtcggcctgaacggcgcaattgtcggtatgacgagcttcggcgaatcggctccggctgaactgctgttcgaagcattcggcttcactgtcgataacgtggtcgaaaaagcgcaggcgctgctgaagtaa

SEQ ID NO: 9953 - protein, 664 aa, Erwinia carotovora subsp. atroseptica SCRI1043
MSSRKELANAIRALSMDGVQKAKSGHPGAPMGMADIAEVLWRDYLNHNPANPNWANRDRFVLSNGHASMLIYSLLHLSGYDLPIEELKNFRQMHSKTPGHPEYGYTAGVETTTGPLGQGVANAVGMAIAERTLAAQFNRPGHDIVNHHTYTFLGDGCMMEGISHEVCSLAGTMKLGKLTAFYDDNGISIDGHVEGWFTDDTAARFEAYGWHVVRGVDGHDADAIKRAIGEAQLVTDKPSLLMCKTVIGFGSPNKAGTHDSHGAPLGQAEVAASREQLGWTHAPFDIPADIYAAWDAKPAGQRKEAAWDEAFSAYASAYPELAAEFTRRTGGELPTHWQADAQKFIEDLQANPAKIASRKASQNALEAYGKLLPEFLGGSADLAPSNLTIWSGSVSLDKDHAGNYIHYGVREFGMTAIANGIALHGGFVPYTATFLMFVEYARNAVRMAALMKIRSIYVYTHDSIGLGEDGPTHQPVEQLASLRVTPNMSNWRPADQVETAVAWKYAIERQDGPTSLILSRQNLAQQTRTAEQLANVVKGGYVLKDSDGQPELILIATGSEVELAVGAYDKLTAAGRKVRVVSMPSTDAFDKQDAAYREAVLPKAVSARVAIEAGIADYWFKYVGLNGAIVGMTSFGESAPAELLFEAFGFTVDNVVEKAQALLK

SEQ ID NO: 9954 - DNA, 1995 bp, Erwinia carotovora subsp. atroseptica SCRI1043
  CDS (1)..(1995): transl_table=11
atgtcctctcgtaaagaacttgccaatgctatccgcgcgctgagcatggatggggtgcagaaagccaaatccggtcacccgggcgcaccgatgggcatggccgatatcgccgaagtgctgtggcgtgattatcttaaccataatccggccaatcccaactgggtcaaccgcgaccgcttcgtgctgtccaacggtcatgcgtccatgctgatttacagcctgctgcatctctccggctacgacctgccgattgaagaactgaaaaacttccgtcagatgcattccaaaactccgggtcaccctgaatacggctacaccgccggcgtcgaaaccaccaccggcccgctgggtcagggtgttgccaacgcggtgggtatggcgattgccgagcgcacgctggcggcgcagttcaaccgcccgggccacgacattgttaaccatcatacctacaccttcctcggtgacggctgcatgatggaagggatttcccacgaagtctgctcgctggcaggcaccatgaagctcggcaaactgaccgcgttttatgatgacaacggcatctccatcgacggccacgtagaaggctggtttaccgatgatactgccgcccgctttgaagcctacggctggcacgtggtgcgcggcgtggacggtcacgatgcggatgccatcaaacgcgccatcggcgaagcacagctggtgaccgacaaaccgtcgctgctgatgtgcaaaaccgtgattggcttcggttcaccgaacaaggccggcacgcacgactcgcacggtgcaccgttgggcgaggcggaagtcgcggcttcccgcgaacaactgggctggacgcacgcgccgtttgatattccggcggatatttatgctgcctgggatgcgaaaccggccggtcagcgtaaggaagccgcctgggatgaggaatttgccgcctacgccagcgcgtaccctgaactggctgctgaattcacacgccgtaccggcggtgaactgccgacccactggcaggcagatgcacagaaatttatcgaagacctgcaggccaatccggcgaaaatcgccagccgtaaagcctcacagaacgcgctggaagcctacggcaaactgctgccggaattcctgggcggctctgccgacctggctccgagcaacctgaccatctggtccggctcggtatcgctggataaagaccacgcgggtaactatatccactacggcgtgcgcgagttcggtatgaccgccattgccaacgggattgcgctgcacggtggctttgtgccgtataccgcgaccttcctgatgtttgtagaatatgcgcgtaacgccgtgcgtatggccgcgctgatgaaaatccgcagcatctacgtctacacccacgactccatcggtctgggcgaagacggcccgacgcaccagccggttgaacagctggccagcctgcgcgtaacgccgaacatgagcaactggcgtccggcggaccaggtggaaacggcggtggcatggaaatacgccatcgagcgtcaggacggcccgacgtcacttatcctgtcgcgtcagaatctggcgcagcagacgcgtaccgctgaacaactggctaacgtggtgaaaggcgggtacgtgctgaaagacagcgacggccagccggaactcatcctgattgccaccggttctgaagtcgaactggctgtcggtgcgtatgacaagctgacagccgccggccgcaaggtgcgcgtggtgtcgatgccgtcaacggatgcgttcgacaagcaggacgcggcctaccgtgaagcggtgctgccgaaagcggtagcggcgcgcgtagccattgaagcgggtatcgcagactactggttcaagtacgtcggcctgaacggcgcgattgtcggtatgacaagcttcggtgaatctgcaccagctgagctgctgttcgaagcgtttggcttcactgtcgataacgtggtcgaaaaagcgcaggcgctgcttaagtaa

SEQ ID NO: 9955 - protein, 664 aa, Erwinia carotovora subsp. atroseptica SCRI1043
MSSRKELANAIRALSMDGVQKAKSGHPGAPMGMADIAEVLWRDYLNHNPANPNWVNRDRFVLSNGHASMLIYSLLHLSGYDLPIEELKNFRQMHSKTPGHPEYGYTAGVETTTGPLGQGVANAVGMAIAERTLAAQFNRPGHDIVNHHTYTFLGDGCMMEGISHEVCSLAGTMKLGKLTAFYDDNGISIDGHVEGWFTDDTAARFEAYGWHVVRGVDGHDADAIKRAIGEAQLVTDKPSLLMCKTVIGFGSPNKAGTHDSHGAPLGEAEVAASREQLGWTHAPFDIPADIYAAWDAKPAGQRKEAAWDEEFAAYASAYPELAAEFTRRTGGELPTHWQADAQKFIEDLQANPAKIASRKASQNALEAYGKLLPEFLGGSADLAPSNLTIWSGSVSLDKDHAGNYIHYGVREFGMTAIANGIALHGGFVPYTATFLMFVEYARNAVRMAALMKIRSIYVYTHDSIGLGEDGPTHQPVEQLASLRVTPNMSNWRPADQVETAVAWKYAIERQDGPTSLILSRQNLAQQTRTAEQLANVVKGGYVLKDSDGQPELILIATGSEVELAVGAYDKLTAAGRKVRVVSMPSTDAFDKQDAAYREAVLPKAVAARVAIEAGIADYWFKYVGLNGAIVGMTSFGESAPAELLFEAFGFTVDNVVEKAQALLK

SEQ ID NO: 9956 - DNA, 1968 bp, Mesoplasma florum L1
  CDS (1)..(1968): transl_table=4
atgataaacaaaaataacaacaatttaaatgctttaagaattttaggagtttctgcaattaataaagcaaattcaggtcacccaggtattgtattaggcgctgcaccaatcgtttatactttatttaacaaaattatgaaacacaatcctaaaaatcctaagtgatttgatagagatcgttttgtattatcagcagggcatggaagtgctttattatattcagcattacatttagctggttataatttatcaatggatgaaattaaaaactttagacaatgaaatagtaaaacaccaggtcaccctgaatctcacttaactgaaggggttgatgtaacaactggacctttaggtcaaggaattgctatggctgttggattggcaattgctgaatctcatacagcatcagtatataatcaatcagatttaaaattagttgatcaccatacatttgttttatgtggtgatggagatttacaagaaggtgtagctcaagaatcaattagtttagctggtagattaaaattaaacaaattaattttaattcacgactcaaatgatattcaattagatgacaaagttgaaaaagctcaaagtgaaaatatgcacgaaagatttaaagctgctcaatgaaatactttaaaaattaatgatggtgaagatttagtagctattgaaaaagctattaatgatgccaaagtatcagataaacctacatatattgaagttaaaacaattattggtataggggccacaaaacaagggactagtgcagtacacggtgccccaattggttcagatatcgaaacagttaaaaacgtttttgattgaaaatttgatgattttgaaataccaactgatatttataaacattgaaatgaaaatatttcaaaaaatttaataattgaaaaaaaatgaaacgaaacattaaatactttaaaaactaaaaatccagaattagcaaaacaatttacagatgctattaacaaagaaattaattttgattttgaagcattaaaaggtaaaactccagaaaaagcagaagctactagagttagttcaggaaacatttgagatagcataaattctcaagttaaatttttaattggtggttcagctgatttagtttcatcaacaagaattaaaggtgctgatggtcaatttgatattgataacagaagtggaagaaatattctttatggtgttagagaatttgctatgggagctataaataatggtattcatcaacatggtggtttaattccattctcaagtggattctttgtattctcagattacatgaaaccagcaatgcgtttatcatcaattatgaatacacaacaattgtttatatttactcatgattcagttgctgttggagaagatggaccaactcatcaaccaatagagcaattagcaatgattagaagtattccaaatcacattacatttagaccagctgattatgctgaaacattagcatcttataaaatagctttacaagacttaaaaaaatgtccttctactttagttttaactagacaagacttagttcaattaccacataatgatgtttatgaagaagttaaaaaaggagcatatattatttttgatcaacctaatgcttcagtaactttaatagcaacaggtagtgaagttggtttagcgatagaaacagctaaaagactaaaagaagataacatcattgcaaaagtagtttcaatgccttcaacaaacttatttgatcaacaagatcaatcatataaagataaaattattgataaatcaactttaagagtttcaattgaaatgggaacaacttatggatgaagcaaatatacaggtgacaatggattaaacattggaattgatgtttttggagcaagtgcaccagctaatacagtaattagtcaatatggatttacaagtgagcaaatttttaataaaattaaaaaggttataaaataa

SEQ ID NO: 9957 - protein, 655 aa, Mesoplasma florum L1
MINKNNNNLNALRILGVSAINKANSGHPGIVLGAAPIVYTLFNKIMKHNPKNPKWFDRDRFVLSAGHGSALLYSALHLAGYNLSMDEIKNFRQWNSKTPGHPESHLTEGVDVTTGPLGQGIAMAVGLAIAESHTASVYNQSDLKLVDHHTFVLCGDGDLQEGVAQESISLAGRLKLNKLILIHDSNDIQLDDKVEKAQSENMHERFKAAQWNTLKINDGEDLVAIEKAINDAKVSDKPTYIEVKTIIGIGATKQGTSAVHGAPIGSDIETVKNVFDWKFDDFEIPTDIYKHWNENISKNLIIEKKWNETLNTLKTKNPELAKQFTDAINKEINFDFEALKGKTPEKAEATRVSSGNIWDSINSQVKFLIGGSADLVSSTRIKGADGQFDIDNRSGRNILYGVREFAMGAINNGIHQHGGLIPFSSGFFVFSDYMKPAMRLSSIMNTQQLFIFTHDSVAVGEDGPTHQPIEQLAMIRSIPNHITFRPADYAETLASYKIALQDLKKCPSTLVLTRQDLVQLPHNDVYEEVKKGAYIIFDQPNASVTLIATGSEVGLAIETAKRLKEDNIIAKVVSMPSTNLFDQQDQSYKDKIIDKSTLRVSIEMGTTYGWSKYTGDNGLNIGIDVFGASAPANTVISQYGFTSEQIFNKIKKVIK

SEQ ID NO: 9958 - DNA, 2064 bp, Propionibacterium acnes KPA171202
  CDS (1)..(2064): transl_table=11
gtggcaaccgaactgacgtggaccgacaccgataggctcgctgtcgacaccgctcgagtgctggcggccgatgccgtcgagaagactggtaacggtcaccccggcaccgctatttccctagcgccgctgggctacctgctttaccacaaggtcatgtctatcgatccgtcggacccgaattggctcggacgcgatcgcttcatcatgtcggcaggacattcctcgctgacccagtacacccagttatacctagcagggctgggactcgagctgtccgacctggagtccctgcgtacctggggatccctgacccccggccaccccgaatatggcttgacgaagttcgtcgagaccaccaccggcccgctcggcgccggtgttgccaacgccgtcggcatggccatggcagctcgtcgtgaacgcggcctgctcgacccggacgccgctcccggtacgagcctcttcgaccactacatttacgccattgccggtgacggctgtatgcaggaaggcattgcatctgaggcttcgtctctggcggggacccaggagctgggcaacctcatcatgttctacgacgacaaccggatcaccatcgaaggtgataccgccatcgccttctctgagaacgtcgaggcccgctatgaggcctacggttggcatgtccagcacgtcgatttcaccaacggcggaacgacctacgaggagaatgtcgaagccctcatggaggccatcgacaacgccaagactgttaccgacaagccgtctttcatccgtctcaccaccgtcattggttggccgattccgaagctcgccggtctggcccaggtacacggtgcgaagattggcgctgagggggtcagtgccctcaaggagaagcttggctttgaagacaagccgtttgccatcgaccttgagatggtgcaacaggtccgcgctgctttcgctgagcgcggcaagggtctgcgcgaggtctgggacgagaagttcgccgcctggcatgacgccaacccagacggcgctgccctgctcgagcggatgctcgcccacaagctgcccgacgacctcgacattcccacttttgagccgggcaagatgagcacccgtaaggcttcgggagcggtcctgagcgctctgggtccgcagcttcccgagctgtggggcggatcggccgacctcgccgggtcgaacaacacgaccatgaagggggccgactccttcctgcctgaagatcgctgctccgagaaagatccaggtggtccttacgggcgtactatccacttcggtgttcgcgagcacgccatgggtggcatcctcaacggcatcaccttggcgggcctgacccgctgctacggcggaaccttctttgtcttctccgattacatgcgtccgtcggtgcgtcttgcggccctcatgaagatcccgtcgatcttcgtgtggacccacgattctatcggcgttggtgaagatggacccacccaccagccagtcgagcacctagcctcctaccgagccatcccgggactcgacatcgtccgtcccgccgacgccaacgagaccgccgtggcatggcgcaccatcgtggagcacaccgaccgtcccgccggcctagtgctgtcgcgtcaggacctgccgacgattgaccgcagcaaatacgcctctgccgaaggcgtcgccaggggtgcctacgtggtttgcgaggctagcgccgagcccaaagtcatcctcatcggtactgggtccgagctgtcggtggccctcgaagcacgcgagaagcttgaggccgacgggatcgcgacccgcgtcgtctcgatgccgtgccaagagtggttcgacgagcaggacgaggagtaccgcgagtcggtgctacccagctcagtgactgcccgagtgagcgtcgaggccggcatcgccatgggctgggcaaagtatgtcggctgcaagggcgcctcggtgtccctcgagcacttcggcgcctcggcctctggggcgctgctgttcgagaagttcggattcaccgctgaccacgtcgcggaggtcgctcacaccgtgttcatggagtga

SEQ ID NO: 9959 - protein, 687 aa, Propionibacterium acnes KPA171202
MATELTWTDTDRLAVDTARVLAADAVEKTGNGHPGTAISLAPLGYLLYHKVMSIDPSDPNWLGRDRFIMSAGHSSLTQYTQLYLAGLGLELSDLESLRTWGSLTPGHPEYGLTKFVETTTGPLGAGVANAVGMAMAARRERGLLDPDAAPGTSLFDHYIYAIAGDGCMQEGIASEASSLAGTQELGNLIMFYDDNRITIEGDTAIAFSENVEARYEAYGWHVQHVDFTNGGTTYEENVEALMEAIDNAKTVTDKPSFIRLTTVIGWPIPKLAGLAQVHGAKIGAEGVSALKEKLGFEDKPFAIDLEMVQQVRAAFAERGKGLREVWDEKFAAWHDANPDGAALLERMLAHKLPDDLDIPTFEPGKMSTRKASGAVLSALGPQLPELWGGSADLAGSNNTTMKGADSFLPEDRCSEKDPGGPYGRTIHFGVREHAMGGILNGITLAGLTRCYGGTFFVFSDYMRPSVRLAALMKIPSIFVWTHDSIGVGEDGPTHQPVEHLASYRAIPGLDIVRPADANETAVAWRTIVEHTDRPAGLVLSRQDLPTIDRSKYASAEGVARGAYVVCEASAEPKVILIGTGSELSVALEAREKLEADGIATRVVSMPCQEWFDEQDEEYRESVLPSSVTARVSVEAGIAMGWAKYVGCKGASVSLEHFGASASGALLFEKFGFTADHVAEVAHTVFME

SEQ ID NO: 9960 - DNA, 2181 bp, Leifsonia xyli subsp. xyli str. CTCB07
  CDS (1)..(2181): transl_table=11
atgacatccacggcgcgcactactctcaatcggtgcgggcaccgttcgacgacccccccaccacctctacgaagggtcagttctccagtggcagctctgcagtgggatcccattgacaacaaggcggtagacacagcccgcgtcctcgcggccgacgcggtggagaaggtgggaaacggccatcccggcaccgctatgagcctcgcccccgctgcctatctgctcttccagaaggtgatgcgccgcgacccccgcgaccagcactggctgggccgggaccgcttcatcctctcggccggccatagctcgctgactcagtacatccagctctacctcggcggctacggactcgagctggcagacctcgaggcgctccgcacctggggctcgctcacgccgggccaccccgagtacgggcacaccgacggcgtggagatcaccaccgggcccctcggccagggaatctcctcctccgtcggcttcgcctacgcgcagcgctacgaacgcggcctgttcgacccggaggccgggcccggagccagcccattcgaccacttcacctatgtgatcgcctccgacggcgacctggaggagggcatcagctcggaggcctccagcctcgccggccaccagcagctcggcaacctcatcgcgatctacgacgacaaccagatctcgatcgaggacgacaccaccatcgcgttcaccgaggacgtcaaggcgcgctacgaggcgtacaactggcacgtgcaggtggtggactggaagaagacgggcgtctacgcagaggacgtccacgagctgtaccaggccatccagaacgctcaggcggtcaccgacaagccctcgctgatcgtcctgaagacgatcatcggctggcccgccccgaagaagcagaacacgggcaagatccacggctccgcactcggcgccgacgaactgagagcggtcaaggaggtgctcggattcgaccccgagaagaccttcgaggtcgccgcggaggtcattgagcacacgcgcagggcggtcggcagcggcgccgagcagcgggccgcgtggcagaagggcttcgatgcctgggccgctgcccacccggagcgcaaagagctcctcgaccgcctgctctccggcgccgcgcccgcggggatcgcggacgcgctgcccgtgttcgcagccggcgcggagatgtcgacccgcgccgccagcggcaaagtcatcaacgccatcgctccggtcatgccggagctgtggggcggatcggccgacctcgccgagtcgaacaacacgacgatcgagggcgccgcttcgttcgttcccagcgagcactccacccacgagtggaccgggaacccttacggccgtatgctgcacttcggcatccgcgagcacgcgatggcagcgatcatcaacggcattgtgctgcacggaccgacccggcccttcggcgggacgttcctgatcttcagcgactacatgcgccccgcggttcgcctggccgcgctgatgcgggttccgtcgatcttcgtctggacgcacgactccgtggctctcggcgaggacggacccacccaccagccgatcgagcaactcgccactctgcgcgcgatcccgcatctggatgtcgtgcgccccggcgatgcgaacgaagtcacccacgcctggaagaccatcctcacccgccggaacggcccggccggaatcgcgctgacccgccagaacatcccggtgttcgagcgcggcgacggtgaggcagcgggcgacaccctggcctcagccgagaatgtcgccaaaggcgcctacatcctggccgaggcgccgggtggcacgccggacgtgctgttcatcgccacgggctccgaggtgcagatcgcgctcgaggcccgcgacgtgctgcgcggcgaagggatcaaagcccgcgtcgtctccgccccgtgtctcgagtggttcgccgagcaggacgccgcctatcgggagaaggtgctgcccgccgccctcaaagcccgcgtttccatcgaggccgggctcgccttgagctggagcacgatcgtcggcgaccacggccgtagcgtctcgatcgagcacttcggcgcttcggcggactacaagacgctgttccgcgaatttggaatgaccaccgagcacgccgtcgccgccgcgaaggaatcgctcgcgtcgctgtga

SEQ ID NO: 9961 - protein, 726 aa, Leifsonia xyli subsp. xyli str. CTCB07
MTSTARTTLNRCGHRSTTPPPPLRRVSSPVAALQWDPIDNKAVDTARVLAADAVEKVGNGHPGTAMSLAPAAYLLFQKVMRRDPRDQHWLGRDRFILSAGHSSLTQYIQLYLGGYGLELADLEALRTWGSLTPGHPEYGHTDGVEITTGPLGQGISSSVGFAYAQRYERGLFDPEAGPGASPFDHFTYVIASDGDLEEGISSEASSLAGHQQLGNLIAIYDDNQISIEDDTTIAFTEDVKARYEAYNWHVQVVDWKKTGVYAEDVHELYQAIQNAQAVTDKPSLIVLKTIIGWPAPKKQNTGKIHGSALGADELRAVKEVLGFDPEKTFEVAAEVIEHTRRAVGSGAEQRAAWQKGFDAWAAAHPERKELLDRLLSGAAPAGIADALPVFAAGAEMSTRAASGKVINAIAPVMPELWGGSADLAESNNTTIEGAASFVPSEHSTHEWTGNPYGRMLHFGIREHAMAAIINGIVLHGPTRPFGGTFLIFSDYMRPAVRLAALMRVPSIFVWTHDSVALGEDGPTHQPIEQLATLRAIPHLDVVRPGDANEVTHAWKTILTRRNGPAGIALTRQNIPVFERGDGEAAGDTLASAENVAKGAYILAEAPGGTPDVLFIATGSEVQIALEARDVLRGEGIKARVVSAPCLEWFAEQDAAYREKVLPAALKARVSIEAGLALSWSTIVGDHGRSVSIEHFGASADYKTLFREFGMTTEHAVAAAKESLASL

SEQ ID NO: 9962 - DNA, 1953 bp, Symbiobacterium thermophilum IAM 14863
  CDS (1)..(1953): transl_table=11
atggagaaggccaagtccggtcaccccggggctccgatgggatgcgccgacatggccttcgtgctttggacccagttcctgcgcttcgacccggagaatccggagtggcccaatcgcgaccgcttcatcctctccaacggtcacggctccatgttgctgtactccctgctgcacctgtccggctacgacctggacatggagcagatccagtccttccggcagtggggcagccggacgcccggtcaccccgagtacggccacacccccggcgtggaagtgacgaccggtcccctgggccagggcatcgcccacgcggtggggatggcggcggccgccgagatgctggccgcccgggtgaacaccgacgacttccggcccgttgaccactacatctacggcatctgcggggacggcgacctgatggaaggggtcgtggccgaggccgccgcgctggcgggccagtggaagctcggccggctgatcttcctgtacgacgacaacgagatctccatcgagggcaacaccgacatcgctttctcggaggacgtggcgaagcggttcgagtcctacggctggcacgtcgaccggtgcgacggccacgaccacctggcgatcgcggcggccatcgagcgggcgcgggcggtcaccgacaagccctcgctgatcatctgccggacggtcctcggccacggctcgcccaacaaggccggcaaggccgtcgcccacggggcgccgctggggccggaggagacccggctgaccaaggaggccctgggctggccgcaggagcccgccttctacgtgcccgacgaggtgcggcagttcttcgcggaactgaaggcggagaagcaggcggaggcccgccgctggcaggagcagtttgacgcctggcggcaggccaaccccgagaaggcgcagctctgggaccagcacaagaacctcatggtccccgccgatctggacgcccagctggtggaggcggcgaggagcgagaagccgctggccacccgcaagtactccgagatggtcatccagcgggcggcggccctggtccccagcctggtgggcggctcggccgacctggcggagtccaacctgaccaccatcaagggcggcggcgacgtcggcccggcgtgccggatcgatgagtacgacttctcctggtccgggcgcaacttccatttcggcgtgcgggagcacgcgatgggctccatcgtcaacggagtggtgctctacggcggcttccgggcctacggcgcgaccttcctggtcttctccgactacatgcgcccgccgatccgcctggcggcgctgatgcaggtgccgtcgatcttcgtcttcacccacgactccttcttcctgggcgaggacggcccgacgcaccagccggtggagcacctctggtcgctgcggatgatcccgcacgtcaccgtgttccggcctgccgacggcctggagacggccatggcctgggcctacgccctcatggaggcgaaggagccgacgatcctggccctcacccggcagaacgtgccgcatctggagcggccggcgggctttgcgatccgtgacgtgtggaagggcggctacgtggtctctgacgccgcgaacccggtcgcgacgctgatcgccaccggctcggaggtggggctggccgtcgaggcgcagaagcttctggccgagcgggggatcgccgtccgggtggtctcgatgccctcggtggagctcttcctgcgccagccccgggagtatcaggagcaggtcctggtgggccggctggccgccatcgaggcgggccggaccgacggctggtaccggatcatcggccgggacggcctggccatcggccacgaggatttcggtgcctccgcccccgccggcgtcctggcggagaagttcgggttcaccccggcgcaggtcgcggcgcgggtggtggagtggctcgaggggtag

SEQ ID NO: 9963 - protein, 650 aa, Symbiobacterium thermophilum IAM 14863
MEKAKSGHPGAPMGCADMAFVLWTQFLRFDPENPEWPNRDRFILSNGHGSMLLYSLLHLSGYDLDMEQIQSFRQWGSRTPGHPEYGHTPGVEVTTGPLGQGIAHAVGMAAAAEMLAARVNTDDFRPVDHYIYGICGDGDLMEGVVAEAAALAGQWKLGRLIFLYDDNEISIEGNTDIAFSEDVAKRFESYGWHVDRCDGHDHLAIAAAIERARAVTDKPSLIICRTVLGHGSPNKAGKAVAHGAPLGPEETRLTKEALGWPQEPAFYVPDEVRQFFAELKAEKQAEARRWQEQFDAWRQANPEKAQLWDQHKNLMVPADLDAQLVEAARSEKPLATRKYSEMVIQRAAALVPSLVGGSADLAESNLTTIKGGGDVGPACRIDEYDFSWSGRNFHFGVREHAMGSIVNGVVLYGGFRAYGATFLVFSDYMRPPIRLAALMQVPSIFVFTHDSFFLGEDGPTHQPVEHLWSLRMIPHVTVFRPADGLETAMAWAYALMEAKEPTILALTRQNVPHLERPAGFAIRDVWKGGYVVSDAANPVATLIATGSEVGLAVEAQKLLAERGIAVRVVSMPSVELFLRQPREYQEQVLVGRLAAIEAGRTDGWYRIIGRDGLAIGHEDFGASAPAGVLAEKFGFTPAQVAARVVEWLEG

SEQ ID NO: 9964 - DNA, 1995 bp, Bacillus cereus E33L
  CDS (1)..(1995): transl_table=11
atgatacaaaacataaatcaattagcagtgaatacaattcgtacgttatcaattgatgctattaatgcggcaaattcaggtcatccaggtcttccgatgggagcagcgccaatggcttatgcattatgggcgaatcatttaaatcataatcctaatcatccaaaatggtttaaccgtgatcgcttcgttttatcggcgggacatggatctagcttattatatagcctacttcatttagctggatatgacgtttcaattgatgacttgaaaaacttcagaaagttaaatagtaaaacaccaggacatcctgagtttggtcatacttctggagttgaagcgacaacgggcccgttaggacaagggattgccaatgctgtcggaatggcaatggcagaagcgcatttagcagcgaaatttaataaggatggtcactctattattgatcacaatacgtacgctttagttggagacggtgatttaatggaaggtgtcgcttatgaagcgatgtcaatggcaggacatatgaaacttggcaagttaattgtgctgtatgattcaaatgaaatttcacttgatggtgaattaaacattgctttctctgaagatatgcagaaaagggtagaatctgcacattggcaatatataagagttgaagatggaaacgatgttgatgcgattacaaaagcgattcaattagcgaaagataatgcggaccaacctactcttatagaaattagaaccattataggttacggaagtccaaaagttgctggaacgaacaaagcacacggtaacccgcttggattagaagaagcgacagcgacaaaacaagtgtatggttggcattatgaagaagacttctttgtacctgaagaagtaacagctcattttaatgaactgaaacaaaaaggtattgaaaaagaaaatggctggaatgagcagttcaacttatacagagagtcaaatcctgcactagcagatgaattagaaaaagcaattacaggtgaagttttaatcgaagcgaaagacattctatccttcgatactgaaaaaacgatttcaactcgtgttgcaagtggggaagctattaaccattatgtgaaatcgattccttctattttcggtggaagtgcggatctttctcattctacgatgacagatataaaaggtgaagcagtgtatgcggtagaatcgtatgctggccgaaatatatactttggtgtacgtgaacatgcaatgggcgcagcagcgaatggactggctcttcatggaggagtaaaaccgttcgtgagtacattctttgtatttaatgactatcttcgtccatctattcgactggctgcattgcaaaagttacctgttacgtatgtatttacacatgattcgattgctgtaggagaagatggtccaacgcatgaacctattgaacatttagcagctcttcgggcaattcctggtttaacagttatccgtccgtcagatgcaaatgaaacagcaagtgcgtgggcgtatgctttacagcaaaccgatggtccagtcgttttagtacttagccgtcaaaatttaccggtgtttaatgaaacgaaagcaaacatagagaatctttctaaaggagcttacgtattaacacaaacgaatgaaaatccggatgtaattttaattgcgacaggttctgaagtatccttagctgctagtgcgaaagcgaaactagaagaagacaatgtctctgttcgtatcgttgcaatgccgagctgggaattattcgatcaccaatcgaaagaatataaggaatccgttcttccgtcttctgtaacgaaacgagtatctcttgagatgggcgtatctctcggctgggagcgttatgtaggacaagaaggaaacatattatcgattgaaacatttggagcttcaggaactggggctgaagtcatgaatctatttggatttacgacagaaaacgttgttcaaattactaaaaatgtattgaattcttaa

SEQ ID NO: 9965 - protein, 664 aa, Bacillus cereus E33L
MIQNINQLAVNTIRTLSIDAINAANSGHPGLPMGAAPMAYALWANHLNHNPNHPKWFNRDRFVLSAGHGSSLLYSLLHLAGYDVSIDDLKNFRKLNSKTPGHPEFGHTSGVEATTGPLGQGIANAVGMAMAEAHLAAKFNKDGHSIIDHNTYALVGDGDLMEGVAYEAMSMAGHMKLGKLIVLYDSNEISLDGELNIAFSEDMQKRVESAHWQYIRVEDGNDVDAITKAIQLAKDNADQPTLIEIRTIIGYGSPKVAGTNKAHGNPLGLEEATATKQVYGWHYEEDFFVPEEVTAHFNELKQKGIEKENGWNEQFNLYRESNPALADELEKAITGEVLIEAKDILSFDTEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETASAWAYALQQTDGPVVLVLSRQNLPVFNETKANIENLSKGAYVLTQTNENPDVILIATGSEVSLAASAKAKLEEDNVSVRIVAMPSWELFDHQSKEYKESVLPSSVTKRVSLEMGVSLGWERYVGQEGNILSIETFGASGTGAEVMNLFGFTTENVVQITKNVLNS

SEQ ID NO: 9966 - DNA, 2001 bp, Bacillus cereus E33L
  CDS (1)..(2001): transl_table=11
atgtcacattcaatcgaacaactttctatcaacacgattcgcacattatccatcgatgcgattgaaaaagcaaactctggtcacccaggaatgccaatgggtgcagcaccaatggcttatacattatggactcaatttatgaaacacaatccaaataacccaacgtggtttaaccgtgatcgtttcgtattatctgcaggtcatggttcaatgttattatacagcctacttcacctatctggttatgatgtaacaatggatgacttaaagaacttccgtcaatggggaagcaaaactccagggcatcctgagtacggtcatacagctggtgtagatgcaactactggtccacttggacaaggtattgcaactgctgtaggtatggcaatggcagaaagacatttagctgctaaatataaccgtgatgcgtataatgtagtagatcattatacatacgctatttgtggtgatggagatttaatggaaggcgtttctgctgaagcatcttcattagctgctcatttacaattaggtcgtcttgttgtgctttatgattcaaacgatatttcattagatggcgatttaaatcgttcattctctgaaagtgtagaagatcgttacaaagcatacggatggcaagtaatccgtgttgaggatggaaacgatattgaagctatcgcgaaagcaatcgaagaagcgaaagctgacgaaaaacgcccaacgctaattgaagtaagaacgacaattggtttcggttctccaaacaaatcaggaaaatcagcttcacatggttctccacttggtgtagaagaaacaaagttaacgaaagaagcatacgcttggactgctgagcaagacttccatgtagcagaagaagtatatgacaacttccgtaaaacagtacaagatgttggtgaaactgcgcaagctgagtggaacacgatgctaggtgaatatgcacaagcatatccagaattagcaaacgaactgcaagcagcaatgaacggtcttcttccagaaggttgggagcaaaacttaccaacttatgaattaggatcaaaagcagcaactcgtaattcttcaggtgctgtaattaatgcaattgcagagtctgtaccatcattcttcggtggatctgctgaccttgctggttctaacaaaacatacatgaataacgaaaaagactttacaagagatgattacagcggtaaaaacatttggtacggtgtacgtgagttcgcaatgggtgcagcaatgaacggtattgcactacatggtggtttaaaaacttacggtggtacgttcttcgtattctctgactacttacgcccagcaattcgtcttgcagcattaatgcaattgccggtaacgtatgtattcacacacgacagtatcgctgttggtgaagatggtccaacacatgaaccaatcgagcaattagcagcgctacgtgcaatgccaaatgtatctgttattcgtccagctgacggtaacgaatctgttgcagcttggagactagctctagaatctacaaacaaaccaactgctttagtattaactcgtcaagatcttccaacattagaaggtgcaaaagacgatacgtatgaaaaagtagcaaaaggtgcgtatgtagtttctgcaagcaagaaagaaacagctgatgtaatcttacttgcaactggatctgaagtaagtctagctgttgaagctcaaaaagcattagcagtagacggcgttgatgcatctgttgtcagcatgccatctatggatcgctttgaagctcaaacagctgagtacaaagaatctgtattaccaaaagcagtaacaaaacgtttcgcaatcgaaatgggtgctacattcggatggcaccgttacgtaggtcttgaaggagatgtgttaggtatcgatacattcggtgcttctgctcctggtgagaagattatggaagagtatggatttactgtagagaacgttgttcgtaaagtaaaagaaatgctttaa

SEQ ID NO: 9967 - protein, 666 aa, Bacillus cereus E33L
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYDNFRKTVQDVGETAQAEWNTMLGEYAQAYPELANELQAAMNGLLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 9968 - DNA, 1998 bp, Mannheimia succiniciproducens MBEL55E
  CDS (1)..(1998): transl_table=11
atgacagatcataaaaaactagccaatgcgatccgtttcttaagtatggatgcggtgcaaaaagcaaaatccggtcaccccggcgcacctatgggcatggcggatattgcagaggttttatggcgcggttttatgaagcacaatccgaccaatcctaaatgggcggatcgtgaccgttttgtgctttcaaacggtcacggctccatgttgatttacagccttttacatttgacgggctatgacctttctatcgaagatttaaaaaacttccgtcaacttcattctaaaacgccgggtcacccagaatacggctacgcaccaggcgtagaaaccaccacaggtccgcttggtcaaggtatcaccaatgccgtaggtatggcgattgcggaaaaaaccttggcggcgcaatttaaccgcgaaggtcacgatattgttgaccatcacacttacgtatttttaggcgacggctgtttaatggaagggatttcccatgaagcctgttcattagcgggaaccttaggtttaggcaaattaatcgcgttctatgatgacaacaacatttccatcgacggtcatgttgacggttggttcagcgacaacaccaaaggccgttttgaagcttacggctggcaagtaattgataatatcgacggtcataatccggaacaaattgctgcggcggtgaaattagcccgggcggaaacggaaaaaccgtctatcattatctgcaaaaccattatcggttacggttcgccgaacaaatccgcctctcatgattgtcacggcgcgccattaggcgatgaagaaatcgctttaacccgtaaagcgttaaattgggaatacgcaccttttgaaattccggcggatatttacgccgcatgggatgcaaaatcggcaggtcaaagcgcagaagcggtatggaatgaaaaattcgccgcttatgaaaaagcctatcctgaattagcgaaagaatttaaacgccgagtaaacggtgaattgccggcaaactgggcggcagaatctcaggcattcattgaaaaattacaggcaaatccggcttcaattgccagccgtaaagcctcacaaaacgctattgaagcttacgcccatattttacctgaattcttgggtggttccgccgacctggcaagctcaaacttaaccctgtggtcaggttcaaaaccgattcgtgctaaacaaaacgtagacggtaactacatcaactacggcgtgcgtgaattcggtatgtccgctattatgaacggtatcgccttgcacggcggtttcattccttacggcgctaccttcttaatgttctacgaatacgcccacaatgcggttcgcatggcggcattaatgaaacaacgctcattattcgtctacactcatgactccatcggtttgggcgaagacggtccgactcaccaaccggtagaacaaaccgcttcattacgtttaattcctaacctggaaacctggcgtccggcggatcaagtggaatccgccattgcatggaaagccgcggttgaacgtaaagacggtccgagcgcattaatcttcacccgccaaaacctggcgcaacaagatcgtacttccgaacaattagcaaacgtagcgcgcggcggttatatcttaaaggattgcgccggcacgcctgagcttattttaattgctaccggttcggaagtggaattagcggtaaaagcggcggaagcgttaactgcggaaggtaaagcagttcgcgtggtttctatgccgagcactaacgtgttcgacaaacaggatgaagcctaccgcgaatccgtgttaccgagttcagtaaccaaacgtgttgccattgaagcgcaaattgccgatttctggtataaatacgtgggtttagagggccgcatcgtaggcatgaatcgcttcggtgaatccgctccggcagatcaattatttaaactcttcggttttaccgttgaaaatgtagtggcaaaagcaaaagagattctttaa

SEQ ID NO: 9969 - protein, 665 aa, Mannheimia succiniciproducens MBEL55E
MTDHKKLANAIRFLSMDAVQKAKSGHPGAPMGMADIAEVLWRGFMKHNPTNPKWADRDRFVLSNGHGSMLIYSLLHLTGYDLSIEDLKNFRQLHSKTPGHPEYGYAPGVETTTGPLGQGITNAVGMAIAEKTLAAQFNREGHDIVDHHTYVFLGDGCLMEGISHEACSLAGTLGLGKLIAFYDDNNISIDGHVDGWFSDNTKGRFEAYGWQVIDNIDGHNPEQIAAAVKLARAETEKPSIIICKTIIGYGSPNKSASHDCHGAPLGDEEIALTRKALNWEYAPFEIPADIYAAWDAKSAGQSAEAVWNEKFAAYEKAYPELAKEFKRRVNGELPANWAAESQAFIEKLQANPASIASRKASQNAIEAYAHILPEFLGGSADLASSNLTLWSGSKPIRAKQNVDGNYINYGVREFGMSAIMNGIALHGGFIPYGATFLMFYEYAHNAVRMAALMKQRSLFVYTHDSIGLGEDGPTHQPVEQTASLRLIPNLETWRPADQVESAIAWKAAVERKDGPSALIFTRQNLAQQDRTSEQLANVARGGYILKDCAGTPELILIATGSEVELAVKAAEALTAEGKAVRVVSMPSTNVFDKQDEAYRESVLPSSVTKRVAIEAQIADFWYKYVGLEGRIVGMNRFGESAPADQLFKLFGFTVENVVAKAKEIL

SEQ ID NO: 9970 - DNA, 2004 bp, Bacillus licheniformis ATCC 14580
  CDS (1)..(2004): transl_table=11
atgaaaacgattgaattaaaatctgtcgcaacaatacgaacactctccatagacgcgattgaaaaagctaaatccggtcaccccggcatgccgatggggactgctccgatggcttatgcgctttggacaaaaatgatgaatgtcagccctgaaaatccgaattggtttaacagggaccgttttgtgctttccgccggacacggatcaatgcttttgtacagcatgcttcacttaagcggatatgacgtttcaattgaagacctcaaaaatttccgccaatggggaagcaaaactcctgggcatccggaattcggacatactccgggtgtagatgcgactacaggtccgcttggccaaggaatcggaatggctgtcggaatggcgcttgctgaacgtcaccttgctgaaacttacaaccgtgacgactatcgcgtcgttgaccattatacatacagcatttgcggtgacggagacttgatggagggaatttcatccgaagcggcttcgcttgcgggacatttgaacctcggccgtctcatcgtgctttatgattcaaatgacatttcgcttgacggcgaactaaaccgctcattctctgaaaatgtaaagcagcgctttgaagcgatgaattgggaagtgctttatgttgaagacggcaacaacattgccgaaattacggcggccatcgagaaagcgaaacaaaatgaaaagcagccgacattaattgaagtgaaaacaacgatcggtttcggttctccaaaccgtgcgggcacatccggcgtccacggcgctccgctcggatcagaagaggcgaaattaacgaaggaagcgtatgagtggacatacgaagaagatttttatgttccttccgaagtgtacgagcactttaacgaaacagtgaaggaagcgggcaagaaaaaagaggcggaatggaacgaactgttctccgcatacaagaaagcccacccggaacttgccgaagagcttgaactggcgatcaaaggcgagcttcctgaaggatgggatcagaaagtacctgtatatgaaaaaggaagcagccttgcttcacgtgcatcctcaggtgaagtgttaaacggaatcgctcaacaagtgccgtttttctttggcggatccgcggacttggccggttccaacaaaacgacaatcaaaaacggcggagatgtttcagcgaaggattacgccggcagaaatatctggttcggtgtaagggaatttgcgatgggagcagctttgaacggaatggctcttcacggaggcctccgcgtattcggcggaacgttcttcgttttctccgattacttgagaccagcgattcgtcttgctgcattgatggggcttcctgtcacctatgtatttacacatgacagcattgccgtcggtgaagacggaccgactcatgagccgattgaacagctggcatcacttcgtgcgctgccgaacttgtccgtcatcagacctgccgacggaaatgaaacagcagctgcctggaagctcgcgcttcaatcaaaagaccagccgactgcgcttgtgttgacacgccaaaacttgccgacaatcgatcagtctgctgaaacggcttatgaaggcgttaaaaagggtgcatatgtcgtttcaaaaagccaaaacgaaaaaccggaagcgatcttgcttgcgagcggatctgaagttggccttgcgcttgatgcacaaagcgagctgcaaaaagaaggcattgacgtatccgttgtcagcgttccgtcatgggatcgatttgacaagcagccggctgaatataaaaacgctgttcttccaactgatgtgacaaagcgtctcgcaattgaaatgggatcgccgctcggatgggagagatatacaggcactgacggggacattctcggaatcgaccagttcggtgcatcagctcctggcgaaacgatcatgaaagaatacggttttacgcctgcgaatgtagttgaccgggtgaaaaaactgttaaatcgctaa

SEQ ID NO: 9971 - protein, 667 aa, Bacillus licheniformis ATCC 14580
MKTIELKSVATIRTLSIDAIEKAKSGHPGMPMGTAPMAYALWTKMMNVSPENPNWFNRDRFVLSAGHGSMLLYSMLHLSGYDVSIEDLKNFRQWGSKTPGHPEFGHTPGVDATTGPLGQGIGMAVGMALAERHLAETYNRDDYRVVDHYTYSICGDGDLMEGISSEAASLAGHLNLGRLIVLYDSNDISLDGELNRSFSENVKQRFEAMNWEVLYVEDGNNIAEITAAIEKAKQNEKQPTLIEVKTTIGFGSPNRAGTSGVHGAPLGSEEAKLTKEAYEWTYEEDFYVPSEVYEHFNETVKEAGKKKEAEWNELFSAYKKAHPELAEELELAIKGELPEGWDQKVPVYEKGSSLASRASSGEVLNGIAQQVPFFFGGSADLAGSNKTTIKNGGDVSAKDYAGRNIWFGVREFAMGAALNGMALHGGLRVFGGTFFVFSDYLRPAIRLAALMGLPVTYVFTHDSIAVGEDGPTHEPIEQLASLRALPNLSVIRPADGNETAAAWKLALQSKDQPTALVLTRQNLPTIDQSAETAYEGVKKGAYVVSKSQNEKPEAILLASGSEVGLALDAQSELQKEGIDVSVVSVPSWDRFDKQPAEYKNAVLPTDVTKRLAIEMGSPLGWERYTGTDGDILGIDQFGASAPGETIMKEYGFTPANVVDRVKKLLNR

SEQ ID NO: 9972 - DNA, 2079 bp, Legionella pneumophila subsp. pneumophila str. Philadelphia 1
  CDS (1)..(2079): transl_table=11
atgaatggtcttcttgccgatttatgccttctgagcgacaatagtgcctcagttaaatgcaaaagagtaggcatgaacagttttacagaattagctaatgcagtacgcatgttaagcatcgatgcagtaaaccaagctcaatcaggccaccctggcatgcccttgggtatggctgatattgccaccgttttatggaaaaaatttctaaaattcaaccccaaaaacccgcactggtttaacagagaccgttttgtattatctaatggccatggttccatgcttctctattctttactgcatttgaccggatacaacttggatattagcgagcttaaaaacttccgccaattgcactcaaaaacaccagggcatccggaacatgggcacactcctggtgtcgaaacaacaacagggccattaggtcagggtttagccaattcagtcgggatggccttagcggagcgtgtgctggctagtacctttaaccacgatcactttaacctggttgatcattatacatatacttttgccggtgatggttgcctgatggaaggcatttctcatgaggcgtgttctttagctggcactcttggtttgggaaagctcattgtattttatgacgacaatgggatatctattgatggtaaggtagaatcctggtttacggacgatactacgtctcgctttaaagcctacaactggcaagtcataggccccatcgatggccacgacgcagatcaaattgagcaagccatatcagcagcacgcgagaacacgactcaaccttcattaattatctgtaaaaccgtcataggactgggctcctctgtagccggtagcgaaaaagcgcacggctctccattgagtgcccaagacataaataatgtccgtgaattttttaattggaaacatgctccctttgaaattccagattcgatatacaagcaatgggatcatagagagcaaggagaaaaagaagagcaacaatggctgcagctcctgcatgaataccggcaacaacatccatcggaacacgatgagtttttgcgtcgtgccaatggcgacctgcccgatgattggcaagaaatatcggctggattcctaaaacaatgcctgaacaatgagaaagccatagcaacgcgtaaggcgtcgcagcaatgcatagagtttttcgcgccaatattaccggaaatgtttggcggctcagcggatttgactggttccaataataccgactggtcaggcagcaaagccatcacggcccataatttttccggaaattacctttattatggagtgagggaatttgccatggcagccatcatgaatggacttgctgtgcatgggggattcattccctacggcggaacattccttgttttcgcagattatgcaagaaatgccatccgtttaagcgctttaatgaaacaaagagtgatatacgtattgactcatgattctatcggtttaggggaagatggcccgacacaccaacctatagaacatatcgctatgttaagaatgacccctggcatgacggtctggcgccctgctgatttgatggaaaccgctgttgcatggcaacaatcgttagaacatcataatggcccgtctgccttattactctcaagacaaaatctgcccgctttagcccatggcaccgatgcggctgacttgattaagaaaggcggatatattattgccgattgtgaagggaaacctgatgctatcctgatagccactggttcagaagttcaactggctataaccgcagcagaaaaggcaaaagcaagaggtctccaggtcagggtggtatccatgccctgtgctgagcgattccttgcccagagtgatgattacaaaaaccaggtattacctggtcaggttcgcacacgtattgcgatagaagcagctagcagtgcctattggcaccaatttgttggctttgacggcgctgtcattgggctggattgttttggggtatcagctcctgctacagatgcttttaattaccttggaattacagtagaaaaaattatcaatactctagatacattaaccaaacaaacaatggtgtaa

SEQ ID NO: 9973 - protein, 692 aa, Legionella pneumophila subsp. pneumophila str. Philadelphia 1
MNGLLADLCLLSDNSASVKCKRVGMNSFTELANAVRMLSIDAVNQAQSGHPGMPLGMADIATVLWKKFLKFNPKNPHWFNRDRFVLSNGHGSMLLYSLLHLTGYNLDISELKNFRQLHSKTPGHPEHGHTPGVETTTGPLGQGLANSVGMALAERVLASTFNHDHFNLVDHYTYTFAGDGCLMEGISHEACSLAGTLGLGKLIVFYDDNGISIDGKVESWFTDDTTSRFKAYNWQVIGPIDGHDADQIEQAISAARENTTQPSLIICKTVIGLGSSVAGSEKAHGSPLSAQDINNVREFFNWKHAPFEIPDSIYKQWDHREQGEKEEQQWLQLLHEYRQQHPSEHDEFLRRANGDLPDDWQEISAGFLKQCLNNEKAIATRKASQQCIEFFAPILPEMFGGSADLTGSNNTDWSGSKAITAHNFSGNYLYYGVREFAMAAIMNGLAVHGGFIPYGGTFLVFADYARNAIRLSALMKQRVIYVLTHDSIGLGEDGPTHQPIEHIAMLRMTPGMTVWRPADLMETAVAWQQSLEHHNGPSALLLSRQNLPALAHGTDAADLIKKGGYIIADCEGKPDAILIATGSEVQLAITAAEKAKARGLQVRVVSMPCAERFLAQSDDYKNQVLPGQVRTRIAIEAASSAYWHQFVGFDGAVIGLDCFGVSAPATDAFNYLGITVEKIINTLDTLTKQTMV

SEQ ID NO: 9974 - DNA, 2028 bp, Burkholderia pseudomallei K96243
  CDS (1)..(2028): transl_table=11
atgacgacttcgtctcccgcctccaccactctgatggccaacgcgatccgcgcgctcgcgatggacgccgtccagcaagcgaactccggccaccccggcatgccgatgggcatggccgagatcggcgtcgcgctgtggtcgcgccacctgaagcacaacccgacgaacccgcattgggccgaccgcgaccgcttcgtgctgtcgaacggccacggctcgatgctgctgtactcgctgctgcacctgacgggctacgatctgccgatcgaagagctgaagaatttccggcaattgcattcgaagacgccgggccacccggaatacgggatcacgccgggcgtcgagacgacgacgggcccgctcggccagggcctcgcgaacgcggtcggcatggcgctcggcgaggcgctgctcgccgccgagttcaaccgcgacgacgcgaagatcgtcgatcatcacacgtacgtgttcgtcggcgacggctgcctgatggagggcatctcgcacgaagcgtgctcgctcgcgggcacgctcaagctcaacaagctgatcgcgttctacgacgacaacgggatctcgatcgacggcgacgtcgtcaactggttccacgacgacacgccgaagcgcttcgaggcgtacggctggaacgtgattccgaacgtgaacggccacgacgtcgacgcggtcgatgccgcgatcgcgaaggcgaagagcgcggacaagccgacgctcatctgctgcaagacggtgatcggcaagggcgcggcgacgaaggcgggcggccacgacgtgcacggcgcggcgctcggcgcggaggaaatcgcgaagacgcgcgacgcgctcggctggaagtgggcgccgttcgtgattccgcaggaagtctacgcggcgtgggacgcgaaggaagcgggcaagcgccgcgaaggcgactggaacgcggcgttcgcgcagtaccgcgcgaagtacccggccgaggccgccgaattcgagcgccgcatggcgggcaagctgccggccgactgggccgagaaggccgcggcgatcgtcgccggcgcgaacgagcgcggcgagacggtcgcgacgcgtaaggcgtcgcagcagacgatcgagggccttgccgccgtgctgcccgagctgctcggcggctcggccgacctgacgggctcgaacctcacgaactggaaggcgtcgaaggcggtgcgcgcgaatgcgcacggtgcgggcatccagtggggcaaccacatcaactacggcgtgcgcgaattcggcatgagcgccgcgatcaacggcctcgtgctgcacggcggctacaagccgttcggcggcacgttcctcacgttctccgactacagccgcaacgcgctgcgcgtcgccgcgctgatgaaggtgccgtcgatcttcgtgttcacgcacgattcgatcggcctcggcgaagacgggccgacgcaccagtcggtcgagcacgtcgcgagcctgcggctgattccgaacctcgacgtctggcgcccggccgacacggtcgagacggcggtcgcgtggacccacgcggtctcgcaccagcacccgtcgtgcctggtcttcagccgccagaacctcgcgttcaacgcgcgcaccgacgcgcagctcgcgaacatcgagaagggcggctacgtgctgcgcgactgggacgaagagatcgtcgcgcgcaagatcatcctgatcgcgacgggctcggaagtggagctcgcgatgaaggcggtcgagccgctcgcgcagcaggggatcgccgcgcgcgtcgtgtcgatgccgtcgaccgacgtgttcgaccggcaggacgccgagtaccgcgagcgcgtgctgccgcacggcgtgcgccgcgtcgcgatcgaagcgggcgtcaccgatttctggcgcaagtacgtgggcctcgaaggcggcgtggtcggcatcgacacgttcggcgagtcggctccggctggcgtgttgttcaagcatttcggcttcacgatcgagcacgtggtcgaaacggcgaaggcggtgctcgcgtaa

SEQ ID NO: 9975 - protein, 675 aa, Burkholderia pseudomallei K96243
MTTSSPASTTLMANAIRALAMDAVQQANSGHPGMPMGMAEIGVALWSRHLKHNPTNPHWADRDRFVLSNGHGSMLLYSLLHLTGYDLPIEELKNFRQLHSKTPGHPEYGITPGVETTTGPLGQGLANAVGMALGEALLAAEFNRDDAKIVDHHTYVFVGDGCLMEGISHEACSLAGTLKLNKLIAFYDDNGISIDGDVVNWFHDDTPKRFEAYGWNVIPNVNGHDVDAVDAAIAKAKSADKPTLICCKTVIGKGAATKAGGHDVHGAALGAEEIAKTRDALGWKWAPFVIPQEVYAAWDAKEAGKRREGDWNAAFAQYRAKYPAEAAEFERRMAGKLPADWAEKAAAIVAGANERGETVATRKASQQTIEGLAAVLPELLGGSADLTGSNLTNWKASKAVRANAHGAGIQWGNHINYGVREFGMSAAINGLVLHGGYKPFGGTFLTFSDYSRNALRVAALMKVPSIFVFTHDSIGLGEDGPTHQSVEHVASLRLIPNLDVWRPADTVETAVAWTHAVSHQHPSCLVFSRQNLAFNARTDAQLANIEKGGYVLRDWDEEIVARKIILIATGSEVELAMKAVEPLAQQGIAARVVSMPSTDVFDRQDAEYRERVLPHGVRRVAIEAGVTDFWRKYVGLEGGVVGIDTFGESAPAGVLFKHFGFTIEHVVETAKAVLA

SEQ ID NO: 9976 - DNA, 2013 bp, Methylococcus capsulatus str. Bath
  CDS (1)..(2013): transl_table=11
atgccttcgcgacgagaactcgccaacgccatacgcgccttgagcatggatgccgtgcagaaggccaactcgggccatcccggggcgccgatggggatggcggacattgccgaggtgctgtggaacgactacctgtgccacaacccggccaatccgaagtggcccaaccgcgaccgcttcgtgctgtccaacggccacggctcgatgctgatctattccctgctgcatctgaccggctacgatctgcccatcgaggagctgcagaacttccgtcagctccactccaaaacccccggccatcccgaatacggctacacccccggggtggagaccaccacgggtccgctgggccagggcatcaccaacgccgtcggcatggccctggccgagcgcacgctcgccggccagttcaaccgccccggccataccatcgtcgaccattacacctacgtcttcctgggcgatggctgcctgatggagggcatctcccacgaggcctgctcgctggccggctccatgaagctgggcaagctgatcgccttctacgacgacaacaacatctccatcgacggcgaagtgcgcggccatggcggcgtgcccggctggttcatggacgataccccccggcgcttcgaggcttacggctggcacgtgatccccaaggtcgacgggcatgatccggacgccgtgaaggcggccatcgaggaagcccgcgcggtcaccgacaaaccgtcgctgatctgctgccagaccatcatcggctggggttcgcccaacaaacagggcaaggaagactgccacggcgccgccctcggcaccgacgaggtcgccttgacccgcgagaacatcggctggtcgcacccgcctttcgaaatcccggccgacatctacgaggcctggagcgcgcgcgagaccggcgccaaggccgaaggcgagtggaacgaccgcttcgaaaactaccgccgcgaattccccgagctggccgccgagttcgaacgccgcatggccggcgaattgccccgcgactgggcggagaaatccgccgccttcgtggcccaggtgaacgagaaggccgagaccatcgccagccgcaaggcctcccagaacgccctcaacggcttcgggcccctgctgccggagatcctgggcggctcggccgacctcgccggctccaacctgaccctgtggtccggctgcaaggacgtcaacgcccccggccacgacggcaactacgtctactacggcgtgcgtgaattcggcatgtccgccatcatgaacggcatcgccctgcacggtggcttcaagccctacggcgcgaccttcctgatgttctccgaatacgcccgcaacgcgctgcgcatgtcggccctgatgaagatcccggtgatctacgtctacacccacgactccatcggcctgggtgaggacggccccacccaccagcccgtcgagcagaccgccaccttgcgcctcatccccaacatgcaggtctggcggccgtgcgacgcggtggaatcggcggtggcctggaagtgcgcgatcgagcgccgggacggtccctccgccctgatcttctcgcgccagaacctgccgcacatgccccgcacgccggagcagatcgccgcgatcgccaagggcggctatgtcctggtcgactgcaccggcacccccgacctcatcctgatggccaccggctcggaggtcgagctggcggtgaaagcggccgaggccctgaccgccaagggcaggcaggtgcgggtggtgtcgatggcctccaccaacgtgttcgatgcccaggagccggcgtaccgcgacagcgtgctgccgcccgccgtgacccgccgcctcgccatcgaggccggtgtcagcgacggctggtggaaatacgtcggcagccatggcaaagttatcggcctggaccgcttcggcgaatccgcgccggccggcgtgctgttcaagaccttcggcttcaccgtcgacaacgtggtcggccaggccgaggccttgttctaa

SEQ ID NO: 9977 - protein, 670 aa, Methylococcus capsulatus str. Bath
MPSRRELANAIRALSMDAVQKANSGHPGAPMGMADIAEVLWNDYLCHNPANPKWPNRDRFVLSNGHGSMLIYSLLHLTGYDLPIEELQNFRQLHSKTPGHPEYGYTPGVETTTGPLGQGITNAVGMALAERTLAGQFNRPGHTIVDHYTYVFLGDGCLMEGISHEACSLAGSMKLGKLIAFYDDNNISIDGEVRGHGGVPGWFMDDTPRRFEAYGWHVIPKVDGHDPDAVKAAIEEARAVTDKPSLICCQTIIGWGSPNKQGKEDCHGAALGTDEVALTRENIGWSHPPFEIPADIYEAWSARETGAKAEGEWNDRFENYRREFPELAAEFERRMAGELPRDWAEKSAAFVAQVNEKAETIASRKASQNALNGFGPLLPEILGGSADLAGSNLTLWSGCKDVNAPGHDGNYVYYGVREFGMSAIMNGIALHGGFKPYGATFLMFSEYARNALRMSALMKIPVIYVYTHDSIGLGEDGPTHQPVEQTATLRLIPNMQVWRPCDAVESAVAWKCAIERRDGPSALIFSRQNLPHMPRTPEQIAAIAKGGYVLVDCTGTPDLILMATGSEVELAVKAAEALTAKGRQVRVVSMASTNVFDAQEPAYRDSVLPPAVTRRLAIEAGVSDGWWKYVGSHGKVIGLDRFGESAPAGVLFKTFGFTVDNVVGQAEALF

SEQ ID NO: 9978 - DNA, 1986 bp, Anaplasma marginale str. St. Maries
  CDS (1)..(1986): transl_table=11
ttgatgggacgtgaatcatatcaaattatggcgaaagcggttaggctgctgtccgtagatgccatacaaaatgctgcctcagggcatccgggaatgccactgggtatggccgatgttgccactgtgctgttttcaaagtttttgcggttcagcgtgaaccatccgtcgtggttcgatagagacaggctagttctctccaacgggcacgggtccatgctcatgtactcaataatgcatctggttggatatattgggattgatgatatcaagcgtttccggcagctgcattcaataactcccggtcatccggaatatggttgcactacaggtgttgaggtaaccactgggccactgggccagggccttgggtgcgccgtgggtcttgctattgctgagcgcatgttctcccagaaatttggcgatgatcttataaatcaccacacatacgccatagttggggacggctgcttgatggagggaatcagccacgaagctgcttctctagccgggcacctgggcctagatcacctaattgtcttgtttgatgataatggcatctcgatagatgggagtaccagcttggcgacctctgacgacgtacgtgcaaggttttccgcctatgggctggatgtctttgaggttgacgggcatgattttggcgagattgaacaagcaattggtgcagctagggagtctaggggcaaaccgtccataatttgttgcaagacagtcataggtaagtttatgccccccaaggcgggtacttctgcggcgcacagctggccgttttcccctgaagatgctcaagagtttcggaatgccataggatgggaaggtgagaagttcgaaattcccgaggaagccaaggccttatggcgtaaagttagagcaagagctgagctggaatgcgagctttggatgaagaaatttgctggttgcgcaaaggctgaggtgcttaacgcaatactttcagatggtgtaccaaacagcgtcatagatgagcttgataccctgaaaaacaccctttgtgaaacgcgccctgctgaggcgaccagaaaatccttcggcagagttttagaattcttggcgatgagggtgaacaagctcgtcggggggtcctccgatctcacttcctccaataacaccaaggtaccctgcatgggggtggtaagctccaaaaattttgacgcatcctacgtgcattatggggtgagagagcacgcgatggccgcgtgtatgaacggcatggcgctccatgggggcataataccctacggcgggacatttctagttttttctgactattgtagacctgctataagactgtctgcattgatgagagtgcaggtcatatatgtaatgactcacgactccataggtgtaggggaggatggccccacccatcagcccgtggaacacctcgcttccctgcgttccatacccaacctgtacgttttcagacctgcggatgctgttgaggttttggaatgctgggagatggccctgaagctcaccaagtcaccatcgctgtttgcgttgtcaaggcagagcgtaggcttcagtcgcgcgtgctattcccacaataaccttgccagcaggggtgcgtacataatacgcgagcatgagggggattttagggttactatcttttctacgggttccgaagtgggcgtggcactgggtgctagggaaattcttcaagatcagggaatcggcaccagagtggtttccatgccttgctggcgaatatttgacgaacaagacgaagagtatattgcaagtttgctggggaacggcagcctaaaagtggctgtggaggcggcttgttctctggggtggcataagtacataggtgaaaagggcgtatttatggggcttgacaggtttggtgcatcaggtaagtgtgaggatttgtacaggcattttgggatcacgaaggaaaatgtagccggtacaattttggctaagttgcgttctggggtatag

SEQ ID NO: 9979 - protein, 661 aa, Anaplasma marginale str. St. Maries
MMGRESYQIMAKAVRLLSVDAIQNAASGHPGMPLGMADVATVLFSKFLRFSVNHPSWFDRDRLVLSNGHGSMLMYSIMHLVGYIGIDDIKRFRQLHSITPGHPEYGCTTGVEVTTGPLGQGLGCAVGLAIAERMFSQKFGDDLINHHTYAIVGDGCLMEGISHEAASLAGHLGLDHLIVLFDDNGISIDGSTSLATSDDVRARFSAYGLDVFEVDGHDFGEIEQAIGAARESRGKPSIICCKTVIGKFMPPKAGTSAAHSWPFSPEDAQEFRNAIGWEGEKFEIPEEAKALWRKVRARAELECELWMKKFAGCAKAEVLNAILSDGVPNSVIDELDTLKNTLCETRPAEATRKSFGRVLEFLAMRVNKLVGGSSDLTSSNNTKVPCMGVVSSKNFDASYVHYGVREHAMAACMNGMALHGGIIPYGGTFLVFSDYCRPAIRLSALMRVQVIYVMTHDSIGVGEDGPTHQPVEHLASLRSIPNLYVFRPADAVEVLECWEMALKLTKSPSLFALSRQSVGFSRACYSHNNLASRGAYIIREHEGDFRVTIFSTGSEVGVALGAREILQDQGIGTRVVSMPCWRIFDEQDEEYIASLLGNGSLKVAVEAACSLGWHKYIGEKGVFMGLDRFGASGKCEDLYRHFGITKENVAGTILAKLRSGV

SEQ ID NO: 9980 - DNA, 2034 bp, Azoarcus sp. EbN1
  CDS (1)..(2034): transl_table=11
atgccgccagccgcacacacgaatccgcgcaacgtcactcccccggtcttcaacccggtcaccggcgcgattcgcgcgctcgcgatggacgccgtccagcaagccaactcgggccacccgggcgccccgatgggcatggccgagatcgccgaagtcctgtggcgccaccacctgcgtcacaatccggcgaacccgcaatgggccgaccgcgaccgcttcgtgctgtcgaacggccacggctcgatgctgatctacgcgctgctgcacctgaccggctacgatctgccgatcgaagagctcaagcgcttccgccagttgcacagcaagactcccggccaccccgagtacggctacacgccgggcgtcgagacgaccaccgggccgctcggccagggcctcagcaacgccgtcggcatggcgatcgccgagaaggtgctcgccgccgaattcaaccggcccggccacgccatcgtcgatcaccacacctacgtgttcgtcggcgatggctgcctgatggaaggcatttcgcacgaagtctgctcgctcgccggcacgctcggcctcggcaagctgatcgccttctatgacgacaacagcatttcgatcgacggcgacgtcgcgggctggttcaccgacgacacgccgaagcgcttcgaagcctacggctggcatgtcgtgcgcgacgtgcagggtcacatgtcggccgaaatcgacgatgcgatccgcgccgcgaaagccgagaccaggcggccgacgctgatctgctgcaagacggtcatcggcgcgggctccccggccaagcagggcggccacgactgccacggcgcgccgctcggcgccgcggagatcacggccgcgcgcgcccatatcggctggacccacgcgccgttcgagatccccgccgatgtctacgccgagtgggacgcgcgcgaagccggcaaggcccgcgaagccgactggaacgcaacgttcgccgcgtacgccgagtccttccccgaagccgccgccgagttcgaacgccgcatgaaaggcgagctgccggcgagttgggcgcagcatgtcgacagcgtgctcgcgaagttcggcgagaaggccgagacgatcgcgacgcgcaaggcgagccagaactcgatcgaggcgttcgcgcctgcgctgcccgagctgatcggcggctcggccgacctcgccagttcgaacctgacgctgtggtccggctcgaagggcgtgtcgaaggattccggcggcaactacatctactacggcgtgcgcgaattcggcatggccgcgatcgccaacggcatcggcctgcacggcgggctgatcccctacaccgccaccttcctgatgttcagcgaatacgcgaggaacgcgctgcggatggcggcgctgatgaagctgcgccaggtgttcgtgttcacgcacgactcgatcggcctcggcgaggacggcccgacgcaccagccggtcgagcagactgcgacgctgcgcctgatccccaacatggacgtgtggcggccgtgcgacaccgtcgaaaccgcggtcgcctgggcgaacgcgattgaacgccgcgacggcccgtcgtcgctgctgttctcgcgccagaacctgccgttccaggcgcgcaacccggagcaggtcgcggcgattcgccggggcgcctacgtgctgtcggaagcggcgaacggcaagccacaggcagtcgtcatcgccaccggctcggaagtcggtctggcgatggcagcgcagcaggcgctcgccggcgacgacatccatgtgcgcgtcgtgtcgatgccctcgaccaacgtgttcgaccgccaggaagccgcgtacaaggcgtccgtgctgccgctcggcgtcccgcgcgtcgcggtcgaagccggcgttaccggcctgtggcacaagtacgtcggcctcgaaggcgctgtcgtcggcatcgacaccttcggcgaatccgctccggcgggggacctgttcagacatttcgacatcaccgccgacgcggtcgcgcgcgccgtgcgctcggtccttctttaa

SEQ ID NO: 9981 - protein, 677 aa, Azoarcus sp. EbN1
MPPAAHTNPRNVTPPVFNPVTGAIRALAMDAVQQANSGHPGAPMGMAEIAEVLWRHHLRHNPANPQWADRDRFVLSNGHGSMLIYALLHLTGYDLPIEELKRFRQLHSKTPGHPEYGYTPGVETTTGPLGQGLSNAVGMAIAEKVLAAEFNRPGHAIVDHHTYVFVGDGCLMEGISHEVCSLAGTLGLGKLIAFYDDNSISIDGDVAGWFTDDTPKRFEAYGWHVVRDVQGHMSAEIDDAIRAAKAETRRPTLICCKTVIGAGSPAKQGGHDCHGAPLGAAEITAARAHIGWTHAPFEIPADVYAEWDAREAGKAREADWNATFAAYAESFPEAAAEFERRMKGELPASWAQHVDSVLAKFGEKAETIATRKASQNSIEAFAPALPELIGGSADLASSNLTLWSGSKGVSKDSGGNYIYYGVREFGMAAIANGIGLHGGLIPYTATFLMFSEYARNALRMAALMKLRQVFVFTHDSIGLGEDGPTHQPVEQTATLRLIPNMDVWRPCDTVETAVAWANAIERRDGPSSLLFSRQNLPFQARNPEQVAAIRRGAYVLSEAANGKPQAVVIATGSEVGLAMAAQQALAGDDIHVRVVSMPSTNVFDRQEAAYKASVLPLGVPRVAVEAGVTGLWHKYVGLEGAVVGIDTFGESAPAGDLFRHFDITADAVARAVRSVLL

SEQ ID NO: 9982 - DNA, 2022 bp, Silicibacter pomeroyi DSS-3
  CDS (1)..(2022): transl_table=11
gtggacctgactgcgctgcgcactgcgaaccccgaccactggaccaaggccaccgccatccgcgccctgacgctggatgctatcgcggcggcaaattccggccattccggcatgccgatgggcatggccgatgtcgccaccgtgctgttcgaaaagcacctgaaattcgacgccgccaaccccacctggcccgaccgcgaccggttcatcctgtcggctggccatggctcgatgctgctctattcgctgctctatctcaccggcaaccccgagatcacgctggatgaggtgaagaacttccgccagatgggcgccaagaccgccggccacccggaaaacttccttgccaaggggatcgagaccaccaccggcccgttgggtcagggcatctcgaacgccgtgggctttgccatcgccgaggaaatccagcgcgcgcaatacggcaagaaggtcgtcgatcattacacctatgtgatcgccggtgacggctgcctgatggagggcgtcagccaggaggcgatcggccttgccggccggctggagctgagcaagctggtcgtgttgtgggacaacaacaacatcaccatcgacggcaccgtcgatattgccgaccgcaccgaccaggtgcgccgctttgccgcctcgggctggcatgtgatcgagatcgacggccatgacccggccgccatcgacgccgccctgacccaggccaagggctcgaaaaagcccacgatgatcgcctgcaagacccatatcgctctgggccacgcggcacaggacacctccaagggccatggcgcgctcaccgatcagggccagcttctggccgcgaaagagggttatggatgggcacatggccccttcgaggtgccctcggacgtgaaatccgcatgggaggccatcggcagccggggtgccgccgagcgcgccgcctgggaggcccgctttgccgagctgagcgagcgcaagcaggccgaattcacccgtgcctatgcgttcgaggcgcccaagaaactggccggcgccatccgcgcgctgaaaaagcaggtctcggaagatcagcccaaatgggccacccgcaaaagctcggaagaggtgctgaaggtcgtcaacccgatcatgaccgagaccgtcggcggctcggccgacctgaccgggtcgaacaacaccaagaccgccgatctgggcatcttcctgccggaaaaccgcaagggccgctatatccactggggtatccgcgaacatggcatggcggcggcgatgaacggcatggcgctgcatggcggtatccgcccctatggcggcaccttcatgtgcttcaccgactatgcccgcccggcgatgcgcctggccgcgctgatgaagatcccgtcggtcttcgtgatgacccatgactcgatcggcctgggcgaggacggtccgacccaccagccggtcgaacatctggcaatcagccgcgccacgcccaacacctatgtgttccgccccgccgacacggtagaaaccgccgaggcctgggaactggcactgaccttccagaacagcccctcggtgctgtcgctgacgcgccagaacctgcccaccctgcgcaccgagcacaaggtcaagaacctgaccgcccagggcggctatgtgctggccgaggccaccggcaagcgtcaggtgatcctgatcgccaccggctccgaggtcgagatcgccatgcaggcgcgcgcaacgctcgaggccgaggggatcggcacccgcgtggtgtcgatgccctgcatggagctgtttgccgagcaggacgaagcctatcgcaagcgcgtgctgcccgcaggcccggtgcgtgtcggcatcgaggccgcgatgcgcgctggtggctgggatcgctggctgctgggcgagcgcgggcgcgaggccaaggcaggctttgtcggcatgaccggcttcggcgcctcggccccggccgaagagctttatgaaaagttcggcatcaccgcggccgcgaccgtggccaaggtcaaggacctgctgggctga

SEQ ID NO: 9983 - protein, 673 aa, Silicibacter pomeroyi DSS-3
MDLTALRTANPDHWTKATAIRALTLDAIAAANSGHSGMPMGMADVATVLFEKHLKFDAANPTWPDRDRFILSAGHGSMLLYSLLYLTGNPEITLDEVKNFRQMGAKTAGHPENFLAKGIETTTGPLGQGISNAVGFAIAEEIQRAQYGKKVVDHYTYVIAGDGCLMEGVSQEAIGLAGRLELSKLVVLWDNNNITIDGTVDIADRTDQVRRFAASGWHVIEIDGHDPAAIDAALTQAKGSKKPTMIACKTHIALGHAAQDTSKGHGALTDQGQLLAAKEGYGWAHGPFEVPSDVKSAWEAIGSRGAAERAAWEARFAELSERKQAEFTRAYAFEAPKKLAGAIRALKKQVSEDQPKWATRKSSEEVLKVVNPIMTETVGGSADLTGSNNTKTADLGIFLPENRKGRYIHWGIREHGMAAAMNGMALHGGIRPYGGTFMCFTDYARPAMRLAALMKIPSVFVMTHDSIGLGEDGPTHQPVEHLAISRATPNTYVFRPADTVETAEAWELALTFQNSPSVLSLTRQNLPTLRTEHKVKNLTAQGGYVLAEATGKRQVILIATGSEVEIAMQARATLEAEGIGTRVVSMPCMELFAEQDEAYRKRVLPAGPVRVGIEAAMRAGGWDRWLLGERGREAKAGFVGMTGFGASAPAEELYEKFGITAAATVAKVKDLLG

SEQ ID NO: 9984 - DNA, 2007 bp, Synechococcus elongatus PCC 6301
  CDS (1)..(2007): transl_table=11
atggttgttgcggctcaatccctcgacgaactttgtattaattcgatccgttttcttgccattgatgcggtcgaaaaagcaaagtcgggtcaccctggtctgcccatgggggcagcgccgatggcctacgtcctttgggaccgcttcctgcgcttcaatcccaaaaaccctgcttggttcaaccgcgatcgcttcgtcctctcggcgggccacggttgcatgctgcagtacgcgctgctgcacctgagcggctacgacagcgtcagcattgaagacatcaagaacttccgccagtggggttcgccgactccgggtcaccccgagaactttgaaaccccgggcgtggaagtgaccactggtcccttgggtcaaggcattgccaacgcggttggtctggcgctagctgaagcccatcttgcggctcgcttcaacaaacccgatgccaagctagtggatcactacacctatgtgatcctgggcgacggctgcaacatggagggtatttccggtgaagctgcttcgctggctggtcactggggcttgggcaagctgatcgccctctacgacgacaaccacatctcgatcgacggctcgactgacgttgccttcaccgaagacgtcagcaagcgctttgaagcttacggctggcatgtgctgcacgttgaaaacggcaacaccgatttggctgcgatcgaaaaagcgatcgcagatgccaaggctgtcaccgacaagccgaccctgatcaaagtcaccacaacgatcggctacggctcgcccaacaaagccaacacggcaggtgttcacggcgcagccttgggtgatgcggaaatcaagctgacccgcgaaaacctcggctgggactacgaaccctttgtggtgcccgaagatgcgctggcgcactggcgcaaagcgatcgagcgtggtgcagccctggaatcaagctggaatgaaaccctggctcagtacaaagccaactacccggctgaagcggctgaatttgagcggatgctgagtggccaactgccgactggctgggccgatgcactgccgagctacaccccggcagataaagctgtggcgacccgtaagcactcggaaatctgtctgaacgccttggctccggtgctgccggaactgatcggtggttcggcagacttgacccactccaacctgacggagttgcacgtctcgggcgacttccaaaaaggcgcttacgaaaatcgcaacgtccactttggggtgcgtgagcatgcgatggcggcgatcgccaacgggattgctctgcacaacagtggcttgattccctacgctgcgaccttcctggtctttgcagactacatgcgcggcgcaatgcgtctgtcggcgctgtcggaagtcggggtcatctacgtcctcacccacgactcgatcggcttgggcgaagacggcccgacccaccaaccggtggagacaatcgcttcgctgcggatcatccccaacatgctggtcttccgtccagccgacggcaacgaagctagcggagcctacaaagtggcggtggaaaaccgtaagcgtccgtcggtcttggccatgtcgcgtcaaaacctgcccaacttggaaggttccagcatcgacatcgttgccaaaggcgcttacgtcctttcggatgatgaaggcacgccggatctgattctgctggcgaccggtagcgaagtctcgctctgtgttgaagctgcgaaacaactgcgggcagaagggaagaaagtccgcatcgtctcgatgccttgctgggaactgttcgacgagcagtcggctgagtacaaagaatcggtactgccgaaagccgtcacggctcgtctggccgtggaagcgggttcctccttcggctggcatcggtacgtcggtgatgctggcgccacgatctcgactgatacctttggcgcttcggctccgggcaacgtcatgttcgagaaatttggcttcaccgtcgacaacgtcgtcgccaaagcgaaagcagtgatcggctag

SEQ ID NO: 9985 - protein, 668 aa, Synechococcus elongatus PCC 6301
MVVAAQSLDELCINSIRFLAIDAVEKAKSGHPGLPMGAAPMAYVLWDRFLRFNPKNPAWFNRDRFVLSAGHGCMLQYALLHLSGYDSVSIEDIKNFRQWGSPTPGHPENFETPGVEVTTGPLGQGIANAVGLALAEAHLAARFNKPDAKLVDHYTYVILGDGCNMEGISGEAASLAGHWGLGKLIALYDDNHISIDGSTDVAFTEDVSKRFEAYGWHVLHVENGNTDLAAIEKAIADAKAVTDKPTLIKVTTTIGYGSPNKANTAGVHGAALGDAEIKLTRENLGWDYEPFVVPEDALAHWRKAIERGAALESSWNETLAQYKANYPAEAAEFERMLSGQLPTGWADALPSYTPADKAVATRKHSEICLNALAPVLPELIGGSADLTHSNLTELHVSGDFQKGAYENRNVHFGVREHAMAAIANGIALHNSGLIPYAATFLVFADYMRGAMRLSALSEVGVIYVLTHDSIGLGEDGPTHQPVETIASLRIIPNMLVFRPADGNEASGAYKVAVENRKRPSVLAMSRQNLPNLEGSSIDIVAKGAYVLSDDEGTPDLILLATGSEVSLCVEAAKQLRAEGKKVRIVSMPCWELFDEQSAEYKESVLPKAVTARLAVEAGSSFGWHRYVGDAGATISTDTFGASAPGNVMFEKFGFTVDNVVAKAKAVIG

SEQ ID NO: 9986 - DNA, 2001 bp, Bacillus clausii KSM-K16
  CDS (1)..(2001): transl_table=11
atgaagccattaacaaaagaaaacatatctcaattatcagtcactacagtgagaacattgtctatcgatagtgtcgaatatgctcaacatgggcatttgggaatgccgcttggagctgctccgatggcatatgcattgtatagaaatgtgttgaagcataatcctaaaaatccaaagtggtatgatcgagatcgatttgttttatcgtcagggcacggatcgattctgcaatatactttattgcatctaactggatatgatgtctccctatctgatttaaaaaactttagaaagcttggcagtaagacaccgggtcatccggaagttggttatactcctggcgtagaggcaacaactgggccattaggtcaaggtctgccgatggttgtggggatggcaatcgcagaacgccatctagctgctaaatataataaagacgatctaaacatcgtcgatcattacacgtatacaatctgtggtgatggcgatttaatggaaggtgtagggcaagaagccatgtcgcttgcaggtcatttagggcttggcaagttgatcgttttatatgattctaacgacatatgttcagatggctctgttactgatagcaacacggaaaatgtacaagaaaagtataaaacaatgggctggcagacgattttggtggaagatggaaatgaccttgaaaaaatacaacaagcgatcgaattaggtaaaaaagaaacgaataaaccgaccttaattgaagttaaaaccgttattggctacggttctccaaacttaagtggaactgaacatattcatagcaatccagttggtgaaaaagaagctcaactcattaagcagcaatacggatggcattttgaggatccatttcacatcccagataaggtaaaagaagatttttcgcaagtcctttcgaatggtttggataatgaaaataaatggaacgaattattcaagcaataccaacagaagtacccagcattggctactgaatttattcgtagcatggaaaatgaaatagaaataaatgaattatcaacggagttcacggaagaaaaagtagcgacaagatcagcgtcaggtaccgtattaaatgaggttgcttctaaagtgccgtccattatcggtggttcagcagacttagcttcatcaaataaaacaacccttcgtgataatgagtttatgacaaaggaagactatcgtggatcaaatattcattttggcgttcgggaatttggaatggctgcgattattaatgggattgcattgcatggtggaataaaaggatattgtggtacattcctcgtattctctgattatatgagatcggccattagaatgtccgctattatgaaagttccagtaacttatgtgtttacgcatgatagcatcatgctaggaccagatgggcctacacatcaaccaattgaacatctgattagcttaagggctatgccgaacttaaatgtgattcgtccggcagacgcgaatgagacgaaagctgcctggcttatcgcagcgaattctaaaaaaacaccaactgcgattatacttgggaggcacgacgttccagtattagacaatgcttctttagaaggggtccgaaaaggagcatatctcatttctgaaggaacggaagaggcgacaggtattattattgcgactggatctgaggtggaattggcaattaaagcacagaatattttggaaagtaagaatatatttgtgaatgtcgtaagtatgcctagttgggaattgtttaaccaacaaaatgaagactacaaaaatagtgttttaccatcaaaccttgataataagctagctgttgagatggggtctgatattggatggagagagtatattggccctaaaggagacacaataacgattaatacgtttggagattcaggaaacgggcaggaattggctgaaaaattaggcttcacaccagaaaacattgcacatagatttatcgaattgaaagaaagaaatctataa

SEQ ID NO: 9987 - protein, 666 aa, Bacillus clausii KSM-K16
MKPLTKENISQLSVTTVRTLSIDSVEYAQHGHLGMPLGAAPMAYALYRNVLKHNPKNPKWYDRDRFVLSSGHGSILQYTLLHLTGYDVSLSDLKNFRKLGSKTPGHPEVGYTPGVEATTGPLGQGLPMVVGMAIAERHLAAKYNKDDLNIVDHYTYTICGDGDLMEGVGQEAMSLAGHLGLGKLIVLYDSNDICSDGSVTDSNTENVQEKYKTMGWQTILVEDGNDLEKIQQAIELGKKETNKPTLIEVKTVIGYGSPNLSGTEHIHSNPVGEKEAQLIKQQYGWHFEDPFHIPDKVKEDFSQVLSNGLDNENKWNELFKQYQQKYPALATEFIRSMENEIEINELSTEFTEEKVATRSASGTVLNEVASKVPSIIGGSADLASSNKTTLRDNEFMTKEDYRGSNIHFGVREFGMAAIINGIALHGGIKGYCGTFLVFSDYMRSAIRMSAIMKVPVTYVFTHDSIMLGPDGPTHQPIEHLISLRAMPNLNVIRPADANETKAAWLIAANSKKTPTAIILGRHDVPVLDNASLEGVRKGAYLISEGTEEATGIIIATGSEVELAIKAQNILESKNIFVNVVSMPSWELFNQQNEDYKNSVLPSNLDNKLAVEMGSDIGWREYIGPKGDTITINTFGDSGNGQELAEKLGFTPENIAHRFIELKERNL

SEQ ID NO: 9988 - DNA, 2007 bp, Bacillus clausii KSM-K16
  CDS (1)..(2007): transl_table=11
atgactaaaacaattaatgtatctcaactctcaattaatacaattcggaccttaaccctcgatgccgttgaaaaagcacagcatggacatccgggtatgccgatgggggcagccccaatggcttatagcttatggaaacattttttaaacgtgaaccctgaaaatccaaactggtttaatcgtgaccgttttgtcctttcagcagggcatggttctactttaatatattctttgctgcatttgacaggatttgacgttacgatagaagatttgaaaaacttccgacgtcttgggagcaaaactccaggccacccggaatatggggtcactccaggaattgaagcaaccacgggccccctcggccaaggaattcccgccagtgttggcttagcaatggctgagagacatttggcagcctcctataatcgggaaggatttcccgttgtggatcactatacgtataccatttgcggtgatggagatttaatggaaggtgtatcctatgaagcagcatctctcgccggacacttaaaacttggacgtttaatcgttttatatgattccaatgatatttgccttgatggcggacttgaactggctttctctgaaaatattcaacaacgttttgaatctatgaattggcaatacatgaaggtggaagatggaaatgatgtagatgcgattgcaaaggctattgaagaagcaaaagccgatgaaacccgtccaacaattattgaaattaaaacggtgatcggttatgggtcttccttgcaaggaaccaataatgcccacagtgacccaatggggaaagaggaagttgctaaaacgaagaagttttacaattggaattatgaagaagcgttttatgttcccgaagaagtttatgctgattacgcaacgattcgcgaacgcggaaaacaaaaagaacaagaatggaatcaattgttcagtcaatatgaagcgcactatccggaacttgcgcaggaattaaagcgaatcatggaaggccaacttcctgaaaactgggatgaacatctctcctcttatgaagaaggaagttcattggctactcgtgtagcaggaagtgaagtcttgaacgcgtttgtcaaacgtatacctgaatttgttggtggctctgccgacttagattcatctacaaaaacaagattgaaagaggagatcgatttcggtaatgatcgctatgggggacgaaatatccgttttggtgttagagaatttgcgatgggcgccattgcaaacggtttggcactgcattcccttcgtccctttgtaagtaccttcttcgtattctccgattatttgcgccctgctattcgattggctgctttaatgggactcccggtaacttatgtgtttacacatgattccgttgccgttggacaagacggacctacccatgaaccggttgaacagttagcttcttttcgagcaatgcctggtttaacagtaattcgtcctgcggatgcgaatgaaacaaaagctgcatggaaagtagctgttgagcaaacagaccgtccaacaatgcttgtgttaggaagacaaaatgtccctacattaaaggattccgataccttggcggaagaaggtgtaagacgcggtgcttatgtgatttccaaagcagaaggggcacctgtagggattttggttgctgctggttctgaagtgtccttggccatcaatgcccaaaaggaattggccaaagaaggcatttatgtaaatgtagtcagcatgccatcctgggatttatttgaaaaacaatcgcaaaagtataaagaaggcgtattgccaagcaatcttcaaacccgcctaacaattgaaatgggttcgaaactaggatggagagaatatgcaagtaccaatggtgccgttatgagcattgattcctttggcgaatccggccctggtgaggaagtaattgcaaaatttggctttaccgtcgaaaatgtagttgacaactttaaacagctactagcaaacgttcgatga

SEQ ID NO: 9989 - protein, 668 aa, Bacillus clausii KSM-K16
MTKTINVSQLSINTIRTLTLDAVEKAQHGHPGMPMGAAPMAYSLWKHFLNVNPENPNWFNRDRFVLSAGHGSTLIYSLLHLTGFDVTIEDLKNFRRLGSKTPGHPEYGVTPGIEATTGPLGQGIPASVGLAMAERHLAASYNREGFPVVDHYTYTICGDGDLMEGVSYEAASLAGHLKLGRLIVLYDSNDICLDGGLELAFSENIQQRFESMNWQYMKVEDGNDVDAIAKAIEEAKADETRPTIIEIKTVIGYGSSLQGTNNAHSDPMGKEEVAKTKKFYNWNYEEAFYVPEEVYADYATIRERGKQKEQEWNQLFSQYEAHYPELAQELKRIMEGQLPENWDEHLSSYEEGSSLATRVAGSEVLNAFVKRIPEFVGGSADLDSSTKTRLKEEIDFGNDRYGGRNIRFGVREFAMGAIANGLALHSLRPFVSTFFVFSDYLRPAIRLAALMGLPVTYVFTHDSVAVGQDGPTHEPVEQLASFRAMPGLTVIRPADANETKAAWKVAVEQTDRPTMLVLGRQNVPTLKDSDTLAEEGVRRGAYVISKAEGAPVGILVAAGSEVSLAINAQKELAKEGIYVNVVSMPSWDLFEKQSQKYKEGVLPSNLQTRLTIEMGSKLGWREYASTNGAVMSIDSFGESGPGEEVIAKFGFTVENVVDNFKQLLANVR

SEQ ID NO: 9990 - DNA, 1998 bp, Bacillus clausii KSM-K16
  CDS (1)..(1998): transl_table=11
ttgacaaataaagttgaagaattggctgttaacacaatccgtacgctatccatcgacagcattgaaaaagcgaattccggccatccagggatgccgatgggcgcagcgccaatggcattaaatctgtggacgaagcatatgaaccataaccctgcgaacccgaagtggtcaaaccgcgaccgtttcgtgctctctgctggccatggttccatgctgctatatagtttgctccatttaagtggatacgacgtgacgcttgacgacttgaagtctttccgccagcttggcagccgtacgcccggccatcctgaatacggccatacagacggagtcgaagcaacgacagggccgcttgggcaagggattgccatggcagtcggcatggcaatggcagagcgccatttagccgctacatacaatactgataaatacccgattgttgaccattttacgtatgcaatttgcggcgatggcgacctaatggaaggcgtttcccaagaagccgcttcattagctggtcatttgaagcttgaacgtttaattgtcctttatgattcaaatgacatttcacttgatggcgatttgcatgaatcgttctctgagagtgtcgaagaccgtttcaaagcttatggctggcatgttgttcgtgtagaagatggcacggatatggaggaaattcaccgcgcgattgaagaagcaaaacgggtagaccgtccgacgctcattgaagtcaaaacagtcattggctatggttcaccaaacaaagcggcttcatctgcttcacacggatctccacttggcactgaagaagtaaagttaacaaaagaagcatacaagtggacgtttgaggaagacttctacattccagaggaagtgaaggcttattttgctgcagtcaaagaagaaggggcagcgaaagaagcagaatggaacgacttgtttgcggcatacaaggcagaatatcctgaattggctgcgcagtacgagcgcgctttctcaggggagttgccagaaggatttgaccaagctttgcctgtttatgaacacggcacgagccttgcgacgcgggcttcttcaggcgaggcgctcaattctcttgccgcccatacgcctgaattgtttggcggctctgctgaccttgctggttcaaacaaaacaacgctaaaaggggaaagcaactttagtcgtgataactatgctggccgcaatatttggtttggtgtccgcgaatttgcaatgggagcggctttaaacggaatggcgctccacggcggattgaaagtatttgggggaaccttttttgtcttctccgattacctgcgtccggctattcgcttatctgcgcttatgggcgtgccagtcacgtatgtgctcactcatgatagcgttgctgttggcgaagacggcccaacgcacgaaccggtagagcatcttgcggcattgcgggcaatgcctggcttgtccgttgtccgtccaggtgacggaaacgaaacagctgctgcttggaaaatcgcactagagtcgtcagaccgtccaaccgtgctcgttcttagccgtcagaacgtcgatacgttaaaaggcactgataaaaaggcttatgaaggggtcaaaaaaggggcatacattgtatcggagccacaagataaaccagaagttgtgctgttggcaactggttcagaagtgccgttagctgtaaaagcacaagctgcacttgctgatgagggcatcgatgcttcagtagttagcatgccgtcttgggaccgttttgaggaacagccacaggaatacaaagatgcagtcattccgagagacgtaaaagcgcgtttggcgattgaaatgggctcttcatttggatgggcaaaatacgtaggcgacgaaggagacgtgcttggcattgacacgttcggcgcttctggagcaggtgaagcggttattgctgagttcggctttacggttgacaatgtcgtttcacgggcaaaagcgttattaaagaaataa

SEQ ID NO: 9991 - protein, 665 aa, Bacillus clausii KSM-K16
MTNKVEELAVNTIRTLSIDSIEKANSGHPGMPMGAAPMALNLWTKHMNHNPANPKWSNRDRFVLSAGHGSMLLYSLLHLSGYDVTLDDLKSFRQLGSRTPGHPEYGHTDGVEATTGPLGQGIAMAVGMAMAERHLAATYNTDKYPIVDHFTYAICGDGDLMEGVSQEAASLAGHLKLERLIVLYDSNDISLDGDLHESFSESVEDRFKAYGWHVVRVEDGTDMEEIHRAIEEAKRVDRPTLIEVKTVIGYGSPNKAASSASHGSPLGTEEVKLTKEAYKWTFEEDFYIPEEVKAYFAAVKEEGAAKEAEWNDLFAAYKAEYPELAAQYERAFSGELPEGFDQALPVYEHGTSLATRASSGEALNSLAAHTPELFGGSADLAGSNKTTLKGESNFSRDNYAGRNIWFGVREFAMGAALNGMALHGGLKVFGGTFFVFSDYLRPAIRLSALMGVPVTYVLTHDSVAVGEDGPTHEPVEHLAALRAMPGLSVVRPGDGNETAAAWKIALESSDRPTVLVLSRQNVDTLKGTDKKAYEGVKKGAYIVSEPQDKPEVVLLATGSEVPLAVKAQAALADEGIDASVVSMPSWDRFEEQPQEYKDAVIPRDVKARLAIEMGSSFGWAKYVGDEGDVLGIDTFGASGAGEAVIAEFGFTVDNVVSRAKALLKK

SEQ ID NO: 9992 - DNA, 1899 bp, Campylobacter jejuni RM1221
  CDS (1)..(1899): transl_table=11
atggacattcaaattttacaagaacaggcaaatactctaagatttttaagtgccgatatggtgcaaaaagcaaactcaggacacccaggtgcacctttgggtttagcagatattttaagtgttttaagttatcatttaaaacacaatcctaaaaatcccacttggctaaaccgcgatagacttgtattttcaggcggacatgcaagtgctttgctttatagttttttacatttaagcggctatgatttaagcctagaagatcttaaaaatttccgccaacttcattctaaaaccccaggacaccctgaaatttcaactcttggagtagaaatcgctacaggccctttaggacaaggcgttgccaatgctgtaggctttgctatggcagcaaaaaaagcacaaaatttgctaggcagtgatttaatcgatcataaaatttattgtctttgcggagatggggatttacaagaaggcatttcttatgaagcttgttctttagcaggacttcacaaacttgataacttcatacttatttatgatagcaacaatatctccatagaaggcgatgtaggtttagcctttaacgaaaatgtaaaaatgcgttttgaagcacaaggatttgaagttttaagtataaatggacacgattatgaagaaatcaataaagccttagaacaagctaaaaaatccacaaaaccttgtcttatcatcgcaaaaacaactatagcaaagggtgcaggagagcttgaaggcagtcataaaagccatggcgcacctttgggtgaagaagtgattaaaaaagccaaagaacaagcaggttttgatccaaatatcagttttcatatcccacaagcaagcaaaatccgctttgaaagtgctgtagaacttggggatttagaagaagcaaaatggaaagataagcttgaaaaaagtgctaaaaaagaacttttagaaaggctattaaatcctgattttaacaagatagcttatcctgattttaaaggaaaagatcttgctacaagagatagtaatggtgaaattttaaatgttttagctaaaaatttagaaggatttttaggtggaagtgcagacttaggcccttcaaacaaaacagaacttcacggcatgggagactttgtagaaggtaaaaatatccattttggtatcagagaacacgctatggcagcgattaacaatgcttttgcaagatatggaattttcttaccattttcggcaacttttttcatctttagcgagtacttaaaacctgccgcaagaatagcagctctaatgaaaatcaaacattttttcattttcacacacgatagcataggcgtgggcgaagatggaccaacacaccaacctatagaacaacttagcacttttagagctatgccaaattttttaacctttagacctgctgatggggtggaaaatgtcaaagcttggcaaatagccctaaatgctgatattccgagtgcttttgtgctttcacgccaaaaactcaaagctctaaatgaacctgtttttggagatgtaaaaaatggagcgtatttactcaaagaaagcaaagaggctaaatttacacttttagcaagtggaagtgaagtttggctttgtttagaaagtgcaaacgaacttgaaaaacaaggttttgcttgtaatgttgtttccatgccttgttttgaactttttgaaaaacaagataaagcttatcaagaaagattgttaaaaggtgaagttataggtgttgaagcagcgcattctaatgaactttataaattttgccataaagtgtatggcatagaaagttttggagaaagtggcaaagacaaagatgtgtttgaacactttggatttagcgtttcaaagcttgtaaattttatccttagcaaataa

SEQ ID NO: 9993 - protein, 632 aa, Campylobacter jejuni RM1221
MDIQILQEQANTLRFLSADMVQKANSGHPGAPLGLADILSVLSYHLKHNPKNPTWLNRDRLVFSGGHASALLYSFLHLSGYDLSLEDLKNFRQLHSKTPGHPEISTLGVEIATGPLGQGVANAVGFAMAAKKAQNLLGSDLIDHKIYCLCGDGDLQEGISYEACSLAGLHKLDNFILIYDSNNISIEGDVGLAFNENVKMRFEAQGFEVLSINGHDYEEINKALEQAKKSTKPCLIIAKTTIAKGAGELEGSHKSHGAPLGEEVIKKAKEQAGFDPNISFHIPQASKIRFESAVELGDLEEAKWKDKLEKSAKKELLERLLNPDFNKIAYPDFKGKDLATRDSNGEILNVLAKNLEGFLGGSADLGPSNKTELHGMGDFVEGKNIHFGIREHAMAAINNAFARYGIFLPFSATFFIFSEYLKPAARIAALMKIKHFFIFTHDSIGVGEDGPTHQPIEQLSTFRAMPNFLTFRPADGVENVKAWQIALNADIPSAFVLSRQKLKALNEPVFGDVKNGAYLLKESKEAKFTLLASGSEVWLCLESANELEKQGFACNVVSMPCFELFEKQDKAYQERLLKGEVIGVEAAHSNELYKFCHKVYGIESFGESGKDKDVFEHFGFSVSKLVNFILSK

SEQ ID NO: 9994 - DNA, 2016 bp, Ehrlichia ruminantium str. Welgevonden
  CDS (1)..(2016): transl_table=11
atgagtcaaaaatatagtaatatgattgccatggctaatgctgtaagagtactttcaatagatgctatacaaaaagccgcttctggacatccaggtatgcctcttggtatggcagatgtaggaactatgttatttgctaagtttttaaaatttaatcctaaggatcctaattggtttgatagggataggtttgttttatcaaatggacatgggtcaatgttattgtattctatattatatttcttaggatgtttggatatagaagagataaaaaagtttaggcaaatacattctctgacacctggccatccagaatatggttgtactcctggagttgatgctacaactggtccgctaggtcagggattggcttctgctgtgggtatggcaatagcagaaaaaatactatctgaaaaatttggagctgatattgtatctcataatacttatgttatggttggggatggatgtcttatggagggaattagccatgaagctgcgtctttagctggacatttgcagttagataaattaatagtattatttgatgataataatgtttctatcgatggtcctatatcattgtctgtttctgataatgttaaaggtagatttttatcttatggatgggatgttgatgaaatagatgggcatgatttttctcagattgaatcatcaattaaaaatgcaaaaaattctaaaaagccatctctaatttgttgtaagactattattggcaaaactattccttcaaaagaaaatacttgtgatatacatagttggccagtgactgaagaagatatcattgtaatgaagaagagattagggtgggcttataagccatttgagttcccagaggaaattctgcaattatggcaagatattgcgtgtaattcagaggaagagtataaattatgggtagaacgagttagtgagtatggcaagacatcacaagattttatggatgtgatggctgatggtgtatctaatgaggtttttttgaatttgaagagtttaaaagaggaattatgtagcttgaatttgaatgaagcaacacgtaaatcttcaggtagagtattagatgttataatgggtagtactggtaagttgataggtggttctgcagatcttagtaattctaataatactaaaccaaaatttacatcggtaattaataaagataatttctctggttcttatttacattatggagttagagaacatgctatggcagcatgtatgaatggtatggcattgcataagggagtaatcccttatggtggtacatttttaattttctctgattattgtagaccagctataaggttgtctgccttgatgaaaaggcaagttatttatattatgacccatgattcaataggggttggggaagatggtcctactcatcaacctgttgagcatctaccatctttgaggttaattcctaatttgtatgtttttagaccagctgatgctatagaagtattagagtgttgggagattgcattaaagttaatagatgctccatcggttctgatattatctagacagaatgttaaatgtgtacgtagtacttatgttgcagagaatatgtcaaacaaaggtgcatatattattcgtgaatataagaatgatctcgatgtaacaatttttgctactgggtctgaggttgagattgcattaaaagcaagtgatattttaataggtaaaggattaggtgtccgggtagtttctgtaccttgttgggaattgttttataaacaagataaaaaatatattataagtctgttaaataataaaagtataaaggcagcagtagaagctgctaattcatttggttggtgtaagtatataggagaagatggaatttttgtaggtttggaagattttggaatatctgctccattcaaagatttgtataagtattttggaattactccagaaaacttagtggataaaatactcagtaaattaagaattaatagtaattacgaaagtaatgttactgcggattga

SEQ ID NO: 9995 - protein, 671 aa, Ehrlichia ruminantium str. Welgevonden
MSQKYSNMIAMANAVRVLSIDAIQKAASGHPGMPLGMADVGTMLFAKFLKFNPKDPNWFDRDRFVLSNGHGSMLLYSILYFLGCLDIEEIKKFRQIHSLTPGHPEYGCTPGVDATTGPLGQGLASAVGMAIAEKILSEKFGADIVSHNTYVMVGDGCLMEGISHEAASLAGHLQLDKLIVLFDDNNVSIDGPISLSVSDNVKGRFLSYGWDVDEIDGHDFSQIESSIKNAKNSKKPSLICCKTIIGKTIPSKENTCDIHSWPVTEEDIIVMKKRLGWAYKPFEFPEEILQLWQDIACNSEEEYKLWVERVSEYGKTSQDFMDVMADGVSNEVFLNLKSLKEELCSLNLNEATRKSSGRVLDVIMGSTGKLIGGSADLSNSNNTKPKFTSVINKDNFSGSYLHYGVREHAMAACMNGMALHKGVIPYGGTFLIFSDYCRPAIRLSALMKRQVIYIMTHDSIGVGEDGPTHQPVEHLPSLRLIPNLYVFRPADAIEVLECWEIALKLIDAPSVLILSRQNVKCVRSTYVAENMSNKGAYIIREYKNDLDVTIFATGSEVEIALKASDILIGKGLGVRVVSVPCWELFYKQDKKYIISLLNNKSIKAAVEAANSFGWCKYIGEDGIFVGLEDFGISAPFKDLYKYFGITPENLVDKILSKLRINSNYESNVTAD

SEQ ID NO: 9996 - DNA, 2001 bp, Dehalococcoides ethenogenes 195
  CDS (1)..(2001): transl_table=11
atgtcaaatacaaaatcagatagtttatgtataaatgccctgcgctttcttgcggtagacgccgttcagaaggcaaattcggggcatcccggagcacctatgggtatggccgctatggcctatgccctgtggcaaaatttcctcaagcataacccccaagacccggcctggcctaaccgtgaccgtttcatactttctgccggccatgcctcagccttgctttactcacttctccaccttaccggttatgatttgccgctggatgagcttaaaaatttccgccagtggggcagtaaaaccccggggcacccggaatacggcctgacccccggcgttgagatgactaccggcccgcttgggcagggttttgccagcggtgtgggtatggctatggccgaagcccatctggccgcggtttttaaccagccggattgcaaaataatagaccattatacctacggcatagtctctgacggggatttgatggagggcgtagcctcggaagccgcctctttggcggggcatttggcactgggtaagctgatttacctgtatgacgataatgaaatatctattgaaggttcaacagagctggcttttaccgaaaatacggctctgcgttttgaaagttacggctggcaggtaattggcccggtagacgggcttaaccctgaggcagtttcaggggctatcaaagaagcccagtcagattccgcccgccccagcctgattatctgtaaaacagttatcggttttggcagcccgaacaaggccggcaaggcctctgcccatggtgagccgctgggaacagacgaagtggccaaaagccgcaaatctttagggtgggattacgagccttttgtaataccgcctgaagctctggcggaattccgcatggcactggataaaggcaaaacagcccagcaggtttggcaatccaagctggactactattcaagccgttatcccgaaaaagccgcccttttgcaggacaggctttctggtaagctgccagacaactgggataatgagctggataaactttttgacaaggctatggccagccgcgaggcttccggtttgattataaatacactggcttcccgcctgccagcccttatgggcggttcggcagacctcagcccgtctaacaaaactgttatcaaagacggcggcgaatatgaaccgccgcattatgaggggcggaatatccatttcggcgtacgtgaacacgccatgggagcaatagccaacgggctggctctccacggcgggattataccttatgttgccactttccttatattttatgattacatgcgtccggcggtaaggctggcatcccttatgggtcaaagggttatttatatttttacccatgactctatcggtctgggagaggacggccctacccaccagcctattgaacagctggccggtttacgttcggtgcccggtctggttactatccgcccggcagattcgtatgaaacagcccaggcatggaaaacggccatactccgcaaggacggcccgaccgccattgccctctcccgccagaaactgcctctcttagataactcacaggcaaattccgtaaacttggccaaaggggcatatatactggcagaaacagattcccgcccgcaggttgccctggtagccagcggctcagaagtaagcatagccgttcaggcggctgaaatacttaaaaataaaggcgtctcgtcaagggtagtatccttcccttcgtggcagctttttgaggcccaaccccggacctaccgccagagcatcttgcccgcttccctgccgcgggtaataatagaagccggcagtgcacagggatggtgcaaatatttgggcgcaaacggtgatattatttccattgaccatttcggggcatcagccccggcgcctgtgctttaccaacactttgggctaaccccggaaaatatggctgaaaaggctttaaagcttttggagaatgaagatgagtaa

SEQ ID NO: 9997 - protein, 666 aa, Dehalococcoides ethenogenes 195
MSNTKSDSLCINALRFLAVDAVQKANSGHPGAPMGMAAMAYALWQNFLKHNPQDPAWPNRDRFILSAGHASALLYSLLHLTGYDLPLDELKNFRQWGSKTPGHPEYGLTPGVEMTTGPLGQGFASGVGMAMAEAHLAAVFNQPDCKIIDHYTYGIVSDGDLMEGVASEAASLAGHLALGKLIYLYDDNEISIEGSTELAFTENTALRFESYGWQVIGPVDGLNPEAVSGAIKEAQSDSARPSLIICKTVIGFGSPNKAGKASAHGEPLGTDEVAKSRKSLGWDYEPFVIPPEALAEFRMALDKGKTAQQVWQSKLDYYSSRYPEKAALLQDRLSGKLPDNWDNELDKLFDKAMASREASGLIINTLASRLPALMGGSADLSPSNKTVIKDGGEYEPPHYEGRNIHFGVREHAMGAIANGLALHGGIIPYVATFLIFYDYMRPAVRLASLMGQRVIYIFTHDSIGLGEDGPTHQPIEQLAGLRSVPGLVTIRPADSYETAQAWKTAILRKDGPTAIALSRQKLPLLDNSQANSVNLAKGAYILAETDSRPQVALVASGSEVSIAVQAAEILKNKGVSSRVVSFPSWQLFEAQPRTYRQSILPASLPRVIIEAGSAQGWCKYLGANGDIISIDHFGASAPAPVLYQHFGLTPENMAEKALKLLENEDE

SEQ ID NO: 9998 - DNA, 1980 bp, Neisseria gonorrhoeae FA 1090
  CDS (1)..(1980): transl_table=11
atgtctcaactggcaaacgtaatccgcttcctctcggccgatgccgttcaaaaagccaattccggccaccccggcgcgcctatgggtatggcggaaatggcggaaacattgtggacgaaattcctcaatcacaatcccgccaatcccaaattctacaaccgcgaccgcttcgtcctctccaacggtcatgcgtctatgctgttgtacagcctgctgcacctgaccggctacaacctgagcattgaagatctgaaaaacttccgccagctgcacagcaaaacccccggccatcccgaatacggctacaccgacggcgtggaaaccacgaccggcccgttggggcaaggtattgccaacgcagtgggcatggcattggcagaaaaaatccttgccgccgaatttaataaagacggtttgaacatcgtcgatcactacacttacgtctttatgggcgacggctgcctgatggaaggcgtatcgcacgaagcctgctcactcgccggcaccttgggcttgggcaaactgattgttttgtatgacgataacaatatctccatcgacggcaaagtggacggctggtttaccgaaaacatcccgcaacgctttgaaagctacggctggcacgtcgttcccaacgtaaacggccacgacaccgccgccattcagacggccatcgaagccgcccgcgccgaaaccggcaagccgtccatcatctgctgcaaaaccttaatcggcaaaggcagcgccaacaaagaaggcagccacaaaacccacggcgcgcctttgggtgcggacgaaatcgaagccacgcgcaaacatttgggttgggcttatcctgcgtttgaaatcccgcaagaaatttacgatgcgtggaatgccaaagaaaaaggcgcgaaactggaagccggatggaacgaactgttcgcgcaatatcaagccaaatatcctgccgaagccgcagaattcgtgcgccgcatggataaaaagctgccggaaaactttgacgagtacgttcagacggcattgaaagaagtgtgcgccaaagcggaaaccgtcgccacccgcaaagccagccaaaacagcatcgaaatcttggcaaaagagctgcccgaactggtgggcggttctgccgacctgaccccgtccaacctgaccgactggtcaaacagcgtctccgttacccgcgacaaaggcggcaactacatccactacggcgtgcgcgagttcggtatgggtgcgattatgaacggtttggtattgcacggcggtgtaaaacccttcggcgcgactttcctgatgttcagcgaatacgaacgcaacgccttacgcatggcggcactgatgaaaatcaaccccgtcttcgtatttacccacgattccatcggtttgggcgaggacggcccaacccaccagcctatcgagcaaaccgccaccctgcgcctgattccgaatatggacgtatggcggccgtgcgacaccgcagaatctctggtcgcttgggcagaagcggcaaaagccgaagaccacccgtcctgcctgattttcagccgtcaaaacctgaaattccaagcacgcagcgagcaacaactgaacgacatcaaacgcggtgcttacgtaatcagtgaagcccaaggcaacgcccaagccgtcatcattgccaccggttccgaggtaggattggctgtagaagcgcaaaaagtattggcaggacaaggtattgccgtgcgcgtcgtttccatgccgtccaccagcgtcttcgaccgccaagacgccgcctatcaagccgccgtcctaccggaaggcctgccgcgcatcgccgtagaagccggacacaccaacggctggtacaaatatgtcggactgaacggcgcagtcgtcggcatcaaccgcttcggcgaatccgcccctgccgatctgctgttcaaagcattcggctttaccgtggacaatgtggttgatacggtgaaatccgtgctgtaa

SEQ ID NO: 9999 - protein, 659 aa, Neisseria gonorrhoeae FA 1090
MSQLANVIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQTAIEAARAETGKPSIICCKTLIGKGSANKEGSHKTHGAPLGADEIEATRKHLGWAYPAFEIPQEIYDAWNAKEKGAKLEAGWNELFAQYQAKYPAEAAEFVRRMDKKLPENFDEYVQTALKEVCAKAETVATRKASQNSIEILAKELPELVGGSADLTPSNLTDWSNSVSVTRDKGGNYIHYGVREFGMGAIMNGLVLHGGVKPFGATFLMFSEYERNALRMAALMKINPVFVFTHDSIGLGEDGPTHQPIEQTATLRLIPNMDVWRPCDTAESLVAWAEAAKAEDHPSCLIFSRQNLKFQARSEQQLNDIKRGAYVISEAQGNAQAVIIATGSEVGLAVEAQKVLAGQGIAVRVVSMPSTSVFDRQDAAYQAAVLPEGLPRIAVEAGHTNGWYKYVGLNGAVVGINRFGESAPADLLFKAFGFTVDNVVDTVKSVL

SEQ ID NO: 10000 - DNA, 1998 bp, Pseudomonas syringae pv. syringae B728a
  CDS (1)..(1998): transl_table=11
atgccaagccgtcgtgagcgtgccaacgctattcgtgccctcagcatggatgccgtgcaaaaagccaacagcggccatccgggtgcccccatgggcatggcggatatcgccgaggttctttggcgcgattatctgaaacacaacccggcaaacccttcgtttgccgaccgtgaccgtttcatcatgtccaacggccacggctcgatgctggtctattcgctgctgcacctgaccggctacgacctgtccatcgacgacctgaaaaacttccgtcaattgcacagccgtacaccgggccacccggaatacggttacacgcctggcatcgagaccaccaccggtccgctgggtcagggctttgccaacgctgtcggtttcgctgctgccgagaagacgctcgccgcgcagttcaaccgcccaggccactccatcgtcgatcaccatacctacgtgttcatgggtgatggctgcatgatggaaggtatttcccacgaagcggcctcgctggccggtacgttgcagttgaacaagctgatcgcgttctacgacgacaacggcatctccatcgatggcgaagtggaaggctggtttaccgacgacacgccaaagcgtttcgagtcctacggctggctggtgatccgcaatgtcgacggtcacgatcctgaagaaatcaagacggccatcgagaccgctcgcaagagcgatcagccgacgctgatctgctgcaagaccaccatcggtttcggttcgccgaacaaacagggcaaggaagagtcccacggtgcgccgctgggtgctgacgaaatcgccctgacccgtgctgcactgaagtggaactacggtcctttcgaaatcccggctgatatctatgccgagtggaacgggaaggaaaaaggcctggctgccgaagccgagtgggaccagcgctttgctgactattccgccgcgttcccggaactggccaatgacttcattcgtcgcatgagcgggcaattgcctgctgattttgctgaaaaatcagcggcttatgtcgccgaagtcaacgcaaagggcgaaaccatcgccagccgcaaggccagccagaacgcgctgggtgcactcggcccgttgctgcctgaaattctgggtggttcggctgaccttgccgggtccaacctgaccatctggaaaggctgcaagagcatcaccggcgaagaccctaacggcaactacctgcattacggtgttcgcgagttcggcatgggcgccatgatgaacggcatcgccttgcacggcggcttcgtgccttacggcgccaccttcctgatcttcatggaatacgctcgcaacgcggtgcgtatggcctcgttgatgaagaagcgcgtgatctacgtattcacccacgactccatcggtctgggcgaagacggtccgactcaccagccgatcgagcaattgaccagtctgcgtaccacgccgaacctggacacctggcgtcctgcggatgcggtggaatcggccgtagcctggaaacacgcgatcgagcgtgacgatggcccgtcggcactgatcttctcccgtcagaatctgacccatcaggcgcgtgacgagaagcaactgtcctacatcgcgcgtggcggctacgtgctgcgtgactgtgctgccgagcctgaactgatcctgatcgcaaccggttcggaagtcggtctggctgtgcaggcgtacgacaagctgaccgagcagggtcgcaacgtgcgcgtggtgtccatgccatgcaccagcattttcgaagctcaggatgctgcttacaagcaggcggtgctgccgttgcaggtcagcgcgcgtattgccatcgaagcggctcacgccgactactggtacaaatacgttggcctggaagggcgcgtgatcggcatgactaccttcggcgagtcggcccctgcgccagcgctgttcgaagagttcggcttcacgctggaaaacgtcctgagcactgctgaagagctgctggaagactga

SEQ ID NO: 10001 - protein, 665 aa, Pseudomonas syringae pv. syringae B728a
MPSRRERANAIRALSMDAVQKANSGHPGAPMGMADIAEVLWRDYLKHNPANPSFADRDRFIMSNGHGSMLVYSLLHLTGYDLSIDDLKNFRQLHSRTPGHPEYGYTPGIETTTGPLGQGFANAVGFAAAEKTLAAQFNRPGHSIVDHHTYVFMGDGCMMEGISHEAASLAGTLQLNKLIAFYDDNGISIDGEVEGWFTDDTPKRFESYGWLVIRNVDGHDPEEIKTAIETARKSDQPTLICCKTTIGFGSPNKQGKEESHGAPLGADEIALTRAALKWNYGPFEIPADIYAEWNGKEKGLAAEAEWDQRFADYSAAFPELANDFIRRMSGQLPADFAEKSAAYVAEVNAKGETIASRKASQNALGALGPLLPEILGGSADLAGSNLTIWKGCKSITGEDPNGNYLHYGVREFGMGAMMNGIALHGGFVPYGATFLIFMEYARNAVRMASLMKKRVIYVFTHDSIGLGEDGPTHQPIEQLTSLRTTPNLDTWRPADAVESAVAWKHAIERDDGPSALIFSRQNLTHQARDEKQLSYIARGGYVLRDCAAEPELILIATGSEVGLAVQAYDKLTEQGRNVRVVSMPCTSIFEAQDAAYKQAVLPLQVSARIAIEAAHADYWYKYVGLEGRVIGMTTFGESAPAPALFEEFGFTLENVLSTAEELLED

SEQ ID NO: 10002 - DNA, 1998 bp, Haemophilus influenzae 86-028NP
  CDS (1)..(1998): transl_table=11
atggcaactcgtagacaattagccaatgcaattcgtgtcttagcaatggattctgtacaaaaagcgaaatctggtcaccctggtgcaccaatggggatggcggatattgctgaagtattatggcgcgactttttaaaacacaatccaaccaatcctaaatgggctgatcgtgaccgttttgtgctttcaaatggacacggttctatgttgatttatagtcttttacatttaactggctatgatctttctatcgaagatttaaaacaattccgtcaattacattctaaaaccccaggtcacccagaatatggttatgcacctggtgttgaaaccacgactggcccgttaggtcaaggtatcactaatgcggtgggtatggcaattgctgagaaaaccttagctggacaatttaaccgtgaaggccatgaaattgtcgatcaccacacttatgtgttcttaggcgatggctgtttaatggaagggatttctcacgaggcttgctctttagcaggaacattaggtctgggtaaactaatcgcattctacgatgacaacaatatttccattgatggtcatgttgatggctggttcagtgatgacaccgccgagcgttttgaagcttatggctggcaagtaatccgtaatgtaaatggtcacaatgcagagcaaattcgcgctgctgccgttcttgctcaagcagaaaaagaaaaaccaacgttaattatttgtaaaaccatcattggttttggttctccaaataaatcaggttctcatgattgccacggtgcgccattaggcgatgaagaaatcgctttaacccgcaaagcacttggttgggaatatgcgccatttgaaattccagctgaatactatgctgaatggtcggcaaaagagaaaggtgctgcagcagaaaaatcttgggaagaaaaatttgccgcttatgcaaaagcctatcctgaattggcagcagaatttaaacgtcgtgtttctggcgaattaccaacaaactgggcggcagaatctaaagcgttcatcgaaaaattacaagcaaatccagcgagtattgcaagccgtaaagcatcacaaaatgccattgaagcctatgcacacctattgccagaatttttaggtggttctgcagacttagcaagctccaacttaaccttatggagtggttcaaaaccgattcgtgcccacgaaaacgtaagtggtaactacattaactacggtgttcgtgaatttggtatgtctgccattatgaacggcattgccttacacggcggtttcattccttacggcgcaaccttcttaatgttctacgagtatgctcacaacgcagtacgtatggcagcattaatgaaacaacgcacattattcgtttatacccacgattccatcggtttaggcgaagatggacctacacaccaaccagtagaacaaacggcttcactacgcttaattccaaaccttgaaacatggcgtccatgtgaccaagttgaatcagccatcgcatggcaacaagcggttgaacgtcaagatggcccaagtgcgttaattttcactcgtcaaaatcttgctcaaatgaaccgcacttctgcacaattagatgcggttaaacgtggtgcttatgtattaaaagactgtgatggcacacctgagttaattttcattgcgacaggttctgaagtggaattagcagtgcaagcagccgaagcattaagtgctgaaggtaaaaaagtacgcgttgtttctatgccaagtactaaccgtttcgataaacaagacgaagcataccgtgaaagtgtattacctgcagcggtaaccaaacgtgttgcgattgaagcgggtattgctgacttctggtataaatacgttggattcaatggtcgtgttgtcggtatgaatagctttggcgaatccgcaccagcagatcaattatttaaactctttggtttcactgttgaaaacgtggtagcaaaagcgaaagaaattctttaa

SEQ ID NO: 10003 - protein, 665 aa, Haemophilus influenzae 86-028NP
MATRRQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAERFEAYGWQVIRNVNGHNAEQIRAAAVLAQAEKEKPTLIICKTIIGFGSPNKSGSHDCHGAPLGDEEIALTRKALGWEYAPFEIPAEYYAEWSAKEKGAAAEKSWEEKFAAYAKAYPELAAEFKRRVSGELPTNWAAESKAFIEKLQANPASIASRKASQNAIEAYAHLLPEFLGGSADLASSNLTLWSGSKPIRAHENVSGNYINYGVREFGMSAIMNGIALHGGFIPYGATFLMFYEYAHNAVRMAALMKQRTLFVYTHDSIGLGEDGPTHQPVEQTASLRLIPNLETWRPCDQVESAIAWQQAVERQDGPSALIFTRQNLAQMNRTSAQLDAVKRGAYVLKDCDGTPELIFIATGSEVELAVQAAEALSAEGKKVRVVSMPSTNRFDKQDEAYRESVLPAAVTKRVAIEAGIADFWYKYVGFNGRVVGMNSFGESAPADQLFKLFGFTVENVVAKAKEIL

SEQ ID NO: 10004 - DNA, 1998 bp, Pseudomonas fluorescens Pf-5
  CDS (1)..(1998): transl_table=11
atgccaagccgtcgtgagcgtgccaacgccattcgtgccctcagcatggatgccgtgcaaaaagccaacagcggccatccaggtgcccctatgggtatggcggatatcgccgaagtactttggcgtgactacctgaagcacaacccgagcaacccatccttcgccgaccgcgaccgcttcgtgctgtccaatggccacggctcgatgttgatctactcgctgctgcacctgaccggctacgacctgtcgatcgatgacctgaagaacttccgccaactgcacagccgcaccccgggccacccggagtttggttacaccccaggcgtggaaaccaccaccggcccgctgggccagggcctggccaacgctgtgggctttgccctggcggagaaagtcctggcggcgcagttcaaccgtccaggccacaacattgtcgaccatcacacctacgtgttcctgggtgatggctgcatgatggaaggcatttcccacgaagtcgcttccctggccggcaccctgggcctgggcaagctgatcgccttctacgatgacaacggcatctccatcgacggcgaagtcgaaggctggttcaccgacgacacgcccaagcgtttcgaagcctataactggcaagtgatccgcaacgtcgacggccacgatccggaagagatcaagaccgccatcgacaccgcgcgcaagagcccgctgccgactctgatctgctgcaagaccaccatcggtttcggttcgccgaacaagcagggcaaggaagattgccacggcgcgccactgggcgacgcggaaatcgccctgacccgccaggcgctgaactggaactacggcccgttcgaaatcccggccgacatttatgccgagtgggatgccaaggaaaaaggtcgcgctgccgaagccgagtgggaccagcgtttcgcggcctattccgctgcattcccaaccgaagccaacgaactggtacgtcgccttagcggtgacctgcctgccgacttcgccgagaaggccgacgcctacatcgccgaagtggccgccaagggcgaaaccatcgccagccgcaaggccagccagaacaccctgaatgccttcggccccctgctgccggaagtgctcggtgggtcggccgacttggccggttccaacctgaccctgtggaaaggttgcaagggtgtcagcgctgaagatgccagcggcaactacatgtactacggcgtgcgcgagttcggcatgaccgccatcatgaacggtgttgccctgcacggcggcctggtgccttacggcgcgaccttcctgatgttcatggaatacgcccgcaacgcagtgcgcatgtcggcgctgatgaagaagcgtgtgatccatgtctacacccacgactccatcggtctgggcgaagacggcccgacgcaccagccgatcgagcaactgaccagcctgcgtaccacgccgaacctcgacacctggcgcccggccgatgccgttgaatcggcggtggcctggaaaaacgcgctggagcgtaaagacggcccttcggcgctgatcttctcgcgccagaacctgcagcaccaaacccgcgatgccggccagatcgccgacatcagccgcggtggctatgtgttgaaggactgcgcaggcgagcctgaactgatcctgatctccaccggttcggaagtcggcctggccgttcaggcctacgacaaactgaccgagcaaggccgcaaggtgcgcgtggtttccatgccttgcaccagcgtgttcgacgctcaggacgctggctacaagcaatcggttctgccgctgcaggtcagcgcacgtatcgcgatcgaagcggctcatgccgacttctggttcaagtacgtgggtctggaaggtcgcgtgatcggcatgaccacctacggcgaatcggctccggcttcggcactgttcgaagagttcggcttcaccctggacaacatcctgggccaggccgaagagttgctggaagactaa

SEQ ID NO: 10005 - protein, 665 aa, Pseudomonas fluorescens Pf-5
MPSRRERANAIRALSMDAVQKANSGHPGAPMGMADIAEVLWRDYLKHNPSNPSFADRDRFVLSNGHGSMLIYSLLHLTGYDLSIDDLKNFRQLHSRTPGHPEFGYTPGVETTTGPLGQGLANAVGFALAEKVLAAQFNRPGHNIVDHHTYVFLGDGCMMEGISHEVASLAGTLGLGKLIAFYDDNGISIDGEVEGWFTDDTPKRFEAYNWQVIRNVDGHDPEEIKTAIDTARKSPLPTLICCKTTIGFGSPNKQGKEDCHGAPLGDAEIALTRQALNWNYGPFEIPADIYAEWDAKEKGRAAEAEWDQRFAAYSAAFPTEANELVRRLSGDLPADFAEKADAYIAEVAAKGETIASRKASQNTLNAFGPLLPEVLGGSADLAGSNLTLWKGCKGVSAEDASGNYMYYGVREFGMTAIMNGVALHGGLVPYGATFLMFMEYARNAVRMSALMKKRVIHVYTHDSIGLGEDGPTHQPIEQLTSLRTTPNLDTWRPADAVESAVAWKNALERKDGPSALIFSRQNLQHQTRDAGQIADISRGGYVLKDCAGEPELILISTGSEVGLAVQAYDKLTEQGRKVRVVSMPCTSVFDAQDAGYKQSVLPLQVSARIAIEAAHADFWFKYVGLEGRVIGMTTYGESAPASALFEEFGFTLDNILGQAEELLED

SEQ ID NO: 10006 - DNA, 1998 bp, Psychrobacter arcticus 273-4
  CDS (1)..(1998): transl_table=11
atgccagctccaattagcgaacgtaaattagccaatgccatccgtgtactgtcgttcgacgcggttcaaaaagccaattctgggcaccctggtgcaccaatgggcatggctgatattgccgaagttttgtggcgcaagtttttaaagcacaatcctgctgacccaagctggcacaaccgtgaccgctttgtattatcgaacggtcatggctcgatgctgatttattcattactacatttatctggttatgacgtcagtgttgacgatttgaaaggttttcgtcaattacattcgaaaacgccaggtcatccagagcttggctatacgccaggtgttgaaaccaccactggtccactaggacaaggtattgccaacgcggttggttttgcgattgcagaaaaaacattggcagcgcagttcaatcgtgatggtcataatatcgttgaccaccatacctatgcgttcttgggtgatggctgcttgatggaaggtatcagtcatgaagtgtgttcgctggctggcacgttagagcttggcaagttagtattcttctatgatgacaatggcatctcaattgatggtgacgtcgaaggctggtttactgatgacacgcaagcgcgctttgagtcttatggctggcaagtcatcaaggtagatggtcatgataccgatgagattacgcaagccactgagcaagcgattaaagaaacgactaagcctagcttaatcatttgtaaaacgaccattggtgcaggtagtccaaacaaacaaggtttggcagccagtcatggcgcgccactaggtgatgatgaaatcgtcttaactcgtgatgcgttatcttggaagcatgcgccgtttgaattggatgatgaaatctatcaagcgtgggatgccaaagccaaaggcgatgtacaacagaagaactgggacgcgaactttgaagcttataaaaaggcttatccagagttggcagctgagttggttcgtcgtttagaaggtgacttgccagctgattttgagcaaaaagcgcaagagtatattcagcaaactcaagaccaaggcggcgatgttgccagccgtaaagccagccaaaatgcgatcaatatcttgcagccattactgccagaattgcttggtggctcagcggatttagcgggctcaaacctcacgctatttaaagacgccaaaggtattcaagacgatgacgcgggcaactatatctattatggtgtgcgcgaatttggtatgacggcgattgctaatggtatcgcgctgcatggcggttttattccttatgttgctaccttcctgatgtttatggaatacgcacgtaatgcggtacgtatgggcgcgctcatgaaacagcgtgtgattcatgtttatacccatgattctattggtttgggtgaagacggtcctacgcatcagccggttgagcaattgaccagcttgcgcaccacgccaaacttacgtacatggcgtccttgtgatgcgaccgaatcagcgagtgcttgggtagaagcgattaaatcagaaaacaatccatctgcattgatttttagccgtcaaagcttgccacatcaagctcgtgatactgagcaagtcgccaatatcactaaaggtggttatgtactggcgaaagaacaaggcgagctacaagcgattatcatcgcaactggttcagaagtcggtcttgctatgcaagcttacgcgaccttaagcgaaaatggcgttggcgtgcgcgtggtctctatgccatgtgctgaaatctttagcgagcaagatgccagctaccgtgaaggggtattacctgccaatatccgcgcccgagtcgctgtagaagcagcacatgtcgattactggtataagttcgttggcctagacggtaaagtcattggtatgacgacttatggcgagtctgcacctgctgatgagctatataaagagtttggtattactactgaagctgtggttgatgcggtaaatagtttggtgtaa

SEQ ID NO: 10007 - protein, 665 aa, Psychrobacter arcticus 273-4
MPAPISERKLANAIRVLSFDAVQKANSGHPGAPMGMADIAEVLWRKFLKHNPADPSWHNRDRFVLSNGHGSMLIYSLLHLSGYDVSVDDLKGFRQLHSKTPGHPELGYTPGVETTTGPLGQGIANAVGFAIAEKTLAAQFNRDGHNIVDHHTYAFLGDGCLMEGISHEVCSLAGTLELGKLVFFYDDNGISIDGDVEGWFTDDTQARFESYGWQVIKVDGHDTDEITQATEQAIKETTKPSLIICKTTIGAGSPNKQGLAASHGAPLGDDEIVLTRDALSWKHAPFELDDEIYQAWDAKAKGDVQQKNWDANFEAYKKAYPELAAELVRRLEGDLPADFEQKAQEYIQQTQDQGGDVASRKASQNAINILQPLLPELLGGSADLAGSNLTLFKDAKGIQDDDAGNYIYYGVREFGMTAIANGIALHGGFIPYVATFLMFMEYARNAVRMGALMKQRVIHVYTHDSIGLGEDGPTHQPVEQLTSLRTTPNLRTWRPCDATESASAWVEAIKSENNPSALIFSRQSLPHQARDTEQVANITKGGYVLAKEQGELQAIIIATGSEVGLAMQAYATLSENGVGVRVVSMPCAEIFSEQDASYREGVLPANIRARVAVEAAHVDYWYKFVGLDGKVIGMTTYGESAPADELYKEFGITTEAVVDAVNSLV

SEQ ID NO: 10008 - DNA, 1989 bp, Colwellia psychrerythraea 34H
  CDS (1)..(1989): transl_table=11
atgtcatcgcgtcaagagttagcaaatgctatccgtgtattaagtatggatgccgtacaaaaagcaaaatcagggcaccctggtgcacctatgggtatggccgatatcgcagaggtattatggcgtgattttttaaagcataatccaactgacccaaactgggccgaccgtgatcgctttattttatcaaacggccatggctcaatgcttatctattcactattgcatttatcgggttatgatttatctattgaagatttgaaagaattccgtcaattgcattcaaaaaccccaggtcatcctgaatacggttacacaccaggtgttgaaacaacgacgggtccattaggtgctggtattgccaatgccgtgggtatggctattgctgaaaaaacgttagcagcacagtttaaccgtgaagatcatgcgattgttgaccatttcacttattgcttcttaggcgatggttgtttaatggaaggtatctctcatgagtcttgttcactagccggaactttaggtctaggtaaacttatcgctttttgggatgacaatggcatttcaatcgatggtaaagttgaaggttggtttactgacaatacccctgctcgttttgaatcttacggctggcatgttatttgtgttgatggtcatgaccctcaagcaattactcacgctatcgaagaagctaaatcagtcattgataagccaagtatgatttgttgtaaaactatcattggttttggctcaccaaataagtcaggtactcatgactgtcacggcgcaccattaggtgatgacgaaattgccgcaacacgtgaatttttaaactggtcacatgctccatttgatattccaagtgacatatatgagcaatgggatagaaaagaaaaaggtcaagcgagccaagtgagctggaatgacaaatttgccgcttataaagcagcacaccctggtcttgcaagcgaatatgaacgtcgtgtgattaaaggtgaattacctgctgaatttgaagaaaaagcaaatgctttcattcaacagtgtcacgaaagcagtgaaaacattgcttcacgtaaagcatcacaaaatgcgattgaagcttttggtagcgttttacctgaaatgttaggtggctctgccgatttagctggctcaaacctaacgttatggtctggctctaaaggtattcaagaagatgctgctggtaactatatcttttacggcgtacgtgaatttggtatgagtagcataatgaatggtatttcattgcacggtggttttgttaactacggtgcgactttcatgatgtttatggaatatgcacgtaatgcggttcgtatgtcggcattaatgggcattcaaaatatctttgtttatacccatgactctattggtcaaggtgaagatggtccaacgcatcagcctattgagcagttaactaacttaagaactacaccaaacttaacgacttggcgtccatgtgatgcaacagagtctgctgttgcatggaaagctgctgttcaaagccaaaaagcgccaacagcgttaatattttcacgtcaaggtttacctgcaatgagtcgtactcaaacgcaagtaagcgatattgaaaaaggcgcttatattttagttgattgtgctggcacacctgatgttatcttaatggctacaggctctgaagttgctttggcagttaatgcagcaacagcattaactgaacaaggtaaactagtgcgtgtggtttctatgccttcaacgaatgtttttgataagcaaagcagcgactacaaagaagctatattaccgtttagcgtaactaaacgtgtcgctattgaagcagcacatgttgacttctgggctaaatatgttggtcttagtggcgcagttgttggtatgacaacatttggtgaatcagctccaggtaatgtattacttgagcactttggtttcactgtagacaatgttgtaaatactgtaaacaagctataa

SEQ ID NO: 10009 - protein, 662 aa, Colwellia psychrerythraea 34H
MSSRQELANAIRVLSMDAVQKAKSGHPGAPMGMADIAEVLWRDFLKHNPTDPNWADRDRFILSNGHGSMLIYSLLHLSGYDLSIEDLKEFRQLHSKTPGHPEYGYTPGVETTTGPLGAGIANAVGMAIAEKTLAAQFNREDHAIVDHFTYCFLGDGCLMEGISHESCSLAGTLGLGKLIAFWDDNGISIDGKVEGWFTDNTPARFESYGWHVICVDGHDPQAITHAIEEAKSVIDKPSMICCKTIIGFGSPNKSGTHDCHGAPLGDDEIAATREFLNWSHAPFDIPSDIYEQWDRKEKGQASQVSWNDKFAAYKAAHPGLASEYERRVIKGELPAEFEEKANAFIQQCHESSENIASRKASQNAIEAFGSVLPEMLGGSADLAGSNLTLWSGSKGIQEDAAGNYIFYGVREFGMSSIMNGISLHGGFVNYGATFMMFMEYARNAVRMSALMGIQNIFVYTHDSIGQGEDGPTHQPIEQLTNLRTTPNLTTWRPCDATESAVAWKAAVQSQKAPTALIFSRQGLPAMSRTQTQVSDIEKGAYILVDCAGTPDVILMATGSEVALAVNAATALTEQGKLVRVVSMPSTNVFDKQSSDYKEAILPFSVTKRVAIEAAHVDFWAKYVGLSGAVVGMTTFGESAPGNVLLEHFGFTVDNVVNTVNKL

SEQ ID NO: 10010 - DNA, 1998 bp, Pseudomonas syringae pv. phaseolicola 1448A
  CDS (1)..(1998): transl_table=11
atgccaagccgtcgtgagcgtgccaatgctattcgtgccctaagcatggatgccgtgcaaaaagccaacagcggccatccgggtgccccgatgggcatggcggatatcgccgaggttctgtggcgtgattatctcaagcacaacccggcaaaccccgcgttcgctgaccgtgaccgtttcatcatgtccaacggccatggttcgatgctggtctattcgttgctgcacctgaccggctacgacctgtccatcgacgacctgaaaaacttccgtcaactgcacagccgcacaccgggtcaccccgagtttggctataccccaggcgttgaaaccaccactggcccattgggtcagggttttgccaacgccgtcggttttgccgctgccgagaaaaccctcgccgcacagttcaaccgtccaggccattccatcgttgatcaccatacctacgtgtttatgggtgatggctgcatgatggaaggtatttcccacgaagtcgcttccctggccggcacgttgcagcttaaaaagctgatcgcgttctacgacgacaacggcatctccatcgatggcgaagtcgaaggctggtttaccgacgatacgcctaagcgtttcgagtcgtacggctggttggtgatccgcaatgtcgacggtcatgaccctgaagaaatcaagaccgccatcgacaccgcgcgcaagagcgacaagccgacgctgatctgctgcaagaccaccatcggctttggctcgccgaacaagcagggcaaggaagaatcccacggtgcgccgctgggtgcggacgaaatcgccctgacccgtgcggccctgaaatggaaccacggtcctttcgaaattccggctgatatctacgccgagtggaatgcgaaagaaaaaggcctggctgccgaagccgagtgggatcagcgctttgctgcctattccgccgctttccctgagctggccaacgacttcattcgtcgcatgagcggcgagttgcctgctgactttgcagagaaatccgctgcttatgtcgccgaagtcaacgccaaaggcgaaaccatcgccagccgtaaggccagtcagaacgccctgagcgcactgggcccgttgctgccggaaattctcggtggttcggctgacctggccggctccaacctgaccatttggaaaggctgcaagagcatcactggcgaagatcccaacggcaactacctgcactacggtgttcgtgagttcggtatgggcgccatgatgaacggtatcgccctgcacggcggcttcgtgccgtacggcgcaaccttcctgatcttcatggaatacgctcgcaacgcggtgcgtatggcctcgctgatgaagaagcgtgtgatctacgtattcacccacgactccatcggtctgggcgaagacggcccgactcaccagccgatcgagcaactgaccagcctgcgtaccacgccgaacctggacacctggcgtccggcagatgccgtggaatcggccgtggcctggaaacacgccatcgagcgcaatgacggtccatccgcattgattttctcgcgtcagaacctgactcaccaagcgcgtgaacagcagcaaatagatgccattgcccgtggcggctatgtactgcgtgactgcgctgcagagcctgagctgatccttatcgcgactggttcggaagtcggtctggctgtgcaggcgtatgacaagctgaccgagcagggtcgcaacgttcgtgtggtctccatgccatgcaccagcatcttcgaagctcaggatgcggcctacaagcaggctgttctgccactgcaggtcagtgcacgtattgctatcgaagcggctcacgccgactactggtacaaatacgtgggtctggaaggtcgcgtgatcggcatgaccacgttcggcgagtcggcccctgcgtcagccttgttcgaagagttcggctttacgctggaaaacgtcttgagcacggctgaagagctgctcgaagactga

SEQ ID NO: 10011 - protein, 665 aa, Pseudomonas syringae pv. phaseolicola 1448A
MPSRRERANAIRALSMDAVQKANSGHPGAPMGMADIAEVLWRDYLKHNPANPAFADRDRFIMSNGHGSMLVYSLLHLTGYDLSIDDLKNFRQLHSRTPGHPEFGYTPGVETTTGPLGQGFANAVGFAAAEKTLAAQFNRPGHSIVDHHTYVFMGDGCMMEGISHEVASLAGTLQLKKLIAFYDDNGISIDGEVEGWFTDDTPKRFESYGWLVIRNVDGHDPEEIKTAIDTARKSDKPTLICCKTTIGFGSPNKQGKEESHGAPLGADEIALTRAALKWNHGPFEIPADIYAEWNAKEKGLAAEAEWDQRFAAYSAAFPELANDFIRRMSGELPADFAEKSAAYVAEVNAKGETIASRKASQNALSALGPLLPEILGGSADLAGSNLTIWKGCKSITGEDPNGNYLHYGVREFGMGAMMNGIALHGGFVPYGATFLIFMEYARNAVRMASLMKKRVIYVFTHDSIGLGEDGPTHQPIEQLTSLRTTPNLDTWRPADAVESAVAWKHAIERNDGPSALIFSRQNLTHQAREQQQIDAIARGGYVLRDCAAEPELILIATGSEVGLAVQAYDKLTEQGRNVRVVSMPCTSIFEAQDAAYKQAVLPLQVSARIAIEAAHADYWYKYVGLEGRVIGMTTFGESAPASALFEEFGFTLENVLSTAEELLED

SEQ ID NO: 10012 - DNA, 2007 bp, Dechloromonas aromatica RCB
  CDS (1)..(2007): transl_table=11
atgagcgtcagcaacctccccaagttttctcccctgaccggcgccatccgcgccctcgccatggatgcagtccagcaggccaactccgggcatcccggcgccccaatgggcatggctgaaatcgccgaagtcctctggcgccgccacctgcgtcacaacccggccaacccgcactgggccgaccgcgaccgctttgtgctgtcgaacggccacggctcgatgctgctctacgcgctgctgcacctgaccggctacgatctgtcgatcgatgacctgaagaatttccgccagttgcacgccaagaccccgggccatccggaatacggctacacgccgggcattgaaacgaccaccggcccgctcggccagggcatcaccaacgccgtcggcttcgcgctggctgaaaaggtgctggccgccgagttcaacaaacccggccacgaaatcgtcaatcaccacacctatgtcttcctgggcgacggctgcctgatggaaggcgtgtcgcatgaagcctgctcgctggccggcacgctcggcctcggcaagctgatcgccttctgggacgataacggcatctcgatcgacggtcacgtcgaaggctggttcaccgacgacaccccgaagcgctttgaagcctacggctggcatgtcgtcgcccacgtcgacggccatgattccgacgccatagaacgcgccctgctcgccgccaaggcagtcaccgacaagcccagcctgatctgctgcaagacgaccatcggcgccggctcgccgaacaagcagggatcgcacgactgccacggcgccccgctcggcaaggacgaaatcgctgccgcccgcgcttacatcggctggaaccacccggccttcgaaatcccggccgacatttacgccgcctggaatcgcaagccggccggtgctgtttttgaggaaaactggagcacccgtttcgctgcctaccgcaccgccttcccggccgaagccgccgaattcgagcgccgcgtcatcaagaacgaactgccaaccaactgggcagcgaccaaggccgcctacatcgccacctgccgcgacaaggccgagaacatcgccacccgaaaggcttcgcagaacgccattgccgcactggtcccggccgtgccggaaatcttcggcggctcagccgacctggccggctccaacctgaccttcgtcaagggcagcaagggcgtcacccgcaccgagggcggcaactattgctactacggtgtgcgcgaattcggcatgaccgccatcgccaacggcatcgcgctgcatggtggcctggtgccctacaccgcgactttcctggtcttctccgactacgcccgcaacgccatccgtatggcggcgttgatgaagcagcgccagatcatggtctatacccatgactccatcggtctcggcgaagatggcccgacgcaccagccggtcgagcatatcccgtcgatgcgcatcatcccgaacctcgacgtctggcgcccggccgacgcgaccgaaacggccattgcctggaccgcagcggtcgagcgcaaggatggcccgagcatcctcgccctgtcgcgccagaacctgccgaccgtcacccagcaggcggccgatgccgacatcgccaagggcggctatgtactggccgaagcggatggcgaagcgcagatcaccttcattgccaccggctccgaaatcaagctggcgctcgacgcccaggctgcactggccggcgaagggatcaagacccgcgtcgtctcgatgccctgctccaatgttttcgaccgccagagcgccgaatacaaagcctcggtgctcggcgcctgcaaaaaacgcatcgccatcgaagccgctcacccggacttctggcgcaagtacgtcggcctgcatggcgccgtgatcggtatcgaccgcttcggcgagtccgcaccggccggccagctgttcgacctgttcggtttcaccgtcgccaacgtcgtcaagacggccaaggcactgttgtcctga

SEQ ID NO: 10013 - protein, 668 aa, Dechloromonas aromatica RCB
MSVSNLPKFSPLTGAIRALAMDAVQQANSGHPGAPMGMAEIAEVLWRRHLRHNPANPHWADRDRFVLSNGHGSMLLYALLHLTGYDLSIDDLKNFRQLHAKTPGHPEYGYTPGIETTTGPLGQGITNAVGFALAEKVLAAEFNKPGHEIVNHHTYVFLGDGCLMEGVSHEACSLAGTLGLGKLIAFWDDNGISIDGHVEGWFTDDTPKRFEAYGWHVVAHVDGHDSDAIERALLAAKAVTDKPSLICCKTTIGAGSPNKQGSHDCHGAPLGKDEIAAARAYIGWNHPAFEIPADIYAAWNRKPAGAVFEENWSTRFAAYRTAFPAEAAEFERRVIKNELPTNWAATKAAYIATCRDKAENIATRKASQNAIAALVPAVPEIFGGSADLAGSNLTFVKGSKGVTRTEGGNYCYYGVREFGMTAIANGIALHGGLVPYTATFLVFSDYARNAIRMAALMKQRQIMVYTHDSIGLGEDGPTHQPVEHIPSMRIIPNLDVWRPADATETAIAWTAAVERKDGPSILALSRQNLPTVTQQAADADIAKGGYVLAEADGEAQITFIATGSEIKLALDAQAALAGEGIKTRVVSMPCSNVFDRQSAEYKASVLGACKKRIAIEAAHPDFWRKYVGLHGAVIGIDRFGESAPAGQLFDLFGFTVANVVKTAKALLS

SEQ ID NO: 10014 - DNA, 2073 bp, Dechloromonas aromatica RCB
  CDS (1)..(2073): transl_table=11
atggatcgcaaccagaccgaaatcaccttccgccgcgaactggccaacgccgtccgctttctggccatcgatgccgtcaatcaggccaagtccggacaccctggcgcgccgatgggcatggccgacatcgccgaagtgctgtggcgtgaccatctcaagcacaatccagccaacccgcagtgggcggaccgcgaccgcttcgtactgtcgaacggtcacggctcgatgctgctctacgcgctgcttcacctgaccggctacgacctcaatatcgatgacctcaagaacttccgccagttcggcagccgcaccgccggccatccggaagtcggccacacgcccggcgtcgagacgaccaccgggccgctcggccagggcctgaccaacgccgtcggcatggcgctggccgaaaagctgctggcccagcgctacaaccggccaggttgcgagatcgtcgatcaccggacttgggttttcgtcggtgacggctgtctgatggaaggcatcagccacgaagcctgttcgctggccggcgtctggggcctcgacaagctgacctgcttctacgacgacaacgggatttccatcgacggccacgtcaaaggctggttccgcgacgacaccccggcccgcttccgcgcctacggctggcatgttgtcgggccgattgacggccatgactcggtggcgctgtccgcggccattgccgaagccaaggccgtcaccagccaaccgaccctgatcgtctgccgcacgcagatcggttggggttcgccgaacaaggccggttcgcacgacgttcatggcgcgccgctcggcgccgatgaaacggccgccacccgtgccgcgcttggctggttgcatccgccgtttgaagtgccggacagcctgcgcgccgcgtggaatgcccagtctactggcgccactgccgaagcctcatggctggccaggttcgccgcttaccgcaccgagtatccggaactcgccgccgaattcgaacgcacgcaggccggcggtctgccggaaaaatggccggaaattaaaagcgaactgctggccacggccggccgcaaggaaggcgccgtcgccacccgcaagtcgtcgcagaactgcctcgattggctggtcgaccgcgtgcccgaactacttggcggctcggccgacctgaccggctccaacctgaccgccggcaaaggcagcgtggccctgcatgaagtaccccaagggcacttccttcggggcgctggtgagcggcaggccaactacatttcctacggcgtccgcgaattcggcatgacggcgatcatgaacggtgtcgccctgcacggcgggttgattccctacggcggcaccttcgccgtcttctccgactacgcccgcaacgcgatccggatgagcgccctgatgcagcagcgcgtcgtccatgtcctgacccacgattccatcggcctcggcgaggatggcccgacccaccagccggtcgagcacgccagcagcctgcgcatcattcccggcctcgacctgtggcgcccgtgcgacgagctggaaacagccatcgcctggggcgccgcgctcgagcgccaaaacggaccttccaccctctttttgtcgcgtcaaaacctgccgcaatacggcggcgcggcgagccgggcggaaggtgccagccgcggcggctacgtgctctccgaagccgacggcccgctgcaggcagtgatcatcgccaccggctcggaagtcgccatcgccatgcaggcgcaggccattctgaaaaccggcggcgttgcagtgcgtgtcgtctcgatgccctgcacgcggcgcttcgaccagcagccttcgacgtggaagaagctcgtgctgccgccggaagtctgccgcgtcgccatcgaagccggccagaccgatttctggcgaaagtacgttggcctcgacggcgacgtgctcggcctcgacgaattcggcgcctcggccccggccccggtgctttacgaacactacggcctgaccgcggacaacctggcgcagacggtgttgcgcaccatcgtcagtgccgggggcagtgatggtgacttctga

SEQ ID NO: 10015 - protein, 690 aa, Dechloromonas aromatica RCB
MDRNQTEITFRRELANAVRFLAIDAVNQAKSGHPGAPMGMADIAEVLWRDHLKHNPANPQWADRDRFVLSNGHGSMLLYALLHLTGYDLNIDDLKNFRQFGSRTAGHPEVGHTPGVETTTGPLGQGLTNAVGMALAEKLLAQRYNRPGCEIVDHRTWVFVGDGCLMEGISHEACSLAGVWGLDKLTCFYDDNGISIDGHVKGWFRDDTPARFRAYGWHVVGPIDGHDSVALSAAIAEAKAVTSQPTLIVCRTQIGWGSPNKAGSHDVHGAPLGADETAATRAALGWLHPPFEVPDSLRAAWNAQSTGATAEASWLARFAAYRTEYPELAAEFERTQAGGLPEKWPEIKSELLATAGRKEGAVATRKSSQNCLDWLVDRVPELLGGSADLTGSNLTAGKGSVALHEVPQGHFLRGAGERQANYISYGVREFGMTAIMNGVALHGGLIPYGGTFAVFSDYARNAIRMSALMQQRVVHVLTHDSIGLGEDGPTHQPVEHASSLRIIPGLDLWRPCDELETAIAWGAALERQNGPSTLFLSRQNLPQYGGAASRAEGASRGGYVLSEADGPLQAVIIATGSEVAIAMQAQAILKTGGVAVRVVSMPCTRRFDQQPSTWKKLVLPPEVCRVAIEAGQTDFWRKYVGLDGDVLGLDEFGASAPAPVLYEHYGLTADNLAQTVLRTIVSAGGSDGDF

SEQ ID NO: 10016 - DNA, 2124 bp, Thermobifida fusca YX
  CDS (1)..(2124): transl_table=11
atgaacaccggcaccccaaagaccctggactggtctgatctcgatagacgtaccgtagacgtggttcgtgccctggcgatggacgcggtcgaagaagcgggatccgggcaccctggaaccgcgatgagtctggcgcctgtggcctacctgctcttccagaaggtgatgcggcacgatccgacagatccgaagtggatcggccgcgaccgcttcgtcctgtcctgcgggcactccagcctcacgctctacatccagctctacctggctggctacgggctgagcctgaacgacatcaagcggctgcgccagtggggcagcctcaccccgggccaccccgaatacgggcacaccgccggggtggaaaccaccaccggccccttggggcagggcatcggcaacgcggtcggcatggccatggccgcccgccgggagcggggcctgttcgacccggacaccccgatcggggaaagcccgttcgaccactacatctacgtcctgtgctctgacggcgacgtccaggagggcatcagccacgaagtaagtgccctcgccggcacgcagaagctcggcaacctcatcgtcatctgggacgacaaccgcatctccatcgaagacgacacccagatcgcattcaccgaagacgtcgtcgcccgctacgccgcctacggctggcacgtccaagaggtcgagtgggtcggcgaggacggctcctaccacgaagacgtggcggcgctgtacgacgcgatccgggccgcccaggcggagacggaacgtccctctttcatccggctgcgcaccatcatcggctggccgtccccgaacaagcagaacacgggggcgatccacggcgccgcgctgggggctgaagaggtcgccgccaccaagcgggtgctgggcctcaaccctgaggcgcagttcgacgtgcccaacgagctgctggagcacgcccggggcgtggtggcgcggggccgcgccgcccgccaggaatgggaggccttgttcgccaagtggcgggccaacgcgggcgagcgtgccgaactgttcgaccggctgatggcaggctcgctcccggacggttgggagaaggcgatcccgaccttcgagcccagcgctaagggcatggccacccggaaagcgtccggtgaggtgctgagcgcgatcgccccggtgctgccggagctgtggggcggctcggcggacttggccggatccaacaacaccacgcctaagggcgagccgtcgttcatccccgaggagcggtccacgaaggcgttctccggccaccgctacggccgggtgctgcacttcgggatccgtgaacacggcatgggggcgatcctcaacgggatcgcgctgcacggccccacccgcccctacggtggcaccttcctcgtgttcagcgactacatgcggccgtcggtgcggctggctgccctgatgaagctgccggtcacgtacgtgtggacccacgactcgatcggtctgggcgaagacggacccacccaccagccggtggagcacctgtggtcgctgcgcgccatccccggcctggcggtggtgcgtcccgccgacgccaacgagacggcagtggcctggcgcaccatcctggaacgcaatgacggcccggtggcgctcgcgctgacccggcagtcggttccggttctggaccgctccgagctcgcctctgcggagctggtctcccgcggcgggtacatcctggccgaagccagcaacggccgtccggaggcgatcatcatcgccaccggaagtgaggtgcagatcgcgttggaggcgcgttcccgcctggaggagtcgggtactcctacccgtgtggtgtcgatgccgtgcctggagtggttcaacgagcaggacgacgcctaccgccagcaggtgcttccaccgtcggtccgggtccgggtctccgtggaagccggggtcgccttgggctggcgcgagctggtgggcgagtatggcgagtcggtgagtctggaacacttcggcgcttcggctccgtacgcgactctctacgagcagttcgggctcaccgccgaccgggtagtggcagccgtacactccagcgctgccaagctcggcggtgaccgtggatcaacgaccggcaactga

SEQ ID NO: 10017 - protein, 707 aa, Thermobifida fusca YX
MNTGTPKTLDWSDLDRRTVDVVRALAMDAVEEAGSGHPGTAMSLAPVAYLLFQKVMRHDPTDPKWIGRDRFVLSCGHSSLTLYIQLYLAGYGLSLNDIKRLRQWGSLTPGHPEYGHTAGVETTTGPLGQGIGNAVGMAMAARRERGLFDPDTPIGESPFDHYIYVLCSDGDVQEGISHEVSALAGTQKLGNLIVIWDDNRISIEDDTQIAFTEDVVARYAAYGWHVQEVEWVGEDGSYHEDVAALYDAIRAAQAETERPSFIRLRTIIGWPSPNKQNTGAIHGAALGAEEVAATKRVLGLNPEAQFDVPNELLEHARGVVARGRAARQEWEALFAKWRANAGERAELFDRLMAGSLPDGWEKAIPTFEPSAKGMATRKASGEVLSAIAPVLPELWGGSADLAGSNNTTPKGEPSFIPEERSTKAFSGHRYGRVLHFGIREHGMGAILNGIALHGPTRPYGGTFLVFSDYMRPSVRLAALMKLPVTYVWTHDSIGLGEDGPTHQPVEHLWSLRAIPGLAVVRPADANETAVAWRTILERNDGPVALALTRQSVPVLDRSELASAELVSRGGYILAEASNGRPEAIIIATGSEVQIALEARSRLEESGTPTRVVSMPCLEWFNEQDDAYRQQVLPPSVRVRVSVEAGVALGWRELVGEYGESVSLEHFGASAPYATLYEQFGLTADRVVAAVHSSAAKLGGDRGSTTGN

SEQ ID NO: 10018 - DNA, 2013 bp, Prochlorococcus marinus str. NATL2A
  CDS (1)..(2013): transl_table=11
atggttgccttgactacttccctagacacactttgcgtcaacagcatcaggatgctcgctgttgatgcaattaataaatccaaaagtggtcacccaggtttacctatgggttgcgcacctatgggttatgcattatgggacaagcatttacgacacaatccaaaaaacccgaaatggtttaatcgagacagatttgttctttcagcaggacatggctgcatgcttttgtatgctctcttgcatttgaccggctatgactctgtcaccattgaagatataaaagaatttagacagtggggagctaaaactccagggcatccagaaacctttgaaactcctggagttgaagtaactgcaggccctttgggagcaggaatttcaaatgcagttggattagccattgcggaagctcacctcggtgcaaaattcaacaaacctgattcaacagttgtagaccattacacctatgtgatcatgggggatggatgtaatcaagaaggtatttcttcagaagcatgttctcttgctgggcatttaaaacttggaaaattaatagctctctatgacgataatcacataactattgatggaagaacagatgtctcatttacggaggatgtcttaaaaagatatgaagcatatggatggcatgtacaagaaatttctgaagggaatacagatgttgaaggcatatctcaagcaatcgaaaaagccaaatcagtcactgataagccatccatcatcaaagtaacaacaactatcggctacggttctccaaataaaagtgatactgcaggtattcacggcgccccattgggcgaagaagaggcagagctcactagaaaacaattaggttggtcatacaaacctttcgaggttccccaagatgcttatgatcaatatcgacaagccattcaaaaaggtgcacagctagaagaagagtggaatcaaagcctagctacatacaaagaaaaatatcctaatgaagcatctcaatttgagcgcatgttgagaggtgagctccctgaaggctgggataaagatttacctacctatacatccgatgaccaaggggttgccactagaaaacattctcaaatatgtctaggtgctcttggtccaaacatccctgaactaataggaggttctgctgatttaactcattcaaactacacagatataaaaggcgaaactggatcttttcaatatgaaagtcctgaaaaacgttatttacattttggtgtcagagagcacgctatggcagccatattaaatggaattgcttatcacgacagtggtttaattccttatggtggaaccttcttagtcttcgcagattacatgagaggatctatgcgtctttccgctcttagtgagcttggagttatttatgttttaacccatgattccataggtgttggtgaagatggcccaacacatcaacctatagaaaccattccatcattgagagcaatgcccaatatgatggtattccgtcctggcgatggcaatgaaaccagtggtgcttataaagttgcaattaaaaatcgtaagagaccaagttccttatgcctgagtaggcagggtatggccaatcaacaaaattcatccgtagacaaagttgctttaggtggatatgtacttgaggagtgcgatggcactccagaactgatacttatcggaacaggaactgaacttgatttatgtgttcaagcagcgaaaaagttaactaaggaaggtagaaaagtgcgtgttgtttctatgccatgcgttgaactttttgaagaacaaagcgatagttataaagaagaagttttgccttcaaatatcagaaaacgcctagtagtagaagccgcagagagttttggatggcacaaatatattggtcttgatggtgacagcgtaactatgaatagctttggagcatctgctccaggtggattatgtatggaaaaatttggatttacagttgaaaacgtactagaaaaatctagaagtcttctcaacaaataa

SEQ ID NO: 10019 - protein, 670 aa, Prochlorococcus marinus str. NATL2A
MVALTTSLDTLCVNSIRMLAVDAINKSKSGHPGLPMGCAPMGYALWDKHLRHNPKNPKWFNRDRFVLSAGHGCMLLYALLHLTGYDSVTIEDIKEFRQWGAKTPGHPETFETPGVEVTAGPLGAGISNAVGLAIAEAHLGAKFNKPDSTVVDHYTYVIMGDGCNQEGISSEACSLAGHLKLGKLIALYDDNHITIDGRTDVSFTEDVLKRYEAYGWHVQEISEGNTDVEGISQAIEKAKSVTDKPSIIKVTTTIGYGSPNKSDTAGIHGAPLGEEEAELTRKQLGWSYKPFEVPQDAYDQYRQAIQKGAQLEEEWNQSLATYKEKYPNEASQFERMLRGELPEGWDKDLPTYTSDDQGVATRKHSQICLGALGPNIPELIGGSADLTHSNYTDIKGETGSFQYESPEKRYLHFGVREHAMAAILNGIAYHDSGLIPYGGTFLVFADYMRGSMRLSALSELGVIYVLTHDSIGVGEDGPTHQPIETIPSLRAMPNMMVFRPGDGNETSGAYKVAIKNRKRPSSLCLSRQGMANQQNSSVDKVALGGYVLEECDGTPELILIGTGTELDLCVQAAKKLTKEGRKVRVVSMPCVELFEEQSDSYKEEVLPSNIRKRLVVEAAESFGWHKYIGLDGDSVTMNSFGASAPGGLCMEKFGFTVENVLEKSRSLLNK

SEQ ID NO: 10020 - DNA, 2034 bp, Ralstonia eutropha JMP134
  CDS (1)..(2034): transl_table=11
atgtccgcccttgctcatcccgccacaagtccctttgcttcccagcctgccaagctgatggccgatgccattcgcgtgcttgccatggacgccgtccagcaagccaattccggccatcctggcgcgccgatgggcatggccgatatcgcagtggcgctgtggggccgccacctgaagcacaacccggccaatccgcactgggcggaccgcgaccgcttcgtgctgtcgaacggccacggctcgatgctgatctacgcgctgctgcacctgaccggctatgacctgccgatcgaggagctgaagaacttccgccagcttcacagcaagaccgccggtcacccggaatacggcatcacccctggcgtggaaacgaccaccggcccgctgggccagggcatcaccaatgccgtcggcatggcgctggccgaacgcctgctcggtgaagaattcaaccgcccgggcttcaacattgtcaatcactacacctacgtgttcctcggcgacggctgcctgatggaaggcatcagccacgaggcttgctcgctggccggcacgctgaagctgaacaagctgatcgcactgtgggatgacaacggcatctcgatcgatggcgacgtggtgcactggttcaacgacgacacgcccaagcgcttcgaagcctacggctggaacgtgatccgcggcatcgacggccacgacgtgaccgctgtcgacctggcgatttcgcaggccaaggccagcgacaagccgaccctgatctgctgccgcaccaagatcggcaagggcgcgcccaacaaggaaggcggtcacgacgtgcacggcgccccgcttggcggcgccgaagtgctggccacgcgcgaagcgcttggctgggcccacgccccgttcgaagtgccggcggatgtctacgacgcctgggatgccaaggccaccggcctcgccctggaaaaggcctggaacgcgctgttcgaaggctacgccgaccgccacccgtatgaagccggtgaattccagcgccgcatgcgcggcgagctgccaggcagcttcgacgccgccgtcgacgccttcatcgccaagtgcgaggaaaaggccgagaccatcgctacccgcaaggcgagccagaacaccatcgaggccttcggcccggtgctgcccgaattcctcggcggctcggccgacctgaccggctcgaacctgaccaactggtcgggcagccaggccgtgcgtgtggatgcctggggcaaccacatcaactatggtgtgcgcgagttcggcatgagcgccatcctgaacggtattacgctgcacggtggctacatcccctacggcgccacgttcctgaccttctcggactacagccgcaacgcgctgcgcatggcggcgctgatgaaaatccgctcgctgttcgtgttcacccatgactcgatcggcctgggcgaagacggcccgacgcaccagtcgatcgaacacgtcgccagcctgcgcctgatcccgaacatggacgtctggcgtaccgccgacaccactgagaccgccgtggcctgggccgaggcgatccgccgcgaaaacggcccgagctgcctgatcttcagccgccagaacctgccgttccagcagcgtgacgacgcgacccgcgccaatatcgcgcgcggcggctacgtgctgcgcgacggcacgaacgcgaacaccggccgtcccgacgccgtgatcctggccaccggctcggaagtgggcctggccgtcggcgctgccgaccagctggccgccgaaggcgtgcacgtgcgcgtggtatcgattccggccacgactgtgttcgacaagcaggacagcgcctacaaggcgagcgtcctgccggccggcgtgccccgcgtggccgtggaagccggtgtgacggatttctggtggaaataccaggtccaggctgttgtgggcattgacaccttcggccagtcggcgccggccggcgtgctgttcaagcacttcggcttcaccgtcgagaacgtcgtgcggaccgtcaaggacacgctgcaataa

SEQ ID NO: 10021 - protein, 677 aa, Ralstonia eutropha JMP134
MSALAHPATSPFASQPAKLMADAIRVLAMDAVQQANSGHPGAPMGMADIAVALWGRHLKHNPANPHWADRDRFVLSNGHGSMLIYALLHLTGYDLPIEELKNFRQLHSKTAGHPEYGITPGVETTTGPLGQGITNAVGMALAERLLGEEFNRPGFNIVNHYTYVFLGDGCLMEGISHEACSLAGTLKLNKLIALWDDNGISIDGDVVHWFNDDTPKRFEAYGWNVIRGIDGHDVTAVDLAISQAKASDKPTLICCRTKIGKGAPNKEGGHDVHGAPLGGAEVLATREALGWAHAPFEVPADVYDAWDAKATGLALEKAWNALFEGYADRHPYEAGEFQRRMRGELPGSFDAAVDAFIAKCEEKAETIATRKASQNTIEAFGPVLPEFLGGSADLTGSNLTNWSGSQAVRVDAWGNHINYGVREFGMSAILNGITLHGGYIPYGATFLTFSDYSRNALRMAALMKIRSLFVFTHDSIGLGEDGPTHQSIEHVASLRLIPNMDVWRTADTTETAVAWAEAIRRENGPSCLIFSRQNLPFQQRDDATRANIARGGYVLRDGTNANTGRPDAVILATGSEVGLAVGAADQLAAEGVHVRVVSIPATTVFDKQDSAYKASVLPAGVPRVAVEAGVTDFWWKYQVQAVVGIDTFGQSAPAGVLFKHFGFTVENVVRTVKDTLQ

SEQ ID NO: 10022 - DNA, 1986 bp, Ehrlichia canis str. Jake
  CDS (1)..(1986): transl_table=11
atgggcaacagatataatgatatggtaaatatggctaatgctattagggtgttgtcagtagatgctatacaaaatgctgcttctggacatcctggtatgcctttaggtatggcagatgttgctacagtattatttgcaaagtttttgaaatttactcctaaagatactagttggtttaatagggataggtttgtattgtcaaatgggcatggatctatgttattgtattctatattatattttttaggatgtttagatatagaagaaataaagagatttaggcaaattcattctttaactcctggacatccggaatatggttgcactcctggtgttgatgctactactgggccattaggacagggtttagcatgtgctgtaggtatggctatagcagagagagtattatctgaaaagtttggtagtgaacttgtagatcatatgacatatgttatggttggtgatggttgtcttatggaagggattagtcatgaggcagcatctttagcagggcatttgcaaattagtaaattaatagtgttgtttgatgataatggtatttcaatagatggtgatacatctttagctgtttcagatgatattaaggctaggttcttatcttatggttgggatgtctttgagatagatgggcatgattttgatgagattgaatcttcaattgaaaatgctcgtagatctagtaagccttctttaatttgttgtaagacaattattgggaaaggccttgtttcaaaagaaaatacatctgctgcacatagttggccattttcagaagaagaagtaattttaatgaaagaaaagttagggtggtgtgataagccatttgatgtaccagaagagattttacagttatggaaaagtattgccagtaagtcggaaaatgaatataaagcgtggcttaataaatgtgatgataaagcttctcaaagttttgttgatgtaataaaagaaggtgtatctgattcagtattcttgagtttaaagaaattaaaaaaagagctatgtaatttgaatttaaatgaagcaacacgtaaatcttctggtagaatattggaagttgtcatggaaaatacaagtaaattaataggtggttctgctgatcttactggttctaataatactaaaccacaatttgcatcaattattaataaggataactttagtggctcttatttacattatggtataagggaacatgctatggcggcatgtatgaatggtatggcattgcatggaggagtaattccttatggaggaacgtttttagtttttgctgattattgtaggccagctattaggttgtctgcattaatgaagagacatgttatttatgttatgacgcatgattctattggagtaggggaagatggaccaactcatcaacctgtagaacatgtatcatctttaagagctatacctaatttatatgttttcagaccagctgatgctgttgaagtattagaatgttgggaaattgcattaagattaactagttctccatctgcatttatattatctaggcaaaatgtaggtaatgttcgtagtctatatgttgaagaaaatttatctagcaaaggtgcatatattatacgtgaatatgaaaaagatttagatgttacgatctttgctacagggtctgaggtagaagtagcattaaaagctgctgatattttaaaaggtaaagggttggatgcaagaatagtgtctgttccttgttgggaattgtttgctcagcaagataagaaatatatattcagtttgttaaataataaaagtataaaagctgctatagaggctgcaagctcatttggatggcataaatatataggagaagatggagtttttgtaggattagatgattttggattatctgctccatgtaaggatttatataagcattttggaatcactgcagagaatttagtgaataaaatacttgataaattaaaaattaatattgattga

SEQ ID NO: 10023 - protein, 661 aa, Ehrlichia canis str. Jake
MGNRYNDMVNMANAIRVLSVDAIQNAASGHPGMPLGMADVATVLFAKFLKFTPKDTSWFNRDRFVLSNGHGSMLLYSILYFLGCLDIEEIKRFRQIHSLTPGHPEYGCTPGVDATTGPLGQGLACAVGMAIAERVLSEKFGSELVDHMTYVMVGDGCLMEGISHEAASLAGHLQISKLIVLFDDNGISIDGDTSLAVSDDIKARFLSYGWDVFEIDGHDFDEIESSIENARRSSKPSLICCKTIIGKGLVSKENTSAAHSWPFSEEEVILMKEKLGWCDKPFDVPEEILQLWKSIASKSENEYKAWLNKCDDKASQSFVDVIKEGVSDSVFLSLKKLKKELCNLNLNEATRKSSGRILEVVMENTSKLIGGSADLTGSNNTKPQFASIINKDNFSGSYLHYGIREHAMAACMNGMALHGGVIPYGGTFLVFADYCRPAIRLSALMKRHVIYVMTHDSIGVGEDGPTHQPVEHVSSLRAIPNLYVFRPADAVEVLECWEIALRLTSSPSAFILSRQNVGNVRSLYVEENLSSKGAYIIREYEKDLDVTIFATGSEVEVALKAADILKGKGLDARIVSVPCWELFAQQDKKYIFSLLNNKSIKAAIEAASSFGWHKYIGEDGVFVGLDDFGLSAPCKDLYKHFGITAENLVNKILDKLKINID

SEQ ID NO: 10024 - DNA, 2001 bp, Dehalococcoides sp. CBDB1
  CDS (1)..(2001): transl_table=11
atgtcaaatacgaaattagatagtttatgcataaacgcccttcgctttctttcggtagacgctgttcagaaggcaaattcggggcatcccggagcgcctatgggtatggccgctatggcatatgccctgtggcaaaattttctcaagcataacccgcaggaccccgcttggcctaaccgtgaccgttttatactttcagccggccatgcctctgccctgctttattcactactccacctgaccggttatgacctgccgctggacgaacttaaaaatttccgccagtggggcagtaaaacaccgggacatccggaatacggcctgactcccggggttgaaatgactaccggcccgcttgggcagggttttgcaagcggtgtgggtatggctatggccgaagctcatttggcagcggtttttaaccagccggattgcaaaattatagaccattatacctacggcatagtctctgacggagacctgatggaaggcgtagcttcagaagcggcctctctggccgggcatttagcccttggcaagctgatttatctgtatgatgacaatgatatatctattgaaggttcaactgagctggcttttaccgaaaacgcagctctgcgctttgaaagttacggctggcaggttatagaccatgtagacgggcttgacccggaggcggtatctcaggctattaaacaagcccagtcagataccacccgccccagcctgattatctgcaaaacaatcatcggctttggcagcccgaataaggccggcaaggcctctgcccatggcgagccgctgggaacagatgaggtatccaagagccgtaaatctctggggtgggactatgaaccgtttgtaataccagttgaggctctaacagagttccgcgaagcactgggcaagggcaaaacagcccagcaggtttggttgtccaagctggactactatttaagccattatcccgaaaaagcctcactgctgcaggacatgctttcgggcaacttacctgaagactgggacaaagatctggatagactctttgacaaagctatgtcaagccgcgaggcttcaggcctgctgataaatgccttggcttcccgcctgccttctctcatgggtggttcggcagacctcagcccgtctaacaagaccgttatcaaagacggcggggaatacgaacctcactattacgagggacggaatatccatttcggagtgagggagcacgccatgggggcaatagctaacggactggctctccacgggggcataataccttacgttgccactttcctcatattttatgactacatgcgtccggctgtacggttggcttcacttatggggcaaagggtgatttatatttttacccatgattccatcggtctgggagaagacggccctacccaccaacccattgaacagctggccggtctgcgttcggtacccggtctggttactatccgtccggcagattcatatgagactgctcaggcatggaaaacggctatactccgtaagaacggccctaccgccattgccctgtcccgtcagaaactgccgcttttagataactctcagacaaaatccttaaacctgcctaaaggggcatatatactgcaggaaacagactcccacccgcaggtagctctagttgccagcgggtctgaagtaactatagcggttgaagcggctgaaatacttaaggggaaaggcatatcctcaagggtagtatctttcccttcatggcagctttttgataaccaaccccaaacctaccgccagagtgtcctgccttcttccctgccacgggtaataatggaagctggcaactcacagggctggtgcaaatatctgggtacaaacggaactgttatatcaattgaccacttcggggcatcagccccggcagccctgctttacaaaaacttcggcctgacccctgaaaacatggctgaaaaagctttaaagcttttggagaatgaacatgagtaa

SEQ ID NO: 10025 - protein, 666 aa, Dehalococcoides sp. CBDB1
MSNTKLDSLCINALRFLSVDAVQKANSGHPGAPMGMAAMAYALWQNFLKHNPQDPAWPNRDRFILSAGHASALLYSLLHLTGYDLPLDELKNFRQWGSKTPGHPEYGLTPGVEMTTGPLGQGFASGVGMAMAEAHLAAVFNQPDCKIIDHYTYGIVSDGDLMEGVASEAASLAGHLALGKLIYLYDDNDISIEGSTELAFTENAALRFESYGWQVIDHVDGLDPEAVSQAIKQAQSDTTRPSLIICKTIIGFGSPNKAGKASAHGEPLGTDEVSKSRKSLGWDYEPFVIPVEALTEFREALGKGKTAQQVWLSKLDYYLSHYPEKASLLQDMLSGNLPEDWDKDLDRLFDKAMSSREASGLLINALASRLPSLMGGSADLSPSNKTVIKDGGEYEPHYYEGRNIHFGVREHAMGAIANGLALHGGIIPYVATFLIFYDYMRPAVRLASLMGQRVIYIFTHDSIGLGEDGPTHQPIEQLAGLRSVPGLVTIRPADSYETAQAWKTAILRKNGPTAIALSRQKLPLLDNSQTKSLNLPKGAYILQETDSHPQVALVASGSEVTIAVEAAEILKGKGISSRVVSFPSWQLFDNQPQTYRQSVLPSSLPRVIMEAGNSQGWCKYLGTNGTVISIDHFGASAPAALLYKNFGLTPENMAEKALKLLENEHE

SEQ ID NO: 10026 - DNA, 1986 bp, Thiobacillus denitrificans ATCC 25259
  CDS (1)..(1986): transl_table=11
atgccaacccgtaccgacctgtcgaacgccatccgcgcactcgcgatggatgcagtcgaaaaagcgaaatccggccaccccggcgccccgatgggcatggcggaaatcgccgagacgctgtggaaccatcatatgcgtcacaacccggtcaaccccaagtgggccgaccgtgaccgcttcgtgctgtcgaacggtcacggctcgatgctgatctatgcgctgttgcacctgaccggttacgacctgtcgatggacgacctcaagcagttccgccagttgcactcgaagaccccgggccaccccgagtacggctatgcgcccggcgtcgagacgacgaccggcccgctcggccagggcatcaccaacgcggtcggcatggcgatggcggaaaaagtgctggcgcacgaattcaataagcccggccacagcatcgtcgaccaccacacctacgtgttcctcggcgacggctgcatgatggaaggcatctcgcacgaggcctgcgcgctcgccggcacctggaagctcaacaagctgatcgcgttctgggacgacaacggcatttcgatcgacggccacatcgagcactggtacaccgacgacacggccaagcgtttcgaagcctacggctggcaggtcatcccgaacgtcgacggccacgacgtcgtcgcgatcgaagccgcgatccagaaggccaaggcgagcagcgacaagcccacgctgatctgctgcaagacgatcatcggcaagggctcgccgaacaaggccggtacgcacgacgtgcacggcgcagcgctcggccacgacgaagtcgaggcgacccgcaagaacatgggctggaattcgccggcgttcgaagtgccggccgacatctacgccggctgggacgcgaagaccaagggccaggggctcgagacgctgtggaacaacaagttcgccgagtacaagaaggccttccccgccgaagccgccgaattcgagcgccgcatgaagggcgaactgcccgccaactggaaggcgcacgtcgccgagaagctggctgcgatcaacgccaagggcgagaccgtcgccacgcgcaaggccagccagatcgcgatcaacgcgctggcttccgcgctgccggagttcctcggcggttcggccgacctgaccggctccaacctgaccaactgggaaggctgccacccggtgcgccacggcaagcccggcaactacatcagctacggcgtgcgtgaattcggcatggccgcgatcatgaacggcatggcgctgcacggcggcctcttgcccttcggcggcaccttcctgatgttctccgaatactcgcgcaacgccatccgcatggccgcgctgatgaagcagcgcgtgatccacgtgtttacgcacgattcgatcggtctcggcgaagacggcccgacccaccagcctgtcgagcagaccgcgaccctgcgcatgatccccaacatcgacgtctggcgtccgtgcgacaccgtcgagaccatggtcggctgggcgcactcggtcgagcgcaccgacggcccgacctgccacatcctctcgcgccagaacctgccgttcatgcagcgcgacgacgcgacgctcgcgagcatcgcaaagggcggctatgtgctgaaggatgcggccggcgcgaaggccgtcatcatcgccaccggctccgaagtcgaactcgcggtgaaggccgctgacacgctcgccgccgaaggcatcgcggtgcgcgtcgtctcgatgccgtcgaccaacaccttcgaccgccaggacgccgcctaccgcgaaagcgtgctgccgaagggcctgccgcgcgtcgccgtcgaagccggcgtcaccgacttctggcgcaagtacgtgggtctcgaaggcgccgtggtcggcatcgacaccttcggcgaatcggcccctgcgcccgcgctgttcaagcatttcggcatcaccgccgaggccgtcgcggccgcggtcaagagcgtgctgtaa

SEQ ID NO: 10027 - protein, 661 aa, Thiobacillus denitrificans ATCC 25259
MPTRTDLSNAIRALAMDAVEKAKSGHPGAPMGMAEIAETLWNHHMRHNPVNPKWADRDRFVLSNGHGSMLIYALLHLTGYDLSMDDLKQFRQLHSKTPGHPEYGYAPGVETTTGPLGQGITNAVGMAMAEKVLAHEFNKPGHSIVDHHTYVFLGDGCMMEGISHEACALAGTWKLNKLIAFWDDNGISIDGHIEHWYTDDTAKRFEAYGWQVIPNVDGHDVVAIEAAIQKAKASSDKPTLICCKTIIGKGSPNKAGTHDVHGAALGHDEVEATRKNMGWNSPAFEVPADIYAGWDAKTKGQGLETLWNNKFAEYKKAFPAEAAEFERRMKGELPANWKAHVAEKLAAINAKGETVATRKASQIAINALASALPEFLGGSADLTGSNLTNWEGCHPVRHGKPGNYISYGVREFGMAAIMNGMALHGGLLPFGGTFLMFSEYSRNAIRMAALMKQRVIHVFTHDSIGLGEDGPTHQPVEQTATLRMIPNIDVWRPCDTVETMVGWAHSVERTDGPTCHILSRQNLPFMQRDDATLASIAKGGYVLKDAAGAKAVIIATGSEVELAVKAADTLAAEGIAVRVVSMPSTNTFDRQDAAYRESVLPKGLPRVAVEAGVTDFWRKYVGLEGAVVGIDTFGESAPAPALFKHFGITAEAVAAAVKSVL

SEQ ID NO: 10028 - DNA, 1890 bp, Anabaena variabilis ATCC 29413
  CDS (1)..(1890): transl_table=11
atgactacccaagagcaactacaccaatggcatgaattagcgcaacaattgcgaatagatagtattcgcgccacaaccgtcgctggttcaggccaccccacttcttccatgtcctctgccgatttaatggcggtgttattaactaattatcttcactacgattttgacaatccacatcaccctaataacgatcgctttattctctctaaaggacacgctgcacccttactttacgccatgtataaagcggctggggtcatcaccgatgaggaattaatgtcattgcggcaaatgggtagccgtctggaaggtcatcccaccccagtattaccttgggtggatgtggcgactggttccttagggcaaggattacccatcggtgtggggttgggtttagctgggaagtatttagaccagctaccttataacgtctgggtgttgttaggtgacagtgaaacagccgaaggttctgtgtgggaagccttcgaccatgccgcacactacaccctagacaatctcattgccattatcgatgtcaaccgccttggtcaacggggtcagacagaattagggtggaatactcaagcctatgctaatcgtgccaaggcttttggttggcaagccatagaaatagatggtcacaatttgacggagattgaccaagcctttagtgcggcgattagtattaacgatcgccccaccgtcattattgcccgtaccaagaaaggtaaaggtgtagcgtctttggaagatttgggcgggtggcatggcaaagctttaaagcctgatgcagcaaaacaagcgatcgctgagttaggtggtgaacgtcacattactattcaagtagcccaacctgaaccaggacaacccacattactccacccccagcccttgcaactacccacttataaacaaggtgcagaagttgccacacgtcgcgcttatggtgacgctctcaaagccttaggcgcagcgcaacccgatgttgttgccctagatgcagaggtgagcaattccacttacaccgaagattttgccgaagcctacccagaaagatactttgaaatgtacattgccgaacagcaaatggttgcagctgctgttggcttgcaagtacgtcagtataaaccttttgctgcgaccttcgccgccttcttaactcgtgcctacgactttgtgaggatggcagccatctctcgcgccaatattaaattagttggttcccatgcgggtgtatccattggtcaagacggcccttcacaaatggcattggaagacttagcagcctttcgggctgtggggaatagtaccgtactttacccttgtgatgccaatcaaacagcgaaactagtagagcagatgagcgatcgccagggtattgtttatctccgcaccaccagagaaaatacaccagttatctacggaatcgaagaagagttttccatcggtggtagtaaagttattcgtagctctgaccaagaccaagctaccatcattggtgcaggtataactttacacgaagccatcaaagcaggcgatcgcctcaaaaacgaaggcattacagtacgcatcatcgatgcgtactccgttaaacccattgacgtacaaaccctgcatcaagcagccaatgacacagaaggcaatttagtagtcgtcgaagaccattggcaggaaggcggattaggtgcagccgtgttggatgcctttgcaggtattggggatctccctagctacgatggccccccactgcaactaattaagttagcagttcatcatatgcctggttccggtacgccagaagaattactccatgcagccaacattgatgctgatgccattgtagaagccgtgaaatctcaagtcagacatcttattggtaccagagtttaa

SEQ ID NO: 10029 - protein, 629 aa, Anabaena variabilis ATCC 29413
MTTQEQLHQWHELAQQLRIDSIRATTVAGSGHPTSSMSSADLMAVLLTNYLHYDFDNPHHPNNDRFILSKGHAAPLLYAMYKAAGVITDEELMSLRQMGSRLEGHPTPVLPWVDVATGSLGQGLPIGVGLGLAGKYLDQLPYNVWVLLGDSETAEGSVWEAFDHAAHYTLDNLIAIIDVNRLGQRGQTELGWNTQAYANRAKAFGWQAIEIDGHNLTEIDQAFSAAISINDRPTVIIARTKKGKGVASLEDLGGWHGKALKPDAAKQAIAELGGERHITIQVAQPEPGQPTLLHPQPLQLPTYKQGAEVATRRAYGDALKALGAAQPDVVALDAEVSNSTYTEDFAEAYPERYFEMYIAEQQMVAAAVGLQVRQYKPFAATFAAFLTRAYDFVRMAAISRANIKLVGSHAGVSIGQDGPSQMALEDLAAFRAVGNSTVLYPCDANQTAKLVEQMSDRQGIVYLRTTRENTPVIYGIEEEFSIGGSKVIRSSDQDQATIIGAGITLHEAIKAGDRLKNEGITVRIIDAYSVKPIDVQTLHQAANDTEGNLVVVEDHWQEGGLGAAVLDAFAGIGDLPSYDGPPLQLIKLAVHHMPGSGTPEELLHAANIDADAIVEAVKSQVRHLIGTRV

SEQ ID NO: 10030 - DNA, 2013 bp, Anabaena variabilis ATCC 29413
  CDS (1)..(2013): transl_table=11
atggctgttgcaacccaatccctcgaagaactttctattaatgcaattcgtttcttggctgttgatgccatagaaaaagcaaaatcgggacaccccggactaccgatgggcgcggctccaatggcttttgtgctgtggaaccgctttatgcggtataacccgaaaaatcccaaatggtttaaccgcgatcgctttgttttgtctgccggtcatggttccatgttgcagtatgccctgctctacctgacaggctacgatagcgtcagtattgaagatatcaagcaattccgccagtgggaatccaaaacccccggacacccagaaaacttcatgaccgcaggcgtagaagtcaccaccgggccactaggtcaaggtattgccaatggtgttggtttagcgctcgcagaagctcacctcgcagctaagttcaacaaacccgatgccaaaattgttgaccattatacttatgtaattttaggtgatggttgcaacatggaaggcgtttccggtgaagctgcctccctggctggacactggggattaggtaaactgatcgccctgtacgacgacaaccacatctctatcgatggttctacagatgtagcctttaccgaagatgtttcccagcgttttgaatcttatggctggcacgtcatccatgttaaagatggcaacaccgatttagaagcaattcataaagccattgaagaggcaaaagctgtcaccgataagcccaccttgattaaggtgacaaccattatcggttacggttcccccaacaaatctaatactgctggtgttcacggtgcagcattgggtggagacgaagtagccttaactcgtcaaaatctgggttggtcacacgacccatttgttgttcccgaagatgtcctcaactatacccgtaaagcagtagagcgcggtgcaggctacgaatctgactggaacaaaacctacgcagactacaaagctaaatatccccaagaagcagctgaatttgagcgtcacttaagcggcaaactggctgacggctgggataaggtattaccatcctacacccccgaagataaaggacttcccacccgtaagcattcagaaacctgcctcaacaaattggcggcggttctacctgaactcattggtggttcggctgacttgacccattccaacctcaccgaaatcaagggcaaaggcgacttccaaaaaggacaataccaaaatcccaacatccactttggtgtccgggaacatggtatgggcgcaatctgtaacggtattgcactgcatggttcgggattaattccctacggcgctactttcttaatcttcagtgattatatgcgcgctcccatccgcttgtctgccctgtctcaagccggtgcaatttgggtcatgacccacgactccatcggtcaaggtgaagacggccccacccaccaaccaattgaaactctggcttcactccgtgctattcctaacctgacagtaattcgtcccgccgacggtaatgaaacctccggcgcttacaaagtagcaattgagagagctaagaacaatgctcccactttgttggcgtttactcgtcaaaatgttcccaacttggcaggtacatcgattgataacgtagctaagggcggatacatagttgtagataccgatggcacaccagatttaatcctgattggtactggttcagaattgagcctctgtgtcaccgcagccgagaaacttaaagctgaaggcaagaaagttcgtgtagtttccttggctgcttgggatttatttgatgcccaagatgcagcttacaaagaatcagttctacctaaagctgtcaccaagcgtttagctgtagaagcggctagcagtttcggctggcacaaatatattggtagtgaaggcgatgttgtaactatagaccgcttcggtgcttctgctcctggcggcatttgtttggagaaatttggctttaccgttgataatgtattagctaaagctaaacaattgttgggttaa

SEQ ID NO: 10031 - protein, 670 aa, Anabaena variabilis ATCC 29413
MAVATQSLEELSINAIRFLAVDAIEKAKSGHPGLPMGAAPMAFVLWNRFMRYNPKNPKWFNRDRFVLSAGHGSMLQYALLYLTGYDSVSIEDIKQFRQWESKTPGHPENFMTAGVEVTTGPLGQGIANGVGLALAEAHLAAKFNKPDAKIVDHYTYVILGDGCNMEGVSGEAASLAGHWGLGKLIALYDDNHISIDGSTDVAFTEDVSQRFESYGWHVIHVKDGNTDLEAIHKAIEEAKAVTDKPTLIKVTTIIGYGSPNKSNTAGVHGAALGGDEVALTRQNLGWSHDPFVVPEDVLNYTRKAVERGAGYESDWNKTYADYKAKYPQEAAEFERHLSGKLADGWDKVLPSYTPEDKGLPTRKHSETCLNKLAAVLPELIGGSADLTHSNLTEIKGKGDFQKGQYQNPNIHFGVREHGMGAICNGIALHGSGLIPYGATFLIFSDYMRAPIRLSALSQAGAIWVMTHDSIGQGEDGPTHQPIETLASLRAIPNLTVIRPADGNETSGAYKVAIERAKNNAPTLLAFTRQNVPNLAGTSIDNVAKGGYIVVDTDGTPDLILIGTGSELSLCVTAAEKLKAEGKKVRVVSLAAWDLFDAQDAAYKESVLPKAVTKRLAVEAASSFGWHKYIGSEGDVVTIDRFGASAPGGICLEKFGFTVDNVLAKAKQLLG

SEQ ID NO: 10032 - DNA, 1986 bp, Streptococcus agalactiae A909
  CDS (1)..(1986): transl_table=11
atgacatttgacaccattgatcaattagcggttaatacagtccgcacgctttctattgatgctatccaagcagcaaattctgggcacccaggtcttcctatgggagctgcgcctatggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaatttcgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacatctcaatcatttacagaagatgttaaaggacgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatggatgggaatatccagactttactgttcctgctgaagttgcagatcgatttgcctcagatcttcaagcgcgtggtgcgaaggcagaagaggcatggaatgatctttttgctaaatatgaagttgagtatccagaattagcaactgaatacaaagaagcttttgctggccaagctgagacagttgaactgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaactacgctgggcgtaatatttggtttggtgtacgtgaatttgcaatggctgctgcaatgaatggaattgcgcttcacggtgggactcgtgtttatgggggtacgttctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactttaa

SEQ ID NO: 10033 - protein, 661 aa, Streptococcus agalactiae A909
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYGWEYPDFTVPAEVADRFASDLQARGAKAEEAWNDLFAKYEVEYPELATEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 10034 - DNA, 1986 bp, Streptococcus agalactiae A909
  CDS (1)..(1986): transl_table=11
atgacattcgatgcagttgaccagttggcagtaaacactgtccgtacgctttcaatggatgctatccaagcagctaattcaggccaccccggtttaccaatgggggcagctccaatggcttatgttctatggaataaatacatgaacattaatcctaaaacaagccgtaactggacaaacagagaccgttttattctttctgcaggacatggatctgcaatgctatacagcttattacatttagctggttacgacctttcaatcgatgatttgaaaaatttccgtcaatggggttcaaaaacgccaggacatcctgaagtcaatcatacagatggtgtagaagcaacaacaggaccgctaggacaaggtatcgcaaacgctgtaggtatggcaatggcagaagctcaccttgctgcaaaatacaacaaaccaggtttcaatatcgttgaccattatacttttgctttaaatggtgatggtgacttaatggaaggtgtcagtcaagaagtcgcaagtttagcaggtcacttaaaacttggaaaattaatcactttatatgattcaaatgacatttctctagatggccctacatctatggccttcactgaggatgttaaaggacgttttgaagcttatggatggcaacatatcctcgttaaagacggcaatgacttagatgctattgccaaagctatcgaagaggcaaaagctgaaactgaaaaaccaactattattgaagttaaaacaattattgtttttggatctgaaaaacaaggaacttcagcagttcatggtgccccacttggagcagaaggcattgtctttactaaaaatgcttacaaatggacctatgaagatttcatcgttcctgacgaagtgaaagctcgtttccaagaaggattacaagcacgtggtgaacaagctgaaaatgcttggaatgaactctttgcaaaatatgaagcggaatatccagaacttgctaaaggctataaagaagtcttttcaaatgaaccagtttcagtagaattagctgcgcatgaacttgggtcatcaaaagctagccgtgtttcaagtcaagaggctatccaacaaatctctgaacaagtcgcatcattctggggtggttcggcagacctttcagcctcaaacaacacaatggttaaagttgaaaaagacttccaaccaggtcaatatgaaggctgcaatatctggtttggtgtacgtgaatttgccatggcagctgcgatgaacggtattgctcttcatggtggtactcgcgtttatggtggtacattcttcgtcttctcaaactatctattacctgcagtacgtatggcagcactgcaaagcttaccaaccatgtatgtcatgacacatgactccattgccgttggtgaagacggtccaactcatgaaccaattgaacagttagcaagtgtccgttcaatgccaaacttgaacgtcattcgtccagcggatggtaatgaaaccaatgccgcatggaaacatgccttagcagaaatagataaaccaacaatgctagtgttaacacgacaaaacttgccagttcttgaaggaacaaaagaattagcagaagaaggtttaaataagggtgcttatatcttgtcagaagccaaaggcgaaatggatggtatcatcattgcgacgggatctgaagtaaaattagccatggatacacaggctgcgctagcagaagaagggatccatgttcgtgttgtatcaatgccatcacaaaatatctttgatgcgcaaagcgacgcttataaagaagagattttaccagccacaatcacaaaacgcttggcaattgaagcagcatcaagctttggttgggcaaaatatgtaggcttagctggcaaaaccttaaccattgacacatggggagcttcggcaccaggaaatcgtatctttgaagaatatggtttcacaacagaaaatgctacagtcctatataaagcattataa

SEQ ID NO: 10035 - protein, 661 aa, Streptococcus agalactiae A909
MTFDAVDQLAVNTVRTLSMDAIQAANSGHPGLPMGAAPMAYVLWNKYMNINPKTSRNWTNRDRFILSAGHGSAMLYSLLHLAGYDLSIDDLKNFRQWGSKTPGHPEVNHTDGVEATTGPLGQGIANAVGMAMAEAHLAAKYNKPGFNIVDHYTFALNGDGDLMEGVSQEVASLAGHLKLGKLITLYDSNDISLDGPTSMAFTEDVKGRFEAYGWQHILVKDGNDLDAIAKAIEEAKAETEKPTIIEVKTIIVFGSEKQGTSAVHGAPLGAEGIVFTKNAYKWTYEDFIVPDEVKARFQEGLQARGEQAENAWNELFAKYEAEYPELAKGYKEVFSNEPVSVELAAHELGSSKASRVSSQEAIQQISEQVASFWGGSADLSASNNTMVKVEKDFQPGQYEGCNIWFGVREFAMAAAMNGIALHGGTRVYGGTFFVFSNYLLPAVRMAALQSLPTMYVMTHDSIAVGEDGPTHEPIEQLASVRSMPNLNVIRPADGNETNAAWKHALAEIDKPTMLVLTRQNLPVLEGTKELAEEGLNKGAYILSEAKGEMDGIIIATGSEVKLAMDTQAALAEEGIHVRVVSMPSQNIFDAQSDAYKEEILPATITKRLAIEAASSFGWAKYVGLAGKTLTIDTWGASAPGNRIFEEYGFTTENATVLYKAL

SEQ ID NO: 10036 - DNA, 2046 bp, Pseudomonas fluorescens PfO-1
  CDS (1)..(2046): transl_table=11
atgccctcctttttccgtttcaatctattcacacccaggagatcagcgatgcctagccgtcgtgagcgtgccaacgccattcgtgccctcagcatggatgccgtgcaaaaagccaacagcggccatcccggtgcccctatgggtatggcagatatcgccgaagtgctttggcgcgactacctcaagcacaacccgagcaatccattgttcgccgaccgtgaccgctttgtgctgtccaacggccacggctcgatgttgatctactcgctgctgcacctgaccggttacgacctgtcgatcgacgatctgaagcaattccgtcaactgcacagccgtaccccgggtcacccggaattcggttacaccccgggcgttgaaaccaccaccggcccgctgggtcagggtctggccaacgccgtgggcttcgccttggcagaaaaagtcctgggcgcgcagttcaaccgtcctggccacaacatcgtcgaccaccacacctacgtgttcctgggtgatggctgcatgatggaaggcatttcccacgaagtcgcttccctggccggtaccctgggcctgggcaagctgattgccttctacgatgacaacggcatctccatcgacggcgaagtcgaaggctggttcaccgacgacacgccgaagcgtttcgaatcgtacaactggcaagtgatccgcaacgtcgacggtcacgacccggaagagatcaagaccgccatcgagaccgctcgcaagagcccgctgccgaccctgatctgctgcaagaccaccatcggtttcggttcgccgaacaagcaaggcaaggaagattgccacggcgccccgctgggtgacgcggaaatcgccctgacccgtcaggcgctgaactggaaccacggcccgttcgaaatcccggccgacatctatgccgagtgggatgccaaggaaaaaggccgcgccgccgaagccgagtgggatcagcgtttcgctgcctactccgccgcgttcccgaccgaagccaacgaactgatccgtcgcctgagcggcgagctgccggccgacttctccgagaaggccgatgcctacatcgctgaagtcgcggccaaaggcgaaaccatcgccagccgtaaagccagccagaacgccctgaacgcgttcggcccgctgctgccggaagtgctgggcggttcggctgacctggccggttccaacctgaccctgtggaaaggctgcaaaggcgtcagcgccgaagacgccagcggcaactacatgtactacggcgtgcgcgaattcggcatgaccgcgatcatgaacggcgttgccctgcacggcggtctggtgccttacggcgcgaccttcctgatgttcatggaatacgcccgcaacgccgtgcgcatgtccgctctgatgaagcagcgtgtgatccacgtctacacccacgactccatcggtctgggcgaagacggcccgacgcaccagccgatcgagcaactgaccagcctgcgcagcacgccgaacctcgacacctggcgtccagccgatgccgttgaatcggccgtggcctggaaaaacgctctggagcgcaaggacggcccgtcggcgctgatcttctcgcgtcagaacctgcagcaccaaacccgtgatgccggccagatcgccgacatccgtcgtggtggttatgtgctgaaggactgcgcaggcgagcctgagctgattctgatcgccaccggttcggaagttggtctggccgttcaggcctacgacaaactcaccgagcagggccgcaaggtgcgcgtggtttccatgccatgcaccagcgcgttcgacgctcaggacgccagctacaagcaatcggtcctgccgttgcaggttggcgcgcgtatcgcgatcgaagcggctcacgccgacttctggttcaagtacgtgggtctggaaggtcgcgtgatcggcatgaccacctacggcgaatcggctccggcttcggcactgttcgaagagttcggcttcaccctggaaaacatcctgggtcaggctgaagagctgctggaagactga

SEQ ID NO: 10037 - protein, 681 aa, Pseudomonas fluorescens PfO-1
MPSFFRFNLFTPRRSAMPSRRERANAIRALSMDAVQKANSGHPGAPMGMADIAEVLWRDYLKHNPSNPLFADRDRFVLSNGHGSMLIYSLLHLTGYDLSIDDLKQFRQLHSRTPGHPEFGYTPGVETTTGPLGQGLANAVGFALAEKVLGAQFNRPGHNIVDHHTYVFLGDGCMMEGISHEVASLAGTLGLGKLIAFYDDNGISIDGEVEGWFTDDTPKRFESYNWQVIRNVDGHDPEEIKTAIETARKSPLPTLICCKTTIGFGSPNKQGKEDCHGAPLGDAEIALTRQALNWNHGPFEIPADIYAEWDAKEKGRAAEAEWDQRFAAYSAAFPTEANELIRRLSGELPADFSEKADAYIAEVAAKGETIASRKASQNALNAFGPLLPEVLGGSADLAGSNLTLWKGCKGVSAEDASGNYMYYGVREFGMTAIMNGVALHGGLVPYGATFLMFMEYARNAVRMSALMKQRVIHVYTHDSIGLGEDGPTHQPIEQLTSLRSTPNLDTWRPADAVESAVAWKNALERKDGPSALIFSRQNLQHQTRDAGQIADIRRGGYVLKDCAGEPELILIATGSEVGLAVQAYDKLTEQGRKVRVVSMPCTSAFDAQDASYKQSVLPLQVGARIAIEAAHADFWFKYVGLEGRVIGMTTYGESAPASALFEEFGFTLENILGQAEELLED

SEQ ID NO: 10038 - DNA, 2019 bp, Rhodobacter sphaeroides 2.4.1
  CDS (1)..(2019): transl_table=11
gtggacatacagagcctgcgcgagcagcatcccgatcactggaagaaggcctgcgccatccgcgcgctgacgctcgacgccgtggcagccgccaattccggtcactccggcatgcccatgggcatggccgacgtggccaccgtgctctacgagaagcacatggtgttcgacgcccggtcccccgactggccgaaccgcgaccggttcgtactgtcggccggccacggctccatgctggtctatgcgctcctgcatctcacgggcgatcccgaattcccgatcgagcagatccgcaacttccgccagtggggctcgaagaccgcgggccaccccgagaacttccttgccaagggcatcgagaccaccaccggcccgctcggccaggggcttgcgatgtccgtgggcctcgccatggccgaagagtcgctccgcgcccgctggggcgcgaagatcatcgaccattacacctactgcatcgccggtgacggctgcctgatggagggcgtgagccaggaggcgatcggcctcgccggccgccacgagctctcgcatctcatcgtgatgtgggacaacaacggcatcaccatcgacggcaaggtctcactctcggaccgcaccgaccagaaggcgcgcttcgccgccgcgggctgggacgtgttcgaatgcgacgggcacgatccggccgacatcgaccgcgccctgaccgcggccaaggcgtcgaagggcccggccttcatcgcctgcaccacccatatcgcgctcggatcctcggcgcaggacacgtcgaagggccatggtgcgctgaccgatgccaagctcatcgccgacaccaaggccgcctacggctggacctccgccgccttcgagatcccggccgacgtcaagaaagcctgggaagccatcggcgcccgcggcgccgaggcccgcaaggcctgggacgagcgtctggcagccctctcggatggcaagcgcgccctcttccagcagcagttctcctgcgagccgccgaagaagctcgcctccgccatccgcgcggtgaagaaggatgcggtcgagaagatgccgaaggtcgcgacccgccgcgcctcggaaatggtgctcgaggccgtgaacccggtcatgcccgagaccatcggcggctcggccgaccttaccggctcgaacaacaccaagaccgccgatctcggcgtcttcgatccgatcaaccgcaagggccgctacgtctattacggcatccgcgagcacgggatggccgcggccatgaacggcatggcactgcacggcggcctccggccctacggcggcaccttcatgtgcttcgccgattactgccgtccggcgatccgcctctcggcgctgatgcacatgcccgtggtctatgtcttcacccacgattccatcggtctgggcgaggacggcccgacgcaccagccggtcgagcatctggccatgctgcgcgccacgcccaacatgatggtgttccgcccggccgacctcgtcgagaccgccgaggcctgggagatcgcgctcggcgccaaggccacgccctcggtgctggccctctcgcggcagaacctgcccgcggtgcgcaagaaccacaccaacaagaacctcgtggcgcagggcggctacgtcctcgaagaggccacgggcaagcgtcaggtcatcctgatcgcctcgggctcggaggtcgaggtcgcgctgaaggcccgcgaggcgctcgaggccgacggcatcggcacccgcgtcgtctccatgccctgcatggagctcttcgcgcagcaggacgaggcctaccgccgcaaggtcctgcccgcgggcgcggtccgcatcgccatcgaggcgggtgtgcgcatgggctgggaccgctggcttctgggcgagcgcggccgcgaaggcaaggacggcttcgtcggcatgaccggcttcggcgcctcggccccggccgagcggctgttccaggagttcggcatcacctacgaggcgaccgtggcgaaggccaaagcccttctgggctga

SEQ ID NO: 10039 - protein, 672 aa, Rhodobacter sphaeroides 2.4.1
MDIQSLREQHPDHWKKACAIRALTLDAVAAANSGHSGMPMGMADVATVLYEKHMVFDARSPDWPNRDRFVLSAGHGSMLVYALLHLTGDPEFPIEQIRNFRQWGSKTAGHPENFLAKGIETTTGPLGQGLAMSVGLAMAEESLRARWGAKIIDHYTYCIAGDGCLMEGVSQEAIGLAGRHELSHLIVMWDNNGITIDGKVSLSDRTDQKARFAAAGWDVFECDGHDPADIDRALTAAKASKGPAFIACTTHIALGSSAQDTSKGHGALTDAKLIADTKAAYGWTSAAFEIPADVKKAWEAIGARGAEARKAWDERLAALSDGKRALFQQQFSCEPPKKLASAIRAVKKDAVEKMPKVATRRASEMVLEAVNPVMPETIGGSADLTGSNNTKTADLGVFDPINRKGRYVYYGIREHGMAAAMNGMALHGGLRPYGGTFMCFADYCRPAIRLSALMHMPVVYVFTHDSIGLGEDGPTHQPVEHLAMLRATPNMMVFRPADLVETAEAWEIALGAKATPSVLALSRQNLPAVRKNHTNKNLVAQGGYVLEEATGKRQVILIASGSEVEVALKAREALEADGIGTRVVSMPCMELFAQQDEAYRRKVLPAGAVRIAIEAGVRMGWDRWLLGERGREGKDGFVGMTGFGASAPAERLFQEFGITYEATVAKAKALLG

SEQ ID NO: 10040 - DNA, 1974 bp, Rhodobacter sphaeroides 2.4.1
  CDS (1)..(1974): transl_table=11
atgaaggacattggagccgcgcaggagacgcggatggcgaacgccatccgggccctcgcgatggatgcggtggagaaggccaagtcgggccatcccgggatgccgatggggatggcggacgtggcgaccgtcctcttcaaccgctttctcacggtcgatccttcggcgcccaaatggcccgaccgcgaccggttcgtgctgtcggcggggcatggctcgatgctgctctatgccatccatcatctgctgggctatgccgatatggacatggatcagatccggtccttccgccagctcggcgcgcggacggcgggccacccggaatacggccatgccgaggggatcgaggtcacgaccgggccgctcggtcaggggatcgcgaccgcggtgggcatggcgctggccgagcgcatgaagaacgcgcgctatggcgatgatctggtggaccatttcacctatgtcatcgcgggtgacggctgcctgatggagggcatctcgcacgaggccatcgacatggcgggtcatctgggcctcggccggctgatcgtgctgtgggacgacaaccgcatcaccatcgacggcgacacgggcatctcgacctcgaccgaccagaaggcgcggttcgccgcctcgggctggcatgtgctggcctgcgacggtcatgcgcccgaggagatcgccgccgccatcgaggccgcacggcgcgacccccggccctcgatgatcgcctgccgcacggtgatcggctacggcgcgccgaacaagcagggcggccacgatgtccatggcgcgccgctgggcgcggccgagatcgcggcggcgcgcgagcggctcggctgggaccatccgcccttcgagatccccgcggatctctacgaggcctggggccggatcgccgcccgcggcgccgacgcccgcgcggcctgggaaacacgccttcaggcgagccccctccgcgccgccttcgagacggcggaggcggccgacacctcggcgctgccgccggccatcgcggcctacaaggcgcggctctcggccgaggcgcccaaggtcgcgacccgcaaggcctcggaaatggcgctgggtgtggtcaacgaggcgctgcccttcgcggtcggcggctcggccgacctgacgggctcgaacctgacccgctcgaagggcatggtctcggtcgcgccgggcgccttcgcgggcagctatatccattacggcatccgcgagcacggcatggccgccgcgatgaacgggatcgcgctgcatggcggcctgcgcccctacggcggcaccttcatggccttcgccgactattgccggccctcgatccggctctcggcgctgatgggcgtgccggtgacctatgtcatgacgcacgattccatcgggctcggcgaggatgggcccacgcaccagccggtcgagcatctggcgagcctgcgggcgatcccgaaccttgcggtgatccggcctgcggatgcggtcgagaccgccgaggcctgggagatcgccatgacggcgacatccacgcccacgcttctggtgctgtcgcgccagaacctgcccacggtgcggaccgaacatcgggacgagaacctgaccgcgcgcggcgcctatctcctgcgggatccgggcgagcgacaggtgacgctgatcgcgaccggctcggagctggagctggcgctggccgcggcggatcttctggccgcggaaggcatcgccgccgccgtggtctcggcgccctgcttcgagctcttcgccgcgcagccggcggactaccgggcgacggttctgggacgggccccgcgtgtgggatgcgaggcggcgctgcggcaggggtgggatctcttcctcggaccgcaggacgggttcgtgggcatgacgggcttcggcgcttcggcgcccgcgcccgcactctatcaacatttcaacatcaccgctgaagccattgtcaaatcggcaaaagaacggatctga

SEQ ID NO: 10041 - protein, 657 aa, Rhodobacter sphaeroides 2.4.1
MKDIGAAQETRMANAIRALAMDAVEKAKSGHPGMPMGMADVATVLFNRFLTVDPSAPKWPDRDRFVLSAGHGSMLLYAIHHLLGYADMDMDQIRSFRQLGARTAGHPEYGHAEGIEVTTGPLGQGIATAVGMALAERMKNARYGDDLVDHFTYVIAGDGCLMEGISHEAIDMAGHLGLGRLIVLWDDNRITIDGDTGISTSTDQKARFAASGWHVLACDGHAPEEIAAAIEAARRDPRPSMIACRTVIGYGAPNKQGGHDVHGAPLGAAEIAAARERLGWDHPPFEIPADLYEAWGRIAARGADARAAWETRLQASPLRAAFETAEAADTSALPPAIAAYKARLSAEAPKVATRKASEMALGVVNEALPFAVGGSADLTGSNLTRSKGMVSVAPGAFAGSYIHYGIREHGMAAAMNGIALHGGLRPYGGTFMAFADYCRPSIRLSALMGVPVTYVMTHDSIGLGEDGPTHQPVEHLASLRAIPNLAVIRPADAVETAEAWEIAMTATSTPTLLVLSRQNLPTVRTEHRDENLTARGAYLLRDPGERQVTLIATGSELELALAAADLLAAEGIAAAVVSAPCFELFAAQPADYRATVLGRAPRVGCEAALRQGWDLFLGPQDGFVGMTGFGASAPAPALYQHFNITAEAIVKSAKERI

SEQ ID NO: 10042 - DNA, 2073 bp, Burkholderia sp. 383
  CDS (1)..(2073): transl_table=11
atgccgccgtgcccccgtttcctcgactcgttctccggactcgacatgacgacttcgtctcccgcctccaccaccctgatggccaacgcgatccgtgcgctcgcaatggacgccgtccagcaagcgaactccggccaccccggcatgccgatgggcatggccgaaatcggcgtcgcgctctggtcgcgccatctgaagcacaacccgacgaacccgcactgggcggaccgcgaccgcttcgtgctgtcgaacggccatggctcgatgctgctgtactcgctgctgcacctgaccggctacgacctgccgatggaagagctgaagaacttccgccagctgcactcgaagacgccgggccacccggaatacggcatcacgccgggcgtcgagacgaccaccggcccgctcggccaggggctcgcgaacgcggtcggcatggcgctcggcgaagcgctgatggccgacgagttcaaccgcgacggcgcgaagatcgtcgatcaccacacgtacgtgttcctcggcgacggctgcctgatggaaggcatctcgcacgaagcctgctcgctcgccggcacgctgaagctgaacaagctgatcgcgctgtacgacgacaacggcatctcgatcgacggcgacgtcgtgaactggttccacgacgacaccccgaagcgtttcgaagcctacggctggaacgtgatcccgcacgtgaacggccatgacgtcgacgcggtcgacgcagccatcgcaaaggcgaagctgtcggacaagccgacgctgatctgctgcaagacggtgatcggccagggcgcggcgaccaaggccggcggccacgacgtgcacggcgcggcgctcggcgcggaagaaatcgcgaagacgcgcgaagcgctcggctggacgtgggcaccgttcgtgattccgcaggaagtctatgcggcatgggacgcgaaggaagccggcaagcgcgcggaaaccgaatgggatgcgacgttcgctgcttatcgcgccaagttcccggcagaagccgctgaattcgagcgccggatggccaaccagctgccggccgactgggccgaaaaggctgcggcgatcatcgccggcgcgaacgagcgcggcgagacggtggcgacccgcaaggcgtcgcagcaggcgatcgaaggcctggctgccgcgctgcccgagctgctcggcggctcggccgacctgaccggctcgaacctgaccaactggaaggcgtcgaaggccgtccgtgcgaatccggaaggcccgggcgtccagctgggcaaccacatcaactacggcgtgcgcgaattcggcatgagcgccgcgatcaacggcctcgcgctgcatggcggccacaagccgttcggcggcacgttcctgacgttctccgactacagccgcaacgcgctgcgcgtggctgcgctgatgaaggtgccgtcgatcttcgtgttcacgcacgattcgatcggcctcggcgaagacggcccgacgcaccagtcgatcgagcacgtgtcgagcctgcgcctgatcccgaaccacgacgtgtggcgcccggccgacacggtcgagacggccgtcgcatggacccacgcgatcgccgccgaccgtccgtcgagcctgatcttcagccgccagaacctcgcgttcaacccgcgtaccgatgcgcagatcgcgaacatcgagaagggcggttacgtgctgaaggactgggacgaagagatcgtcgcgcgcaagatcatcctgatcgcgacgggctcggaagtcgaactcgcgatgaaggccatcgagccgctcgcgcagcaaggtatcgcggcacgtgtcgtgtcgatgccgtcgaccaacgtgttcgaccgccaggacgccgaataccgtgaacgcgtgctgccgcacggcgtgcgccgcgtcgcgatcgaagcgggcgtgaccgccttctggcacaagtacgtcggcctcgaaggcggcgtcgtcgggatcgacacgttcggtgaatcggcgccggccggcgtgctgttcaagtacttcggcttcaccgtcgagcacgtcgtcgagaccgccaaggccgtgctggcctaa

SEQ ID NO: 10043 - protein, 690 aa, Burkholderia sp. 383
MPPCPRFLDSFSGLDMTTSSPASTTLMANAIRALAMDAVQQANSGHPGMPMGMAEIGVALWSRHLKHNPTNPHWADRDRFVLSNGHGSMLLYSLLHLTGYDLPMEELKNFRQLHSKTPGHPEYGITPGVETTTGPLGQGLANAVGMALGEALMADEFNRDGAKIVDHHTYVFLGDGCLMEGISHEACSLAGTLKLNKLIALYDDNGISIDGDVVNWFHDDTPKRFEAYGWNVIPHVNGHDVDAVDAAIAKAKLSDKPTLICCKTVIGQGAATKAGGHDVHGAALGAEEIAKTREALGWTWAPFVIPQEVYAAWDAKEAGKRAETEWDATFAAYRAKFPAEAAEFERRMANQLPADWAEKAAAIIAGANERGETVATRKASQQAIEGLAAALPELLGGSADLTGSNLTNWKASKAVRANPEGPGVQLGNHINYGVREFGMSAAINGLALHGGHKPFGGTFLTFSDYSRNALRVAALMKVPSIFVFTHDSIGLGEDGPTHQSIEHVSSLRLIPNHDVWRPADTVETAVAWTHAIAADRPSSLIFSRQNLAFNPRTDAQIANIEKGGYVLKDWDEEIVARKIILIATGSEVELAMKAIEPLAQQGIAARVVSMPSTNVFDRQDAEYRERVLPHGVRRVAIEAGVTAFWHKYVGLEGGVVGIDTFGESAPAGVLFKYFGFTVEHVVETAKAVLA

SEQ ID NO: 10044 - DNA, 2010 bp, Synechococcus sp. CC9605
  CDS (1)..(2010): transl_table=11
atggtcgctgcgcccgcgtcactcgacacgctctgcatcaacagcattcggatgctggctgtcgacgccatcaacaagtccaacagcggtcaccccggcctgccgatgggctgcgcacccatgggttatgcgctctgggacaagttcctcaatcacaacccgaagaaccccaagtggttcaaccgcgaccgcttcgttctgtccgccggtcacggctgcatgctgctctacgcactgctgcacctcaccggttacgactcagtgtccattgaggacatcaagcagttccgccagtggggctccaagactccgggccaccccgaaaccttcgaaactcccggcgttgaagtaactacgggccccctgggtgccggcatctccaacgctgtgggcctggccatcgctgaatcccacctggcggccaagttcaacaaggccgacgccaccgtggtggatcactacacctacgtgatcatgggcgacggctgcaatcaggagggtgtgtcctccgaagctgcctccctggccggtcacctgaagctgggcaagctgatcgccctgtacgacgacaacagcatcaccatcgacggccgcaccgacgtgtccttcaccgaggacgtgctgaagcgctacgaggcctacggctggcacgttcagcacgtggccgaaggcaacaccgatgtggatgccatcgccaatgcgatcgaagcggccaaggccgtgaccgacaagccatcgatcatcaaggtgaccaccaccatcggctacggctcccccaacaaggccgataccgccggtgtccacggtgctgccctgggtgaagaggaagccgctctgacccgtcagcaactgggttgggactacgcccccttcgaaattccccaggacgcctacgaccagttccgccaggccatcgaccgcggcgccagcctcgaggccgagtggaaccagaccctggccacttaccgcaccaagtaccccaccgaagccgccgagttcgagcggatgctgcgcggtgagctgcccgagggttgggacaaggaactgcccacctacacccccgaagacggtggcctggccacccgcaagcactcccagatctgccttggtgctctgggccccaacctgcccgaactgatcggcggctccgctgacctcacccactccaactacacggacatcaagggtgaaaccggctcttatcaagccagcagccccgagaagcgctacctgcacttcggtgtgcgcgagcacgccatggccgccatcctcaacggcatcgcttaccacaacagcggcttgatcccctacggcggcaccttcctggtcttcgccgactacatgcgcggttccatgcgcctttcagccctgagtgagctgggtgtgatttatgtgttgacccacgactccatcggtgttggcgaagacggcccaacccaccagccaatcgaaaccatcccctccctgcgggcgatgccgaacatgctggtgttccgccctggcgacggcaatgagaccagcggtgcctacaaggtggccatccagaaccgcaagcgccccagctccctctgcctcagccgccaaggcatggccaaccaggccaactcctcgatcgacaaggtggccctcggcggttacgtgcttgaagattgcgccggcacccctgatctgatcctgatcggcaccggcaccgagcttgatctctgcgtccaggccgccaagcagctcaccgccgaaggcaagaaggtgcgcgtagtgtcgatgccctgcgtcgagctgttcgacgagcagaccgacgcctacaaggaagaggtgctccccaacgccgcgcgcaagcgcatggtggtggaagccgctgaatccttcggctggcaccgtttcatcggcctcgatggcgacagcgtgaccatgaaccgcttcggcgcttccgcccccggcggcacctgcctcaaggaattcggtttcacagtggagaacgtggtggccaaagccaaggctctgctcggctga

SEQ ID NO: 10045 - protein, 669 aa, Synechococcus sp. CC9605
MVAAPASLDTLCINSIRMLAVDAINKSNSGHPGLPMGCAPMGYALWDKFLNHNPKNPKWFNRDRFVLSAGHGCMLLYALLHLTGYDSVSIEDIKQFRQWGSKTPGHPETFETPGVEVTTGPLGAGISNAVGLAIAESHLAAKFNKADATVVDHYTYVIMGDGCNQEGVSSEAASLAGHLKLGKLIALYDDNSITIDGRTDVSFTEDVLKRYEAYGWHVQHVAEGNTDVDAIANAIEAAKAVTDKPSIIKVTTTIGYGSPNKADTAGVHGAALGEEEAALTRQQLGWDYAPFEIPQDAYDQFRQAIDRGASLEAEWNQTLATYRTKYPTEAAEFERMLRGELPEGWDKELPTYTPEDGGLATRKHSQICLGALGPNLPELIGGSADLTHSNYTDIKGETGSYQASSPEKRYLHFGVREHAMAAILNGIAYHNSGLIPYGGTFLVFADYMRGSMRLSALSELGVIYVLTHDSIGVGEDGPTHQPIETIPSLRAMPNMLVFRPGDGNETSGAYKVAIQNRKRPSSLCLSRQGMANQANSSIDKVALGGYVLEDCAGTPDLILIGTGTELDLCVQAAKQLTAEGKKVRVVSMPCVELFDEQTDAYKEEVLPNAARKRMVVEAAESFGWHRFIGLDGDSVTMNRFGASAPGGTCLKEFGFTVENVVAKAKALLG

SEQ ID NO: 10046 - DNA, 2007 bp, Geobacter metallireducens GS-15
  CDS (1)..(2007): transl_table=11
atgtcagcaccagtacttaccagcgaagacgcccgcctcggcgccgataccctcagaatgctggcggtggacgccgtggaggcggccaactcgggccatcccgggctccccatgggggctgcggactatgccttcctcctctggcattcccaccttcgctttgcccccaccgacccggaatgggccggacgggaccgcttcgtcctctcggcggggcacggctccatgctcctctatagcctcctccacctcttcggctttgacctccccctggacgagctgaaacggttccgccagtgggggagccgcaccccgggccacccggagttcggccacacccccggcgtcgaggtgaccaccggccccctggggcaggggttcgccatgggggtcggcatggccctggcggcccggatggcctctgcccgctttgccgacgagcgcttcgacccgtgcggccaccaggtctacgccatcgtgagcgatggggacctcatggagggaatcagccaggaggcggcctccctggcgggacacctgaagctcggcaacatcgtttatatctacgacgacaaccggatcaccatcgaggggtccacggatctcgccttttcggatgatacggccggacgcttcacggccctggggtggcaggtgcagaaggtggacggccacgatatcggccaggtgggggaggccctctggcgggccaaggtggagcgggaccgcccctccctcatcattgcccggacccacatcgcccagggctcgccgggaaagcacgacacggccgccgcccacggctcccccctgggcgccgaagaggcggccgccacccgcaggaatcttgggtggcccgatgaactgttccacgtgccggagcgggtgcgtgagatctgcgacaagcgtcgggaggagcttgtcgcggcctacgccgcctgggaggatgagttccgccgctggcgccgccgcaaccccgacaaggcccggctctgggacggcatgtggcagaaggcgatcccgaaagacctggaaacccggctcctagccgccgttgaggggagtaccggcgccacccgcgccctgtcgggaaaggtgatccaggccgcggccgcggcaatgccggccctggccggcggctccgccgacctggaaccctccaccaacacctggatcgcggaatcaccgtcggtgcttgcggggagctacagggggcggaacctccacttcggcatccgtgagcacgccatggccgccgtcatgaacggcatggcccgctacggctgcttcatcccctacggcgccaccttcctggtcttctccgactactgccggccaagcatccggctcgcggccctcatgaagcagcaggcgatctacgtcttcacccacgactcgatcttcctgggggaggacggccccacccaccagccggtggagcagctctcgtcgctgcggctcattcccaatctccgggtcatccgccccgccgacggccccgagacggccctggcctggaacgcggccctgcgccgcgccgacggccccacggccctcatcctcacccgccagaaggtgccggccatcatgcgggaggaaccactggatgcgaaaaccttcgccaagggggggtacgcggtccggcaagacggggcaacgcccgacgtggtcatcatggcaagcggttccgaggtggggctggccctggccgcggcagatatcctggccggcgaaggggtgacggcccgggtagtgtcggtcccctctctcgaaaccttcctggcccagcccgaggcgtaccggcgccggctcctgccgggccgcgtcccccgggtggcggtggaggcagggcacggcggcctctggtggcgactcctcggcccggggggcctcttcatcggcatggagggcttcggtgcctcggccccggaaaaggtccttgccgagcagttcggcttcaccccgccccaagtggcccagcgggtaagagagctcgtggggcgctag

SEQ ID NO: 10047 - protein, 668 aa, Geobacter metallireducens GS-15
MSAPVLTSEDARLGADTLRMLAVDAVEAANSGHPGLPMGAADYAFLLWHSHLRFAPTDPEWAGRDRFVLSAGHGSMLLYSLLHLFGFDLPLDELKRFRQWGSRTPGHPEFGHTPGVEVTTGPLGQGFAMGVGMALAARMASARFADERFDPCGHQVYAIVSDGDLMEGISQEAASLAGHLKLGNIVYIYDDNRITIEGSTDLAFSDDTAGRFTALGWQVQKVDGHDIGQVGEALWRAKVERDRPSLIIARTHIAQGSPGKHDTAAAHGSPLGAEEAAATRRNLGWPDELFHVPERVREICDKRREELVAAYAAWEDEFRRWRRRNPDKARLWDGMWQKAIPKDLETRLLAAVEGSTGATRALSGKVIQAAAAAMPALAGGSADLEPSTNTWIAESPSVLAGSYRGRNLHFGIREHAMAAVMNGMARYGCFIPYGATFLVFSDYCRPSIRLAALMKQQAIYVFTHDSIFLGEDGPTHQPVEQLSSLRLIPNLRVIRPADGPETALAWNAALRRADGPTALILTRQKVPAIMREEPLDAKTFAKGGYAVRQDGATPDVVIMASGSEVGLALAAADILAGEGVTARVVSVPSLETFLAQPEAYRRRLLPGRVPRVAVEAGHGGLWWRLLGPGGLFIGMEGFGASAPEKVLAEQFGFTPPQVAQRVRELVGR

SEQ ID NO: 10048 - DNA, 1995 bp, Desulfovibrio desulfuricans G20
  CDS (1)..(1995): transl_table=11
atggcttcccgcaaggatcttgccaacgctatccgcgcactcagcatggacgccgtggaaaaggccaaatcaggccaccccggtgcgcccatgggtatggccgacatggccgaagttctgtggaacgatttcatgaagcataaccccgccaaccccggctgggcagaccgcgaccgcttcgtgctttccaacggacacggttccatgcttatttattcgctgctgcacctttccggctacgatctcagcatcgacgacatcagaaatttccggcagctgcattccaaaactccgggccaccccgaatacggcgtgacccccggcgtggaaaccaccaccggcccgctggggcagggcatcgccacggccgtgggcatggccatggcagaacgcatgctggccgaagccttcaaccgcgacggattcaccgttgtcgatcaccacacctatgtgtttctgggtgacggctgcatgatggaaggtctgtcgcatgaagcctgctctctggccggtacgctgggcctgggcaagcttgtggcgctgtacgatgataacggcatttccattgacggtcgtatcgacagctggttcggcgatgatacccccgcccgtttccgtgcctacggctggcatgtggtggccggtgtggacggacacgatgccgaagccgtgcgcaaagccattgaagaagccagagcagaaacaggacgtcccagcctgatctgctgcaagaccaagataggcatgggcgcccccaatatggctgattccagcaaagtgcacggtgcgccgctgggtgcggatgaaatagccgccacccgcgccaacataggttggaatcatcctccgttcgagattccggccgatgtgtatgcaggttgggacgcacggcccagaggcgctgccgcccagcaggtatgggatgacatgtttgctgcttatgccgcagcacaccctgcgcttgccgcggaattcacccgccgcatggcaggcgatctgcccgaaggctggaaggagctttgcgaaaaagcactggcgcagattgtggccgctgccgaaaaccttgccacccgcaaggcctgcaacaaatcgcttgaagccatcggccctgcgctgcccgaaatggtgggcggttccgccgaccttaccggctccgtaggtaccaaatggagtggcagcaggctgctggacagcgccaactggggcggcaactatatttcctatggtgtgcgtgagttcgccatgggtgccatcatgaacggcctgaccctgcatggcggcttcctgccttacgccggtacgttcctcattttctccgattacgccaaaaatgcgttccgtctttccgcgctgatgggcatccgcaccgtctgggtgctgacgcacgactccatcggtgtgggcgaagacggccccacgcaccagccggtggaacagctggccggtctgcgtcttattcccggggctcatgtgtggcgcccctgcgataccgtggaaactcaggttgcctggcagagtgccgttgaatacaaaaacggccccacagcgctgtcgtttacgcggcagggtgtgcctttcatgcagcgtgatgatgccgcagtgcggaacatcgcccgcggcggttatgtgctgcgtgactgcgagggtaccccggaagtcatccttatcgccaccggttcggaagtgggcgtggccgccggagcctgcgacaggctgacagccgaaggccgcagggtacggcttgtttccatgccgtgcagcaatatcttcgaccggcaggacgccgcctaccgtgaatcggtactgcccgcagctgttgaggcccgtgtggccgttgaagccgccgcttctgacttctggtggaaatacgtggggctgaaaggccgcgtggtgggtatgaccacctttggcgaatccgcccccggcaaggtgctgttcgaacacttcggctttacggcagacaatgtggctgccgtggcaaaagaagtgctgtag

SEQ ID NO: 10049 - protein, 664 aa, Desulfovibrio desulfuricans G20
MASRKDLANAIRALSMDAVEKAKSGHPGAPMGMADMAEVLWNDFMKHNPANPGWADRDRFVLSNGHGSMLIYSLLHLSGYDLSIDDIRNFRQLHSKTPGHPEYGVTPGVETTTGPLGQGIATAVGMAMAERMLAEAFNRDGFTVVDHHTYVFLGDGCMMEGLSHEACSLAGTLGLGKLVALYDDNGISIDGRIDSWFGDDTPARFRAYGWHVVAGVDGHDAEAVRKAIEEARAETGRPSLICCKTKIGMGAPNMADSSKVHGAPLGADEIAATRANIGWNHPPFEIPADVYAGWDARPRGAAAQQVWDDMFAAYAAAHPALAAEFTRRMAGDLPEGWKELCEKALAQIVAAAENLATRKACNKSLEAIGPALPEMVGGSADLTGSVGTKWSGSRLLDSANWGGNYISYGVREFAMGAIMNGLTLHGGFLPYAGTFLIFSDYAKNAFRLSALMGIRTVWVLTHDSIGVGEDGPTHQPVEQLAGLRLIPGAHVWRPCDTVETQVAWQSAVEYKNGPTALSFTRQGVPFMQRDDAAVRNIARGGYVLRDCEGTPEVILIATGSEVGVAAGACDRLTAEGRRVRLVSMPCSNIFDRQDAAYRESVLPAAVEARVAVEAAASDFWWKYVGLKGRVVGMTTFGESAPGKVLFEHFGFTADNVAAVAKEVL

SEQ ID NO: 10050 - DNA, 2007 bp, Prochlorococcus marinus str. MIT 9312
  CDS (1)..(2007): transl_table=11
atggttgctgcatctgtttcaatagaatcactctgtgtaaatagtataagaatgcttgctgtagatgcagtaaataaatctaatagtgggcatcctggtttaccaatgggatgtgctcctatgggttatgcactatggcaaaacatactaaatcacaaccccaataatccaaaatggtttaatagagatcgttttgtattatcagctggtcatggctgtatgttgttatattccttgcttcatctaacaggatacaaatcagtttccatagaagatattaaagaatttagacaatggggatcaaaaactcctggtcatccagaaacattcgaaactgagggagttgaagttacagctggacctctcggagctggtatttctaatgcagttggtttagcaatagctgaaactcacttagcagccaaattcaataagcctgattgcaatatcgttgatcattatacttacgtcataatgggtgacggctgtaatcaagaaggtatcgcatcagaggcttgctcattagctggtcaccttaagcttggaaaattaattgcgctctatgacgataatcaaattacaattgatggacgtacagatgtctctttcactgaagatgttttaaaaagatacgaagcttatggatggcatgtacaacatgttgaagatggtaatcatgatgttaaaggaataactgaagctatcgaaaaagcaaaatcaattacaaacaaaccttctattataaaaatctctacaacaataggttatggttctcctaataaatcagatactgcaggaattcatggtgcagctgttggagaagaagaagcttcattaaccagagagtttttaaattgggaatatcctccatttgaaattccagatgaagtatataaacatttcagaaaatcaatagacaagggcgaaaacttagagaaagaatgggattctagatttgaagaatatcagaaaaaatatccctctgaaggagccgaattaaaaagaatgttaaaaggccaattacctgagaattgggattcagatctcccatcttatacacctaatgataaaggtttagctaccagaaagcattcacaaatatgtttaggtgctctaggtcctaacctaccagaattaattggtggatcagcagatttaactcactctaactatacagatatcaaaggagaaacaggatcattccagcctcatagtcctgaaaaaagatatttacattttggagtaagagagcatgcaatggcagcagtacttaatggtattgcatatcacaatagcggtcttataccctatggtggaaccttccttgttttcgcggattatatgagaggttcaatgagactttcagcacttagcgaattaggagttatctatgtattaacccatgattcaattggtgtaggcgaagatggtccaacacatcaacctattgaaactatcccttctcttcgagccatgcctaacatgctagttttcagaccaggagatggaaatgagacgagtggagcttataagcttgctattaaaaatcgcaaaagaccttctgccctttgtttaagtagacaaggtatgcctaatcaagaaaacacttcaattgaaaaagttgcactaggaggatatatagttgctgattgcgaaggaacaccagatttaatatttattggaactggaagtgaactaaatctttgtattgaagcaagtaaggagatttcaaacttaggtaaaaaaactagagttgtctctatgccatgcatagaacttttcgaagaacaagaagaatcttacaaagaaagtgttttacctaatagtgtgactaagagagttgtagtagaagctgcccattcatttggttggcataaatatacaggttttgatgggatttgtattactatggataggtttggtgcatcagcacctggtggcgagtgtatgaaaaattttggatttacagttgaaaacgttgtaaataaaacaaaggaaattctataa

SEQ ID NO: 10051 - protein, 668 aa, Prochlorococcus marinus str. MIT 9312
MVAASVSIESLCVNSIRMLAVDAVNKSNSGHPGLPMGCAPMGYALWQNILNHNPNNPKWFNRDRFVLSAGHGCMLLYSLLHLTGYKSVSIEDIKEFRQWGSKTPGHPETFETEGVEVTAGPLGAGISNAVGLAIAETHLAAKFNKPDCNIVDHYTYVIMGDGCNQEGIASEACSLAGHLKLGKLIALYDDNQITIDGRTDVSFTEDVLKRYEAYGWHVQHVEDGNHDVKGITEAIEKAKSITNKPSIIKISTTIGYGSPNKSDTAGIHGAAVGEEEASLTREFLNWEYPPFEIPDEVYKHFRKSIDKGENLEKEWDSRFEEYQKKYPSEGAELKRMLKGQLPENWDSDLPSYTPNDKGLATRKHSQICLGALGPNLPELIGGSADLTHSNYTDIKGETGSFQPHSPEKRYLHFGVREHAMAAVLNGIAYHNSGLIPYGGTFLVFADYMRGSMRLSALSELGVIYVLTHDSIGVGEDGPTHQPIETIPSLRAMPNMLVFRPGDGNETSGAYKLAIKNRKRPSALCLSRQGMPNQENTSIEKVALGGYIVADCEGTPDLIFIGTGSELNLCIEASKEISNLGKKTRVVSMPCIELFEEQEESYKESVLPNSVTKRVVVEAAHSFGWHKYTGFDGICITMDRFGASAPGGECMKNFGFTVENVVNKTKEIL

SEQ ID NO: 10052 - DNA, 1983 bp, Rhodospirillum rubrum ATCC 11170
  CDS (1)..(1983): transl_table=11
atgtccgccgtcccccacgccgatctcgccaacgccatccgctttctgtccgccgatgcggttcaaaaggccaaatccggccaccccggcatgcccatgggcatggccgatgtggcgacggttctgttcacccggttcctgacctttgatccggcggcgccgcgctggcccgaccgcgaccgcttcgtgctgtcggccggccatggctcgatgctgctctacagcctgctttacctcaccggctatgccgatatcgatcttgatcagatcaagtcgttccgccagcttggcgcgcgtaccgccggccacccggaatacggccatgtggccggcgccgagaccaccaccgggccgctgggccaggggctggccaacgccgtgggcatggccctggccgagcgcatgaccgccgcccgcttcggcgaggccgtggtcaaccaccgcacctatgtgatcgccggcgacggctgcctgatggaaggcatcagccaggaggccatctcgctggccgggcacatgaagctcgaacggctgatcgtgttgtgggacgacaaccgcatctgcatcgacggcgatgtcggtctggcgtcgagcgacgacgttcccgcccgcttccaggccagcggctggcgcaccctggcctgcgacggccatgacccccaggatattacccgggccctgaccgaggcccagacctcggaccggccgacgctgatcgcctgccgcaccatcatcggcaagggcgcgcccacccttcagggcaccgccaagacccatggctcgccgctgggcgatgccgagatcgccggcgcccgcgccgcgctcggctggccccatgcccccttcgaggtgcccgagcccatcttgtcggcttggcggaccgccggcgcccgcggcggggttgcccgcgttgcctgggaagaccgtctggcctcgctgcccggcgacgagcgcgccaccctcatccgcgccctggccggtgatctgccggcgggctgggaagacgccgtcctcgccgccaagcgcgccctgatcgagacccggcccaaggtcgcctcgcgcaaggcctcgcagatggcgctcgaggttctggtgccgcagatccccgaactggtcggcggctcggccgacttgacgggctccaacctcacccaggtcaagggtcaggccgatatcctgcccggctcctatggcggccattacatccactatggcgtgcgcgagcatggcatgggctcgctgatgaacggtttggccctgcatggcggggtcatcccctatggcggcaccttcctggtcttcgccgattacatgcgcccggccatccgcatggccgccctgatgggcctgcgcgccatttatgtgctgacccatgattccatcggtctgggcgaagacggcccgacccatcagccggtcgagcatctggcctcgttgcgcgccattcccaacctgtggaccttccgcccggccgatgcggtggaaaccctggaatgctgggccctggccgtcggtcgcagcgatggcccgagcctgctcgccctgtcgcgtcaggatctgccgaccctgcgcgaggcctatggcgaggaaaacctctcggccaagggcgcctatgtcgtggccggcgaggggccgcgcgacgtcaccctgatcgccaccggctcggaagtgaccatcgccatggcggcgcgcgagctgctggccgccgatggcctggccgccgccgtcgtctccatgccgagttgggagctgttcgaggcccagtcggccgagtaccgcgaggcggtgctgggcccgcgcgcccgccgggtggcggtcgaagccgcctcggccttcggctgggagcggtgggttgaagacaagaccgccgtggtcggcatgccgggcttcggtgcctcgggtccgatcggcgatctttatgagcacttcggcatcaccgccgaagccgtcgcccgcgtcgccaaggcccgggccgagggctga

SEQ ID NO: 10053 - protein, 660 aa, Rhodospirillum rubrum ATCC 11170
MSAVPHADLANAIRFLSADAVQKAKSGHPGMPMGMADVATVLFTRFLTFDPAAPRWPDRDRFVLSAGHGSMLLYSLLYLTGYADIDLDQIKSFRQLGARTAGHPEYGHVAGAETTTGPLGQGLANAVGMALAERMTAARFGEAVVNHRTYVIAGDGCLMEGISQEAISLAGHMKLERLIVLWDDNRICIDGDVGLASSDDVPARFQASGWRTLACDGHDPQDITRALTEAQTSDRPTLIACRTIIGKGAPTLQGTAKTHGSPLGDAEIAGARAALGWPHAPFEVPEPILSAWRTAGARGGVARVAWEDRLASLPGDERATLIRALAGDLPAGWEDAVLAAKRALIETRPKVASRKASQMALEVLVPQIPELVGGSADLTGSNLTQVKGQADILPGSYGGHYIHYGVREHGMGSLMNGLALHGGVIPYGGTFLVFADYMRPAIRMAALMGLRAIYVLTHDSIGLGEDGPTHQPVEHLASLRAIPNLWTFRPADAVETLECWALAVGRSDGPSLLALSRQDLPTLREAYGEENLSAKGAYVVAGEGPRDVTLIATGSEVTIAMAARELLAADGLAAAVVSMPSWELFEAQSAEYREAVLGPRARRVAVEAASAFGWERWVEDKTAVVGMPGFGASGPIGDLYEHFGITAEAVARVAKARAEG

SEQ ID NO: 10054 - DNA, 2049 bp, Rhodospirillum rubrum ATCC 11170
  CDS (1)..(2049): transl_table=11
atgaccgtcaccaccgccgccccgccgccccgcgccgaccacggtgatccccagatcgccgaacgggcggccaccgccattcgcatgcttgccgccgatgccgtggaaaaggccaaatccggccatcccggcgcgccgctgggcatggccgatatcgcggtggcgctatggggcgtcaacggtggcggcgtggtccatcacaatccggccaatccctcctggcccgaccgcgaccgggtggtgctgtcgaacggccatgcctcgatgctgctctacgccctgctccatctgaccggctatgacctgagcgccgccgatctggccgccttccgccagttcggcagccgcaccccgggccatcccgaggtcgaccagaccccgggggttgaaaccaccaccgggccgctcggccaggggctggccaatggcgtcggcttcgccttggccgagaagattttggccgagaccttcaatcgtcccgaccatgccatcgtcgaccatcacacctgggtgctgcttggcgatggctgcctgatggaagggatcagccacgaggtcgcgtccctggccggtcgcctgggcctgggcaagctgatctgcctttatgacgacaacggcatctcgatcgatggcgcggtcgagggctggttcagcgacgatactccggcgcgcttccgcgcctatggctggcaggtgatcgaaggcgtcgacggccacgagatctcggccgtgtccctcgccctgaccgaggccaaggccgacgccctgcgccccaccctgatctgctgccgcacggtgatcggccagggcgcgccgaccaaggccggcggccacgatgtccacggcgcgccgctgggcgcggccgaaatcgccgccatgcgcgaaagcctgaactggccctatgcgcccttcgaggtgcccgaggatatccgcgccgcctgtgacgcccgcccggccggcgcggcgctggaagcggcatggcgcgcacgcttcgcggcttaccaaagcgcctatcccgagcttgccgccgagttcgagcggcggctggcgagcaccttccccgccgatttcgcccagaccgaagaggcgctgtttgccgatctgatcgccgcgggaaccgtcgccagccgcaaggccagccagctcgccatccgccggctggccccggccctgcccgagctgctgggcgcctcggccgatctcaccgggtcgaacctcaccgactggccgggggcggcgcgcatcaacgacggtccggccgggcgctatctgtcggcgggcgtgcgcgagttcggcatggccgccgttctcaacggcatggccttgcatggcggcttcattccctttggcggcaccttcctggtgttttccgattattcgcgcaacgccattcgtctggccgccctgatgcgccggagggtcatccatattctcacccatgattccatcggcctgggcgaggatgggccgacccatcagccggtcgaacacgccgcctcgctgcgcctgatccccaatctggccgtctggcgccccggcgacgcctttgaaaccgctgtcgcctggagcgccgcgcttcgccgcgccgatggcccctcggccctgttgctctcgcgccagaacctgccggcccaaagctttgacggcgaccgccgggcggcggcgtcgcgcggcggctatacgctgtcggcccgtccccagccgcgcgccatcatcctggccagcggctccgagctgggcctcgccaccgccgcccaggcgctgctcgatggcgaagggatcgcggtgaacgtggtgtcggttccctgtctcgagctgtttttgtcccagcccaaggactggatcgacgcggttctgccgcccgacctgccccgtctggccgtcgaagccgcccatcccgatccctggtggaaggtggtcggccttgaaggcgcggtcatcggcatggaccgcttcggcgaatccgccccggcgcccgagttgttcgcccatttcggcttcaccccggcggcggtcgccgcccggctgcgcgacttgctcgcgaaatag

SEQ ID NO: 10055 - protein, 682 aa, Rhodospirillum rubrum ATCC 11170
MTVTTAAPPPRADHGDPQIAERAATAIRMLAADAVEKAKSGHPGAPLGMADIAVALWGVNGGGVVHHNPANPSWPDRDRVVLSNGHASMLLYALLHLTGYDLSAADLAAFRQFGSRTPGHPEVDQTPGVETTTGPLGQGLANGVGFALAEKILAETFNRPDHAIVDHHTWVLLGDGCLMEGISHEVASLAGRLGLGKLICLYDDNGISIDGAVEGWFSDDTPARFRAYGWQVIEGVDGHEISAVSLALTEAKADALRPTLICCRTVIGQGAPTKAGGHDVHGAPLGAAEIAAMRESLNWPYAPFEVPEDIRAACDARPAGAALEAAWRARFAAYQSAYPELAAEFERRLASTFPADFAQTEEALFADLIAAGTVASRKASQLAIRRLAPALPELLGASADLTGSNLTDWPGAARINDGPAGRYLSAGVREFGMAAVLNGMALHGGFIPFGGTFLVFSDYSRNAIRLAALMRRRVIHILTHDSIGLGEDGPTHQPVEHAASLRLIPNLAVWRPGDAFETAVAWSAALRRADGPSALLLSRQNLPAQSFDGDRRAAASRGGYTLSARPQPRAIILASGSELGLATAAQALLDGEGIAVNVVSVPCLELFLSQPKDWIDAVLPPDLPRLAVEAAHPDPWWKVVGLEGAVIGMDRFGESAPAPELFAHFGFTPAAVAARLRDLLAK

SEQ ID NO: 10056 - DNA, 2073 bp, Burkholderia thailandensis E264
  CDS (1)..(2073): transl_table=11
atgccgcccgtgccccgttttctcgactcgttctccggactcgacatgacgacttcgtctcccgcctccaccaccttgatggccaacgcgatccgcgcgctcgcgatggacgccgtccagcaagcgaactccggtcaccccggcatgccgatgggcatggccgagatcggcgtcgcgctgtggtcgcgccacctgaagcacaacccgacgaacccgcattgggccgaccgcgaccgcttcgtgctgtcgaacggccacggctcgatgctgctgtactcgctgctgcacctgacaggctacgatctgccgatcgaagagctgaagaatttccggcaactgcattcgaagacgccgggccacccggaatacgggatcacgccgggcgtcgagacgacgacgggcccgctcggccagggcctcgcgaacgcggtcggcatggcgctcggcgaggcgctgctcgccgccgagttcaaccgcgacgacgcgaagatcgtcgatcaccacacgtacgtgttcctcggcgacggctgcctgatggaaggcatctcgcacgaggcctgctcgctcgcgggcacgctgaagctcaacaagctgatcgcgctctatgacgacaacgggatctcgatcgacggcgacgtcgtcaactggttccacgacgacacgccgaagcgcttcgaggcgtacggctggaacgtgattccgaacgtgaacggccatgacgtcgacgcgatcgacgcggcgatcgcgaaggcgaagcgctcggacaagccgagcctcatctgctgcaagacgcgcatcggcaacggcgcggcgacgaaggcgggcggccacgacgtgcacggcgcgccgctcggcgcggacgaaatcgcgaagacccgcgaggcgctcggctggacgtgggcgccgttcgtgattccgcaggaagtctatgcggcatgggacgcgaaggaggcgggcaagcgcagcgaagacgactggaacgcggcgttcgcgcaataccgcgcgaagtacccggccgaagcggccgaattcgagcgccggatggcgggcacgctgccggccgattgggccgcgaaggccgcggcgatcgtcgccggcgcgaacgagcgcggcgagacggtcgcgacgcgcaaggcgtcgcagcagacgatcgaggggctcgccgccgtgctgcccgagctgctcggcggctcggcggacctgacgggctcgaacctcacgaactggaaggcgtcgaaggcggttcgcgcgaatgcggacggcccgggcgtccagtggggcaaccatatcaactacggcgtgcgcgaattcggcatgagcgccgcgatcaacggcctcgtgctgcacggcggctacaagccgttcggcggcacgttcctcacgttctccgactacagccgcaatgcgctgcgcgtcgccgcgctgatgaaggtgccgtcgatcttcgtgttcacgcacgattcgatcggcctcggcgaggacggcccgacgcaccagtcggtcgagcatgtcgcgagcctgcgcctgattcccaacctcgacgtctggcgtccggcggacacggtggagacggccgtcgcgtggacctacgcggtcgcgcaccagcacccgtcgtgcctgatcttcagccgccagaacctcgcgttcaacgcgcgcaccgatgcgcagctcgcgaacgtcgagaagggcggctacgtgctgcgcgactgggacgaagaaatcgtcgcgcgcaagatcatcctgatcgcgacgggctccgaagtcgagctcgcgatgaaggcggtcgagcccctcgcgcagcaggggatcgccgcgcgcgtcgtgtcgatgccgtcgagcgacgtgttcgaccgccaggacgccgagtaccgcgagcgggtgctgccgcacggcgtgcgccgcgtcgcgatcgaagcgggcgtcaccgatttctggcgcaagtacgtgggcctcgaaggcggcgtggtcggcatcgacacgttcggcgagtcggccccggccggcgtgctgttcaagcatttcggcttcactgtcgagcacgtgatcgaaacggcgaaggcggtgctcgcgtaa

SEQ ID NO: 10057 - protein, 690 aa, Burkholderia thailandensis E264
MPPVPRFLDSFSGLDMTTSSPASTTLMANAIRALAMDAVQQANSGHPGMPMGMAEIGVALWSRHLKHNPTNPHWADRDRFVLSNGHGSMLLYSLLHLTGYDLPIEELKNFRQLHSKTPGHPEYGITPGVETTTGPLGQGLANAVGMALGEALLAAEFNRDDAKIVDHHTYVFLGDGCLMEGISHEACSLAGTLKLNKLIALYDDNGISIDGDVVNWFHDDTPKRFEAYGWNVIPNVNGHDVDAIDAAIAKAKRSDKPSLICCKTRIGNGAATKAGGHDVHGAPLGADEIAKTREALGWTWAPFVIPQEVYAAWDAKEAGKRSEDDWNAAFAQYRAKYPAEAAEFERRMAGTLPADWAAKAAAIVAGANERGETVATRKASQQTIEGLAAVLPELLGGSADLTGSNLTNWKASKAVRANADGPGVQWGNHINYGVREFGMSAAINGLVLHGGYKPFGGTFLTFSDYSRNALRVAALMKVPSIFVFTHDSIGLGEDGPTHQSVEHVASLRLIPNLDVWRPADTVETAVAWTYAVAHQHPSCLIFSRQNLAFNARTDAQLANVEKGGYVLRDWDEEIVARKIILIATGSEVELAMKAVEPLAQQGIAARVVSMPSSDVFDRQDAEYRERVLPHGVRRVAIEAGVTDFWRKYVGLEGGVVGIDTFGESAPAGVLFKHFGFTVEHVIETAKAVLA

SEQ ID NO: 10058 - DNA, 2070 bp, Syntrophus aciditrophicus SB
  CDS (1)..(2070): transl_table=11
atgtcgaaaacgaccgccttcgaagaaaagtgtatcaacaccatccgttttttagccgcggatgccatagaaaaagcgaaatcgggacatcccggaatgccgatgggcgccgctgccgcagcccacaccctctgggtcagtcatctgaaacataatcctgtgaacccgcggtgggtcgatcgagaccgcttcgttctttccgcgggacatgcctccatgcttctgtacgtactgctccatctgaccggatatgacctctccatggatgacttgaaggccttccgccaatgggaaagccggacgccggggcatcccgaactccactgtgcgccgggagtggaagtgaccaccggcccgctcgggcaggggctgagcaatgccgtgggcatggcgatcgccgaggcccatctggccgcccgcttcaaccgtccggactgtgaggtggtcgatcattttacctatgttctggccagtgacggcgacatcatggaaggggtgacggcggaatcctgttctctggcaggacatctgggattgggtaagctcatcgtcctttatgacgacaaccgggtttcgctggcggggaccacgtccctgtcttttacggaagacgtgggcagacggtttgaggcttatggctggcaggttctccgggttcaggaaggcaaccggccggcggcgatcaatgcggccctgcagcaggcgagggcggaagagtcgaagccttcgattatttccgtgcagacggtcctcggttacggcgctcctcataaacagggaacggcggatgcccatggctctcccctgggccgggatgaactggacgccgccaagaaaaatctgggctggccggttgaccccaccttctttgtgcccgaagatgtttcaaatttttaccgggaggcgctcgatcgggggaaagccagggaagagcaatggcttcagacatttgaacgctatcgccggcagtatccggagcaggctgcggaattcagccgggttctggccggtcggctgcccgacgactgggaagcggcattgcccgtgtacggggaaggagccgccgatgtggccacccgcaaggccggggaaacggtgatgcaggcccttgccccgaagatcccggaactgatgggcggatcggcggatctcaatccgtccaccttcacctggctcaaagggctgggcgattttcagcctccgggattttctccggaaggcgtgcagggtcgtgtcggcggaccgtggggctatgaaggccgcaacatccattacggcgtccgggaacatgccatgggggccatttccgtggggatggcccttcatgggggcattcttccctatacggccacctttctgacctttgccgattacatgcggccgcccattcggctttccgccctcatgggccttcgtgtcatctatgtctttacccacgacagcatcggcctgggcgaggatggcccgacccatcaaccgatcgagcacatcatgaatctgcgggccgttcccaatcttaccgtgatccgtcccgccgatgccggtgaaaccgtggaagcctggcgggaggcgatcagaaacacggaggggccgacgaccctgatcttttcgcgccagaatcttcccgtgctggatcgcgcgaagctggcccccgcgaccggcctgcggaagggaggttataccctctgggaatccggggagggaatccccgacatcatcctgatcgggacggggtccgaggttgttccgactttggaagccggtcaccgtctggcggtggatggagttgccgtgcgggtggtctcaatgcccagctgggaactctttgaccgtcaaccggacgcctatcgcgaggccgttctgccctcggccgtgcgggcgcgcgtcgccgtggaggcggggatcaaactgggctgggaacgttacgtcgggctggacggcgcgattgtcgggctggaaggtttcggagccagtgcgccggccaaagtcctttttgaaaaattcggcattactgtggaaaacgtcacggcagcagccagggcgctcctgcgggccagagtgacctcttga

SEQ ID NO: 10059 - protein, 689 aa, Syntrophus aciditrophicus SB
MSKTTAFEEKCINTIRFLAADAIEKAKSGHPGMPMGAAAAAHTLWVSHLKHNPVNPRWVDRDRFVLSAGHASMLLYVLLHLTGYDLSMDDLKAFRQWESRTPGHPELHCAPGVEVTTGPLGQGLSNAVGMAIAEAHLAARFNRPDCEVVDHFTYVLASDGDIMEGVTAESCSLAGHLGLGKLIVLYDDNRVSLAGTTSLSFTEDVGRRFEAYGWQVLRVQEGNRPAAINAALQQARAEESKPSIISVQTVLGYGAPHKQGTADAHGSPLGRDELDAAKKNLGWPVDPTFFVPEDVSNFYREALDRGKAREEQWLQTFERYRRQYPEQAAEFSRVLAGRLPDDWEAALPVYGEGAADVATRKAGETVMQALAPKIPELMGGSADLNPSTFTWLKGLGDFQPPGFSPEGVQGRVGGPWGYEGRNIHYGVREHAMGAISVGMALHGGILPYTATFLTFADYMRPPIRLSALMGLRVIYVFTHDSIGLGEDGPTHQPIEHIMNLRAVPNLTVIRPADAGETVEAWREAIRNTEGPTTLIFSRQNLPVLDRAKLAPATGLRKGGYTLWESGEGIPDIILIGTGSEVVPTLEAGHRLAVDGVAVRVVSMPSWELFDRQPDAYREAVLPSAVRARVAVEAGIKLGWERYVGLDGAIVGLEGFGASAPAKVLFEKFGITVENVTAAARALLRARVTS

SEQ ID NO: 10060 - DNA, 1875 bp, Frankia sp. CcI3
  CDS (1)..(1875): transl_table=11
gtggcaactcccgtatccgagagcacggtcgggacggccgacctggagacggttcgggaactcgcgcagcaactgcgggtcgactcggtgcgcagcagcacctcggcgggttccgggcatcccacctcgtcgatgtcggccgcggacgtgctggcggttctcgtcgcgcgccaccttcggtacgactgggacaacccggcggacccggcgaacgatcatctgatcttttcgaaggggcacgcatccccgctgatctactccatcttcaaggcggtcggggtcgtcggtgacgacgagttgatcaatggttaccgccgtttcggtgagcggcttcagggccacccgacgcctgtcctgccgtgggtcgacgtcgcgaccgggtcgctcgggcagggcctgcccgacggcgtgggcgtcgcgctcgccggtaagtacctggacaaggtgccctaccgggtctgggtgatctgcggtgacagcgagatggcggagggctcggtctgggaggcactggacaaggcctcctactacaacctctccaacctcatcgcgatcgtcgacgtcaaccggctcggccagcgcggcccgaccgagctcggctgggacctcgacacctacgccaggcgggtggagtccttcggcgcccgcgcggtcgtcgttgacggccacgacatcgccgcgatcgacgcggtgctcgccgacgccgaggacgtcacccggccgaccgtcatcctcgcccgcacccgcaagggcgagggcttctccgagaccgcggacgtcgagggctggcacggcaagccgttccccgccgacatggccgaccgcgccatcgccgagctcggcggcctgcgcgacctgcgggttcgcggtccggtgccgcccgcggacctcccccgaccggcgccggtcgagcggcccgtcatcacactgcccacctacgatctcggcgccaaggtggcgactcggcgcgcctacggccaggcgctcgccgcgctcggagcccgcaccgacgtggtggcgctcgacgcggaggtcagcaactcgacctactccgaggacttcgccaagatctacccggaccgcttcttcgagatcttcatcgccgagcagcagctcgtcgcggcggcggtcgggctgtcggtgcgtggctacgtgcccttcgcctccacgttcgcggcgttcttctcccgggcctacgacttcatccggatggcggcgatctcccaggccgacatccggctgtccggcagccacgcgggagtcgagatcggcgccgacgggccgtcgcagatggcgctcgaggacatcgccatgatgcgggcggtcggcggctcgacggtgctctacccgagcgatgcgacgtccgccgcgaagctcgtcgaggcgatggcggatctgcccggggtcagctacctgcgcaccacccgtggagcctaccccgtgctctatggcccggacgagccgtttgcccccggtggttccaaggtgctccgccgatcgaatgccgacaccgtcacgctcatcggtgccggtgtcaccctgcacgagtcgctggccgcggcggacaccctcgtggccgaggggatcgcggcccgcgtgatcgacctgtattccgtgaagccggtcgacgcggcgacgctcgccgacgccgcccaggccaccggcgggcgcatcgtcgtcaccgaggatcactacccggagggtggactggccagcgcggtgctggaagcgctcagcgacggcggcgtgccgctgtcggtccgtcatctcgcggtgcggtcgctgccgggttccgggacgtctcaggagctcctggacgcggccggcatctccgcgaggcacatcgtcgaggccgcccgcgacctgctgcgctga

SEQ ID NO: 10061 - protein, 624 aa, Frankia sp. CcI3
MATPVSESTVGTADLETVRELAQQLRVDSVRSSTSAGSGHPTSSMSAADVLAVLVARHLRYDWDNPADPANDHLIFSKGHASPLIYSIFKAVGVVGDDELINGYRRFGERLQGHPTPVLPWVDVATGSLGQGLPDGVGVALAGKYLDKVPYRVWVICGDSEMAEGSVWEALDKASYYNLSNLIAIVDVNRLGQRGPTELGWDLDTYARRVESFGARAVVVDGHDIAAIDAVLADAEDVTRPTVILARTRKGEGFSETADVEGWHGKPFPADMADRAIAELGGLRDLRVRGPVPPADLPRPAPVERPVITLPTYDLGAKVATRRAYGQALAALGARTDVVALDAEVSNSTYSEDFAKIYPDRFFEIFIAEQQLVAAAVGLSVRGYVPFASTFAAFFSRAYDFIRMAAISQADIRLSGSHAGVEIGADGPSQMALEDIAMMRAVGGSTVLYPSDATSAAKLVEAMADLPGVSYLRTTRGAYPVLYGPDEPFAPGGSKVLRRSNADTVTLIGAGVTLHESLAAADTLVAEGIAARVIDLYSVKPVDAATLADAAQATGGRIVVTEDHYPEGGLASAVLEALSDGGVPLSVRHLAVRSLPGSGTSQELLDAAGISARHIVEAARDLLR

SEQ ID NO: 10062 - DNA, 1968 bp, Novosphingobium aromaticivorans DSM 12444
  CDS (1)..(1968): transl_table=11
atgacacgcgaaaccaccgcgctggcgcccatggccaacgcgatccgtgcgcttgccatggacgcggtccaggcagcgaattcgggacaccctggcatgccgatgggcatggccgatgtcgcgacggtgctgtggacgcagtttctgaagcacgatcccgccgcgccgaagtggtcggatcgggaccgcttcattctgtcggccggccacggctccatgctgatctacgcgctgcttcacctgtcgggctacgaaagcccgacgatggacgacatccgcaagttccgccagctcgacagcgtctgcgccggtcaccccgagaacttccttattcccggcgttgaatgcaccaccggtccgctcgggcaggggcttgccatggcagtcggcttcgcaatggccgaacgccatcttaatgcccagttcggcagcgacctggtcgaccacaagacgtgggtcattgctggcgacggctgcctcatggaaggcatcaaccacgaagcggtcggccttgcaggcacactcaagcttggtcgcctcaacgtgctgtgggacgacaacaagattaccattgacggtgacacatcgctttcgacaagcgaggacattcttggccggtatgccgcgtcgggttggcacgtcacctcgtgcgacggccatgattttgcagacatcgcacgcgcgctggcagaagcacaggccgatccgcgcccgtcgcttgttgcctgccgcaccgtgatcggaaagggtgcgcccaacaagcagggcgggcacaacgtccatggcgcaccgctcggtgcggacgagatcgctgccgcgcgtgagtatcttggctggaccgcggctccgttcgaagtcccggccgacatcctcgccaactggcgctcctcggcagaagccggaaagaccgcgcgagccgaatgggaaaagcgggctgcagccaatcccaatgccgccgaactggcccgccgcatggccggggaactccccgcccagaccggtttcgacgcctatatccagtcgctgatcgccagcccgcccaaggtcgccacccgcaagtcgagcgagatggctctcgaggccttcaccgcgaacgtgcccgagatggtgggtggttcggctgacctcaccggctcgaacaacacgaagacaaagtcgaccgcgccgttcacgccggaaagctatgacggacgctacgtctactacggcatccgcgaattcggcatggctgccgcgatgaacggcatggcgctgcatggcgggatcatcccgtatggcggcacgttcctcgtgttctccgactactgtcgcaacgccgtgcgcatgtctgcgctccagcacgtgcgagcgatctatgtgttcactcacgattcgatcggccttggcgaagacggcccgacccatcagccggtcgagcatgtcatgtcgctgcgcatgatcccgaacctgctggtattccgtcctgcggatgccatcgagaccgctgaagcgtgggctatcgcgcttgcaaacaaggaccgtccgtcggtcctcgcgctgacccgccaaaatctgccgccggtccgcttcgacgccgagatgaagagcgcaaagggcgcctatcgccttgttgccgcgcaggccgaccgcaaggttgtgctgctggctaccggttcggaagtggaagtcgcgatcaaggtcgcggccgaactggaagccaagggtctgggcgccgacgtcgtttcggttccatgctgggaactgttcgacgaacaggacgcggcctacaaggctgacctgctgcccgccgacgcactcaaggtctcggtggaggcaggcgtgactctggggtggcagaagtacatcggcgatggcctggccatcggcatcgacacgttcggcgcgtcggccccggccgaagtgctgttcgaccactttggcctcacggctgaaaagattgtcccgcagattctcgcgcgggtttcgtaa

SEQ ID NO: 10063 - protein, 655 aa, Novosphingobium aromaticivorans DSM 12444
MTRETTALAPMANAIRALAMDAVQAANSGHPGMPMGMADVATVLWTQFLKHDPAAPKWSDRDRFILSAGHGSMLIYALLHLSGYESPTMDDIRKFRQLDSVCAGHPENFLIPGVECTTGPLGQGLAMAVGFAMAERHLNAQFGSDLVDHKTWVIAGDGCLMEGINHEAVGLAGTLKLGRLNVLWDDNKITIDGDTSLSTSEDILGRYAASGWHVTSCDGHDFADIARALAEAQADPRPSLVACRTVIGKGAPNKQGGHNVHGAPLGADEIAAAREYLGWTAAPFEVPADILANWRSSAEAGKTARAEWEKRAAANPNAAELARRMAGELPAQTGFDAYIQSLIASPPKVATRKSSEMALEAFTANVPEMVGGSADLTGSNNTKTKSTAPFTPESYDGRYVYYGIREFGMAAAMNGMALHGGIIPYGGTFLVFSDYCRNAVRMSALQHVRAIYVFTHDSIGLGEDGPTHQPVEHVMSLRMIPNLLVFRPADAIETAEAWAIALANKDRPSVLALTRQNLPPVRFDAEMKSAKGAYRLVAAQADRKVVLLATGSEVEVAIKVAAELEAKGLGADVVSVPCWELFDEQDAAYKADLLPADALKVSVEAGVTLGWQKYIGDGLAIGIDTFGASAPAEVLFDHFGLTAEKIVPQILARVS

SEQ ID NO: 10064 - DNA, 1980 bp, Anaplasma phagocytophilum HZ
  CDS (1)..(1980): transl_table=11
gtgcagtattctactcagctaactgagatggcaagtgccattaggctattatctgttgatgcaattcagaatgctgcttcaggtcatcctggtatgcccttaggtatggctgatgtagctgctgtattgttttctaaatttttgagattcagtgtacaaaacccaaactggatcaatcgggatagactggtcatgtctaatggacatggttccatgcttatttactccatactccatttattagggtacatcagcatagatgatataaagaaattcaggcagttgcattccataactcctggtcatcctgaatatgggtgtacacctggtatagaagctactactggtcctttgggtcagggattgggttgtgctgttggaatggctattgctgaacggatgcttgcgcagagatttggcggtgatctaattgatcattacacttacgtcatggccggggatgggtgcttgatggagggtattagtcatgaagcagcttccttagcggggcatttgggtctgggtaagcttatagttctatttgatgacaatggtatctctatagatggaaagattagccttgcctcttctgataacgtagctgcgagatttgcatcatatggctgggatgtctgggaagtagatgggcatgattttggtcatgtatatgctgctatcgcctccgctagggagactaataggccatctataatagcatgcaagactattatagggaagtttatgcgctctaaagagaatacttctgcagcgcatagttggccttttacgcctgctgatgctcaagaagttagagagtctctagggcagggagaaagtaaggcttttgaggtaagtacagatgcttctgctttgtggaaagaagttagggaaagagcggagttggagtatgagtcttggcttagcaagtctgagcaatgtgacaaaataggcgaattgaatgctgctactactaagggtgtacctgagtctgtatttgaaggtttagatgagcattttagagatctaggttttgctgaagctactagaaagtcctttggtagagcgctggagtttttctcgcaaagggtgaataatcttgtagggggttctgcggacttaacttcttctaataatactaaagctagttggatgaagcctattacgaaggaagatttctctgggtcatacattcattatggtataagagagcatgccatggccgcatgtatgaatggaatggctcttcatgctggggttattccttatggcggaacctttttggtgttttctgattactgtaggcctgcaatacgattatctgctttaatggctcttcaggctatttacgtaatgactcatgactccataggggttggcgaggatggacctactcatcagcctgtggagcatcttgcgtcgttgagagctattccaaatctttatgtttttaggccggcagatgctgtggaagttttggagtgctgggaaattgcattgaagcttactaagtctccatctttgtttgtgttgtctaggcaaaatgtggaaccaatgaggtctgagttgggccgtgagaatcgctctgggagaggggcgtatattctcagggagtttgaaggagatcttagggttaccatttttgcgacaggtacagaggttggggtagcaatggcagcttgtgatatccttcataagacttatggggtaggtactagggttatatctatgccttgttggaggttatttgatcagcaagagaaaaagtacatttctgggttgttggataataatagtcttaaagtagcggtagaagcgggtagttctgttgggtggcataaatacattggtagagatggcatatttatagggcttgatgaatttggggcttctggtaaatgtgaggatttatatgcgcactttggtataacgaaggagaatctggtttctaaggtgctggctaggctgcatcctgctgtttag

SEQ ID NO: 10065 - protein, 659 aa, Anaplasma phagocytophilum HZ
MQYSTQLTEMASAIRLLSVDAIQNAASGHPGMPLGMADVAAVLFSKFLRFSVQNPNWINRDRLVMSNGHGSMLIYSILHLLGYISIDDIKKFRQLHSITPGHPEYGCTPGIEATTGPLGQGLGCAVGMAIAERMLAQRFGGDLIDHYTYVMAGDGCLMEGISHEAASLAGHLGLGKLIVLFDDNGISIDGKISLASSDNVAARFASYGWDVWEVDGHDFGHVYAAIASARETNRPSIIACKTIIGKFMRSKENTSAAHSWPFTPADAQEVRESLGQGESKAFEVSTDASALWKEVRERAELEYESWLSKSEQCDKIGELNAATTKGVPESVFEGLDEHFRDLGFAEATRKSFGRALEFFSQRVNNLVGGSADLTSSNNTKASWMKPITKEDFSGSYIHYGIREHAMAACMNGMALHAGVIPYGGTFLVFSDYCRPAIRLSALMALQAIYVMTHDSIGVGEDGPTHQPVEHLASLRAIPNLYVFRPADAVEVLECWEIALKLTKSPSLFVLSRQNVEPMRSELGRENRSGRGAYILREFEGDLRVTIFATGTEVGVAMAACDILHKTYGVGTRVISMPCWRLFDQQEKKYISGLLDNNSLKVAVEAGSSVGWHKYIGRDGIFIGLDEFGASGKCEDLYAHFGITKENLVSKVLARLHPAV

SEQ ID NO: 10066 - DNA, 1992 bp, Ehrlichia chaffeensis str. Arkansas
  CDS (1)..(1992): transl_table=11
atggacaacgaatataatgatatggtaaatatggctaatgccattagggtgttatcagtagatgctatacagaaagctgcgtctggacatccaggtatgcctcttggaatggcagatgttgctacagtattgtttgcaaagtttttaaaatttaatcctaaagatcctaattggtttgatagagatagatttgtgttatcaaatggccatggatctatgttgctgtattccatattatattttttaggatgtttagatatagaagaaataaaaagatttagacaaattcattctttaactcctggacacccagaatatggatacactcctggagtagatgctactactggcccattaggtcagggtttagcgtgtgcagtaggtatggcaatagcagaaaaaatattgtctgaaaaatttggcagtgaaattgtaaatcatactacttatgttatggttggtgatggatgccttatggaaggcattagtcatgaagcagcatctttggcaggacatttgcagttgaataaattgatagtattatttgatgacaataatatttcaatagatggtccaatttctttatctgtttcagatgatgttaaagctaggtttttgtcttatcagtgggatgtttttgaaatagatgggcatgattttggtcagattgaatcttcaattaaaaatgctcagaaatctgaaaaaccttctttgatttgttgtaagacggttattggaaagcatctttcttcaaaagaaaatacatgtgctgcacatagttggccattttcagaagaagaagtaatgttgatgaaagagaaattaaattggcaatgtaatccatttaatataccagaagaaattttgcagttatggaagaatgtttctagtagatcagaagatgaatacaacatgtggcttgataggtctgcgaaatatagtaaaacttttgatgattttgtagatatgatgaaggaaggtgttcctgattcagtttttttaggtttgaaagaatttaaaaaagaactttatgctttaaacttaagtgaagcaactcgtaggacttctggtagagtattagaagttatagcaaagcatacaagtaaattaataggtggatctgctgatcttactaattctaataatactaaaccacagttaatatcaattattaacagaagtaattttaatggatcttatttgcattatggtattagagaacatgctatggcagggtgtatgaatggtatggcattgcatggtggaatgattccttatggtggaacatttttagttttttctgattattgtagaccagctattagattgtctgcattgatgaaaaaacaagttatttatgttatgacacatgattctattggagtaggagaggatgggccaactcatcaacctatagagcacttatcatctttacgatcgatccctaatttatatgtttttagaccagctgatgctattgaagtattagaatgttgggaaattgcattaaagttaactagttctccatctgtgtttatactatctagacaaaatgttggcagtgttcgcagtgtatctgttgatgagaatttatctaataaaggtgcatatgttatacgtgaatatgagaaggatttagatgttaccatttttgccacagggtctgaagtggagattgcactaaaagcatctgatattttgaaaagtaaagggttaggtacaagagtagtatctattccttgctgggagttgtttgttcagcaagataaaaagtatatattcaatttattgaataataaaagcattaaagctgcggtagaagctgcaagttcttttggatggcatagatacataggagaaaatggtatttttgtaggtttagaggattttgggatatctgctccatataaggatttatataaacattttggaatcactgcggaaggtttagtaaacaagatacttgataagttgaaaattaatacaaattag

SEQ ID NO: 10067 - protein, 663 aa, Ehrlichia chaffeensis str. Arkansas
MDNEYNDMVNMANAIRVLSVDAIQKAASGHPGMPLGMADVATVLFAKFLKFNPKDPNWFDRDRFVLSNGHGSMLLYSILYFLGCLDIEEIKRFRQIHSLTPGHPEYGYTPGVDATTGPLGQGLACAVGMAIAEKILSEKFGSEIVNHTTYVMVGDGCLMEGISHEAASLAGHLQLNKLIVLFDDNNISIDGPISLSVSDDVKARFLSYQWDVFEIDGHDFGQIESSIKNAQKSEKPSLICCKTVIGKHLSSKENTCAAHSWPFSEEEVMLMKEKLNWQCNPFNIPEEILQLWKNVSSRSEDEYNMWLDRSAKYSKTFDDFVDMMKEGVPDSVFLGLKEFKKELYALNLSEATRRTSGRVLEVIAKHTSKLIGGSADLTNSNNTKPQLISIINRSNFNGSYLHYGIREHAMAGCMNGMALHGGMIPYGGTFLVFSDYCRPAIRLSALMKKQVIYVMTHDSIGVGEDGPTHQPIEHLSSLRSIPNLYVFRPADAIEVLECWEIALKLTSSPSVFILSRQNVGSVRSVSVDENLSNKGAYVIREYEKDLDVTIFATGSEVEIALKASDILKSKGLGTRVVSIPCWELFVQQDKKYIFNLLNNKSIKAAVEAASSFGWHRYIGENGIFVGLEDFGISAPYKDLYKHFGITAEGLVNKILDKLKINTN

SEQ ID NO: 10068 - DNA, 2004 bp, Saccharophagus degradans 2-40
  CDS (1)..(2004): transl_table=11
atgtcttcacgcagagaacttgcgaatgccatccgtgcattaagtatggacgccgtacaaaaagcaaatagtggtcacccaggtgcaccaatgggaatggccgatattgcggaagtgctgtggaatgacttcctcaagcacaacccaagcaaccctaattgggccgatcgcgaccgttttgtattgtcaaacggccacggctctatgcttatttattctttgttgcaccttagcggttacgacttgccaatgagcgagttggctcagttccgtcagttgcactctaaaaccccaggtcacccagagttgggttataccccaggtgtagaaactaccactggcccacttggccaaggtatcagtaacgccgtaggtatggcgcttgccgaaaaaatgttggctgcgcagtttaaccgcgatggtcacgatattgttgatcactacacctactgctttttaggtgatggctgtttgatggaaggtgtttctcacgaaacctgttcacttgctggcaccttgggcttgggcaaattaattgccttttgggacgacaacggtatttctattgatggtcacgtagaaggctggtttaccgataataccccagcacgttttgaagcttatggctggcatgttatcccagcggtagatggtcacgacccagaagctattaaagcggcggtagaagctgcgcaagcagaaacaggcaagccaacgttgatttgtactaaaaccaccattggttttggttcacctaacaagagcggttctcacgattgtcacggcgcaccattaggcgatgcagaaattgccgcagcgcgcgaatttttgggctggcctcatgcgccattcgaaattccagacaacgtttacgctggttgggatgcgaaagaaaaaggtgcagcggcacagtctgcatgggaagccaagtttgaagcatacaaggctgcacagcccgctttggcggccgagtttgagcgccgcgtattaaacggtgacttgcctgcagatttcgaagctaaagccgatgcgtttattaaagctgttaacgaaaaaggcgaaagcattgccacccgtaaagcgtcacaaaacactattgcagaatttggcgctgcattgccagagctactcggtggctctgccgatttggctggctctaacctcaccatgtggagcggttctaagcctgttacgcgcgaagatgccagcggcaactatatttactacggtgtgcgtgaatttggtatgagcgccattatgaatggtattgctgctcacggtggctttattaactacggcgcaaccttcttaatgtttatggaatacgcgcgcaacgctgtgcgtatgtctgcattgatgaagttgccaaatatttttgtttacacccacgattccattggtcagggtgaagacggcccaactcaccagcctatcgagcagttggccgcgttgcgtttaacgccaaacctaaatacttggcgcccagcggatgcagttgaatctgcggttgcttggaaatctgcagtaatgcgtaaagacggcccaagcgcattggtatttacccgtcaaggcgttaaggcgcaaagccacgacgacgagcaaatagccaacatggcgcgcggtgcatacgtactagtagattgcgacggcgagccagaagtgatgctaattgccactggttctgaagtgggtattaccgtagatgccgcagcacagctagcgggtgaaggcgtgaaggtgcgtgttgtatccatgccttgtaccaatgtgttcgatcagcaagatgccgcctacaaagaatctgtattacctattgcggttacccatcgcgtagcggtagaaacgtcacacgttgactactgggcgaaatacgtaggcattgatggccgcgtagtgggcatgaccaccttcggtgaatctgcaccgggtggcgcattgcttgagtacttcggttttactgtagaaaacgtcgtaaacaccgttaaagaattgctagaagactaa

SEQ ID NO: 10069 - protein, 667 aa, Saccharophagus degradans 2-40
MSSRRELANAIRALSMDAVQKANSGHPGAPMGMADIAEVLWNDFLKHNPSNPNWADRDRFVLSNGHGSMLIYSLLHLSGYDLPMSELAQFRQLHSKTPGHPELGYTPGVETTTGPLGQGISNAVGMALAEKMLAAQFNRDGHDIVDHYTYCFLGDGCLMEGVSHETCSLAGTLGLGKLIAFWDDNGISIDGHVEGWFTDNTPARFEAYGWHVIPAVDGHDPEAIKAAVEAAQAETGKPTLICTKTTIGFGSPNKSGSHDCHGAPLGDAEIAAAREFLGWPHAPFEIPDNVYAGWDAKEKGAAAQSAWEAKFEAYKAAQPALAAEFERRVLNGDLPADFEAKADAFIKAVNEKGESIATRKASQNTIAEFGAALPELLGGSADLAGSNLTMWSGSKPVTREDASGNYIYYGVREFGMSAIMNGIAAHGGFINYGATFLMFMEYARNAVRMSALMKLPNIFVYTHDSIGQGEDGPTHQPIEQLAALRLTPNLNTWRPADAVESAVAWKSAVMRKDGPSALVFTRQGVKAQSHDDEQIANMARGAYVLVDCDGEPEVMLIATGSEVGITVDAAAQLAGEGVKVRVVSMPCTNVFDQQDAAYKESVLPIAVTHRVAVETSHVDYWAKYVGIDGRVVGMTTFGESAPGGALLEYFGFTVENVVNTVKELLED

SEQ ID NO: 10070 - DNA, 1992 bp, Methylobacillus flagellatus KT
  CDS (1)..(1992): transl_table=11
atggcagcaagtcgtcaagaattggcaaatgccatccgcgtgttatccatggatgcagttcagaaggcaaattctggacaccctggtgcaccgatggggatggcagacatcgcagaggttctctggaaccatcatctgcgtcacaacccgaccaaccctagttgggctgatcgtgaccgtttcatcctgtccaacggtcacggctccatgttgatctactccttgttgcacctgacaggctacgacctgaacatggacgacatcaagtctttccgtcagctgcattcccgttgtgctggtcaccctgagtatggctacgcgcctggcgtcgaaaccacaactggtcctcttggccagggcattaccaatgctgtaggtttcgccatggctgaaaaactgctggcacaccaattcaataagccaggccatgagatcgtcgatcactatacatactgtttcctcggcgatggctgcatgatggaaggcatttcccacgaagccgcagcgctggccgggacatggggtttgggcaagctgattgctttctgggatgacaacggcatctccatcgatggtcacatcgagggttggtacactgacgatacagccaagcgtttcgaagcttacggctggcatgttgtccccaatgttgatggtcacgatttcgacgcagtcaatgccgccatcgaagctgcgaagaaggtgactgacaagccgactttgatttgctgcaagaccatcatcggtaagggatcccccaacaagtgtggctcccatgactgccatggttctgcccttggcctggaagaagtcgccgctacccgcgaagccttgggctggaaacacgagccattcgtgattcctgaagaggtctacgctggctgggatggcaaggaaaaaggcgctaagctcgaaagcgagtggaacgcgaagttcgaagcgtatgccaaggcctatcctgctgaagctgctgagttcaagcgccgcatggctggtgagttgcctgccaactggaaggaagtcaccgacgccttcatcaaggccaccaacgaaaaggcagaaagcattgctacccgcaaggcctcccagaatgccattgctgccttggcaccagtgctgcccgagttcctcggcggctctgccgacctgaccggttccaacctgaccagctgcgccagcttcaagcatgttagcggcaaggagccaggcaactacatttcctacggcgtgcgtgagttcggcatgttcgcgatcatgaacggtatggcgctgcatggcggtctgctgcctttcggcggtacattccacatgttctccgattacgctaagaacgcattgcgcatggcagcattgatgaagcaacgcactatcgcggtgttgacgcatgactccatcggtcagggcgaagacggtcctacccaccagccaatcgaaaacaccgcaggcctgcgttatattccccgcatggatgtatggcgtcctgccgactccgttgaaaccgcgattgcctgggtggctgccgttgagcgcaaggatggcccgaccagcctggtgctgagccgccagaatgtgcctggcatcaagcacgacgagaagcacttcgaactgatccgcaagggcggttatgtgttctccgacgtggaaggcaaggcagacgtcatcctgatcgcgaccggctccgagctggacctggcaatcaaggctgcggcagagttgaatgctgctggcaccaaggtgcgtgtggtttccatgccatccaccaacgtgttcgaccgccaagatcaagcctacaaggacagcgtattgaccccaggcgtgaagcgcgtagctgttgaagctggtgtgaccgatttctggcgcaagtatgttggcctcgaaggtgccgtggtcggtatcgacacctttggcgagtctgctccaggcggcgtgctgttcaagcacttcggcttcacggttgaaaatgtagtgaacaccgtcaagtccgtgctgtaa

SEQ ID NO: 10071 - protein, 663 aa, Methylobacillus flagellatus KT
MAASRQELANAIRVLSMDAVQKANSGHPGAPMGMADIAEVLWNHHLRHNPTNPSWADRDRFILSNGHGSMLIYSLLHLTGYDLNMDDIKSFRQLHSRCAGHPEYGYAPGVETTTGPLGQGITNAVGFAMAEKLLAHQFNKPGHEIVDHYTYCFLGDGCMMEGISHEAAALAGTWGLGKLIAFWDDNGISIDGHIEGWYTDDTAKRFEAYGWHVVPNVDGHDFDAVNAAIEAAKKVTDKPTLICCKTIIGKGSPNKCGSHDCHGSALGLEEVAATREALGWKHEPFVIPEEVYAGWDGKEKGAKLESEWNAKFEAYAKAYPAEAAEFKRRMAGELPANWKEVTDAFIKATNEKAESIATRKASQNAIAALAPVLPEFLGGSADLTGSNLTSCASFKHVSGKEPGNYISYGVREFGMFAIMNGMALHGGLLPFGGTFHMFSDYAKNALRMAALMKQRTIAVLTHDSIGQGEDGPTHQPIENTAGLRYIPRMDVWRPADSVETAIAWVAAVERKDGPTSLVLSRQNVPGIKHDEKHFELIRKGGYVFSDVEGKADVILIATGSELDLAIKAAAELNAAGTKVRVVSMPSTNVFDRQDQAYKDSVLTPGVKRVAVEAGVTDFWRKYVGLEGAVVGIDTFGESAPGGVLFKHFGFTVENVVNTVKSVL

SEQ ID NO: 10072 - DNA, 2043 bp, Burkholderia xenovorans LB400
  CDS (1)..(2043): transl_table=11
atgagtgccgtcgcagaatccgtcgcaatacccgcgacccggctgatggccgacgcgctgcgcatgctcgcgatcgacgcggtcgaagccgcgaagtccggtcatccgggcatgccgctcggcatggccgagattgccgtcgcgctgtgggaccggcatctgaagcacaacccgcgcaatcccgcgtggcccgatcgcgaccgcttcgtgctgtcgaacgggcacggtgcgatgctgttgtatggcctgctgcatctcaccggctacgatctgccgatcgacgaactcaggcgcttcaggcaactgtacagcaggacgccggggcatccggaggtgggcgtgacccctggcgtggaaacgaccaccgggccgctcgggcaggggctcgccaatgctgtcggcatggcgctcgccgaggcgctgctcgcgcgcgaattcaaccggcccggccattcgatcgtcgatcaccgcacgtatgtgttcgtcggcgacggttgcatgatggaaggcatttcgcacgaggcggcttcgctcgccggcacgttgaagctcgacaagctcacggtgctgtatgacgacaacggcatctcgatcgacggccacgtctcgcagtggttcagcgacgacacgcccgcgcgttttgcggcctacggctggcatgtggtacgcgaggtggacggacatgacgtggacgcggtcgatcgggctctctcgcgcgcacgcgcagccggccggccgacgctgatctgctgccgcacggtgatcggcaaaggctcgccctcgaaagcgggcacgcacgacgtgcacggcgcgccgctcggggccgacgaagttgcgaacacgcggcgcgcgctcggctggccgcatgcgccgttcgctatgcctgccgaggttcgcacgctgtgggacgcgagcgagcgtggcgcggccacagaagccgactggaacacgcgtttcgaagcgtatcgcaagcactatccgcatgaagccgccgagttcgagcgaaggacgcaacgcacgctgcccgtgcagtggcgcgacacggtccgcgcgatggtgagcgacgcggaccacgcgggcgaatcgatcgcgacccgcaaggcctcgcaacaggcgattgccgtgctggctcgcgcattgccggaattgctgggcggttcggccgacctgaccggctcgaacctcaccaactggaaaaccgcggtcgatgttcatgccgacgacagcggcctgcaaggcggcaactatctgcacttcggcgtgcgcgaattcggcatgagcgcggtgatgaacggtattgcgctgcatcgcggacatattccgttcggcggcacctttctcacgttctccgactactcacgcagcgcgctgcgcatggccgcgctgatgaagacccgtgcgattttcgtgttcacgcacgactcgatcggcctcggcgaagacgggccgacacatcagtccgtggagcacgcggcgagcttgcggctcattcccgggctcgacgtctggcgtccgtgcgacacggtcgagaccgcgcaggcgtgggcgagcgcggtggaacgcgatgggccgtcgtgcctgctgctgagccgccagaatctgccgttcgccgcgcgcagcgctgaacagatcgacgcgatcgagcgcggcggctatgtgttgcgtgactggcctgcggaacgggcgcaaacgcggatcgtgctgatcgccaccggttcggaagtctcgctcgcgctcgatgccgtcgcgccgctcgcgcaagccggcatcgccgcgcgggtcgtgtcgatgccgtccaccagcgtattcgaccggcagcccgccgcatggcgcgacgcggtgctgccgccgcgggtgccgcgcgtcgcggtggaagcgggcgtgcgcgcgttctggcggcaatacgtgggcctcgaaggcggcgtggtgggcattgatacgttcggcgaatccgcccccgccgcggcgctgttcgagcatttcggtctgaccgcgcgcgcggtggtggacgaagcccgccgtgtcgcgcaactcgcgcgttaa

SEQ ID NO: 10073 - protein, 680 aa, Burkholderia xenovorans LB400
MSAVAESVAIPATRLMADALRMLAIDAVEAAKSGHPGMPLGMAEIAVALWDRHLKHNPRNPAWPDRDRFVLSNGHGAMLLYGLLHLTGYDLPIDELRRFRQLYSRTPGHPEVGVTPGVETTTGPLGQGLANAVGMALAEALLAREFNRPGHSIVDHRTYVFVGDGCMMEGISHEAASLAGTLKLDKLTVLYDDNGISIDGHVSQWFSDDTPARFAAYGWHVVREVDGHDVDAVDRALSRARAAGRPTLICCRTVIGKGSPSKAGTHDVHGAPLGADEVANTRRALGWPHAPFAMPAEVRTLWDASERGAATEADWNTRFEAYRKHYPHEAAEFERRTQRTLPVQWRDTVRAMVSDADHAGESIATRKASQQAIAVLARALPELLGGSADLTGSNLTNWKTAVDVHADDSGLQGGNYLHFGVREFGMSAVMNGIALHRGHIPFGGTFLTFSDYSRSALRMAALMKTRAIFVFTHDSIGLGEDGPTHQSVEHAASLRLIPGLDVWRPCDTVETAQAWASAVERDGPSCLLLSRQNLPFAARSAEQIDAIERGGYVLRDWPAERAQTRIVLIATGSEVSLALDAVAPLAQAGIAARVVSMPSTSVFDRQPAAWRDAVLPPRVPRVAVEAGVRAFWRQYVGLEGGVVGIDTFGESAPAAALFEHFGLTARAVVDEARRVAQLAR

SEQ ID NO: 10074 - DNA, 2085 bp, Burkholderia xenovorans LB400
  CDS (1)..(2085): transl_table=11
atgcaaaacgatcccgccctcgaccagctgtgtatcaacacgatccgcacgctgtcgatggacgctgtgcaaaaggccaattccggtcaccccggtacgccgatggcactggcacccgttgcctatcacctgtggcaaaaccatctgcgctacgaccccgacgagccgctctggcctgatcgcgaccgcttcgtcttatccgtgggacacgcgtcgatgctgctgtattcgctgttgcaccttgcaaacgtgaaagccgtggacgacgacggcaacccgaccgacggacccgcagtttcgctcgacgatatcgaacatttccgccagatgggcagcaagacaccgggccacccggagtaccgcatgaccaccggcgtcgagaccaccacgggcccgcttgggcaagggctcggcaatagcgttggcatggcgatggcggcgcgctggtacgagagccatttcaacaagcccgatgcgccgctgttcgactatcgggtctacgcgttgtgcggcgacggcgacatgatggaaggcatctcgcacgaggcggcttcgctcgccggccacctgaagctgtccaatctgatctggatctacgacagcaaccgcgtgacgattgaaggccacaccgacctcgcttatagcgacgacgtggaaacccgctttcgcgggtacaactggcacacgctgcatgtgagcgatgcaaacgacgccgccgcgctggaagcggcattcgtcgaagcgaaaagcattaccgacaggccgacgctgatcgtggtgcacagcatcatcggctggggggcgccgcataagcaggacacctcggcggcgcacggcgagccgctcggcgtagaagaagtggcgctcgccaagaaagcgtacggctggcccgaggataaattcttctatgtgccggacggtgtgcacgaacgcttcgcggcgggcatcggcgcgcgcggcaaggcggcgcgcgaggaatggcaggcgaagtacgacgcctacagcagaaagtaccccgaactcgcgcgtgaattcgcgcagatcgaagcgcacgaattgccggccggttgggacagcgacattcccaccttcgacgcggacccgaaaggcgttgcgtcacgcgaatcgtcgggcaaggtgctcaatgcgattgccgcgcgcgttccgtggatgatcggcggcgcggccgacctttcgccgtccaccaaaacgaatctgaaattcgagggcgcgggcagcttcgaatacgacaactacggcggctgcaatctgcatttcggcattcgcgaacacgcaatgggcgcggcggtgaatggcctcgcgctgtcgaatctgcggccgttcggctcgaccttcctgattttcagcgactatatgaagccgccgatccgcctctcggcgatcatggaagtgccggccatctacgtgttcacgcacgattcgatcggcgtcggcgaagacggtccgacccatcagccaatcgagcagctggcctcgctgcgcggcgtgccggggctgaccgtgctgcgtccgggcgacgccaacgaagtggccgaggcgtggcgcgtggcgcttgccgatccgcggcggccgtcgtgcatcgtggtgtcgcgccagccgttgcccacgctggaccgcagccgctatgcggccgcgaagggcacgcagaagggcgcctatgtgctcgccgatgcagccgacgggcaaaagccgcaggtgatcctgatagccacgggcagcgaactctcggtctgcgtcgacgtgtatgagaagctcacgagcgaaggtattgcggcgcgcgtggtgtcgatgccgtcgtgggatatcttcgagcgccaggacgaggcctatcaggactcggtgctgccaccggatgtggacgcgcgcgtggcggtcgagcaggcggcctcgcttggctgggaccgttatgtggggcgtctcggcgcgcaggtggtgatgcatacgttcggcgcgtccgcgccgcttgccgaactgaagaagaagttcggcttcacgccggagcatgtgtacgaagcggcaaagcagcagattgcgcgggtgcaaggcaagcgcagccaggagtag

SEQ ID NO: 10075 - protein, 694 aa, Burkholderia xenovorans LB400
MQNDPALDQLCINTIRTLSMDAVQKANSGHPGTPMALAPVAYHLWQNHLRYDPDEPLWPDRDRFVLSVGHASMLLYSLLHLANVKAVDDDGNPTDGPAVSLDDIEHFRQMGSKTPGHPEYRMTTGVETTTGPLGQGLGNSVGMAMAARWYESHFNKPDAPLFDYRVYALCGDGDMMEGISHEAASLAGHLKLSNLIWIYDSNRVTIEGHTDLAYSDDVETRFRGYNWHTLHVSDANDAAALEAAFVEAKSITDRPTLIVVHSIIGWGAPHKQDTSAAHGEPLGVEEVALAKKAYGWPEDKFFYVPDGVHERFAAGIGARGKAAREEWQAKYDAYSRKYPELAREFAQIEAHELPAGWDSDIPTFDADPKGVASRESSGKVLNAIAARVPWMIGGAADLSPSTKTNLKFEGAGSFEYDNYGGCNLHFGIREHAMGAAVNGLALSNLRPFGSTFLIFSDYMKPPIRLSAIMEVPAIYVFTHDSIGVGEDGPTHQPIEQLASLRGVPGLTVLRPGDANEVAEAWRVALADPRRPSCIVVSRQPLPTLDRSRYAAAKGTQKGAYVLADAADGQKPQVILIATGSELSVCVDVYEKLTSEGIAARVVSMPSWDIFERQDEAYQDSVLPPDVDARVAVEQAASLGWDRYVGRLGAQVVMHTFGASAPLAELKKKFGFTPEHVYEAAKQQIARVQGKRSQE

SEQ ID NO: 10076 - DNA, 1989 bp, Burkholderia xenovorans LB400
  CDS (1)..(1989): transl_table=11
atggccaacgcaatccgcgcgctgtccatggacgccgttcaaaaagcgaactccggccaccccggcatgccaatgggcatggccgaaatcggcgtggcgttgtggtcgcgtcatctgcgccacaacccgaagaacccgcaatgggccgatcgcgaccgtttcgtgctgtcgaacggtcacggctcgatgctgctgtactcgctgctgcacctgaccggctacgatctgccgatcgaagagctgaagaacttccgccagatgcattcgaagacgccgggccacccggaatacggcatcacgccgggcgtcgagacgaccaccggcccgctcggccagggtctggcgaatgcggtcggcatggcgctcgccgagtcgctgctcgccaccgaattcaacaagcctgacgcaacgatcgtcgaccaccacacgtacgtgttcgtcggcgacggctgcctgatggaaggcatctcgcacgaagcctgttcgctcgcgggcgtgctgaagctgaacaagctgattgcgttctacgacgacaacggcatctcgatcgacggcgaagtggtgcactggttccacgacgacacgcccaagcgcttcgaggcgtacggctggaacgtgatcccgaacgtggtcggccacgacgtcgaagcagtggacgcggccatcaagcaggcgaagcaatccgacaaacccacgctgatctgctgcaagacggtgatcggcgaaggctcgccgaacaaggccggcagccacgattcgcacggcgcggcgctcggcgacaaggaagtcgcggccacgcgcgaaaagatcggctggaagtgggagccgttcgtgatcccgcaagaggtctatgcagcttgggacgcaacagaagcgggcgcacgcaacgaatccgagtgggacaaggcattcgccgcgtacgctgccaaatatccgcaggaagccgctgaattcaagcgccgcaacgcgaagcagttgccggcggactggaaggaaaaggccaaggcgatcattgccggcgcgaacgagcgcgcggaaaccgtagcgacgcgcaaggcatcgcaacaggctatcgaggctttgtcggccgtgctgccggaactgctcggcggctccgccgacctgaccggctcgaacctgaccaactggaaggccgccaaaccggtacgcgtgaacgccgaaggcaaggctgccggcaactacgtcaactacggcgtgcgtgaattcggcatgagcgccgcgatcaacggcgttgcgctgcacggtggcttcaaggcgttcggcggcacgttcctgacgttctcggactacagccgcaacgcgctgcgcgtcgccgcgctgatgaaagcgccgtcgatcttcgtgttcacgcacgactcgatcggtctgggcgaagacggcccgacccaccagtcgatcgaacatgttgcgagcctgcgtctgattccgcacctgcaagtgtggcgtccggctgataccgtcgagacggcggtggcctggacccacgcggtcgaacatcatggcccgtcgtgcctgatcttcagccgtcagaacctgccgttctcggagcgcacggacgcgcagatcgccaacatcgagaagggcggttacgtgctgcgcgactggaacgacgagatcgtcgcgcgcaagatcatcctgatcgccaccggttcggaagtcgaactggcgctgaacgcggtcgagccgctggcgcgcgaaggtatcgcggcgcgcgtcgtgtccatgccgtcaaccaccgtgttcgacaagcaggacgccgagtaccgtgaacgcgtgctgccgcaaggcgtgcgccgcgtcgcgatcgaagcgggtgtgacggatttctggcgcaagtacgtgggtctggaaggcggcgtggtcggcatcgacacgttcggcgaatcggccccggctggcgtgctgttcaagcatttcggcttcaccgtcgaacacgtggtagagacggcaaaagccgcactcggctga

SEQ ID NO: 10077 - protein, 662 aa, Burkholderia xenovorans LB400
MANAIRALSMDAVQKANSGHPGMPMGMAEIGVALWSRHLRHNPKNPQWADRDRFVLSNGHGSMLLYSLLHLTGYDLPIEELKNFRQMHSKTPGHPEYGITPGVETTTGPLGQGLANAVGMALAESLLATEFNKPDATIVDHHTYVFVGDGCLMEGISHEACSLAGVLKLNKLIAFYDDNGISIDGEVVHWFHDDTPKRFEAYGWNVIPNVVGHDVEAVDAAIKQAKQSDKPTLICCKTVIGEGSPNKAGSHDSHGAALGDKEVAATREKIGWKWEPFVIPQEVYAAWDATEAGARNESEWDKAFAAYAAKYPQEAAEFKRRNAKQLPADWKEKAKAIIAGANERAETVATRKASQQAIEALSAVLPELLGGSADLTGSNLTNWKAAKPVRVNAEGKAAGNYVNYGVREFGMSAAINGVALHGGFKAFGGTFLTFSDYSRNALRVAALMKAPSIFVFTHDSIGLGEDGPTHQSIEHVASLRLIPHLQVWRPADTVETAVAWTHAVEHHGPSCLIFSRQNLPFSERTDAQIANIEKGGYVLRDWNDEIVARKIILIATGSEVELALNAVEPLAREGIAARVVSMPSTTVFDKQDAEYRERVLPQGVRRVAIEAGVTDFWRKYVGLEGGVVGIDTFGESAPAGVLFKHFGFTVEHVVETAKAALG

SEQ ID NO: 10078 - DNA, 2055 bp, Ralstonia metallidurans CH34
  CDS (1)..(2055): transl_table=11
atggccagtacctctgccgaccgcgtgctgcgccccgagagcggccgctacgacgaactcgccaacgcgctgcgcgccctggccatggacgccgttcagcaggccaactccggccaccccggcgcgccgatgggcatggccgagatggccgtcgcgctgtggagcggtcatctgcgccacaacccgggcaatcccgggtggcccgaccgcgaccggttcgtcttgtccaacgggcatgcgtcgatgctgctgtatgccttgctgcacctgagcggctacgacctgccgatcgaggaactgcagcgcttccggcaactgcacagcaagaccccgggccaccccgaggtgggcctcacgcccggcgtggaaaccacgaccggcccattgggccaaggtttggcgaacgcggtcggcatggcgctggccgggaagttgctgggcgacgagttcaaccgcccgggacatgtcgtggtcgaccaccacacctacgtctttctcggcgacggctgcctgatggaaggcatcagtcacgaggtctgctcgctggctggcgtgtggaggctcaacaagctgatcgcgctgtacgacgacaacggcatctcgatcgacggtgcggtcgatgcctggtttcgcgacgacaccgcggcacgctttcgagcctatggctggaacgtgatcggcccgatcgacggccacgacgtcgtggcgatcgggcgttccatcgccgacgcgcggcgctctgccgaccggcccacgttgatcgtgtgccgcaccaccatcggccgcggctccccgggacgcgccggtacggccaaggcccatggcgaaccgctcggggccgacgagattgccgccacgcgcgccgccatcgggtggcacgaggctccgttcgaaattccggataccgtgcgtgcgcgctggagcgcgcgcgatctgggcgccaggcgcgaagctcagtggcgcttgggcttcgaggcctaccggagcgaatatcccgcactggccgcggagttcgagcgccggattgccggcgacctgccgtcgtcgtttcatgaagccgcgtcggcagcgatgatcgaactcggtcaggccaccacgccggtcgcctcacgcaaggcttcgcagcaagcgctggcgatgctggcgcccaagatccccgagatgctcggcggcagtgccgacctcacgggctctaacctgaccgacttcccgggctgcggtgccgtgcgggccggccagcccggcgggcgccacgtcaactacggcgtgcgcgagttcggcatggcggcgatcatgaacgggctggcgctgcacggcggcttcattccgtacggcggcaccttcctcaccttcagcgactacagccgcaacggaattcgcatggccgcgctgatgaagctgcgcgtggttcatgtcttcacgcacgactcgatcggcctgggcgaggacggcccgacgcaccaggccgtcgagcatgccgcgagcttgcgcctgatccccaatctcgatgtctggcggccctgcgacgccgccgagaccgcggtggcctgggcgttcgcgctcgagcaacgcacgcgccccagcgcgttgctgctgtcgcggcagaacctgccgccgcaggcgcgcactgcggagcaggtcgcgcagatccgtcgcggcggttacgtgctctccgaccgacccgagccgcaggtggtgctgatcggcaccggctccgaggtgtccatcgcgatggaggcgcagcgccttctcgatgcggtgggcatcgcggcgcgggtggtctcgttgccctgcagcaccctcttcgatcggcaggaggccgcctggcacgagcaggtgctcggccggggaatcccgcgcatcggcgtcgaagcgggcgtcacctcgtggtggggccagtaccactgcgtcgccgcgctgggggtgaacagcttcggcgagtcggcgcccggcccgcaggtgtacgagcacttcggcctcgacgccaaggcgctggccgacctggcacgcgaagtgctggcgcgcgaagtgcggttcgtccggtccaggagctga

SEQ ID NO: 10079 - protein, 684 aa, Ralstonia metallidurans CH34
MASTSADRVLRPESGRYDELANALRALAMDAVQQANSGHPGAPMGMAEMAVALWSGHLRHNPGNPGWPDRDRFVLSNGHASMLLYALLHLSGYDLPIEELQRFRQLHSKTPGHPEVGLTPGVETTTGPLGQGLANAVGMALAGKLLGDEFNRPGHVVVDHHTYVFLGDGCLMEGISHEVCSLAGVWRLNKLIALYDDNGISIDGAVDAWFRDDTAARFRAYGWNVIGPIDGHDVVAIGRSIADARRSADRPTLIVCRTTIGRGSPGRAGTAKAHGEPLGADEIAATRAAIGWHEAPFEIPDTVRARWSARDLGARREAQWRLGFEAYRSEYPALAAEFERRIAGDLPSSFHEAASAAMIELGQATTPVASRKASQQALAMLAPKIPEMLGGSADLTGSNLTDFPGCGAVRAGQPGGRHVNYGVREFGMAAIMNGLALHGGFIPYGGTFLTFSDYSRNGIRMAALMKLRVVHVFTHDSIGLGEDGPTHQAVEHAASLRLIPNLDVWRPCDAAETAVAWAFALEQRTRPSALLLSRQNLPPQARTAEQVAQIRRGGYVLSDRPEPQVVLIGTGSEVSIAMEAQRLLDAVGIAARVVSLPCSTLFDRQEAAWHEQVLGRGIPRIGVEAGVTSWWGQYHCVAALGVNSFGESAPGPQVYEHFGLDAKALADLAREVLAREVRFVRSRS

SEQ ID NO: 10080 - DNA, 1980 bp, Ralstonia metallidurans CH34
  CDS (1)..(1980): transl_table=11
atggcggatgccatccgcgtgcttgccatggacgctgtccagcaagccaactccggtcaccccggtgcgccgatgggtatggccgatatggccgtggcgctgtggggccggcatctgaagcataaccccgtcaatccgcactggcctgaccgcgaccgcttcgtgctgtccaacggccacggatcgatgctgatctacgcgctgctgcacctgaccggctatgacctgccgatcgaggaactgaagaacttccgccagttgcacagcaagaccgccggccacccggagtatggcattaccccgggcgtggaaaccacgaccggcccgctgggccagggcatcaccaatgccgtcggcatggcgctggccgagcgcctgctgggcgaggaattcaaccgcccgggtttcgacatcgtcaaccaccacacgtacgtgttcatgggcgatggctgcctgatggaaggcatcagccatgaagcctgctcgctggccggcacgctcaagctgaacaagctgatcggcttctgggatgacaacggcatctccatcgatggcgacgtggtgcactggtttgccgacgatacgccgaagcgtttcgaagcctatggctggaacgtgatccgcgccgtggacggccacgacgtggctgccgtcgacaacgccatcgcgctggccaaggccagcgacaagccgaccctgatctgctgccgcaccgtcatcggcaagggtgcgccgaacaaggccggcggccacgacgtgcatggcgcgccgctgggcggcgccgaagtgctggccacccgcgaagcgctgggctggacccacgccccgttcgaagtgccgcaggacgcgtacctcgcctgggacgcgaagccgaacggccacgcgctggaaaaggcctgggacgcactgttcgacgcctacgccgaagtgcatccgtacgaagccggtgagttcaagcgccgcgtgcgcggcgagctgccgggcgcgttcgatgcggccgtggacgcctacatcgccaagtgcgaggagaaggccgagacgatcgctacccgcaaggccagccagaactcgatcgaggcactggcgccggtactgccggaactgctgggcggctcggccgacctgaccggttcgaacctgaccaactggtcgggcacgcaggccgttcgcttcgactcgtggggcaaccacatcaactacggtgtgcgtgagttcggcatgagcgcgatcatgaacggcatcgcgctgcatggtggctacatcccctacggcgccacgttcctgacgttctcggactacagtcgcaacgcgttgcgcatggccgcgctgatgaagatccgctcgctgtttgtgttcacgcatgattcgatcggcctgggcgaagacggtccgacccaccagtcgatcgagcacgtggccagcctgcgtctgatcccgaacatggatgtctggcgtaccgccgacaccaccgagactgcagtggcctgggcgcagtcgatccgccgcgagaacggtccgagctgcctgattttcagccgccagaacttgccgttccagaagcgtgacgatgtcacgcgcgccaatatcgcgcgcggtggctacgtgctgcgcgatggcacgaatccgcgcaagaagcgcccggatgccgtgattatcgccaccggctcggaagtcggcctggccgtgggcgccgccgatgcgctggccgtggaaggcgtgcacgtgcgcgtggtgtcggttccgtcgacctccgtctttgacaagcaggacgccgcctacaaggccagcgtgctgccggcaggcgtgccgcgcatcgccgtggaagcgggcgtcaccgatttctggtggaagtaccaggttcaggccgtcgtcggtatcgacacgttcggcgaatcggccccggcaggcgtgctgttcaagcacttcggcttcaccgtggaaaacgtggccgatacggtgcgcgccacgctcgcccagtaa

SEQ ID NO: 10081 - protein, 659 aa, Ralstonia metallidurans CH34
MADAIRVLAMDAVQQANSGHPGAPMGMADMAVALWGRHLKHNPVNPHWPDRDRFVLSNGHGSMLIYALLHLTGYDLPIEELKNFRQLHSKTAGHPEYGITPGVETTTGPLGQGITNAVGMALAERLLGEEFNRPGFDIVNHHTYVFMGDGCLMEGISHEACSLAGTLKLNKLIGFWDDNGISIDGDVVHWFADDTPKRFEAYGWNVIRAVDGHDVAAVDNAIALAKASDKPTLICCRTVIGKGAPNKAGGHDVHGAPLGGAEVLATREALGWTHAPFEVPQDAYLAWDAKPNGHALEKAWDALFDAYAEVHPYEAGEFKRRVRGELPGAFDAAVDAYIAKCEEKAETIATRKASQNSIEALAPVLPELLGGSADLTGSNLTNWSGTQAVRFDSWGNHINYGVREFGMSAIMNGIALHGGYIPYGATFLTFSDYSRNALRMAALMKIRSLFVFTHDSIGLGEDGPTHQSIEHVASLRLIPNMDVWRTADTTETAVAWAQSIRRENGPSCLIFSRQNLPFQKRDDVTRANIARGGYVLRDGTNPRKKRPDAVIIATGSEVGLAVGAADALAVEGVHVRVVSVPSTSVFDKQDAAYKASVLPAGVPRIAVEAGVTDFWWKYQVQAVVGIDTFGESAPAGVLFKHFGFTVENVADTVRATLAQ

SEQ ID NO: 10082 - DNA, 2094 bp, Acidobacteria bacterium Ellin345
  CDS (1)..(2094): transl_table=11
atgtccagtgaaccagccgtaaaagaggaacagaaaatagcagccgaaccaaagcgcggtcccgagggcggcgttagcgaaaagcaggaagacctgctcgcgatcaacacgatccgcaccctctcgatggacgcggtgcagaaggcgaacagcgggcaccccggaacgccgatggcgctcgctccggtggcctatacgctgtggtcgcgcttcctgcgcttcaatccgaagaacccgcattgggccaaccgtgatcgcttcgttctgtccaacggccacgcctccatgctgctgtattccctgctgcatctcttcggatacggcctctcgctcgatgaattgaagaacttccgccagtgggattcgaagactcccggccaccccgagtaccgccttacagaaggcgtcgagaccacgactggtcctctcggccagggcgtcgcgaactccgtcggaatggcgatctctgaacgctggctggattcgcacttcaacaagggcgaccagaagattgtggactatcgtatttacgccatctgtggcgatggcgatctgatggaaggcgtttcgcaggaagccgcttcgattgctggccacctcgggctctcaaacttgctctggatttatgacaacaaccagatcacgattgagggcaatacctcactcgcattcagcgacgatgtgggcactcgattcctcagctatcactggaatgttctccgtgtaagtgacgcaaacgacgtggaatccatcgatcgagcgattcgcaccgctcagaaggaaaccgaacgcccgacgctgatcattctcgacagccacattgcctggggcgctccgaataagcaggataccgccgccgctcacggcgaaccgctcggcgaagacgagatcaaactggcgaagaaagcctacggctggccagaggacgcgaagttcctcgtgccgcaagaggtctatgaccacctgaagccatatgccgaccgcggcaaaaagctggaaggcgattggaacgacaagctgaacagctatcgttcggctaacgccgacctcgcgaaggaatgggacacgctccacgccggcaaactgcccgacggttgggacaaggacatcccggtgttccccgccgacgccaaaggcatggcgacccgcgaatcgaacggcaaagtgctgaatgccatcgcgaaaaatcttccgtggttaataggcggtgcagccgacctggcaccttcaaccaaaactttaatcaatggcgctaagggatttgaaaaaggctcgtatgatggccgcaacttccacttcggtatccgcgagcacgccatgggttccatcctgaatggaatggcactctcagggctgcggccgtacggcgccaccttcctgatcttcaccgactacatgaagccaccggttcgtctctcggcgctcatggaactgccggtgatcttcctttacacccacgactccatcggtctgggtgaggacggcccgacgcatcaaccgatcgagcagatgctcggcctgcgttcggtgccccgactcattgatttccgtcccggcgatgcgaatgaggttgctgtcgcctggaagacgattctccagttgcacaacacaccggtggcaatggcgctcagccgccagggcatgccgaccttcgaccgcaccaaatatgccagcgccgacggcgtcgccaagggtggctacgtgctggccgacagtgagaatcccgagctgatcctgattggcacgggttccgaagttcagctctgcgtgagcgcgtatgaggaactaaagaaggaaggcgttcgcgctcgagtggtgagtttgccgtcgtggaagctcttccagcagcaatcgcaggagtatcgcgactcggtactgccgccggcggttcgggcgcgcgttgccgtggaagccggtaccgatctcggctggcgcgagcacgttggcatcgatggcgagatcatcgcgcgctccgacttcggcgcctcggctcccatcaaggatttgttcaagcatttcggctttacggttgaaaacgtggtggcgaaatcgaaagtgacgcttgatcgcgtccgccagggcggaaagaagtag

SEQ ID NO: 10083 - protein, 697 aa, Acidobacteria bacterium Ellin345
MSSEPAVKEEQKIAAEPKRGPEGGVSEKQEDLLAINTIRTLSMDAVQKANSGHPGTPMALAPVAYTLWSRFLRFNPKNPHWANRDRFVLSNGHASMLLYSLLHLFGYGLSLDELKNFRQWDSKTPGHPEYRLTEGVETTTGPLGQGVANSVGMAISERWLDSHFNKGDQKIVDYRIYAICGDGDLMEGVSQEAASIAGHLGLSNLLWIYDNNQITIEGNTSLAFSDDVGTRFLSYHWNVLRVSDANDVESIDRAIRTAQKETERPTLIILDSHIAWGAPNKQDTAAAHGEPLGEDEIKLAKKAYGWPEDAKFLVPQEVYDHLKPYADRGKKLEGDWNDKLNSYRSANADLAKEWDTLHAGKLPDGWDKDIPVFPADAKGMATRESNGKVLNAIAKNLPWLIGGAADLAPSTKTLINGAKGFEKGSYDGRNFHFGIREHAMGSILNGMALSGLRPYGATFLIFTDYMKPPVRLSALMELPVIFLYTHDSIGLGEDGPTHQPIEQMLGLRSVPRLIDFRPGDANEVAVAWKTILQLHNTPVAMALSRQGMPTFDRTKYASADGVAKGGYVLADSENPELILIGTGSEVQLCVSAYEELKKEGVRARVVSLPSWKLFQQQSQEYRDSVLPPAVRARVAVEAGTDLGWREHVGIDGEIIARSDFGASAPIKDLFKHFGFTVENVVAKSKVTLDRVRQGGKK

SEQ ID NO: 10084 - DNA, 2022 bp, Silicibacter sp. TM1040
  CDS (1)..(2022): transl_table=11
atggatctgacagccctgcgctctgaaaaccccgatcattggaacaaagccgccgccatccgcgccctgacgctggatgcggttgcgggtgcaaactccggccactccggcatgccgattggcatggccgatgtcgcaaccgtgctgtttgaaaagcacatgaagttcgacgtctccgcccccaaatgggcggaccgcgatcgcttcatcctgtcggccggccacggctccatgctgatctattcgctgctctacctcatgggcgacgcacaggtcacgctcgagcagatcaagaacttccgtcagtccggcgcgctcacggcgggccacccggagaactttcttctggacgcggtcgaagtcaccaccggcccgcttggccaggggatctcgaacgctgtcggctttgccatggccgaggaaagcctgcgcgcccagtatggcaagaaggttgtcgatcactacacctatgtcatcgcgggcgacggctgcctcatggaaggcgtgagccaggaggcaatcggccttgccgggcgtcaccagctgggcaagctcgtggtgttctgggacaacaacaacatcaccatcgacggcaccgttgatctctctgatcgcaccaatcaggtgcagcgcttcaaagcgtccggttggcatgtgcaggaaatcgacggccataacccggccgagatcgacgccgccatcgaggccgcgaagaagaccaagaaaccgtcgatgatcgcctgcaaaacccatatcgctctgggtcacgctgcgcaggatacctccaaaggccacggcgctctgaccgacgccgatcagctcaaagccgccaaggaagcctatggctggaccggtggcgcctatgaggtgcccgccgagatcaaatcccagtgggaagcgatcggccagcgcggtgctacggcgcgcgctgaatgggaagcgcgttttgccgagatttccaagcagaaacaggaccggttcaaccgggcctttgcccttgaggcgccgaagaagctctccgcgaccgtgaaggcgctgaaaaagcagatctcggaaaccaaacccaaggtggcaacccgcaaggcgtcggaaatggcgcttgaggtcatcaacccgatcatgcccgaaaccattggcggctcggcggatctcaccggctccaacaacaccaagaccggcgatcttggggtgtttgacaccgacaaccgcaagggccgctatgtctattggggcatccgcgagcatggtatggcggcagcgatgaacggcatggcgctgcatggcggtattcgcccctatggcgggacgttcttctgctttaccgattatgcgcgtccggccatgcgtctggcggccctgtcgaagatcccgacggtctttgtgatgacccacgattccatcggtgtgggcgaagatggcccgacccaccagccggtcgagcatctcgcgatctgtcgcgcgaccccgaacacctataccttccgccctgccgacgcggtggaaaccgcagaagcctgggaaatcgcgctgacggccaaggaaaccccgtcggtgatcgcgctcacgcgtcagggcctgcccaccgtgcgcaccgagcacaagctggccaacctcaccgagaaaggcgcctatgtgctggccgaggccgagagcaagcgtcaggtgatcctgatggcttccggctccgaagtgtcggttgcgatggctgcaaaagacatcctcgagggtcaaggcatcggcacccgcgtggtctctgtgccctgcatggagctgttccacgcgcaggacgaagcctaccgccgcaaggttctgcccgcaggtcccgtgcgcgtggccatcgaggccgccgtgcgcgatggcggctgggatcgcctcttgctgggggaacgcggccaggagaagaaggcaggctttgtcggcatgcagggctttggtgcttctgccccggcgggtgagctctttgagaaattcggcattaccgccgaaggcaccgtcgccaaggtcaaagagctgttgggctaa

SEQ ID NO: 10085 - protein, 673 aa, Silicibacter sp. TM1040
MDLTALRSENPDHWNKAAAIRALTLDAVAGANSGHSGMPIGMADVATVLFEKHMKFDVSAPKWADRDRFILSAGHGSMLIYSLLYLMGDAQVTLEQIKNFRQSGALTAGHPENFLLDAVEVTTGPLGQGISNAVGFAMAEESLRAQYGKKVVDHYTYVIAGDGCLMEGVSQEAIGLAGRHQLGKLVVFWDNNNITIDGTVDLSDRTNQVQRFKASGWHVQEIDGHNPAEIDAAIEAAKKTKKPSMIACKTHIALGHAAQDTSKGHGALTDADQLKAAKEAYGWTGGAYEVPAEIKSQWEAIGQRGATARAEWEARFAEISKQKQDRFNRAFALEAPKKLSATVKALKKQISETKPKVATRKASEMALEVINPIMPETIGGSADLTGSNNTKTGDLGVFDTDNRKGRYVYWGIREHGMAAAMNGMALHGGIRPYGGTFFCFTDYARPAMRLAALSKIPTVFVMTHDSIGVGEDGPTHQPVEHLAICRATPNTYTFRPADAVETAEAWEIALTAKETPSVIALTRQGLPTVRTEHKLANLTEKGAYVLAEAESKRQVILMASGSEVSVAMAAKDILEGQGIGTRVVSVPCMELFHAQDEAYRRKVLPAGPVRVAIEAAVRDGGWDRLLLGERGQEKKAGFVGMQGFGASAPAGELFEKFGITAEGTVAKVKELLG

SEQ ID NO: 10086 - DNA, 2064 bp, Myxococcus xanthus DK 1622
  CDS (1)..(2064): transl_table=11
atgacaaccgacaagcaggacgtgctggccatcaacaccatccgcaccctcgccatggatgcggtacagcaggcccactcgggccacccgggggctcccatgtccctggcccccgtggcgtaccagctctggcagcaggagctccggtatgacccgtcccaccccatctggccggaccgggacaggttcatcctgtccaacggccacgcctccatgttgctgtacgcgctgctccacctggccggggtgaagcgcgtcacgcgggagtacaccgtcgaggacgcgcccaccgtgtcgctcgaggacatcaagaagttccggcagctcgactcgtccaccccgggccaccccgagtaccggtggaccagcggcgtggagacgaccaccggccccctgggccagggcgtgtccaacagcgtgggcatggccatggccagccgctggctcgcgagctactacaaccgccccggcttcgagatgttcgggtacgacgtctacgccatctgcggcgacggcgacctgatggagggcgtggcgtccgaggcggcgtccatcgccggccacctccagctacccaacctgtgctggatctacgacagcaaccacatctccatcgacggcagcaccgacctggccttcaccgaggacgtgggccggcgcttcgaggcctacggctggcgcgtgctgcgcgtgccggacgccaacgatttgaacgccatgggtgaggcgctgcgcaccttcaagacggcgcgcggcaagcccacgctcatcatcgtcaccacccagattgcctacggcgcgcccaagctccagggctcctccaaggcccacggcgagccgctgggcgacgaggaaatcaagggcaccaagcgcttctacggctggcccgaggacgagaagttcctggtccccgacggcgtgcgcgagcgcttccaggagcgcatgggcgctcggggcaagcagctgcgcacggagtgggagcagaagttcgccgagtaccgcaagcagttccccgagctggccgaccagttggagcgcatgcagcgccgcgacgcaccccagggctgggacgcggagctgccgacgttccccgccgatgccaagggactggccacgcgcgactccagcggcaaggtgctcaacgccatcgccaagcactacccgtggctggtgggcggctcggcggacctcaacccgtccacgaagacgtacatcaccggcggggaggcgatgaagccgggcgagtacgcggggcgcaacatccacttcggcgtgcgcgagcacgcgatgggctccatcgtcaacggcctgtgcctgagcaagctgcgcggctacggcgccacgttcctcatcttcagtgactacgagcgccccgccatccgcctctccgcgctgatggagctgcccgccatccacatcttcacccacgactccattggcgtgggcgaggacggccccacgcaccagccggtggagcagttggcgtcgctgcgcgcgattcccggcatcatcgtgctgcgccccggtgacgccaacgaggtggtcgagtcgtggcgggtgattgcccagcagcgcaagcaccccgtggtgctggtgctcacgcgccagcccgtgcccacgctggaccgcagcaagttcggcgcggcgtccggcgtggctcgcggcggctacgtgctgtccgaggcggagggcggcaagccggaggtcatcctcatcggcaccggcagcgaggtgtcgctgtgcctggacgcccaggagaagctcaaggcggacggcatcccggcgcgcgtggtcagcctgccgtcgtgggagctgttcgaggcgcaatcccaggagtaccgggacagcgtgctgcccccgtccgtgcgcgcccgcgtcgcggtggagaagggcgccaccttcggctgggagcgcttcgtggggcatgacggcaacatcgtcgccatgcgcagcttcggcgcctccgcgcccctcaaggcgctgcagcagaagttcggtttcaccgcggaccacgtggctcagcaggcgaaggactcgctgaagaagacgaagacgcggccgtaa

SEQ ID NO: 10087 - protein, 687 aa, Myxococcus xanthus DK 1622
MTTDKQDVLAINTIRTLAMDAVQQAHSGHPGAPMSLAPVAYQLWQQELRYDPSHPIWPDRDRFILSNGHASMLLYALLHLAGVKRVTREYTVEDAPTVSLEDIKKFRQLDSSTPGHPEYRWTSGVETTTGPLGQGVSNSVGMAMASRWLASYYNRPGFEMFGYDVYAICGDGDLMEGVASEAASIAGHLQLPNLCWIYDSNHISIDGSTDLAFTEDVGRRFEAYGWRVLRVPDANDLNAMGEALRTFKTARGKPTLIIVTTQIAYGAPKLQGSSKAHGEPLGDEEIKGTKRFYGWPEDEKFLVPDGVRERFQERMGARGKQLRTEWEQKFAEYRKQFPELADQLERMQRRDAPQGWDAELPTFPADAKGLATRDSSGKVLNAIAKHYPWLVGGSADLNPSTKTYITGGEAMKPGEYAGRNIHFGVREHAMGSIVNGLCLSKLRGYGATFLIFSDYERPAIRLSALMELPAIHIFTHDSIGVGEDGPTHQPVEQLASLRAIPGIIVLRPGDANEVVESWRVIAQQRKHPVVLVLTRQPVPTLDRSKFGAASGVARGGYVLSEAEGGKPEVILIGTGSEVSLCLDAQEKLKADGIPARVVSLPSWELFEAQSQEYRDSVLPPSVRARVAVEKGATFGWERFVGHDGNIVAMRSFGASAPLKALQQKFGFTADHVAQQAKDSLKKTKTRP

SEQ ID NO: 10088 - DNA, 1881 bp, Rubrobacter xylanophilus DSM 9941
  CDS (1)..(1881): transl_table=11
atggcgcatgtaaaccagaagaccgtagacgcgaccaccctgcgcgagctcgcgcagcagctgagggtggactcgatccgcgcgagcaccaccgccgggtccggccaccccacctcctccatgtccgcggcggacctcatggccgtcctcatggcgcgctacctccgctacgacttcgacgacccggagaaccccctcaacgaccggctcgtcttctccaagggccacgcctcgccgctgctctactccatgtacaaggcggccggggccataacggacgaggagctgctctccttccgcaagttcggcagccccctccagggccacccgacccccgccctccggtgggtggacgtggccaccggctcgctcgggcaggggctgcccataggggtcgggctcgcgctcgccggcaagcacctcgaccggctgccctaccgcgtgtgggtgctctgcggggactccgagatggccgagggctcgatgtgggaggccttccagcacgccgcccactacggtttggacaacctcgtcgccgtcctggacatgaaccggctcggccagacccgtgagaccatggacggctggaacggcgacgcctacgccggacgggcccgggccttcggctggcacgccatccagatcgacggccacgacgtggaggagatcgaccgggcctacgccgaggcgctggagcaggacaagccggtgctcgtgatcgcccggaccagaaaggggcgcggggtctccttcctcgaggaccagctcggcaagcacggcaagcccgtgccgccggagcaggccgagcaggccatagaggagctcggcggcgagcgcagcataaccgtcgaggtcccgcggcccgaccgcaggccgcagccccccgtaagggacgggttcaccggggagtacaggcccaagcggtgggaggtcggcgactccgaggccacccgcaccgcctacggcgaggggctcaaggcgctcggcgccgcccgcgaggacgtggtggtcatggacggcgaggtcagcgactccacccgggcccagaagttcgccgaggcctaccccgataggtacttcgagatgttcatcgccgagcagcagatggtcgccaccgccgtcgggatgagcgtgcgcgggtacgtgcccttcgcctccagcttcgccgccttcctcacccgggcccacgacttcatccggatggccgccatctccggggcgaacctgcggctgtgcggctcgcacgccggggtctccatcggtccggacggcccctcgcagatggggctcgaggacctggcgatgatgcgctcgctgcacggctccaccgtcctgtacccctgcgacgccaaccagacggtcaagctggtgcgggagatggccgggctcgaggggataagcttcctgcggaccacccgcgactcgacccccgtgatctaccccgccgacgaggagttcccggtgggcggcagcaaggtggtccgctcctcggaggaggacgcggtcaccgtggtcgccgcgggcatcaccgtccaccaggcgctgcgggccgccgaggagctgcagggggagggcatcagggtgcgcgtcatcgacgcctactcggtaaagcccatcgacgcccggaccctcatctcctcggcccgacagaccgcgggccgggtggtggtcgccgaggaccactggccggagggggggctcggcgaggcggtgctctccgccttcgccgagaacggggccctcgacggcctccggctccggcacctggcggtgagcggcatgccgggctccggcaagccgcaggagctcttggacgcggcggggatcggcttcggcgacatagccggggcggtgcgctccctgctggacggccgggcataa

SEQ ID NO: 10089 - protein, 626 aa, Rubrobacter xylanophilus DSM 9941
MAHVNQKTVDATTLRELAQQLRVDSIRASTTAGSGHPTSSMSAADLMAVLMARYLRYDFDDPENPLNDRLVFSKGHASPLLYSMYKAAGAITDEELLSFRKFGSPLQGHPTPALRWVDVATGSLGQGLPIGVGLALAGKHLDRLPYRVWVLCGDSEMAEGSMWEAFQHAAHYGLDNLVAVLDMNRLGQTRETMDGWNGDAYAGRARAFGWHAIQIDGHDVEEIDRAYAEALEQDKPVLVIARTRKGRGVSFLEDQLGKHGKPVPPEQAEQAIEELGGERSITVEVPRPDRRPQPPVRDGFTGEYRPKRWEVGDSEATRTAYGEGLKALGAAREDVVVMDGEVSDSTRAQKFAEAYPDRYFEMFIAEQQMVATAVGMSVRGYVPFASSFAAFLTRAHDFIRMAAISGANLRLCGSHAGVSIGPDGPSQMGLEDLAMMRSLHGSTVLYPCDANQTVKLVREMAGLEGISFLRTTRDSTPVIYPADEEFPVGGSKVVRSSEEDAVTVVAAGITVHQALRAAEELQGEGIRVRVIDAYSVKPIDARTLISSARQTAGRVVVAEDHWPEGGLGEAVLSAFAENGALDGLRLRHLAVSGMPGSGKPQELLDAAGIGFGDIAGAVRSLLDGRA

SEQ ID NO: 10090 - DNA, 2061 bp, Mesorhizobium sp. BNC1
  CDS (1)..(2061): transl_table=11
atgtgtcgcctgcttttgcgggcgcgagccccgccagtgcccgacagaccgcagccgacccagcgagcgcacatgatctcacgcgaaaaacacgaccggatggcgaatgcgatccgtttcctttcgatggatgccgtcgaaaaggccaagtccggacatccgggccttcccatggggacggctgacattgcgacagtccttttcacgcggttcatgaaacatgacccgaagacgccccattggccggatcgcgatcgcttcgtcctttcggcgggccacggctcgatgctgctttactcgctgctccacctgctgggctacgaggacatcacaatcgaggaaatcaagaatttccgccagctcggctcgcgtacggcaggtcatcccgaatatggcttcgctgccggcatcgagacgacgaccggccctctcggccagggcttcggcaatgccgtgggcatggcgatcgccgagcgtctgctcaacgcccgctacggtgacgaccttgtcaatcactttacctatgccctggtaggcgatggctgtctgatggaaggcatcagccaggaggccttgacgctcgccggccacctcaggctcaacaagctaatcgtcctcttcgacgataaccatatctccattgacggccctgtctcgcttgccgattccaccgatcagtgcgcgcgctttgccgcttcgggctggaatacgctgcgcgccgacgggcatgatcccgacgcgatcgcttcggccatcgagactgcgcgccagtccgatcggccgacgctgatcgccttccgcaccactatcggctacggctcgccgagcaaagccggcacgaacaaggtgcatggctctcctctcggcgccgacgagatcgccaagacacgctcagctctcggctgggattcacccccctttgttgtaccgtctgaggttctagacgactggcggctggccggccttcgctcggccaaagagcgtggctcgtgggaaaagcgccttgccgccgccgataccgagacgcgcgcgcagttcgagcggcgcatgcgcggcgatctcccggcggcctttccgggcgtcatcgtcgattacaagaaaaagctggcgcagcagaataccgccgttgctacccgaaacgcttccgagatggcgcttgaggtgatcaacgattgtattcccgagacggtgggtggctccgccgacctgactggctccaacaacaccaaaacgagccagacgactccaatcacgcctacggacttttcaggccgctacatacatttcggcattcgcgagcacgcgatggcggccgccatgaacggaattgccttgcatggcggtttgatcccttacggcggcacctttctgactttctccgattatgcccggccggccatgcggcttgcttccttgatgcatattcgttccatcttcgtcatgacgcacgattccatcggtctcggcgaggacggcccaacgcatcaaccggtcgagcatctggctgccctgcgcgctatcccgaatcacaatgttttccgtcccgcggatgctacggaaaccgctgaatgctggcagcttgcccttgaatcgaggaagacgccctccaccatcgccttgacgcgccagaaacttcagcccgtgcgccttgaattcgaggaggagaacctgtgtgcccgcggagcttacgaacttctgcccgccagcgacgaagcgaaggtgacaatcttcgccagcggctcggaagtggaaatcgccgtaaaggctcgtgtcatgctcgaagagcggggataccccacgcgcgtcgtctcggtgccctgtttcgagctgtttgaagagcagtcgcaggattatcagcgggcgattcttggtgatgctccggtgcggattgccattgaggccggcgtgcggcagggttgggatcgctttattggcgtcgatggcatcttcatcggcatgcacggctttggtgccagcggacccgcgcccgagctctaccagcatttcggcatcaccgccgaagctgctgttgaggcggtggaggcgcgactgcccgattga

SEQ ID NO: 10091 - protein, 686 aa, Mesorhizobium sp. BNC1
MCRLLLRARAPPVPDRPQPTQRAHMISREKHDRMANAIRFLSMDAVEKAKSGHPGLPMGTADIATVLFTRFMKHDPKTPHWPDRDRFVLSAGHGSMLLYSLLHLLGYEDITIEEIKNFRQLGSRTAGHPEYGFAAGIETTTGPLGQGFGNAVGMAIAERLLNARYGDDLVNHFTYALVGDGCLMEGISQEALTLAGHLRLNKLIVLFDDNHISIDGPVSLADSTDQCARFAASGWNTLRADGHDPDAIASAIETARQSDRPTLIAFRTTIGYGSPSKAGTNKVHGSPLGADEIAKTRSALGWDSPPFVVPSEVLDDWRLAGLRSAKERGSWEKRLAAADTETRAQFERRMRGDLPAAFPGVIVDYKKKLAQQNTAVATRNASEMALEVINDCIPETVGGSADLTGSNNTKTSQTTPITPTDFSGRYIHFGIREHAMAAAMNGIALHGGLIPYGGTFLTFSDYARPAMRLASLMHIRSIFVMTHDSIGLGEDGPTHQPVEHLAALRAIPNHNVFRPADATETAECWQLALESRKTPSTIALTRQKLQPVRLEFEEENLCARGAYELLPASDEAKVTIFASGSEVEIAVKARVMLEERGYPTRVVSVPCFELFEEQSQDYQRAILGDAPVRIAIEAGVRQGWDRFIGVDGIFIGMHGFGASGPAPELYQHFGITAEAAVEAVEARLPD

SEQ ID NO: 10092 - DNA, 2109 bp, Rhodococcus sp. RHA1
  CDS (1)..(2109): transl_table=11
gtgtcgatcacagacgacatccacgtcctcacgcaaccggttcaccccgccgactggaccgaactggacaccaaggccgtcgacaccatccgggtgctcgccgcggacgcggtgcagaaggtcggcaacggccaccccggcacggccatgagcctcgcgcccctcgcctacaccctgttccagcgcgtcatgcgccacgaccccaccgacgccgactggatcggccgcgaccggttcgtgctgtcctgcgggcactccagcctcaccctttacatccagctgtacctcgccggctacgggctcgaactcgacgacctggaagcattgcgcacctggggctcgaagacccccggccaccccgaacacggccacacccgcggcgtcgagatcaccaccggaccgctcggtcagggcctcgcctccgccgtgggcatggccatggccgcccgccgtgagcgcggcctcttcgaccccgagcccgcgctcggcgacagcccgttcgaccaccacatctacgtcatcgcctccgacggggacatcgaggagggcgtcacctccgaggcctcctccatcgccggcgtccagcagctcggcaacctgacgctgatctacgacgacaacaagatctccatcgaggacgacaccgcgatcgcgctgtccgaggacaccgccgcccgctacgaggcgtacggctggcacgtgcagatcgtcgagggcggcgagaacgtcgtcgccatcgaagaggccctgaacaaggcccgcgaggtcaccgacaagccgtcgctgatcctgctccgcaccatcatcggcttccccgcaccgaccaagatgaacacgggcgcggcgcacggcgccgccctcggtgccgacgaggtcgcggccgtgaagaaggctctcggcttcgatccggacaagacgttcgaggtcgccgacgaggtcatcgcccacacccgcaaggtcgtcgagcgcggcgcgcaggcacacaagcaatggcaggcccagtacgacgagtggacgcagcgcgcccccgagggcaagaagctcctcgaccgtctgatcggccgcgaccttcccgccggctgggccgacgtcctccccacctgggagccggatcccaagggcgtcgcgacccgcaaggcatccgccgccgttctcaacgccgtcgggccggtgctccccgaactgtggggcggctccgccgacctcgccgagagcaacaacaccaccatcaagggcgccgactcgttcggtcccgaagccatctccacccggatgtggacggcccagccctacggccgcaccctgcacttcggggtccgcgaacacgccatgggctctatcctcaacggcattgcgctgcacggaccgacccgcccctacggtggcaccttcctcgtcttcagcgactacatgcgtcccgctgtgcggctcgccgcgatcatgaagaccccggtcacctacgtgtggacgcacgactccatcggactcggtgaggacgggcccacccaccaaccgatcgaacacctcgccgcgctgcgcgcgatccccggcctgtacgtcgtgcggcccggcgacgccaacgagaccgcccacgcctggcgcgccgtcctcgagaagggcgccgacgaggccacccgcgctcccgccggcctcgccctgacccgccaggacctgcccgtcctcgagggcaccagctacgagggtgtctcccgcggcggctacgtcctcgccgacgcgtccaccggcgcaccggaggtcgtgctcatcggcaccgggtccgagctgcagctcgccgtggccgcccgcgagaccctcgaggccgacggcatccccacccgggtcgtgtccatgccctgcgtcgaatggttcgacgcccaggaccaggcctaccgcgacggcgtcctccccccgacggtcaaggcgcgggtctccgttgaagccggcatctccatgccctggtaccgcttcgtcggcgacgcgggcgaaatcgtgtccatcgagcacttcggcgcgtccgccgactacaagaccctgttccgcgagttcggtttcaccgccgaagccgtcaccgccgccgcacagcgctcgctcgcacgcgtgaagggatag

SEQ ID NO: 10093 - protein, 702 aa, Rhodococcus sp. RHA1
MSITDDIHVLTQPVHPADWTELDTKAVDTIRVLAADAVQKVGNGHPGTAMSLAPLAYTLFQRVMRHDPTDADWIGRDRFVLSCGHSSLTLYIQLYLAGYGLELDDLEALRTWGSKTPGHPEHGHTRGVEITTGPLGQGLASAVGMAMAARRERGLFDPEPALGDSPFDHHIYVIASDGDIEEGVTSEASSIAGVQQLGNLTLIYDDNKISIEDDTAIALSEDTAARYEAYGWHVQIVEGGENVVAIEEALNKAREVTDKPSLILLRTIIGFPAPTKMNTGAAHGAALGADEVAAVKKALGFDPDKTFEVADEVIAHTRKVVERGAQAHKQWQAQYDEWTQRAPEGKKLLDRLIGRDLPAGWADVLPTWEPDPKGVATRKASAAVLNAVGPVLPELWGGSADLAESNNTTIKGADSFGPEAISTRMWTAQPYGRTLHFGVREHAMGSILNGIALHGPTRPYGGTFLVFSDYMRPAVRLAAIMKTPVTYVWTHDSIGLGEDGPTHQPIEHLAALRAIPGLYVVRPGDANETAHAWRAVLEKGADEATRAPAGLALTRQDLPVLEGTSYEGVSRGGYVLADASTGAPEVVLIGTGSELQLAVAARETLEADGIPTRVVSMPCVEWFDAQDQAYRDGVLPPTVKARVSVEAGISMPWYRFVGDAGEIVSIEHFGASADYKTLFREFGFTAEAVTAAAQRSLARVKG

SEQ ID NO: 10094 - DNA, 1989 bp, Haemophilus somnus 129PT
  CDS (1)..(1989): transl_table=11
ttggcaaatgcaatccgttttttaagtatggatgcggtacaaaaagcaaaatctgggcatccgggagctccgatgggaatggcggatattgcggaagtattatggcgtgattttttaaatcataatccgactaatcctcaatgggcaaatcgtgatcgttttgtgttatctaacggtcatggctcaatgttaatttatagtttactgcatctcaccggttacgatctttctatcgaagatttaaaacaatttcgtcaattacattccaagactccggggcaccctgaatacggttatgctccgggtattgaaaccacaacaggtccattaggtcaaggcattactaacgctgtaggcatggcgattgcagaaaaaacgttagccgcacaatttaatcgagcaggtcatgacattgttgatcatcatacttacgtttttctaggggatggttgcttaatggagggtatttctcatgaggcttgttcattagccggcacgttaggtttgggtaaattgattgcgttctatgatgacaataatatctcaattgacggtcatgttgacggttggtttactgatgatacacaaaaacgttttgaggcttatggttggcatgttattcctgctgttgatggtcataatgcggaacaaattgttggtgcaataaaacaagctcaggctgagaaaaataaaccaactttaattatgtgtaagacgattattggctatggttctccaaataagcaaaatactcatgatagccatggtgcacctttgggcgatgaagaaatcgctttaactcgtcaagcattaaattggaattacgcaccttttgaaattcctgctgatatttatgcaaaatggaatgctcacgaaaaaggacaagtggcggaaaacgcatggaatgaaaaatttgccgcttatgagaaagcttatcctgaattagcagttgaatttaaacgccgtttaaatggggaattaccggcaaactgggcaacagaaagccaatcctttattgaaaaattacaagcaaatccggcaaacatcgccagtcgcaaagcatcacaaaatgctattgaggcttacgcaaaattattaccggagtttttaggcggttcagctgatttagcagggtcaaacttaacgttatggtccggttcaaaaccaattcgtgccacagaaaatgtagacggtaactacattaattatggtgtgcgtgaatttggtatgtctgccattatgaacggtattgcattacacggcggatttattccttacggtgcaacgttcttaatgtttatggaatatgcacataatgcagtgcgtatggcagccttgatgaaacaacgttcattatttgtttatacgcatgactctatcggtttaggagaagacggtccgactcatcaaccagttgagcaaacaaccgcacttcgcttaattccaaatttagaaacatggcgaccttgcgaccaagtggaatctgcaatcgcatggaaagcggcggttgaacgtcaagacggtccaagtgcattaattttcactcgacaaaatcttgctcaaatgaaccgcacttctgagcaattggaaaacgtgaaacgtggcggttatatcttgcgtgcatgctgtgaaaaaggtgattgtccggatttaatcttgatcgccaccggttctgaagtggaattagcgatgaaagcagcggaagcgttagatgcggaaggcgtgaaagtccgtgtggtatcaatgccgagtacgaatgtatttgataaacaagatgttgcgtaccgtgaggcagtattaccaagtgcggtgactaaacgcgttgcaattgaagcgggtatttcagatttctggtacaaatatgttggtactaacggacgtatcattggtatgaatagcttcggtgaatcagcaccagcagatcaactgtttaaactctttggcttcactgttgaaaatattgtgtcaaaggcaaaagagattttataa

SEQ ID NO: 10095 - protein, 662 aa, Haemophilus somnus 129PT
MANAIRFLSMDAVQKAKSGHPGAPMGMADIAEVLWRDFLNHNPTNPQWANRDRFVLSNGHGSMLIYSLLHLTGYDLSIEDLKQFRQLHSKTPGHPEYGYAPGIETTTGPLGQGITNAVGMAIAEKTLAAQFNRAGHDIVDHHTYVFLGDGCLMEGISHEACSLAGTLGLGKLIAFYDDNNISIDGHVDGWFTDDTQKRFEAYGWHVIPAVDGHNAEQIVGAIKQAQAEKNKPTLIMCKTIIGYGSPNKQNTHDSHGAPLGDEEIALTRQALNWNYAPFEIPADIYAKWNAHEKGQVAENAWNEKFAAYEKAYPELAVEFKRRLNGELPANWATESQSFIEKLQANPANIASRKASQNAIEAYAKLLPEFLGGSADLAGSNLTLWSGSKPIRATENVDGNYINYGVREFGMSAIMNGIALHGGFIPYGATFLMFMEYAHNAVRMAALMKQRSLFVYTHDSIGLGEDGPTHQPVEQTTALRLIPNLETWRPCDQVESAIAWKAAVERQDGPSALIFTRQNLAQMNRTSEQLENVKRGGYILRACCEKGDCPDLILIATGSEVELAMKAAEALDAEGVKVRVVSMPSTNVFDKQDVAYREAVLPSAVTKRVAIEAGISDFWYKYVGTNGRIIGMNSFGESAPADQLFKLFGFTVENIVSKAKEIL

SEQ ID NO: 10096 - DNA, 2019 bp, Trichodesmium erythraeum IMS101
  CDS (1)..(2019): transl_table=11
atggctgttgcaactcaatcacttgaagaactttgcattaactctattcgctttttagcaattgatgcagtccaaaaagctaattctggccatccaggactaccaatgggtgcggcaccaatggcctttgtcctttgggataagttgatgcggtttaaccccaaaaatcctaaatggttaaatcgcgatcgctttgttctctctgctggccacggctgtatgttacagtatgctttgatgcacttgactggttatgacagtgtacctatagaggaaattaaacaattccgtcagtggaattctaaaactcctggccatccagaaaatcatattactgaaggtattgaagttactactgggccactaggacaaggtattgctaatgctgtaggattagctgcagctgaagctcatttagctgctgtatttaataagccagattgtaatctcattgaccattatacttatgtaattgtgggtgatggttgtaatatggaggggatttctggtgaagcttgctcccttgccggacactggggtttaggtaagttaattgctttctatgatgataaccatatctctattgatggtcacactgatatttcttttactgaagatgtaggtaaacgttttgaagcttatggttggcacgttcagcacgttagcgatggtaatactaatttagaagcgatcgctgaagctattgaaaaagcaaaagcagttactgacaaaccttccctaattaaagttactactattattggttacggttctcctaataaagctgatactcacgatgtacatggtgcggcactaggtcctgatgaggtggcagcaactcggaaacatcttggttgggaatatccagagtttgaggttccaccagatgctctcagtcacttccgcaaagcagttgagcgaggagctaaatatgaggaagaatggaatcaattattctctgagtataagtctaagtatcctgaagatgcagctactttagaacggatggtaagtggtaaactacctgaaggttgggcggatgcactacctaaatatactcctgaaagtaagaaagatgctactcgtaaccagtctggtgcaacactcaacgcaatagctggagttttaccagaattaattggtggttctgctgacttggctccttctaacaaaactttactcaagggtttaggagattttcaaaaaggtcaataccaaaaccgaaatgtgcgctttggggttcgggaacatggaatgggagcaatttgtaacggtattgctctacacggttctgggttaatttcttatggtgcaactttcttggtgtttactgactatatgcggaactctatccgtttatctgctttagctgaagctggtgttatttgggtaatgactcacgactccatcgctttgggtgaagacggaccgactcaccaaccagttgaacatattgcatccttacgtttgattccacaactgatagttattcgtccagcagatggtaatgaaacttctggggcttataagattgcagtagaaaaagctaaagcaagtcatcctcaaccgactctgttagcattatctcgtcaaggtttacctaatttagctggtagttctattgatgcggttgctaaaggtgcttatgtgcttagtgacagcgagggtactcctgacattattcttattggtactggtggtgaaacttaccaatgtgtggaagctggtgaaaaacttcgtgctgaaggtaagaaggttcgggtagtttctatgccatgttgggaattatttgaagagcaggatgcagcttataaggagtctgtgttccctgcgtctgtgaagaagcgtttggcagtggaagcaggtgttagttttggttggcatcgttatgtgactgatgaaggtgcgactttgagtgttgatacttttggtgcttctgctcctggcggtgtggtactggaaaagtttggatttactgttgataacattgtagctaaggctaaggcattgttgggttaa

SEQ ID NO: 10097 - protein, 672 aa, Trichodesmium erythraeum IMS101
MAVATQSLEELCINSIRFLAIDAVQKANSGHPGLPMGAAPMAFVLWDKLMRFNPKNPKWLNRDRFVLSAGHGCMLQYALMHLTGYDSVPIEEIKQFRQWNSKTPGHPENHITEGIEVTTGPLGQGIANAVGLAAAEAHLAAVFNKPDCNLIDHYTYVIVGDGCNMEGISGEACSLAGHWGLGKLIAFYDDNHISIDGHTDISFTEDVGKRFEAYGWHVQHVSDGNTNLEAIAEAIEKAKAVTDKPSLIKVTTIIGYGSPNKADTHDVHGAALGPDEVAATRKHLGWEYPEFEVPPDALSHFRKAVERGAKYEEEWNQLFSEYKSKYPEDAATLERMVSGKLPEGWADALPKYTPESKKDATRNQSGATLNAIAGVLPELIGGSADLAPSNKTLLKGLGDFQKGQYQNRNVRFGVREHGMGAICNGIALHGSGLISYGATFLVFTDYMRNSIRLSALAEAGVIWVMTHDSIALGEDGPTHQPVEHIASLRLIPQLIVIRPADGNETSGAYKIAVEKAKASHPQPTLLALSRQGLPNLAGSSIDAVAKGAYVLSDSEGTPDIILIGTGGETYQCVEAGEKLRAEGKKVRVVSMPCWELFEEQDAAYKESVFPASVKKRLAVEAGVSFGWHRYVTDEGATLSVDTFGASAPGGVVLEKFGFTVDNIVAKAKALLG

SEQ ID NO: 10098 - DNA, 2010 bp, Synechococcus sp. CC9311
  CDS (1)..(2010): transl_table=11
atggccgccgcaaccgcttctctcgatacgctctgcgtcaacagcatccgcatgctggccgttgatgccgtcaataaatccaatagcggtcaccccggtttgcccatgggctgcgcaccgatggggtacacgttgtgggacaagtttctcaagcacaaccccaaaaacccaaagtggttcaatcgggatcggtttgtgctgtcagccggccatggctgcatgctgcagtacgccctcctgcacctcaccggctacgactccgtaaccatcgacgacatcaaacaattccggcagtggggctcgaaaacgccaggacatccggaaacatttgaaacccctgggatcgaagtcaccaccgggccccttggcgcaggaatctccaatgccgtgggtctggccattgccgaatcacacctgggcgccaaattcaacaaggctgacgccaaagttgtggaccacttcacctacgtgatcatgggtgatggctgcaatcaggaaggcgtggcttcagaagctgcctccctggccggccacctcaaattgggcaaattgattgccctctatgacgacaatcacatcaccattgatgggcgaactgatgtgtcgttcaccgaggacgttctcaagcgttacgaagcctatggctggcacgtacaacacgtggccgacggagacaccgacgtgaacgcgatcgccaaggcgattgaggccgcgaaagccgtcaccaacaagccttcgatcatcaaggtgaccaccaccattggttacggctcacccaacaagagtgatacggctggtgtccatggcgccccgcttggagcagaggaagctgagctcacacgcaagcaattgggctggacccacggcccattcgaaattcctcaagaggcctacgaccagtaccgccaggcggtggagcgcggcgcttcccaggaagctgagtggaatcagtctttggcgaactaccgcagcaaataccccacagaatctgcagaatttgagcgcatgctgcggggcgaactcccccagggctgggacaaagatctgcctacttacaccccagacgacaaaggtctggccacacgcaaacattcccagatctgtcttggagcgctaggcgccaacctgcccgaattgatcggcggctctgctgacctcacccactccaactacaccgacatcgccggagaaactggctcttaccagcccgaaacccctgaaaagcgctacctccacttcggtgtacgcgagcacgcgatggcggcagtactcaatggcatcgcttatcacaacagcggcctgatcccctacggcggcaccttccttgtgtttgccgattacatgcgcggttccatgcgcttatctgcactgagcatgcttggtgtgatttacgtgctaacccacgattccatcggtgttggcgaagacggccccacccaccagccgatcgaaaccatcccatcgctccgcgccatgcctggaatgctggtgttccgtcctggcgacggcaatgaaaccagtggtgcctacaagcttgcaatcgaaaatcgcaaccgccccagcgcgatgtgcctcagccgtcaggggatggcgaatcaagccaactcttcgatcgacaaagtggcattcggcggttacatccttgaagactgtgcaggcacacccgatctgattttgatcggtacaggcaccgaacttgacctctgcgtgcaagctgccaaacagctgacctcagaaggcaaaaatgtgcgcgtcgtctccatgccttgcgttgagctctacgacgagcaaagcgatgcttacaaagaagaagtgctccccaacgctgttcgtaagcggatcgtggtggaagccgctgaaacctttggctggcatcgtttcattggtctcgatggcgacagcatcaccatgaatcgcttcggcgcctccgctccaggcggcacctgcatggagaagttcggcttcaccgtcgacaacgtggttgcgaagtcaaaggctctactgggctga

SEQ ID NO: 10099 - protein, 669 aa, Synechococcus sp. CC9311
MAAATASLDTLCVNSIRMLAVDAVNKSNSGHPGLPMGCAPMGYTLWDKFLKHNPKNPKWFNRDRFVLSAGHGCMLQYALLHLTGYDSVTIDDIKQFRQWGSKTPGHPETFETPGIEVTTGPLGAGISNAVGLAIAESHLGAKFNKADAKVVDHFTYVIMGDGCNQEGVASEAASLAGHLKLGKLIALYDDNHITIDGRTDVSFTEDVLKRYEAYGWHVQHVADGDTDVNAIAKAIEAAKAVTNKPSIIKVTTTIGYGSPNKSDTAGVHGAPLGAEEAELTRKQLGWTHGPFEIPQEAYDQYRQAVERGASQEAEWNQSLANYRSKYPTESAEFERMLRGELPQGWDKDLPTYTPDDKGLATRKHSQICLGALGANLPELIGGSADLTHSNYTDIAGETGSYQPETPEKRYLHFGVREHAMAAVLNGIAYHNSGLIPYGGTFLVFADYMRGSMRLSALSMLGVIYVLTHDSIGVGEDGPTHQPIETIPSLRAMPGMLVFRPGDGNETSGAYKLAIENRNRPSAMCLSRQGMANQANSSIDKVAFGGYILEDCAGTPDLILIGTGTELDLCVQAAKQLTSEGKNVRVVSMPCVELYDEQSDAYKEEVLPNAVRKRIVVEAAETFGWHRFIGLDGDSITMNRFGASAPGGTCMEKFGFTVDNVVAKSKALLG

SEQ ID NO: 10100 - DNA, 1995 bp, Shewanella sp. MR-4
  CDS (1)..(1995): transl_table=11
atgtcttcccgtaaagtactcgccaacgcaatccgtgcgttaagtatggatgcagttcaaaaagcaaactcaggccaccctggcgccccaatgggcatggcagatattgctgaagtgctgtggaatgatttccttaagcacaatccgaacaatccgaaatgggtagatagagatcgttttatcctctctaacggtcacggatctatgctgatctactctttattacacctgactggctacgacctgcctatcgatgaactgaagcaattccgtcagttacattcaaaaactccgggtcacccagaatacggttacaccccaggtgttgaaaccaccactggcccattaggggcggggatcagcaacgctgtgggtatggcgattgcagaaaaaaccttagcggcacagtttaaccgtgaaggtcacgagattgttgaccactacacttactgcttcctcggcgatggctgcttgatggaaggtatttcccacgaggcttgttctcttgctggtaccttaggcctaggcaaactgatcgcattttgggatgacaacggcatctctatcgacggtcatgttgaaggctggtttaccgatgacacgccaaaacgtttcgaatcatacggctggcatgtgattgctaacgttgatggtcacgatagcgatgcgattcgcgcggctatcgaagcggcaaaagcggtgaccgacaagccaaccatgatctgctgcaaaaccattatcggttttggttctccaaacaaatctggtagccacgattgccacggcgcaccattaggtgatgccgaaatcgcagcggcccgtgaattcttaggctggtcacatgcgccattcgaaatccctgccgacgtatacgcaggttgggatgctaaagaagccggtaacgcccgtgaagccgcatggaacgacaagtttgccgcttacgcgaaagcttacccagaactggctgccgaatacgagcgccgtgttctgaaaggtgaattaccagcagattttgaagccaaagcacaagcctttatccaagaatgccaagcgaaaggcgaaggcattgcgagccgtaaagcgtcacaaaacgcgattgcagccttcggtgcagttctgcctgaactgttaggcggcagtgctgacttagcgggttctaacctgaccctgtgggcaggttctaaaggtattcaagaagatccagcgggtaactacgtgtactacggtgtgcgtgagttcggtatgagcggcatcatgaacggtgtgtcactccacggtggtttcatcaactacggcgcgactttcatgatgttcatggaatacgcacgtaacgcagtacgtatgtctgcgctgatgggcattcaaaacatcttcgtttatacccatgactctatcggtcaaggtgaagatggtccaactcaccaaccagttgagcaattagctaacctgcgtatgacgccaaacatggcggtatggcgtccatgtgacgcggctgaaaccgcagtggcttggaaagcggctatcgaacgtcgtcatgcaccaacatcgctagtattcagccgtcaaaacctgaaggctcaagtacgtactgctgagcaattagcgaatgtggcaaaaggcgcttacgtactgcaagactgtgcaggtacgcctgagtacatcctgattgcgaccggtagtgaagtgcaattagcggtagaagctgcagctgcgctgaccgaacaaggcaaacaagttcgcgttgtttctatgccatcaaacactgagtttgataagcaagatgccgcttacaaagaatctgtactgccaaaagctgtgactaagcgtatcgctatcgaagcggcccatactgacttctggtacaagtatgttggtttcgaaggcactgttgttggcatgaccactttcggtgagtctgcgccaggcaacgtgctgctgaagcacttcggtttcaccgttgaaaatgtgctgaatgctgcaaaatcactaggctaa

SEQ ID NO: 10101 - protein, 664 aa, Shewanella sp. MR-4
MSSRKVLANAIRALSMDAVQKANSGHPGAPMGMADIAEVLWNDFLKHNPNNPKWVDRDRFILSNGHGSMLIYSLLHLTGYDLPIDELKQFRQLHSKTPGHPEYGYTPGVETTTGPLGAGISNAVGMAIAEKTLAAQFNREGHEIVDHYTYCFLGDGCLMEGISHEACSLAGTLGLGKLIAFWDDNGISIDGHVEGWFTDDTPKRFESYGWHVIANVDGHDSDAIRAAIEAAKAVTDKPTMICCKTIIGFGSPNKSGSHDCHGAPLGDAEIAAAREFLGWSHAPFEIPADVYAGWDAKEAGNAREAAWNDKFAAYAKAYPELAAEYERRVLKGELPADFEAKAQAFIQECQAKGEGIASRKASQNAIAAFGAVLPELLGGSADLAGSNLTLWAGSKGIQEDPAGNYVYYGVREFGMSGIMNGVSLHGGFINYGATFMMFMEYARNAVRMSALMGIQNIFVYTHDSIGQGEDGPTHQPVEQLANLRMTPNMAVWRPCDAAETAVAWKAAIERRHAPTSLVFSRQNLKAQVRTAEQLANVAKGAYVLQDCAGTPEYILIATGSEVQLAVEAAAALTEQGKQVRVVSMPSNTEFDKQDAAYKESVLPKAVTKRIAIEAAHTDFWYKYVGFEGTVVGMTTFGESAPGNVLLKHFGFTVENVLNAAKSLG

SEQ ID NO: 10102 - DNA, 1995 bp, Shewanella sp. MR-7
  CDS (1)..(1995): transl_table=11
atgtcttcccgtaaagtactcgccaacgcaatccgtgcgttaagtatggatgcagttcaaaaagcaaactcaggccaccctggcgccccaatgggcatggcagatattgctgaagtgctgtggaatgatttccttaagcacaatccgaacaatccgaaatgggtagatagagatcgttttatcctctctaacggtcacggatctatgctgatctactctttattacacctgactggctacgacctgcctatcgatgaactgaagcaattccgtcagttacattcaaaaactccgggtcacccagaatacggttacaccccaggtgttgaaaccaccacaggcccattaggggcggggatcagcaacgctgtgggtatggcgattgcagaaaaaaccttagcggcacagtttaaccgtgaaggtcacgagattgttgaccactacacttactgcttcctcggcgatggctgcttgatggaaggtatttcccacgaagcttgttctctggctggtaccttaggcctaggcaaactgatcgcattttgggatgacaacggcatatctatcgacggtcatgttgaaggctggtttaccgatgacactccaaaacgtttcgaatcatacggctggcatgtgattgctaacgttgatggtcacgatagcgatgcgattcgcgcggctatcgaagcggcaaaagcggtgaccgacaagccaaccatgatctgctgcaaaaccattatcggttttggttcaccaaacaaatctggtagccacgattgccacggcgcgccattaggtgatgcggaaatcgcagcggcccgtgaattcttaggctggccacatgcgccattcgaaatccctgccgacgtatacgcaggttgggatgctaaagaagccggtaacgcccgtgaagcagcatggaatgacaagtttaccgcttacgcgaaagcttacccagaactggctgccgaatacgagcgccgcgttctgaaaggtgaattaccagcagatttcgaagccaaagcacaagcctttatccaagaatgccaagcgaaaggcgaaggcattgcgagccgtaaagcgtcacaaaacgcgattgcagccttcggtgcggttctgcctgaactgttaggcggcagtgctgacttagcgggttctaacctgaccttgtgggcaggttctaaaggcattcaagaagatccagcgggtaactacgtgtactacggtgtgcgtgagttcggtatgagcggcatcatgaacggtgtgtcactccacggtggtttcatcaactacggcgcgactttcatgatgttcatggaatacgcacgtaatgcagtacgtatgtctgcgctgatgggcattcaaaacatcttcgtttatacccatgactctatcggtcaaggtgaagatggtccaactcaccaaccagttgagcaattagctaacctgcgtatgacgccaaatatggcggtatggcgcccatgtgacgctgctgaaactgcagtggcttggaaagcggctatcgaacgtcgtcatgcaccaacatcgctagtattcagccgtcaaaacctgaaggctcacgcacgtactgctgagcaattagcgaatgtggcaaaaggcgcttacgtactgcaagactgtgcaggtacacctgagtacatcctgattgcgaccggtagtgaagtgcaattagcggtagaagctgcagctgcgctgaccgaacaaggcaaacaagttcgcgttgtttctatgccatcaaacactgagtttgataagcaagatgctgcttacaaagaatctgtactgccaaaagctgtgactaagcgtatcgctatcgaagcggcccatactgacttctggtacaagtatgttggtttcgaaggcactgttgttggcatgaccactttcggtgagtctgcgccaggcaacgtgctgctgaagcacttcggtttcaccgttgaaaatgtgctgaatgctgcaaaatcactaggctaa

SEQ ID NO: 10103 - protein, 664 aa, Shewanella sp. MR-7
MSSRKVLANAIRALSMDAVQKANSGHPGAPMGMADIAEVLWNDFLKHNPNNPKWVDRDRFILSNGHGSMLIYSLLHLTGYDLPIDELKQFRQLHSKTPGHPEYGYTPGVETTTGPLGAGISNAVGMAIAEKTLAAQFNREGHEIVDHYTYCFLGDGCLMEGISHEACSLAGTLGLGKLIAFWDDNGISIDGHVEGWFTDDTPKRFESYGWHVIANVDGHDSDAIRAAIEAAKAVTDKPTMICCKTIIGFGSPNKSGSHDCHGAPLGDAEIAAAREFLGWPHAPFEIPADVYAGWDAKEAGNAREAAWNDKFTAYAKAYPELAAEYERRVLKGELPADFEAKAQAFIQECQAKGEGIASRKASQNAIAAFGAVLPELLGGSADLAGSNLTLWAGSKGIQEDPAGNYVYYGVREFGMSGIMNGVSLHGGFINYGATFMMFMEYARNAVRMSALMGIQNIFVYTHDSIGQGEDGPTHQPVEQLANLRMTPNMAVWRPCDAAETAVAWKAAIERRHAPTSLVFSRQNLKAHARTAEQLANVAKGAYVLQDCAGTPEYILIATGSEVQLAVEAAAALTEQGKQVRVVSMPSNTEFDKQDAAYKESVLPKAVTKRIAIEAAHTDFWYKYVGFEGTVVGMTTFGESAPGNVLLKHFGFTVENVLNAAKSLG

SEQ ID NO: 10104 - DNA, 2001 bp, Alkalilimnicola ehrlichei MLHE-1
  CDS (1)..(2001): transl_table=11
atgcccacacgccgagatctggccaatgccatccgagccctgtccatggacgcggtgcagcgcgcccattccggtcacccgggcgcgcccatgggcatggcggatattgccgaagtgctgtggaacgactatctgcgccacaacccggccaacccccactggtgggaccgggaccggtttgtgctctccaacggtcacggctcgatgctgctttacagcctgctgcacctgtcgggctatgagctgggcattgacgatctgaaggccttccgccaactgcactccaggacccccggtcacccggagtacggctacaccgcgggggtggagaccaccaccgggccgctgggccaggggctggccaacgcggtggggctggcgctggccgagcgcaccctggccgcgcagttcaaccgcccgggccacgagctggtggatcactggacctactgcttcctgggcgatggctgtctgatggagggggtgagtcacgaggcctgctcgctggccggcacatggaagctgggcaagctgatcggtttttacgacgacaacggcatctccattgacggcaaggtggagggctggttcaccgacgatacgccgggccggtttgaggcttacggctggcatgtggtgcgcgaggtggacgggcacgattcggaggcgatcaagcgcgccattgatgaggcgcgtgcggtgaccgaccggccgagcctgatctgctgcaagacggtgatcggctttggcgcgcccaacgtctgcggcacccacggggtgcacggtgcgccgctgggcgatgaggagatccaggccacgcgcgagttcctgaagtgggagcacgggccgtttgagatcccgcgcgagatctacagcgggtgggatgcgcgggcgcgcggcaagcagttggaggcggcctggcacgagcggctggccgcttaccgcaaggcgcacccggagatggcggcggagtttgagcggcggatgaagggcgcgctgcccgagcggtttgcccagcacgccgaggaggcgctggccgaggcggtggacgagtcggccaaggtggccacgcgcaaggcctcggagcaggcgctcaaccggctggggccgtacctgccggagctgctcggcggctcggcggacctgtccggctccaacaacaccaagtgggaagactgcgcggtgatcggcggggcgaaggccgacgccgatggcaattacctccactacggggtgcgtgagttcggcatgagcgccattgccaacgggctggcgctgcacggcgggttcatcccctacaccggcacctttctggtgttctccgattacgcgcgcaacgccatccgcatggcggcgctgatgggcatacagcagatctttgtccacacccacgactctatcggtctgggcgaggatggcccgacccaccagccggtggagcatctggggagtctgcgcatgatcccggggctggatgtctggcgcccgtgcgatgccattgagacccaggcggcgtggcaggcggcgctggagcgccgtgacgggccgagtctgctggcgctctcgcgccaggggttggtggcgcagcagcgcaccgacgagcaggtggcgttgattcggcgcggcggttatgtgctggccgagcccaagcagggtgaggcggagctgatcctgatggccaccggcagtgaggtggcgatcatggtggaggcggccgagcggctggccgaccggggccggcgggtgcgggtggtgtccatgccctgtctggaggtgttccagtcgcagccggccgactaccgcgaggcggtgctgccggcgggggtgccggtgatcgccatggaggcggcccacccgatgccctggcaggcgctgctgggcgaccgcggccgggtgatcggcatcgacaccttcggcgagtcggcaccggggccggcactctacgagcatttcggcatcaacgtcgacgcggtggtcaaggccagcaccacggtgatctga

SEQ ID NO: 10105 - protein, 666 aa, Alkalilimnicola ehrlichei MLHE-1
MPTRRDLANAIRALSMDAVQRAHSGHPGAPMGMADIAEVLWNDYLRHNPANPHWWDRDRFVLSNGHGSMLLYSLLHLSGYELGIDDLKAFRQLHSRTPGHPEYGYTAGVETTTGPLGQGLANAVGLALAERTLAAQFNRPGHELVDHWTYCFLGDGCLMEGVSHEACSLAGTWKLGKLIGFYDDNGISIDGKVEGWFTDDTPGRFEAYGWHVVREVDGHDSEAIKRAIDEARAVTDRPSLICCKTVIGFGAPNVCGTHGVHGAPLGDEEIQATREFLKWEHGPFEIPREIYSGWDARARGKQLEAAWHERLAAYRKAHPEMAAEFERRMKGALPERFAQHAEEALAEAVDESAKVATRKASEQALNRLGPYLPELLGGSADLSGSNNTKWEDCAVIGGAKADADGNYLHYGVREFGMSAIANGLALHGGFIPYTGTFLVFSDYARNAIRMAALMGIQQIFVHTHDSIGLGEDGPTHQPVEHLGSLRMIPGLDVWRPCDAIETQAAWQAALERRDGPSLLALSRQGLVAQQRTDEQVALIRRGGYVLAEPKQGEAELILMATGSEVAIMVEAAERLADRGRRVRVVSMPCLEVFQSQPADYREAVLPAGVPVIAMEAAHPMPWQALLGDRGRVIGIDTFGESAPGPALYEHFGINVDAVVKASTTVI

SEQ ID NO: 10106 - DNA, 1998 bp, Alkalilimnicola ehrlichei MLHE-1
  CDS (1)..(1998): transl_table=11
atgcccacacgccgagatctggccaacgccatccgagccctgtccatggacgcggtccagcgcgcccattccggtcacccgggcgcgcccatgggcatggcggacatcgccgaagtgctgtggaacgactatctgcgccacaacccggccaacccccactggtgggaccgggaccggtttgtgctctccaacggtcacggctcgatgctgctttacagcctgctgcacctgtcgggctatgagctgggcattgacgatctgaaggccttccgccaactgcactccaggacccccggtcacccggagtacggctacaccgcgggggtggagaccaccaccgggccgctgggccaggggctggccaacgcggtggggctggcgctggccgagcgcaccctggccgcgcagttcaaccgcccgggccacgagctggtggatcactggacctactgcttcctgggcgatggctgtctgatggagggggtgagtcacgaggcctgctcgctggccggcacatggaagctgggcaagctgatcggtttctacgacgacaacggcatctccattgacggcaaggtggagggctggttcaccgacgatacgccgggccggtttgaggcttacggctggcatgtggtgcgcgaggtggacgggcacgatgcggaggcgatcaagcgcgccattgatgaggcgcgggcggtgaccgaccggccgagcctgatctgctgcaagacggtgatcggctttggcgcgcccaacgtctgtggcacccacggggtgcacggtgcgccgctgggcgatgaggagatccaggccacgcgcgagttcctgaagtgggagcacgggccgtttgagatcccgcgcgagatctacagcgggtgggatgcgcgggcgcgcggcaagcagttggaggcggcctggcacgagcggctggccgcttaccgcaaggcgcacccggagatggcggcggagtttgagcggcggatgaagggcgagctgcccgagcggtttgcccagcacgccgaggaggcgctggccgaggcggtggacgagtcggccaaggtggccacgcgcaaggcctcggagcaggcgctcaaccggctggggccgtacctgccggagctgctcggcggctcggcggacctgtccggctccaacaacaccaagtgggaagactgcgcggtgatcggcggggcgaaggccgacgccgatggcaattacctccactacggggtgcgtgagttcggcatgagcgccattgccaacgggctggcgctgcacggcgggttcatcccctacaccggcacctttctggtgttctccgattacgcgcgcaacgccatccgcatggcggcgctgatgggcatccagcagatctttgtccacacccacgactctatcggtctgggcgaggatggcccgacccaccagccggtggagcatctggggagtctgcgcatgatcccggggctggatgtctggcgcccgtgcgatgccattgagacccaggcggcgtggcaggcggcgctggagcgccgtgacgggccgagtctgctggcgctctcgcgccaggggctggtggcgcagcagcgcaccgacgagcaggtggcgttgattcggcgcggcggttatgtgctggccgagcccaagcagggtgaggcggagctgatcctgatggccaccggcagtgaggtggcgatcatggtggaggcggccgagcggctggccgaccggggccggcgggtgcgggtggtgtccatgccctgtctggaggtgttccagtcgcagccggccgactaccgcgaggcggtgctgccggcgggggtgccggtgatcgccatggaggcggcccacccgatgccctggcaggcgctgctgggcgaccgcggccgggtgatcggcatcgacaccttcggcgagtcggcaccggcaccggcgctctacgagcacttcgggctgaccgtggacgccgtggtccaggccacggagaccctgtaa

SEQ ID NO: 10107 - protein, 665 aa, Alkalilimnicola ehrlichei MLHE-1
MPTRRDLANAIRALSMDAVQRAHSGHPGAPMGMADIAEVLWNDYLRHNPANPHWWDRDRFVLSNGHGSMLLYSLLHLSGYELGIDDLKAFRQLHSRTPGHPEYGYTAGVETTTGPLGQGLANAVGLALAERTLAAQFNRPGHELVDHWTYCFLGDGCLMEGVSHEACSLAGTWKLGKLIGFYDDNGISIDGKVEGWFTDDTPGRFEAYGWHVVREVDGHDAEAIKRAIDEARAVTDRPSLICCKTVIGFGAPNVCGTHGVHGAPLGDEEIQATREFLKWEHGPFEIPREIYSGWDARARGKQLEAAWHERLAAYRKAHPEMAAEFERRMKGELPERFAQHAEEALAEAVDESAKVATRKASEQALNRLGPYLPELLGGSADLSGSNNTKWEDCAVIGGAKADADGNYLHYGVREFGMSAIANGLALHGGFIPYTGTFLVFSDYARNAIRMAALMGIQQIFVHTHDSIGLGEDGPTHQPVEHLGSLRMIPGLDVWRPCDAIETQAAWQAALERRDGPSLLALSRQGLVAQQRTDEQVALIRRGGYVLAEPKQGEAELILMATGSEVAIMVEAAERLADRGRRVRVVSMPCLEVFQSQPADYREAVLPAGVPVIAMEAAHPMPWQALLGDRGRVIGIDTFGESAPAPALYEHFGLTVDAVVQATETL

SEQ ID NO: 10108 - DNA, 1974 bp, Rhizobium leguminosarum bv. viciae 3841
  CDS (1)..(1974): transl_table=11
atgacctctcccgaacaacacgaccggatggcgaatgcgatccgttttctcgccatggacgccgtcgaaaaggcgaactccggccacccgggcatgccgatgggcatggctgacgtggcaacggtcctgttcaccaaatatctgaagttcgatccgaagaagccgcactggcctaaccgcgatcgcttcgtgctgtcggccggccatggctcgatgctgctctattcgctgctgtatctgaccggctatcctgacatgacgatcgaggatctgaagcagttccgtcagctcggctcgaagaccgccggccatccggaatacggtcacgcgaccggcatcgaaacgacgacgggtccgctcggccagggcattgccaattccgtcggcatggcgattgccgaacgcaagctgcgcgaggagttcggctccgatctccaggatcactatacctatgcgatctgcggcgacggctgcctgatggagggcatcagccacgaagccatcgcgctcgccggccacctgaagctcaacaagctcatcctgttctgggacaataactcgatcaccatcgacggcgccgtgtcgctgtcggattccaccgatcaaatcgcccgcttcaaggccgttcactggaacacgatcgagatcgacggtcacgatcaggctgccatcgccgccgcgatcgaagctgcccacaagtccgaccgcccgaccttcatcgcctgcaagacgatcatcggcttcggcgccccgaacaagcagggcacgcacaaggtccacggcaacccactcggcgccgaggaaatcgcggccacccgcaaggcgttgaactgggaagccgaagccttcgtcatcccgtcggacgtgctcgacagctggcgtgtagccggcgcccgctccgtcgagctcgtcaaggcttgggaagacggcctcgccaaggctccggccaaggccgagttcacccgccgcatggcaggcgagttgccggaaggcttcgacgccgcgatcagcacatacaaaaagaagctcgccgagaccaagccgactgttgcgacccgcaaggcttcggaagacgcgctcgaggtcatcaacggcttcctgccggaaacgctcggcggctccgccgacctgacgccgtcgaacaacaccaagaccagccagatgcattcgatcaccccgacggatttcgccggtcgttatatgcattggggcattcgcgagcatggcatggcgtctgccatgaacggcattgcgctgcatggcggcctcatcccctatagcggcggcttcctgatcttctcggattattgccgcccgccgatccgccttgcttcgctgatgggcatccgcgtcattcacgtcctgacgcatgactcgatcggcgtcggcgaagacggtccgacgcaccagccggtcgaacagctcgccggtctgcgcgccatcccgaacctgatggtctttcgtccggccgacgctacggaaacggcggaatgctggcagatcgccatcaagacgcacaaccgtccctcgggccttgctctgacgcgtcagaacctgctcgcagcccgcaccgaatacagcgaaaagaacctttgcgaacagggcgcctatgtgctcgccggcaatgccgacgccaaggtgacgatcttcgcctccggctccgaagtcgaaatcgccgttgcagcccgtacggcactcgaagccaagggcgtcaccgtccgcgtcgtgtcggttccctgcacggaactgttcttcgagcagccggaagcctatcgcaagggaatcctcggcaactcgccggtcaagatcgccgtcgaagccgccgttcgcgaaggctgggatgcgttcatcggaccggaaggcaccttcatcggcatgaagagcttcggtgcttccggcccggtcaaggaagtttacaagcatttcggcatcaccgccgacgccgtcgttgcggccgccgaagcaaagctttaa

SEQ ID NO: 10109 - protein, 657 aa, Rhizobium leguminosarum bv. viciae 3841
MTSPEQHDRMANAIRFLAMDAVEKANSGHPGMPMGMADVATVLFTKYLKFDPKKPHWPNRDRFVLSAGHGSMLLYSLLYLTGYPDMTIEDLKQFRQLGSKTAGHPEYGHATGIETTTGPLGQGIANSVGMAIAERKLREEFGSDLQDHYTYAICGDGCLMEGISHEAIALAGHLKLNKLILFWDNNSITIDGAVSLSDSTDQIARFKAVHWNTIEIDGHDQAAIAAAIEAAHKSDRPTFIACKTIIGFGAPNKQGTHKVHGNPLGAEEIAATRKALNWEAEAFVIPSDVLDSWRVAGARSVELVKAWEDGLAKAPAKAEFTRRMAGELPEGFDAAISTYKKKLAETKPTVATRKASEDALEVINGFLPETLGGSADLTPSNNTKTSQMHSITPTDFAGRYMHWGIREHGMASAMNGIALHGGLIPYSGGFLIFSDYCRPPIRLASLMGIRVIHVLTHDSIGVGEDGPTHQPVEQLAGLRAIPNLMVFRPADATETAECWQIAIKTHNRPSGLALTRQNLLAARTEYSEKNLCEQGAYVLAGNADAKVTIFASGSEVEIAVAARTALEAKGVTVRVVSVPCTELFFEQPEAYRKGILGNSPVKIAVEAAVREGWDAFIGPEGTFIGMKSFGASGPVKEVYKHFGITADAVVAAAEAKL

SEQ ID NO: 10110 - DNA, 2037 bp, Rhizobium leguminosarum bv. viciae 3841
  CDS (1)..(2037): transl_table=11
atgccggacacctcacaagctccgaagacattcccagctcccaaggatcagcgcctccgggatctcgccgactgcatccgtttcctctccatggatgcggttcaacaggcaaagagcggtcatcccggcatgccgatgggcatggccgacatcgcggcggtgcttttctccgagtttctgaagttcgatgccgccgatccctattggttcgatcgcgaccgcttcgtcatttccaacggtcacggctcaatgttgctctatagcctgctctatctgacgggctacaaggacatgaccatcgaagagatcaaacgcttccgccagatcgacagccgcacggcgggtcaccccgaatatcgccacgccaccggcatcgaaacgaccaccggtccgctggggcaggggattgcaaattctgtcggtctcgcactcggcgagcggatcatgaatgcctcgttcggcgacaatctggtcaatcaccacacctatgtcttcctgggtgacggctgcctgatggaaggcatcagccacgaggcgatatcgcttgccggacatctgaagctcggcaagctcatcgccttctgggacgacaactcgatctcgatcgacggtgcgaccagccttgctgaatccgatgaccatccggcgcgtttccgcgcggcgaactggcacgtccagcaaatcgacggtcacgataccgatgcgatccgcgccgcaatcatcgaagcgcagaaggtgacggatcggccgtcgatgattgcctgcaaaaccatcatcggcttcggtttcccgaccagggcgggaacgcagaaggcccatagcgacgcgcctggtgaagacgagatcgccggcgcccgcaagatcctcggttgggcatcgcctcccttcgaaataccggaagcgcttctcaatgactggcgaaagatcggcgcgaaaggcgggccggcgcggatggcctgggcggtccgtgtccagactgcttcgccggacaagcgagacgattttgagcggcgcatgaacggagaactgccgtccggttggcgcgctgccatcgctgcggcaaagcaggaactttcaggttccgaaaaggatctcgccacccgtcaggcgagcggcatcgtgctcaaccatctcttcgatgcgatccccgagcttcttggcggctcggcggatctgacgccttcaaacaacaccaaggccaagaaccaggtcgagatcaagcccggggaatatggcggatcctatctccactatggtgtccgcgagcacggcatggcggcggcgatgaacggtttggcgctgcatggggggcttattccctatggcggcacgttcctgacattttccgactattgccgcccggcgatccggctcgcggcgataatggaggtgcgttcgatcttcgtgatgacacatgactcgatcggattgggcgaggacgggccgacacatcagccgatcgaacatctgagcgcattgcgcgccattccccggctcgctgtctatcgcccgggcgatccgatcgaaacggccgagtgctgggaggcgatcatggatgcgccgcggcaggcagcactgattgctctgtcccgccagccaatgccgcttttacgccgcggcccgtccgacgagaaccgctcggcaaggggagcctacgttctccaggaagctgaaggcggcgagcggcaactgacgatccttgcctccggctcggaactgaatctggcggtcgaagcccgctcggtgctgcaggacgagggtattcgcacggccgttgtttcgatgccgtgcaggctgctgttcgagaagcaggatgccgcctacaagaagtcggtgctgggcggcagccgagccagggtcgccgtcgaagcagccgtgcgggattcctgggaccgctatctcggcttggacggcgtattcgtcggcatgcatgaattcggagcatccggcaaaatcgatgacgtttacacgaagttcgatatcaccacagacgcagtgatacgtgccggacgtgaggtggcaggaaagcaggcctag

SEQ ID NO: 10111 - protein, 678 aa, Rhizobium leguminosarum bv. viciae 3841
MPDTSQAPKTFPAPKDQRLRDLADCIRFLSMDAVQQAKSGHPGMPMGMADIAAVLFSEFLKFDAADPYWFDRDRFVISNGHGSMLLYSLLYLTGYKDMTIEEIKRFRQIDSRTAGHPEYRHATGIETTTGPLGQGIANSVGLALGERIMNASFGDNLVNHHTYVFLGDGCLMEGISHEAISLAGHLKLGKLIAFWDDNSISIDGATSLAESDDHPARFRAANWHVQQIDGHDTDAIRAAIIEAQKVTDRPSMIACKTIIGFGFPTRAGTQKAHSDAPGEDEIAGARKILGWASPPFEIPEALLNDWRKIGAKGGPARMAWAVRVQTASPDKRDDFERRMNGELPSGWRAAIAAAKQELSGSEKDLATRQASGIVLNHLFDAIPELLGGSADLTPSNNTKAKNQVEIKPGEYGGSYLHYGVREHGMAAAMNGLALHGGLIPYGGTFLTFSDYCRPAIRLAAIMEVRSIFVMTHDSIGLGEDGPTHQPIEHLSALRAIPRLAVYRPGDPIETAECWEAIMDAPRQAALIALSRQPMPLLRRGPSDENRSARGAYVLQEAEGGERQLTILASGSELNLAVEARSVLQDEGIRTAVVSMPCRLLFEKQDAAYKKSVLGGSRARVAVEAAVRDSWDRYLGLDGVFVGMHEFGASGKIDDVYTKFDITTDAVIRAGREVAGKQA

SEQ ID NO: 10112 - DNA, 2040 bp, Oenococcus oeni PSU-1
  CDS (1)..(2040): transl_table=11
atgatcgatactcaatttgaaaatattccacttaaagaattgaaccgtcaagacgaacagcaggcagtcaatgcgatccgttttctcagtctcgatatgatccaaaaggctaattccggccacccgggcctgcccttggacgctgccccgatggcctacacgctttttcaaaagttccttaattttaacaatcgcgatccatattggatcaaccgggaccgttttgttttaagtgccggccatggctcggctctgctttacagcctgcttcatttgaacggatttaaagtcgggatcgatgatctaaaacggtttcgtcagttggattcactaacgccgggtcacccggagtggaaacacaccccgggaatcgatgcgacaaccggtcctttgggtcaggggctgacgatggctgttggcatggcgatggccgaaaaacatctttcggccatctataatcgccctggttttaacatcttcgatcacgagacctatgtgatcgtcggcgatggggacttaatggaagggatcagtcaagaatcaatggcaattgccggtgagaaaagattaagtaaattaatcgttctctttgattccaacgatgtctccttagatggctccttaaagctttcgaccggcgaaaagattcaggatcggattatcggcaacggctgggattaccagtttgtcgccgatggcaataatttgtctgatattgatgaagcaatcagagaagcgaaaaagagcgacaaaccatcctttatcgaaataaagacaatcattggctacggcacgccgcttcagggcagcagcaaagtccacggggcggcaatcggcgaagagaacgtggccaagaccagggatttctatcactggccctatcagccctttgaaattccaaaagatgtttacgatctttttaacgacagtcatcaagccaaagaccggtattataaaagttggcaagaatcctttcagctttacgccgaagcttttcctcgattagcagagcagctggaaaataatgattcgactttaaataccgataatctgaaattggctgaaaataatgatcaagaactagcaacccgtgtaagcagttctgaggtcatgcaacaaatcgccgatcaaaacaggactttctggggcggttcggccgatctttcgtcatctaacaagacctatctgaaagatcaaggcgattttaccgatttaacgcctcagggttcaaacgttttttatggagttcgtgaatttgcgatggccgcaattaccaatggcattctcctccatggcaatagtcgcgcctttgcttcgaccttctttatcttcagcgattatatgaagccggccattcgcttggccgccctgcaaaaactcgcttcgatcttcattttttctcatgattccttagctgtcggcgaagacgggccgactcatcaaccggttgaacagttagagacgcttcggaccacgccgggaatcgatgtttatcgtcctgccgatcaaaacgaaaccctggccgcttggaaggccattgccaaaacaacgaatcgtccaacggctttggttacttcaagacaaaagctgcctgtattaagagaaacaaaggacgctccagtagaaagaggagcctacattgtttcctcagccaaaaaagatcttcccgatgcgattctgattgccagcgggtcagaactccatttggctctggaagctaaaagagaacttgaaaaagaaggttacgatctttcagttgtctcgatgcccagcatggaggcttttcaaaggcaaagtgaagaatatcaagcaagtgtcctgcccaagcaggtcgttaaccgtttgtcgatcgaaatggcatcgagtttggcttggggacgctataccggaatttttggaaagaatcttgccgtcgatacttttggcaaatctggcaaggcaaatgatgtaatcgacgattacggtttcaatcttgcccatatatcccggatggtcaaaaagatgatcgacgaaaataaaaacttgcaaatagtcaaataa

SEQ ID NO: 10113 - protein, 679 aa, Oenococcus oeni PSU-1
MIDTQFENIPLKELNRQDEQQAVNAIRFLSLDMIQKANSGHPGLPLDAAPMAYTLFQKFLNFNNRDPYWINRDRFVLSAGHGSALLYSLLHLNGFKVGIDDLKRFRQLDSLTPGHPEWKHTPGIDATTGPLGQGLTMAVGMAMAEKHLSAIYNRPGFNIFDHETYVIVGDGDLMEGISQESMAIAGEKRLSKLIVLFDSNDVSLDGSLKLSTGEKIQDRIIGNGWDYQFVADGNNLSDIDEAIREAKKSDKPSFIEIKTIIGYGTPLQGSSKVHGAAIGEENVAKTRDFYHWPYQPFEIPKDVYDLFNDSHQAKDRYYKSWQESFQLYAEAFPRLAEQLENNDSTLNTDNLKLAENNDQELATRVSSSEVMQQIADQNRTFWGGSADLSSSNKTYLKDQGDFTDLTPQGSNVFYGVREFAMAAITNGILLHGNSRAFASTFFIFSDYMKPAIRLAALQKLASIFIFSHDSLAVGEDGPTHQPVEQLETLRTTPGIDVYRPADQNETLAAWKAIAKTTNRPTALVTSRQKLPVLRETKDAPVERGAYIVSSAKKDLPDAILIASGSELHLALEAKRELEKEGYDLSVVSMPSMEAFQRQSEEYQASVLPKQVVNRLSIEMASSLAWGRYTGIFGKNLAVDTFGKSGKANDVIDDYGFNLAHISRMVKKMIDENKNLQIVK

SEQ ID NO: 10114 - DNA, 1923 bp, Leuconostoc mesenteroides subsp. mesenteroides ATCC 8293
  CDS (1)..(1923): transl_table=11
atgaaaacatcatcattgtcaacagaaacaattcagtcgttgaggttgctgtctaaccaaatgattagcaaagctggttctgggcaccctggcattgctttgggtgctgcaccaattttgtatgagttgtatgcaaatcaacttaatgttgatcccgagaatcctaatatgattaatcgcgatcgtttcgttttgtctgctggtcacggtgccgcattactgtatgcgactttacatgcagctggctttgacctgtcagcccaagatttatcagaatttcgacaaccacattcaaaaacgcctggacatccagaagttggtgtgacgcctggtgttgaagcaacaactggaccacttgggcaaggattgggtatggctgttggtatggcaatggctgaagcaaagctcaataaccaatttccctcagtgattgaccattttacatttgcgctagttggtgatggggatttaatggagggggtgagccatgaagtagcgtcactcgctggtcaacaaaagctcggtaagttggttgttctttatgatgataatgctgtcagtcttgatggtttgaagaaaaggtcagatatatcaaataatctagcgcgctttgccagttatggttgggatatacgtgaggtggcagatggtaatgatttagaagccattcacgatgcaattgaaaatgctaaaatgtctcctgagcccacgttgattgctgtgaaaacaattattggtgattttggaccgttcgctggcactaacaaggctcacggcacaccactagatagtcaacaattgcaagatctttcatcagcgcttgatgttgatatacaaaattttgaattaccaagtaatttgcttgaagacttgcgtgctaaaatttcgaatagacttttgcatcaaaaacaacctttgaatgacgaattaaccgattatctgcaattctcaactaaaaacacggtgaccatccccgagttaccgactgatttgaaagtacaagcaggccgaaaaatatctaaatatgtgttgcaaaactttgcgacacaattaccacaattatggggtggatcagctgacttggtagcatctactaatgctgaagtggtggcttcaccattgttcaacgccgatgatcgatcgggtagaaatattgcgtttggtgtgcgtgagtttggcatgggcgcggtaatgaatgggatagctttacacggtggtacaaaagtatttggcgcgacattcttggctttttcggattatatgaaggcagctattcgtttgagtgccttgcagcatgtgccgagtatttatgtttttacgcatgacagtattacggttggcgaagatggaccaacacatcaaccggttgaacaactgatggggcttcgtctgattccgggtgttgatgtattgcgtccagggacagccgaagagatagccagcgcttggcagcgggcgttgacgtcaactgatcgaccaacaatcttaattttaagtcgtggcgaaattggtgctcaaggaagcacagatcaagcaaaacaatcatttgaaaatggcgcggtacaaataagacatcatgatgaggctaaaattaacttgattgctactggatccgaagtccaaatagcacagaaggtgagtgaattactgtcactaccttcaaacgttgtttccatgccaaatctgtcgcgattcttagcgctagatgatgataaaaagcaacaaattattcccgaaacgggcacaaaaaatgtgataatagaggcaggaacaacattgggttggcaaggaattgctggcaatgatggcgtaatatttggtattgatgaatttggtatgagtgcggcagcacaaatagctcttgacgaatttggatttaatgctgaagatatcgtcgataaaatcacacaggagttacaatga

SEQ ID NO: 10115 - protein, 640 aa, Leuconostoc mesenteroides subsp. mesenteroides ATCC 8293
MKTSSLSTETIQSLRLLSNQMISKAGSGHPGIALGAAPILYELYANQLNVDPENPNMINRDRFVLSAGHGAALLYATLHAAGFDLSAQDLSEFRQPHSKTPGHPEVGVTPGVEATTGPLGQGLGMAVGMAMAEAKLNNQFPSVIDHFTFALVGDGDLMEGVSHEVASLAGQQKLGKLVVLYDDNAVSLDGLKKRSDISNNLARFASYGWDIREVADGNDLEAIHDAIENAKMSPEPTLIAVKTIIGDFGPFAGTNKAHGTPLDSQQLQDLSSALDVDIQNFELPSNLLEDLRAKISNRLLHQKQPLNDELTDYLQFSTKNTVTIPELPTDLKVQAGRKISKYVLQNFATQLPQLWGGSADLVASTNAEVVASPLFNADDRSGRNIAFGVREFGMGAVMNGIALHGGTKVFGATFLAFSDYMKAAIRLSALQHVPSIYVFTHDSITVGEDGPTHQPVEQLMGLRLIPGVDVLRPGTAEEIASAWQRALTSTDRPTILILSRGEIGAQGSTDQAKQSFENGAVQIRHHDEAKINLIATGSEVQIAQKVSELLSLPSNVVSMPNLSRFLALDDDKKQQIIPETGTKNVIIEAGTTLGWQGIAGNDGVIFGIDEFGMSAAAQIALDEFGFNAEDIVDKITQELQ

SEQ ID NO: 10116 - DNA, 2118 bp, Solibacter usitatus Ellin6076
  CDS (1)..(2118): transl_table=11
atgcccaccgacagcaaaacactcgaagaactctgcatcaatacgatccgcatcctggcggcagacgccgtgcaaaacgcaaactccggacatcccggcatgcccatgggagcggccgccatggcctacactctctggtcgcgttatttgaagcacaatccgaagaaccccgggtggttcgatcgcgaccgcttcgtgctttcggcgggccacggctcgatgctgttgtacggcctgctgcacctcaccggatatgacctgccgctcgaggaaatcaagcgtttcaggcagcttggcagcaagacgccgggccacccggagcgcgggttgactccaggcgtggaggtttcgaccggtccgctgggacagggcttcagcaacggcgttggcatggcgatcgcgcagaatttcctggctgcgcggtttaacaggccggggcacaacattatcgatcactacatctatgcaatttgcggcgatggcgacctgatggagggcatcacccaggaagcggcatcgctggccgggcatctgcagttgggaaagttggtctatttgtacgataacaaccatatttccctggccgggcagaccagcctgtgtttcaccgaaaatgtgcaggaacgctttaatgcctatcagtggcatacgcatgcggtggcggacggcaatgatacggcggagatcgcggcagccatcgaagaggcgcgcaaggatccgcggccctcgctgatcctggtgcgaacgcacatcggctatgggagtccgcataagcacgacaacttcgggtcgcacggcagtccgctgggcgaagaggaactgtcagcgaccaagaaggcgctgggctggccgactttggacaagttttatattcccgatgaagcacgagcgcagttccgcggagcgatcgagaagggtgccgcggcggaggcggagtggagcgggcgactgaatgcgtatcgcgcggcattccccacggaatgcgcccagctcgagagcatgatggccgggcaactaccggagggctgggacgccgatctgccgaagtggaagctgagcgacaaggcgattgcgacacgagtcgcgggcggccaggcgctcaatgcgattgccaagcgcatgacgaacctgatcggcgggtccgctgacctcaacccgtctaccgagaccgcgctgaaagggctgggcgatttccagccgccgaatacggacgggacgaacgtgcaaggcgaggtcggcggcgtgtggagttacgcagggcagaacgtcgccttcggagtccgcgaacatgcgatgggggcggcagtcaacggcatggcggcgcacggcggcgtgcatccgttcagcgccaccttcctggtgttcagtgactacatgaagccggcgatccgcctgggtgcgctcagtgatctgaaggcgctctacattttcacgcacgacagcatcggggtgggcgaggatggtccgacgcacgagccggtggaacagctcgcggggctgcgtgcgatcccggggctggtggtgatccggccggcggatccgaatgagacaagcgaggcgtaccgatttgcgatcccgcacgatggtccggtgctgatcgcgctgacacggcagaacgtgccgcatgtttcgcagaatccgccggtggcaaagggggcgtacgtgctcgccgattcggaaggcacgcccgatgtgattctggtgggcacgggcagcgaagtcgcactttgtgtgaaggcgcaggagaagttgaagcaattcggcgtgaaggcgcgggtggtcagcatgccaagctgggaactcttcgaaaagcaggatgccgcgtatcgggaacaggtgctgcccaaaacagtgcgaaagcgcgtatgcgtggaggccgagtctccgttcgggtgggagcgctgggctggcgacgaaggtgcgatcatcggcataaatcgttatggcctgagcgcaccgggcgcggaggtgatgaagtacttcgggttcacggtggagcgggtgacgtctaccgcgctgcggctgttagggaaggttcgcgaggctgaggaggtcgagccgggctttggcggtgagactgcggtaaagccgacctctccgcaggaagggcactcgtaa

SEQ ID NO: 10117 - protein, 705 aa, Solibacter usitatus Ellin6076
MPTDSKTLEELCINTIRILAADAVQNANSGHPGMPMGAAAMAYTLWSRYLKHNPKNPGWFDRDRFVLSAGHGSMLLYGLLHLTGYDLPLEEIKRFRQLGSKTPGHPERGLTPGVEVSTGPLGQGFSNGVGMAIAQNFLAARFNRPGHNIIDHYIYAICGDGDLMEGITQEAASLAGHLQLGKLVYLYDNNHISLAGQTSLCFTENVQERFNAYQWHTHAVADGNDTAEIAAAIEEARKDPRPSLILVRTHIGYGSPHKHDNFGSHGSPLGEEELSATKKALGWPTLDKFYIPDEARAQFRGAIEKGAAAEAEWSGRLNAYRAAFPTECAQLESMMAGQLPEGWDADLPKWKLSDKAIATRVAGGQALNAIAKRMTNLIGGSADLNPSTETALKGLGDFQPPNTDGTNVQGEVGGVWSYAGQNVAFGVREHAMGAAVNGMAAHGGVHPFSATFLVFSDYMKPAIRLGALSDLKALYIFTHDSIGVGEDGPTHEPVEQLAGLRAIPGLVVIRPADPNETSEAYRFAIPHDGPVLIALTRQNVPHVSQNPPVAKGAYVLADSEGTPDVILVGTGSEVALCVKAQEKLKQFGVKARVVSMPSWELFEKQDAAYREQVLPKTVRKRVCVEAESPFGWERWAGDEGAIIGINRYGLSAPGAEVMKYFGFTVERVTSTALRLLGKVREAEEVEPGFGGETAVKPTSPQEGHS

SEQ ID NO: 10118 - DNA, 1968 bp, Magnetococcus sp. MC-1
  CDS (1)..(1968): transl_table=11
atgagcacgtcggatctggatcgtctctgtattaatacccttcgcatgttgtcggtggatgccattgaggctgccaattccgggcacccgggtttgccactgggggcagcgcctatggcctatgtgttatggtcgcggattatgcggcataaccccaaaaatcccctttggcccgaccgtgaccgctttatcctctcggcagggcatggttcggcgctgctctacgcgctgctgcacaccagcggttatgatgtgagcttggatgagctgaaaaatttccgccaatatggcagcaagacccccggtcaccccgaatatggtcacaccccaggggtggagtgtaccacaggccccttgggtcaggggttcgccatgggggtggggatggctttggcagagcggcatctggcgcagcaggtcaaccgcgcggagtttcatcccattgtcgaccactttacctatggcattgtcggtgatggcgacctaatggaaggcattacctatgaagcggcggctatggcgggcaacctctgcctgggtaagttaatctatctgtatgatgataatggcatctccatcgagggcagtacggagattgcctttaccgaggatgtcaccacccgctttgaggcggccgagtggcaggtgctcacggttgaggatggtgaggatctggatgccattgaggcggcgattcttcaggctcagcaagaagaagagcgcccctcgctgatccgggttaagacggtgattggtcgtggcagccccaagcagggtaccgccgccacccacggttcccccattaagggggcggatatggtcgctacccgtcaggtttatgcatggcccgagacgcgtttttatctccctgacgaggcccaaagccactttgcgcaaatggttaagcgcggggctgaggccgaagcggagtggaacgccacccgcgaaatttatatgagccgttttcccaccgagactgagctgttgttggagcgtctggccggtgagctgaccgatggctgggatcgctctttggatgagctaacctttgcaccatcggcggcgacccgctccacttcgggtcaatgtctgaatgccattgcccaggatctgccgggtctgattgggggttcagccgatctaggtccctccaacaacaccaccctgaagcattttcccgagcgtaccttgcactttggggtgcgggagcacgccatgggtgcggtactcaacggattggcgttgcatgggggctttcacccctatgggggcacctttttggtcttttccgactatctgcgtggggcgattcgtctctctgcccttatgcatctaccggtgacctatgtgttgacccatgacagcattggggtgggggaggatggtccgacccaccagccggtggagcatgtggccagtttgcgtgccatccctgggctcaatgtattccgtccgtgcgatggcgaggagacccgcgcagcatggcactggaccctctgccacaaggcccctgcggcaatgattctgacccgtcaggagctgcccgagttgggcggtggtgaaggggttatggaaggggtagcgcgtgggggatatatcaaggtggattgccaaggcacgcccgatcttatcctgttggccagtggtagtgaggtgagtttggcggtggcggcggcggcgcagttgagcgctaaagggcaccaggtccgggtggtctccatgccctgtatggagcgctttgatgtccaggatgccgcctataaagagtcggtcttgccggcggcggtggcaacacgtctggcggtggaggcgggttcgaccatgagctggtataaatatgtgggcttagagggagaggttatcggtttggataactttggtgcctcgggtcctggtgataccttaatggaggtttacggctttaccacggaaaatgtggtggcccaggcccaggagctgctgggttaa

SEQ ID NO: 10119 - protein, 655 aa, Magnetococcus sp. MC-1
MSTSDLDRLCINTLRMLSVDAIEAANSGHPGLPLGAAPMAYVLWSRIMRHNPKNPLWPDRDRFILSAGHGSALLYALLHTSGYDVSLDELKNFRQYGSKTPGHPEYGHTPGVECTTGPLGQGFAMGVGMALAERHLAQQVNRAEFHPIVDHFTYGIVGDGDLMEGITYEAAAMAGNLCLGKLIYLYDDNGISIEGSTEIAFTEDVTTRFEAAEWQVLTVEDGEDLDAIEAAILQAQQEEERPSLIRVKTVIGRGSPKQGTAATHGSPIKGADMVATRQVYAWPETRFYLPDEAQSHFAQMVKRGAEAEAEWNATREIYMSRFPTETELLLERLAGELTDGWDRSLDELTFAPSAATRSTSGQCLNAIAQDLPGLIGGSADLGPSNNTTLKHFPERTLHFGVREHAMGAVLNGLALHGGFHPYGGTFLVFSDYLRGAIRLSALMHLPVTYVLTHDSIGVGEDGPTHQPVEHVASLRAIPGLNVFRPCDGEETRAAWHWTLCHKAPAAMILTRQELPELGGGEGVMEGVARGGYIKVDCQGTPDLILLASGSEVSLAVAAAAQLSAKGHQVRVVSMPCMERFDVQDAAYKESVLPAAVATRLAVEAGSTMSWYKYVGLEGEVIGLDNFGASGPGDTLMEVYGFTTENVVAQAQELLG

SEQ ID NO: 10120 - DNA, 1995 bp, Shewanella sp. ANA-3
  CDS (1)..(1995): transl_table=11
atgtcttcccgtaaagtactcgccaacgcaatccgtgcgttaagtatggatgcagttcaaaaagcaaactcaggccaccctggcgcccctatgggcatggcagatattgctgaagtgctgtggaatgatttccttaagcacaatccgaacaatccgaaatgggtagatagagatcgttttatcctctctaacggtcacggatctatgctgatctactctttattacacctgactggctacgacctgcctatcgatgaactgaagcaattccgtcagttacattcaaaaactccgggtcacccagaatacggctacacccctggtgttgaaaccaccactggcccattaggggcggggatcagcaacgctgtgggtatggcgattgcagaaaaaaccttagcggcacagttcaaccgtgaaggtcacgagattgttgaccactacacatactgcttcctcggcgatggctgcttgatggaaggtatttcccacgaagcttgttctctggctggtaccttaggcctaggcaaactgatcgcattttgggatgacaatggcatctctatcgacggtcatgttgaaggctggtttaccgatgacacgccaaaacgtttcgaatcatacggctggcatgtaattgctaacgttgatggtcacgatagcgatgcgattcgcgcggctatcgaagcggcaaaagccgtgaccgacaagccaaccatgatctgctgcaaaaccattatcggttttggttcaccaaacaaatctggcagccacgattgccacggcgcgccattaggtgatgcagaaatcgccgcggcccgtgaattcttaggctggccacatgcgccattcgaaatccctgccgacgtatacgcaggttgggatgctaaagaagccggtaacgcccgtgaagcggcttggaacgacaagtttgccgcttacgctgctgcttacccagaactggctgccgaatacgagcgccgtgtgctgaaaggtgaattaccagccgatttcgaagctaaagcgcaagcttttatccaagaatgccaagcgaaaggcgaaggtattgcgagccgtaaagcgtcacaaaacgcgattgcagccttcggtgcggttctgcctgaactgttaggcggcagtgctgacttagcgggttctaacctgaccttgtgggcaggttctagaggtattcaagaagatccagcgggtaactacgtgtactacggtgtgcgtgagtttggtatgagcggcatcatgaacggtgtgtcactccacggtggtttcatcaactacggcgcgactttcatgatgttcatggaatacgcacgtaacgcagtacgtatgtctgcgctgatgggcattcaaaacatcttcgtttacacccatgactctatcggtcaaggtgaagatggtccaactcaccaacccgttgagcaattagctaacctgcgcatgacaccaaacatggcggtatggcgcccatgtgacgcggctgaaaccgcagtggcttggaaagcggctatcgaacgtcgtcatgcaccaacatcgctagtattcagccgtcaaaacctgaaggctcaagcacgtacagctgagcaattagcgaatgtggcaaaaggcgcttatgtactgcaagactgtgcaggtacgcctgagtacatcctgattgcaaccggtagtgaagtgcaattagcggtagaagcggcggctgcgctgactgaacaaggcaaacaaattcgcgttgtttctatgccatcaaacactgagtttgataagcaagatgccgcatacaaagagtctgtactgccaaaagctgtgactaagcgtattgctatcgaagcggcccatactgacttctggtacaagtatgttggtttcgaaggcactgttgttggcatgaccacttttggtgagtctgcgccaggtaacgtgctgctgaagcacttcggtttcaccgttgaaaatgtgctgaatgctgcaaaatcactaggctaa

SEQ ID NO: 10121 - protein, 664 aa, Shewanella sp. ANA-3
MSSRKVLANAIRALSMDAVQKANSGHPGAPMGMADIAEVLWNDFLKHNPNNPKWVDRDRFILSNGHGSMLIYSLLHLTGYDLPIDELKQFRQLHSKTPGHPEYGYTPGVETTTGPLGAGISNAVGMAIAEKTLAAQFNREGHEIVDHYTYCFLGDGCLMEGISHEACSLAGTLGLGKLIAFWDDNGISIDGHVEGWFTDDTPKRFESYGWHVIANVDGHDSDAIRAAIEAAKAVTDKPTMICCKTIIGFGSPNKSGSHDCHGAPLGDAEIAAAREFLGWPHAPFEIPADVYAGWDAKEAGNAREAAWNDKFAAYAAAYPELAAEYERRVLKGELPADFEAKAQAFIQECQAKGEGIASRKASQNAIAAFGAVLPELLGGSADLAGSNLTLWAGSRGIQEDPAGNYVYYGVREFGMSGIMNGVSLHGGFINYGATFMMFMEYARNAVRMSALMGIQNIFVYTHDSIGQGEDGPTHQPVEQLANLRMTPNMAVWRPCDAAETAVAWKAAIERRHAPTSLVFSRQNLKAQARTAEQLANVAKGAYVLQDCAGTPEYILIATGSEVQLAVEAAAALTEQGKQIRVVSMPSNTEFDKQDAAYKESVLPKAVTKRIAIEAAHTDFWYKYVGFEGTVVGMTTFGESAPGNVLLKHFGFTVENVLNAAKSLG

SEQ ID NO: 10122 - DNA, 2100 bp, Mycobacterium avium 104
  CDS (1)..(2100): transl_table=11
gtgacgacacttgaagagatctctgcgctgacccaaccgcaccttcccgacgactggtccgagctggactcggccgccgtcgacaccattcgggtgctggccgccgacgcggtgcaaaaggtgggcaacggacatcccgggacggcgatgagcctggctcccctggcctacacgctgtttcagcgggtgatgcggcacgaccccagcgacacccactggctgggccgggaccggttcgtgctgtcagccgggcacagcagcctgacgctgtacctgcagctgtacctgggtggcttcggtctggagctgtccgacatcgagtcgctgcgcacctggggctccaagacgcccgggcacccggagttccggcacaccaagggtgtggagatcaccaccggcccgctgggccagggcctggcctccgcggtgggcatggcgatggcctcccgctacgagcgcgggctgttcgacccggacgccgccgccggcaccagcccgttcgaccacttcatctacgtgatcgcctccgacggcgacatcgaggagggcgtcacgtcggaggcctcgtcgctggcggccgtgcagcaactgggcaatctgatcgtgttctacgaccacaaccagatctccatcgaggacgacaccaacatcgccctgtgcgaggacaccgccgcccgctacgaggcctacggctggcacgtgcagcgcgtcgagggtggcgagaacgtcgtcgccatcgaggaggccatcgccgccgccaaggccgtcaccgaccggccgtcgttcatcgagctgcgcaccatcatcggctatccggcgcccaacgcgatgaacaccggcaaggcgcacggcgcggcgctgggcgaggaggaggtggccgcggtcaagaagatcctcggcttcgacccggacaagacgttccaggtgcgcgacaaggtgatcgcccacacccgcaagctggtcgaccgcggccgggaggcacaccagaagtggcagaccgatttcgacgcctgggcgcagcgcgagcccgagcgcaaggcgctgctggagcggttgacggccgagaagctgcccgacgggtgggacgccgacctgccgcactgggagccgggctccgacgcgatcgccacccgcaaggcctccggcgcggtgctcaacgccgtggcgccgaaactgcccgagctctggggcggctcggccgacctggccgagagcaacctcaccaccatcaacaacgcggattcctttgggcccccgtcgatttccaccaaggagttcaccgcctcctggtatggccgggtgctgcatttcggtgtccgcgaacacgccatgggggcgatcctgtccggcatcgtgctgcacggcccgacccgcgcctacggcggcaccttcctgcagttctcggactacatgcgtccggcggtgcggctggcctcgctgatggacatcgacaccatctacgtgtggacgcacgattccatcgggctgggtgaggacgggccgacgcaccagccgatcgagcacctggcggcgttgcgcgccatccccaagctgtcggtggtgcgtccggccgacgccaacgagaccgcctacgcctggcgcaccatcctggcccgcggcaacggcagcggcccggtcggattggtcctgacccgccagggcctgccggtgctcgagggcaccgacgccgacggtgtcgcccggggcggctacatcctgggctcggacggcgaggaggccggccaggagcccgacgtcatcctgatcgccaccggctcggaggtacagctggccgtcgaggcgcagaagttgttggcggacaaggacattgtggcgcgggtggtgtccatgccgtgcgtggaatggttcgagtcccagcccgacgactaccgcgacagtgtgctgccgccgtcggtgtcggcccgggtggccgtcgaggccggggtggcgcagagctggcacaagctggtcggcgacaccgggaagatcatctcgatcgagcactacggcgaatccgccgactacaaaacgttgttccgtgaattcggcttcactgccgaagccgtcgctgccgccgcggaagaagtcgtggacaactga

SEQ ID NO: 10123 - protein, 699 aa, Mycobacterium avium 104
MTTLEEISALTQPHLPDDWSELDSAAVDTIRVLAADAVQKVGNGHPGTAMSLAPLAYTLFQRVMRHDPSDTHWLGRDRFVLSAGHSSLTLYLQLYLGGFGLELSDIESLRTWGSKTPGHPEFRHTKGVEITTGPLGQGLASAVGMAMASRYERGLFDPDAAAGTSPFDHFIYVIASDGDIEEGVTSEASSLAAVQQLGNLIVFYDHNQISIEDDTNIALCEDTAARYEAYGWHVQRVEGGENVVAIEEAIAAAKAVTDRPSFIELRTIIGYPAPNAMNTGKAHGAALGEEEVAAVKKILGFDPDKTFQVRDKVIAHTRKLVDRGREAHQKWQTDFDAWAQREPERKALLERLTAEKLPDGWDADLPHWEPGSDAIATRKASGAVLNAVAPKLPELWGGSADLAESNLTTINNADSFGPPSISTKEFTASWYGRVLHFGVREHAMGAILSGIVLHGPTRAYGGTFLQFSDYMRPAVRLASLMDIDTIYVWTHDSIGLGEDGPTHQPIEHLAALRAIPKLSVVRPADANETAYAWRTILARGNGSGPVGLVLTRQGLPVLEGTDADGVARGGYILGSDGEEAGQEPDVILIATGSEVQLAVEAQKLLADKDIVARVVSMPCVEWFESQPDDYRDSVLPPSVSARVAVEAGVAQSWHKLVGDTGKIISIEHYGESADYKTLFREFGFTAEAVAAAAEEVVDN

SEQ ID NO: 10124 - DNA, 2091 bp, Mycobacterium smegmatis str. MC2 155
  CDS (1)..(2091): transl_table=11
gtgaccacggccgaagagatcaccgctctcacccagcccaaccaccccgacgattggaccgatctcgacacgctcagcgtcgacacggcacgggtgctcgcggctgacgcggtacagaaggtcggcaacggccacccgggtacggcgatgagcctcgcgccgctcgcgtacacgctgttccagcggcagatgcgccatgaccccagcgacacgcactggctgggtcgcgaccgcttcatcctgtcctgcgggcattcgagcctgacgctgtacatccagctctacctcggtggcttcggtctggagctctccgacatcgaatcgctgcgcacgtggggttccaagaccccgggccaccccgagttccgccacaccaagggcgtcgagatcaccaccgggccgctcggccagggtctggcctcggccgtcggcatggcgatggccgctcgctacgagcgcggcctgttcgatcccgacgccgcacccggcaccagcccgttcgaccactacatctacgtcgtggcatccgacggcgacatggaggagggcgtcaccagcgaggcgtcgtcgctggcgggaacgcagcagctgggcaacctgatcgtcatctgggacgacaacaagatctccatcgagcacaacaccgacatcgccttcagcgaggacgtggtcgcgcgctaccgcgcctacgggtggcacgtgcaggaagtgcagggcggcgagaacgtcgtcggcatcgagcaggcgctcgaagaggcccgcaaggtcaccgacaagccgtcgttcatcgcgctgcggaccatcatcggctaccccgcgcccaacaagatgaacaccggcggcgtgcacgggtcggcgctcggcgccgacgaggtcgccgccaccaagaagatcctcggcttcgaccccgagaagaacttcgaggtgcgcgacgaggtgatcgcgcacacccgcgagctcgtcgcccgcggcaagaaggcccacgacgagtggcaggtgtccttcgacgagtgggccgagcgtgagcccgagcgcaaggagctgctcgaccgtctgctggccggcaagttgcccgagggctgggacgccgacctgccgcactgggacctcgacgccaagcccgtcgcgacgcgcgcggcctcgggtgcggtgctctcggcggtcgggccgaaactgcccgagctgtggggcggttcggccgacctcgcgggcagcaacaacaccacgatcaagggcgccaactcgttcggtcccccgtcgatttccaccgaggactggaacgccacctggtacggccgcacgctgcacttcggtgtgcgcgagcacgcgatgggcgcgatcctgtccggcatcgtgctgcacggcccgacacgcgcttacggcggaaccttcctgcagttctcggattacatgcggcccgcggtgcgtttggcctcattgatggacatcgacccgatctacgtgtggacgcacgattcgatcggtctcggtgaggacggcccgacccaccagccgatcgagcatctcgcggcactgcgcgcgatcccgaacctgtcggtggtgcgcccgggtgaccccaacgagaccgcctacgcgtggaagagcgtgctggagcgcggctccagcagcggcccggtcggcatgatcctgacgcgccagccgatcccggtgctcgaaggcaccgaccccgagggtgtggctcgcggcggatacgtgctgggcggcacgcccgagaagaacccggatgtcgtgatcatcggcaccggttcggagctgcagctcgcggtgggagcgcagaagatcctggcggacaagggaatcaccgccagcgtggtgtcgatgccgtgcgtcgagtggttcgagtcgcagcccgaggaataccgcgactcggtgctcccgcccgcggtgtcggcgcgtgtggcggtcgaggccgccgtggcgcagagttggtacaagctggtcggcgacaccggcgagatcgtctcgatcgagcactacggcgagtcggccgacgacaagacgttgttccgcgagttcggtttcaccccggaagcggtggccgctgcggcggagcgatcgctcgagaactga

SEQ ID NO: 10125 - protein, 696 aa, Mycobacterium smegmatis str. MC2 155
MTTAEEITALTQPNHPDDWTDLDTLSVDTARVLAADAVQKVGNGHPGTAMSLAPLAYTLFQRQMRHDPSDTHWLGRDRFILSCGHSSLTLYIQLYLGGFGLELSDIESLRTWGSKTPGHPEFRHTKGVEITTGPLGQGLASAVGMAMAARYERGLFDPDAAPGTSPFDHYIYVVASDGDMEEGVTSEASSLAGTQQLGNLIVIWDDNKISIEHNTDIAFSEDVVARYRAYGWHVQEVQGGENVVGIEQALEEARKVTDKPSFIALRTIIGYPAPNKMNTGGVHGSALGADEVAATKKILGFDPEKNFEVRDEVIAHTRELVARGKKAHDEWQVSFDEWAEREPERKELLDRLLAGKLPEGWDADLPHWDLDAKPVATRAASGAVLSAVGPKLPELWGGSADLAGSNNTTIKGANSFGPPSISTEDWNATWYGRTLHFGVREHAMGAILSGIVLHGPTRAYGGTFLQFSDYMRPAVRLASLMDIDPIYVWTHDSIGLGEDGPTHQPIEHLAALRAIPNLSVVRPGDPNETAYAWKSVLERGSSSGPVGMILTRQPIPVLEGTDPEGVARGGYVLGGTPEKNPDVVIIGTGSELQLAVGAQKILADKGITASVVSMPCVEWFESQPEEYRDSVLPPAVSARVAVEAAVAQSWYKLVGDTGEIVSIEHYGESADDKTLFREFGFTPEAVAAAAERSLEN

SEQ ID NO: 10126 - DNA, 1935 bp, Mycobacterium smegmatis str. MC2 155
  CDS (1)..(1935): transl_table=11
ttgaatgaatcgaacgatcgcatcgacaccacgctggtggggcgactggcgcggcaactgcgcgccgacgccatccgagccagcactgccgccggctccggacatccgacttcgagcatgtcggccgccgatctgacggcggttctgctcgctcgccacctcagctatgactgggagcgcccggatcaccctgacaacgaccacttcatcctgtccaaagggcatgcctcgccgctgttgtacgccgcgttcaaagccgtcggtgtcatcaccgacacggaactgatgaccggctaccgccgcttcggctcacgcctgcaaggccaccccacgcctgtgttgccgtgggtcgacgttgccagcggctcactgggacaggggatcgccatcggggtcggcgtcgcgctcgcgggcaagttcctcgacaggtctggatttcacgtgtggacgctgtgcggcgacagtgagatggccgaggggtcggtctgggaggcactggacaaggccggctattacggcctttcgaacttcaccgtcatcgtcgatgtcaaccggttgggccagcgcggacccaccgagttcggttgggatctggagacctacgccaaacgcgtggaagctttcggtgcgcgggcgatctccgtcgacggccatcgcctggaggccatcgaccaggcgctcaccgccgcgcgtaacacaacgcagccgacggtgatcctcgcgagaaccgtcaagggtcgcggtttcagcgaagtcgaggaccgagagggttggcatggcaaggctttcccgcccgaaatggcgcggcgcgcactggccgagctcggcgaggtcgagggtctgaccgtcgcgggaccgaaaccggcgtcacgctccggtcaatcgtcggcgcccggggcgggcaatccggatgggttctcggaccggccgcgttacgcaccgggtgagaaggtcgccacccgggcggcatacggagccgcggtggccgcactgggcgcggtcaatcgccgggtggtggcgctcgacggcgaagtcagcaactccaccggcgccgcagagttcaccgagcaccaccccgagcgatacttcgaaatgttcatcgccgagcaacaactcgttgcctcttccgtcggtctccatgtccgccactacattccgttcgcatcgacctttgccgcgtttttgacccgggcgcatgacttcatccgcatggcggccgtctcacaggcgaacatctgcctgatcgggtcccatgccggcgtcgagatcggtgccgacggaccctctcagatggcgctggaagacctggcgatgatgcggtccgtccacggcgcgaccgtcctctatcccagcgacgcgacaagtacggtcgcgctggtcgacctgatggcggatgccgatggggtccgttatctgaggaccacccgtggtgcctacccggtcctctacgagccggccaccgtgttcaccatcggcggctcccacacgctgcggtccagcagcgccgacgacgtcaccctgatcggtgccggtgtcaccgtccaccaatgcctggccgccgccgaatcgctgcaccgcgacgggatcgcggcccgcgtcatcgatgtctactccgtcaagccgatcgaccgggacacgctgctcgaagctgtgcgcgacaccggtgcacgattggtcatcgccgaggaccatcaccccgagggtggactcggctcggccgtgctcgaggccatctcgggtgcggaaacaccgcgtctgaagctgatgcacctggccgttcgcgccatgccgggctcgggaactcctgccgaactgctcgcggatgccgcgatagacgcggcaagtatcgacaaggctgcgcgacacctgttgcaggccgacgacggccgatccgacgacggccgatccgacgacgacgagacgctgacggcctga

SEQ ID NO: 10127 - protein, 644 aa, Mycobacterium smegmatis str. MC2 155
MNESNDRIDTTLVGRLARQLRADAIRASTAAGSGHPTSSMSAADLTAVLLARHLSYDWERPDHPDNDHFILSKGHASPLLYAAFKAVGVITDTELMTGYRRFGSRLQGHPTPVLPWVDVASGSLGQGIAIGVGVALAGKFLDRSGFHVWTLCGDSEMAEGSVWEALDKAGYYGLSNFTVIVDVNRLGQRGPTEFGWDLETYAKRVEAFGARAISVDGHRLEAIDQALTAARNTTQPTVILARTVKGRGFSEVEDREGWHGKAFPPEMARRALAELGEVEGLTVAGPKPASRSGQSSAPGAGNPDGFSDRPRYAPGEKVATRAAYGAAVAALGAVNRRVVALDGEVSNSTGAAEFTEHHPERYFEMFIAEQQLVASSVGLHVRHYIPFASTFAAFLTRAHDFIRMAAVSQANICLIGSHAGVEIGADGPSQMALEDLAMMRSVHGATVLYPSDATSTVALVDLMADADGVRYLRTTRGAYPVLYEPATVFTIGGSHTLRSSSADDVTLIGAGVTVHQCLAAAESLHRDGIAARVIDVYSVKPIDRDTLLEAVRDTGARLVIAEDHHPEGGLGSAVLEAISGAETPRLKLMHLAVRAMPGSGTPAELLADAAIDAASIDKAARHLLQADDGRSDDGRSDDDETLTA

SEQ ID NO: 10128 - DNA, 2145 bp, Nocardioides sp. JS614
  CDS (1)..(2145): transl_table=11
gtggccgatgacctcgaaaggaatcctgtgaccgacaccgctgcgctcgactggaccgacctcgaccagaaggcggtggacacggcccgagtgctcgcgatggacgcggtgcagaaggtcggcaacggccacccgggcacggcgatgagcctggcccccgcggcgtacctgctgttccagaaggtgatgcgccacgacccgtccgacccgcgctggatcgcgcgggaccggttcgtcctctcggcgggtcactcctcgctcaccctgtacatccagctcttcctcggcggcttcgggctcgagctcgacgacctcaaggcgctgcgcacctggggcagcaagacccccgggcacccggagtaccgccacaccgcgggggtcgagacgaccacgggcccgctcggtcagggcgtcggcaacgcggtcgggatggcgatggccgcgcggcggctgcgtgggctgctcgacccgggcgcgaagaccgggccctcggtgttcgaccaccgggtctacgcgatctgcagtgacggagacatcgaggagggcgtgagcggcgaggcctcctcgatcgccggcacccagcagctcggcaacctcacgctgatctacgacgccaacaagatctccatcgaggacgacaccaacatcgccctcagcgaggacgtggccgcgcgctacgaggcgtacggctggcacgtccaggtcgtcgactggaccaacggcggcaccgagtaccgcgaggacgtgcacgcgctgtacgacgcgctccgcgccgccgaggcggtcaccgaccggcccagcttcatcgagctgaagacgatcatcgcctggcccgcgccgaacgcgcagggcaccggcaagtcccacggatccgccctcggggccgacgaggtcgccgccaccaaggaggtcctcggcttcgacccggcgcagaccttcgaggtcccggagggcgtcctcgagcacacccggcgactcggggagcgcggtgcggccgcgggcaaggcctgggacgaggacttcgccgcgtggcgggccaagaacccggacgccttcgacgtgctgatgcggctgcgcggccacgagctacccgagggctgggccgacgacctgccggtcttcgacgccgacccgaagggggtcgcgacgcgcaaggcctccggccaggtgatcaacgcgatcgcgaagcgcgtcccggagctctggggcggctccgccgacctcgccgagtccaacaacaccacgatcgaggacgtcccgtcgttcctgccggtcgaccggtcctcgaagatgtgggcgggcgacccgtacgcgggccgggtgctgcacttcggcatccgtgagcacgcgatgggttcgatcatgaacggcatcgccctgcacagtggcacccgcgtcttcggcggcaccttcctcacgttctccgactacatgcggcccgcggtccggctcgcgtcgctgatggggctcccggtcacctacgtgtggacccacgactccatcggtctcggcgaggacgggccgacgcaccagccgatcgagcacctcgccgcgctgcgcgccatccccggcctcgacgtcatccggcctgcggacgccaacgaggtggccgcctgctggaaggcggtcatggagcacacggaccggccctccgccctggccctcacccgccagaacgtgccggtgttcccgcgggagcaggacggcttcgccggcaccgccgacgtgcaccggggcggctacatcctgatcgacgcccccgagatcgacggccagggcggccagcccgacgtcgtactgatcggcaccggttcggaggtccagctggccgtcgaggcccgagccctgctcgccgaggacgggatccgcgcccgcgtggtctcgatgccgtgccgcgagtggttcgccgcccagcacgagtcctaccgcgaggccgtcatcccgccgatcgtcaaggcgcgcgtctcggtcgaggcgggcatcgcccagggctggcacgaggtcgtcggcgaccacggccggatcgtctcgatcgagacgtacggcgcctcggccgactacgcccgcatctaccaggagtacggcatcaccgcccgggccgtcgccgacgccgcccgcgacagcatccgcgtgagcagcagctag

SEQ ID NO: 10129 - protein, 714 aa, Nocardioides sp. JS614
MADDLERNPVTDTAALDWTDLDQKAVDTARVLAMDAVQKVGNGHPGTAMSLAPAAYLLFQKVMRHDPSDPRWIARDRFVLSAGHSSLTLYIQLFLGGFGLELDDLKALRTWGSKTPGHPEYRHTAGVETTTGPLGQGVGNAVGMAMAARRLRGLLDPGAKTGPSVFDHRVYAICSDGDIEEGVSGEASSIAGTQQLGNLTLIYDANKISIEDDTNIALSEDVAARYEAYGWHVQVVDWTNGGTEYREDVHALYDALRAAEAVTDRPSFIELKTIIAWPAPNAQGTGKSHGSALGADEVAATKEVLGFDPAQTFEVPEGVLEHTRRLGERGAAAGKAWDEDFAAWRAKNPDAFDVLMRLRGHELPEGWADDLPVFDADPKGVATRKASGQVINAIAKRVPELWGGSADLAESNNTTIEDVPSFLPVDRSSKMWAGDPYAGRVLHFGIREHAMGSIMNGIALHSGTRVFGGTFLTFSDYMRPAVRLASLMGLPVTYVWTHDSIGLGEDGPTHQPIEHLAALRAIPGLDVIRPADANEVAACWKAVMEHTDRPSALALTRQNVPVFPREQDGFAGTADVHRGGYILIDAPEIDGQGGQPDVVLIGTGSEVQLAVEARALLAEDGIRARVVSMPCREWFAAQHESYREAVIPPIVKARVSVEAGIAQGWHEVVGDHGRIVSIETYGASADYARIYQEYGITARAVADAARDSIRVSSS

SEQ ID NO: 10130 - DNA, 2064 bp, Azoarcus sp. BH72
  CDS (1)..(2064): transl_table=11
atgccggttttttcaggccggccctccggcttcgaggaaaccatgtcgcagtcgagaaacgtcaagcccccggtcttcaaccccgtcactggcgccatccgcgcacttgcgatggatgcagtgcagcaggccaactccggccatccgggtgcgccgatgggcatggcggaaatcgccgaggtgctgtggcgccaccacctcaagcacaatccggccaacccgcattgggccgaccgcgaccgcttcgtgctgtccaacggccatggctcgatgctgatctacgcgctgctgcacctcaccggctacgacctgccgatcgaggaaatcaagcgcttccgccagctgcacagcaagacgccgggccatccggaatacggctacaccccgggcgtggaaaccaccaccggtccgctcggccagggcatcaccaacgcggtcggcatggccatcgccgaaaaggtgctggcggccgaattcaaccgcgccggccatgaaatcgtcgaccaccgcacttgggtcttcctgggcgacggctgcctgatggaaggcatcagccacgaagcctgttcgcttgccggcacgctcggcctgggcaagctggtcgcgttctacgacgacaacaatatctccatcgacggccacgtcgaaggctggttcaccgacgacacccccaagcgcttcgaagcctacggctggcaggtgatccgtgacgtgcagggccacgacccggccgaaatcgaagccgccatccagcaggcgcgggccaacaccacccagcccacgctgatctgctgcaaaaccgtcatcggcgccggcgcccctaacaagcagggcggccacgacgtgcacggcgcgccgctcggcaccaccgaaatcgacgcctgccgcgcccacatcggctggacgcacgctccgttcgaaatcccggccgacgtctatgctgcgtgggacgcgcgcccggccggcgccagcgccgaagccggctggaacgacaagttcgctgcctacgccgccgccttccccgaactcgcggccgagttcaagcgccgcgtgcagcagcaggcgctgccggccgactgggcggcgcacgtcgccaccgtgctcggcaagatcaatgacaagggcgaaaccatcgccacccgcaaggccagccagaacagcatcgaggccttcgcgcccaagctgcccgaactcatcggcggctcggccgacctcgccggctccaaccttacgctgtggtcgggcgccaagggcgtcagccgcgacaccggcggcaactacatctactacggcgtgcgcgaattcggcatggcggccatcgccaacggcatcgcgctgcatggcggcctgattccctacaccgccaccttcctgatgttcagcgaatacgcccgcaatgccctgcgcatggcggcgctgatgaagctgcgccagatcttcgtgttcacccacgactccatcggccttggcgaagacggccccacccaccagccggtggaacagaccgccacgctgcgcctgattcccaacatggacgtctggcgcccgtgcgacacgatggagtccgcggtggcctgggcgcacgcgatcgagcgtaaggacggcccgtcctgcctgctgttctcgcgccagaacctgcccttccaggcccgcagcgccgagcagatcgacgccatccgccggggcggctacgtgctgtcggaagccgcgggcggcacgccgaaggcggtcatcctcgccaccggctcggaagtcgcgctcgcgatggccgcgcagaagacgctggccgaggccggcatcgcggtgcgcgtggtgtcgatgccgagcaccaacgtattcgaccgtcaggatgccgcctacaaggccgccgtcctgcccgccggcctgccgcgcattgcggtcgaagccggcgtcaccgacggctggcgcaagtatgtcggcctcgaaggcgaggtgatcggcctcgaccgcttcggtgaatccgcccccgcgggcgagctgttcaagtacttcggcattaccgccgacgcggtcgtcgaagccgtccgcaagctcgtccggtaa

SEQ ID NO: 10131 - protein, 687 aa, Azoarcus sp. BH72
MPVFSGRPSGFEETMSQSRNVKPPVFNPVTGAIRALAMDAVQQANSGHPGAPMGMAEIAEVLWRHHLKHNPANPHWADRDRFVLSNGHGSMLIYALLHLTGYDLPIEEIKRFRQLHSKTPGHPEYGYTPGVETTTGPLGQGITNAVGMAIAEKVLAAEFNRAGHEIVDHRTWVFLGDGCLMEGISHEACSLAGTLGLGKLVAFYDDNNISIDGHVEGWFTDDTPKRFEAYGWQVIRDVQGHDPAEIEAAIQQARANTTQPTLICCKTVIGAGAPNKQGGHDVHGAPLGTTEIDACRAHIGWTHAPFEIPADVYAAWDARPAGASAEAGWNDKFAAYAAAFPELAAEFKRRVQQQALPADWAAHVATVLGKINDKGETIATRKASQNSIEAFAPKLPELIGGSADLAGSNLTLWSGAKGVSRDTGGNYIYYGVREFGMAAIANGIALHGGLIPYTATFLMFSEYARNALRMAALMKLRQIFVFTHDSIGLGEDGPTHQPVEQTATLRLIPNMDVWRPCDTMESAVAWAHAIERKDGPSCLLFSRQNLPFQARSAEQIDAIRRGGYVLSEAAGGTPKAVILATGSEVALAMAAQKTLAEAGIAVRVVSMPSTNVFDRQDAAYKAAVLPAGLPRIAVEAGVTDGWRKYVGLEGEVIGLDRFGESAPAGELFKYFGITADAVVEAVRKLVR

SEQ ID NO: 10132 - DNA, 2094 bp, Mycobacterium sp. KMS
  CDS (1)..(2094): transl_table=11
atgaccaccgtcgacgacatcgcgacgctgacccaaccccaccaccccgacgactggtccgagttggactccgtcgcggtcgacaccgtgcgggtgctggcggcggatgccgtgcagaaggtcggcaacggccatcccggtacggcgatgagcctggcgccgctggcgtacacgctgttccagcggaccatgcggcacgaccccagcgatgtgcactggctgggccgggaccggttcgtcctgtcctgcggtcattcgagcctgacgctctacatccagctctacctgggcgggttcggtctcgagctcgaggacatccaggcgctgcggaccttcaagtcgaagaccccgggccatcccgagttccggcacaccaagggtgtggagatcaccaccggcccgctcggtcagggcctcgcctcggccgtgggtatggcgatggcggcgcgctacgagcgcgggctgttcgacccggacgccgcgccgggcaccagcccgttcgaccaccacatctacgtgatcgcctccgacggcgacatcgaagagggtgtgaccagcgaggcgtcgtcgctggcgggtacccagcagctgggcaacctcatcgtcttctacgaccagaaccagatctccatcgagcacgacacgaacatcgcgctgtcggagaatgtcgccgaccgctaccgcgcctacggctggcacgtccaggaggtcgagggcggcgagaacgtcgtcggaatcgaagaagccatcgaggccgccaaggcggtcacggaccgcccgtccttcatcgcggtgcgcacgatcatcggctatccggcgccgaacaagatgaacaccggcggcgtgcacggctcggcgctcggtgacgacgaggtcgcggcggtcaaggaggttctcggcttcgatccggacaagacgttcgaggtgcgcgacgaggtcatcgagcacacccgcaagctcgtccagcggggccgcgaagcccacgagaagtggcagcccgagttcgacgcctgggccgagcgcgaacccgagcgcaagaagctgctcgaccggctgctcgcccaggagctgccggacggctgggacgccgatctgacgtactgggagccgggcagcaaggcggtcgccacccgcgccgcgttcggccaggtgctcaacgacgtcgcgccgaagctgcccgaattgtggggcggttcggccgatttggccggtagcaacaacacgaccatcaagggcgtgaaatcgttcggcccgccgtcgatctcgaccgacgacttcaccgccgactggtacggccgggtgctgcacttcggtatccgcgaacacgcgatgggctcgatcctgtcgggcatcgtgctgcacggcccgacgcgcgccttcggcgggacgttcctgcagttctccgactacatgcggccggcggtgcggttggcctcgctgatggacatcgacaccatctacatctggacccacgattcgatcggtctcggcgaggacggccccacgcaccagccgatcgaacatctcgccgcgctgcgggcgatccctaacctgtcggtggtccggccgggtgacccgaacgagacggcctacgcctggcgcagcatcctggcccgcggcaacggcagcggcccggtcggtttcatcctgacccgacagggcatcccggtgctggagggcaccgactccgacggcgtcgcccgcggcggatacgtcctcggcggcgggaatccctccgatgacgccgacgtcatcatcatcgcgaccggatccgaactccagctcgcggtggaggcgaagaagctcctcgccgagaaggacctcaccgcatacgtggtgtccatgccgtgcgtggagtggttcgagtcgcagccgaaggaataccgcgacagcgtgctgcctcccaacgtctccgcgcgcgtcgcagtggaggccgccgtcgcccagagctggtacaagctcgtcggcgacaccggcgagatcgtctccatcgagcactacggggagtccgccgacgacaagacgttgttccgcgagttcggcttcaccgccgaggccgtggccgccgccgcggagcgcaccataaacaactaa

SEQ ID NO: 10133 - protein, 697 aa, Mycobacterium sp. KMS
MTTVDDIATLTQPHHPDDWSELDSVAVDTVRVLAADAVQKVGNGHPGTAMSLAPLAYTLFQRTMRHDPSDVHWLGRDRFVLSCGHSSLTLYIQLYLGGFGLELEDIQALRTFKSKTPGHPEFRHTKGVEITTGPLGQGLASAVGMAMAARYERGLFDPDAAPGTSPFDHHIYVIASDGDIEEGVTSEASSLAGTQQLGNLIVFYDQNQISIEHDTNIALSENVADRYRAYGWHVQEVEGGENVVGIEEAIEAAKAVTDRPSFIAVRTIIGYPAPNKMNTGGVHGSALGDDEVAAVKEVLGFDPDKTFEVRDEVIEHTRKLVQRGREAHEKWQPEFDAWAEREPERKKLLDRLLAQELPDGWDADLTYWEPGSKAVATRAAFGQVLNDVAPKLPELWGGSADLAGSNNTTIKGVKSFGPPSISTDDFTADWYGRVLHFGIREHAMGSILSGIVLHGPTRAFGGTFLQFSDYMRPAVRLASLMDIDTIYIWTHDSIGLGEDGPTHQPIEHLAALRAIPNLSVVRPGDPNETAYAWRSILARGNGSGPVGFILTRQGIPVLEGTDSDGVARGGYVLGGGNPSDDADVIIIATGSELQLAVEAKKLLAEKDLTAYVVSMPCVEWFESQPKEYRDSVLPPNVSARVAVEAAVAQSWYKLVGDTGEIVSIEHYGESADDKTLFREFGFTAEAVAAAAERTINN

SEQ ID NO: 10134 - DNA, 2037 bp, Acidovorax sp. JS42
  CDS (1)..(2037): transl_table=11
atggccaactctcaacaaatggcgaatgcgatccgcgcactcgcaatggatgccgttcaacaagccaactccggccaccccggcgcccccatgggcatggccgacatggccgtggcgttgtggggccggcacctgaagcacaaccccaccaacccccagtggatggaccgcgaccgtttcgtgctgtccaacggccacgcgtcgatgctgctgtactcgctgctgcacctcacgggctacgacctgcccctgcaggagctgaagaacttccgccagctgcacagcaagacccccggccaccccgagcacggcatcacccccggcgtggagaccaccaccggcccgctgggccagggcgtgaccaacgccgtgggctttgcgctggccgagaagctgctggccgccgagttcaaccgcgaaggccacgccgtggtggaccaccacacctacgtgttcctgggcgacggctgcctgatggaaggcatcagccatgaggccgtggctctcgccggcgcgtggaagctcaacaagctcatcgcgctgtacgacgacaacggcatcagcatcgacggccaggtggcgccctggttcatcgacaacaccccgcagcgcttcatggcctgcggctggaacgtgatcgacgccgtggacgggcatgacgtggaagctgtggccgccgccatcggccaagccaaggccagcgccgacaagcccacgctgatcgtctgcaagaccgtcatcggcaagggcagccccaaccgcgccaacacggccaaggcccatggcgagcccctgggcgccgaggaaatcaacctcacgcgcgctgccctgggctggacgcacgagcccttcgcgatccccgagtcggtgtacgccgactgggatgccaaggcggccggccaggccgccgaagccgagtggacgctgcgctttgccgcctacgaggccgcctaccccgagctggcattcgagctgtcccgccgcatggctggcgacctgcccaagcacttcgcccaggtggcggtggacaccgtggtggccgcgcacaccaaggccgagaccgtggccagccgcaaggccagccagatcgcgctggaagccttcaccgccgcactgcccgaactgctgggcggcagcgccgacctgaccggctccaacctcaccaacaccaagagcacgcccgcgctgcgcatcgagcccaacggcgccgtggccaagaccgaggccggccaggtgggccgccacatcaactacggcgtgcgcgagttcggcatggcggccatcatgaacggcctggcgctgcacggcggtttcatcccctacggcggcaccttcctcacattcagcgactacagccgcaacgccatccgcatggccgcgctgatgaagcagcgcgtgatccacgtgttcacgcacgactccatcggcctgggcgaggacggccccacgcaccagtcgatcgagcacgccgccagcctgcgcctgatccccggcctggacgtgtggcgccccgccgacacggccgagaccgccgtggcctggagcgtggccctgtccaaccgcgacaagcccaccgcgctgctgctgtcccgccagaacctgccctacgcgcccaagagcgacctgggcgacatctcgcgcggcgcctacatcctctccgagcccgccgccgtgggtctgaagaagaaggcccaggccgtgatcatcgccaccggctccgaggtgcagctggccctggccgcgcagcaactgctggccgccaagaagatcgccgtgcgcgtggtctccatgcccagtaccaccaccttcgaccgcgaggacaccaagtacaagcaactggtgctgcccgccggcacgccgcgcatcgccgtcgagatgggcgtgtccgacttctggtggaagtacggctgcgccgcggtggtcggcatcgacacctatggcgagtcggccccggccggcgtgctgttcaagcacttcggcttcacggccgagaacgtcgctgacacggtgctggccgcgctgcagcgcgcgcgctga

SEQ ID NO: 10135 - protein, 678 aa, Acidovorax sp. JS42
MANSQQMANAIRALAMDAVQQANSGHPGAPMGMADMAVALWGRHLKHNPTNPQWMDRDRFVLSNGHASMLLYSLLHLTGYDLPLQELKNFRQLHSKTPGHPEHGITPGVETTTGPLGQGVTNAVGFALAEKLLAAEFNREGHAVVDHHTYVFLGDGCLMEGISHEAVALAGAWKLNKLIALYDDNGISIDGQVAPWFIDNTPQRFMACGWNVIDAVDGHDVEAVAAAIGQAKASADKPTLIVCKTVIGKGSPNRANTAKAHGEPLGAEEINLTRAALGWTHEPFAIPESVYADWDAKAAGQAAEAEWTLRFAAYEAAYPELAFELSRRMAGDLPKHFAQVAVDTVVAAHTKAETVASRKASQIALEAFTAALPELLGGSADLTGSNLTNTKSTPALRIEPNGAVAKTEAGQVGRHINYGVREFGMAAIMNGLALHGGFIPYGGTFLTFSDYSRNAIRMAALMKQRVIHVFTHDSIGLGEDGPTHQSIEHAASLRLIPGLDVWRPADTAETAVAWSVALSNRDKPTALLLSRQNLPYAPKSDLGDISRGAYILSEPAAVGLKKKAQAVIIATGSEVQLALAAQQLLAAKKIAVRVVSMPSTTTFDREDTKYKQLVLPAGTPRIAVEMGVSDFWWKYGCAAVVGIDTYGESAPAGVLFKHFGFTAENVADTVLAALQRAR

SEQ ID NO: 10136 - DNA, 2028 bp, Nostoc punctiforme PCC 73102
  CDS (1)..(2028): transl_table=11
atgactgttgcaacccaatccgccaaagaattgtccgtcgaagaactggctattaactcgatccgcttcttggctattgatgccgtagaaaaggcaaaatcgggacacccaggactaccaatgggcgcggctccgatggcttttgtcctctgggatcgctttttgaagtttaatcccaagaatcccaaatggtttaaccgcgatcgctttgtcttgtctgccggtcatggctcgatgttgcagtacgccctactctacctgacaggctacgatagcgtcaccattgaagatatcaaacaattccgtcaatggggttctaaaactcctggacacccagaaaactttgaaaccccaggcgtggaagtcacaactgggcccttgggtcaaggaattgctaatggagttggtttagcgatcgcagaagcacaccttgccgctaaatttaacaaacctgataccaagattgttgaccattacacctacgtaattgtaggtgacggttgcaatatggaaggaatttccggtgaagcttgttcttttgcaggacacttgggattaggcaaactcatcgctctgtatgacgacaaccacatttccatcgacggttccacagatgtggcatttaccgaagatgtttccaagcggtttgaagcttacggttggcacgtccaacatgtcgaagatggcaataccgatttagcagcgatcgctaaagcaattgaagcggctaaagctgtcaccgataagccttctttcatcaaagtaacaaccattattggttacggttcccccaataaagcaaacactgctggcgttcacggcgctgccttgggtgcagacgaaatagcattgactcggaaaaatttgggttgggaatacgagccttttgatgttccacaagaagccctcaaccacacacgcaaagcagtagaacgcggcgcaagctacgaagccgaatggaacaaaacatttgccgactacaaagctaagtatgcccaagaagccgctgaatttgaacgttacctaagcggcaagctacccgacggttgggataacgtactacccacctacacccccgaagacaaaggactacccacccgtaaacactcagaaacctgcctcaacaaactggcggcagttttacctgaattgattggtggttcggctgacttgacccactccaacttgaccgaaatcaagggcaagggcgactttcaaaaagggcactacgaaaaccccaacatccactttggtgtgcgggaacatgctatgggcgcaatctgtaatggtatagcgctgcacacttcaggattaatcccctacggtgctaccttcttgatcttcacagattacatgcgtgctgccattcgcttatctgccctttcccaagctggcgtgatttgggtgatgacccacgattccattggacaaggtgaagatgggccaacacaccaacccattgaaactctagcttccttgcgagctattcctaatttattagtgtttcgtcccgcagacggtaacgaaacctctggcgcttataaaattgcgattgaaaaagcgaagcaaaatgctccgtctctgttggcgttcactcgtcaaaacgttcctaacttggcaggtacatcggttgagggtgtggcgaagggtggatacaccgttgttgatagcgaaggtacacctgatatcatcttgattggtactggttcagaattgagcctcgccgtcagcgcagccgaaaaactcaaggctgaaggtaagaaagttcgtgttgtctcgctaccttcatgggaactgtttgaagcacaggatgcggcttataaagagtccattctgccaaaagctgtcaccaagcgtttgtctgtagaagctgccgctagtttcggttggcacaaatacgtgggtactgaaggcgatactgttagtatcgatcgctttggtgcttcggctccaggcaatgtttgtctagagaagtttggctttagcgttgataatgtgttagcaaaggctaaacaattgttgggttaa

SEQ ID NO: 10137 - protein, 675 aa, Nostoc punctiforme PCC 73102
MTVATQSAKELSVEELAINSIRFLAIDAVEKAKSGHPGLPMGAAPMAFVLWDRFLKFNPKNPKWFNRDRFVLSAGHGSMLQYALLYLTGYDSVTIEDIKQFRQWGSKTPGHPENFETPGVEVTTGPLGQGIANGVGLAIAEAHLAAKFNKPDTKIVDHYTYVIVGDGCNMEGISGEACSFAGHLGLGKLIALYDDNHISIDGSTDVAFTEDVSKRFEAYGWHVQHVEDGNTDLAAIAKAIEAAKAVTDKPSFIKVTTIIGYGSPNKANTAGVHGAALGADEIALTRKNLGWEYEPFDVPQEALNHTRKAVERGASYEAEWNKTFADYKAKYAQEAAEFERYLSGKLPDGWDNVLPTYTPEDKGLPTRKHSETCLNKLAAVLPELIGGSADLTHSNLTEIKGKGDFQKGHYENPNIHFGVREHAMGAICNGIALHTSGLIPYGATFLIFTDYMRAAIRLSALSQAGVIWVMTHDSIGQGEDGPTHQPIETLASLRAIPNLLVFRPADGNETSGAYKIAIEKAKQNAPSLLAFTRQNVPNLAGTSVEGVAKGGYTVVDSEGTPDIILIGTGSELSLAVSAAEKLKAEGKKVRVVSLPSWELFEAQDAAYKESILPKAVTKRLSVEAAASFGWHKYVGTEGDTVSIDRFGASAPGNVCLEKFGFSVDNVLAKAKQLLG

SEQ ID NO: 10138 - DNA, 2007 bp, Haemophilus somnus 2336
  CDS (1)..(2007): transl_table=11
atggtaactcgtagggaattggcaaatgcaatccgttttttaagtatggatgcggtacaaaaagcaaaatctgggcatccgggagctccgatgggaatggcggatattgcggaagtattatggcgtgattttttaaatcataatccgactaatcctcaatgggcaaatcgtgatcgttttgtgttatctaacggtcatggctcaatgttaatttatagtttactgcatctcaccggttacgatctttctatcgaagatttaaaacaatttcgtcaattacattccaagactccggggcaccctgaatacggttatgcaccaggtattgaaaccacaacgggtccattaggtcaaggcattactaacgctgtaggcatggcgattgcagaaaaaacgttagccgcacaatttaatcgagcaggtcatgacattgttgatcatcatacttacgtttttctaggggatggttgcttaatggagggtatttctcatgaggcttgttcattagccggcacgttaggtctaggtaaattgattgctttttatgatgataataatatttccattgacggtcatgtagatggttggttcactgatgatacacaaaaacgctttgaggcttacggctggcatgttattcctgctgttgatggacataatgcagaacaaattattgaagcaataaaacaagctcaggctgagaaaaataaaccaactttaattatgtgtaagacgattattggctatggttctccaaataagcaaaatactcatgatagccatggggcaccattaggtgatgaagaaatcgctttaactcgtcaagcattaaattggaattacgcaccttttgaaattcctgctgatatttatgcaaaatggaatgctcacgaaaaaggacaagtggcggaaaacgcatggaatgaaaaatttgccgcttatgagaaagcttatcctgaattagcagttgaatttaaacgccgtttaaatggggaattaccggcaaactgggcaacagaaagccaagcctttattgaaaaattacaagcaaatccagccaatattgcaagtcgcaaagcgtcacaaaatgcgattgaagcgtatgcaaaattattaccggaatttttaggcgggtcagctgatttagcggggtcaaacttaacgttatggtctggttcaaaacccattcgtgcgacagaaaatatagatggtaactatattaattatggcgtgcgtgaattcggaatgtctgccatcatgaatggtattgcattgcacggcggatttattccttatggtgcaacgttcttaatgtttatggaatatgcacataatgcagtgcgtatggcagccttgatgaaacaacgttcattatttgtttatacacatgactctatcggtttaggagaagacggtccgacgcatcaacctgttgagcaaacaaccgcacttcgcttaattccaaatttagaaacatggcgtccttgcgaccaagtggaatctgcaatcgcatggaaagcagcggttgaacgtcaagacggtccaagtgcattaattttcactcgacaaaatcttgctcaaatgaaccgcacttctgagcaattggaaaacgtgaaacgtggcggttatatcttgcgtgcatgctgtgaaaaaggtgattgtccagatttaatcttgatcgccaccggttctgaagtggaattagcgatgaaagcagcggaagcgttagatgcggaaggcgtgaaagtccgtgtggtatcaatgccgagtacgaatgtatttgataaacaagatgttgcgtaccgtgaggcagtattaccaagtgcggtgactaaacgtgttgcaattgaagcgggtatttcagatttctggtacaaatatgttggtactaacggacgtatcgttggtatgaatagctttggtgaatcagcaccggcagatcaactgtttaaactctttggcttcactgttgaaaatattgtggcaaaggcaaaagagattttataa

SEQ ID NO: 10139 - protein, 668 aa, Haemophilus somnus 2336
MVTRRELANAIRFLSMDAVQKAKSGHPGAPMGMADIAEVLWRDFLNHNPTNPQWANRDRFVLSNGHGSMLIYSLLHLTGYDLSIEDLKQFRQLHSKTPGHPEYGYAPGIETTTGPLGQGITNAVGMAIAEKTLAAQFNRAGHDIVDHHTYVFLGDGCLMEGISHEACSLAGTLGLGKLIAFYDDNNISIDGHVDGWFTDDTQKRFEAYGWHVIPAVDGHNAEQIIEAIKQAQAEKNKPTLIMCKTIIGYGSPNKQNTHDSHGAPLGDEEIALTRQALNWNYAPFEIPADIYAKWNAHEKGQVAENAWNEKFAAYEKAYPELAVEFKRRLNGELPANWATESQAFIEKLQANPANIASRKASQNAIEAYAKLLPEFLGGSADLAGSNLTLWSGSKPIRATENIDGNYINYGVREFGMSAIMNGIALHGGFIPYGATFLMFMEYAHNAVRMAALMKQRSLFVYTHDSIGLGEDGPTHQPVEQTTALRLIPNLETWRPCDQVESAIAWKAAVERQDGPSALIFTRQNLAQMNRTSEQLENVKRGGYILRACCEKGDCPDLILIATGSEVELAMKAAEALDAEGVKVRVVSMPSTNVFDKQDVAYREAVLPSAVTKRVAIEAGISDFWYKYVGTNGRIVGMNSFGESAPADQLFKLFGFTVENIVAKAKEIL

SEQ ID NO: 10140 - DNA, 1998 bp, Haemophilus influenzae R2846
  CDS (1)..(1998): transl_table=11
atggcaactcgtaaacaattagccaatgcaattcgtgtcttagcaatggattctgtacaaaaagcgaaatcaggtcaccctggagccccaatggggatggcggatattgcagaagtgttatggcgcgactttttaaaacacaatccaactaatcctaaatgggctgaccgagatcgttttgtactttctaacggccatggttctatgttgatttatagtcttttacatttaactggctatgatctttctatcgaagatttaaaacaattccgtcaattacattctaaaacccctggccacccagaatatggttatgcgcccggtgttgaaaccacgactggccctcttggtcaaggtattaccaatgctgttggtatggcaattgcagaaaaaacacttgcaggtcaatttaaccgtgaaggccatgaaattgtcgatcaccacacttatgtgttcttaggcgatggctgtttaatggaagggatctctcacgaggcttgctctttagcgggaacattaggtcttggcaaattaattgcattctacgatgacaataatatttccattgatggtcatgttgatggctggttcagcgatgatactgcagcacgttttgaagcttatggctggcaagtaattcgtaatgtagatggtcacgatgcagagcaaattcgtgctgctaccattcttgctcaagcagaaaaagaaaaaccaacgttaataatttgtaaaaccatcattggttttggttctccaaataaatcaggctctcacgatagccacggtgcgccattaggcgatgaagaaatcgctttaactcgcaaagcacttggttgggaatatgcgccatttgaaattccagctgaatactatgctgaatggtctgcaaaagagaaaggctcagcagcagaaaaatcttgggaagaaaaatttgccgcctatgcaaaagcctatcctgaattagcagcagaatttaaacgtcgtgtttctggcgaattaccagcaaattgggcggcagaatccaaagcgttcattgaaaaattacaagcaaatccagcgagcatcgcaagccgtaaagcatcacaaaatgcaatcgaggcgtacgctcacgtattacctgaattcttaggtggttctgcagacttagcaagctctaacttaaccttatggagtggttctaaaccgattcgtgcgcatgaaaacgtaggtggtaactacatcaactacggcgttcgtgaatttggtatgtctgccattatgaacggtattgctttacacggaggtttcattccttatggtgcaactttcttaatgttctacgaatatgcacacaatgcggtacgtatggcggcattaatgaaacaacgcgctttattcgtttacactcacgattctatcggtttaggcgaagatggcccaacacaccaacctgtagaacaaacggcttcactacgcttaattccaaaccttgaaacatggcgtccatgtgaccaagtggaatctgctattgcatggcaacaagcggttgaacgtcaagatggcccaagtgcgttgatctttacccgtcaaaatcttgctcaaatgaaccgcacttctgcacaattagatgcagttaaacgtggtgcttatgtgttaaaagattgtgatggcacacctgagttaatcttcattgcgacaggttctgaagtggaattagcagtaaaagctgcagatgtattgagtgctgaaggtaaaaaagtgcgtgttgtttctatgccaagcactaatcgttttgataaacaagatgcagcataccgtgaaagcgtattgcctgcagctgtaacaaaacgtgttgcaattgaagcgggtattgctgacttctggtataaatacgttggattcaacggtcgtgttgtcggtatgaatagcttcggcgaatccgcaccagcagatcaattatttaaactctttggtttcactgttgaaaacgtggtagcgaaagcaaaagaaattctttaa

SEQ ID NO: 10141 - protein, 665 aa, Haemophilus influenzae R2846
MATRKQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAARFEAYGWQVIRNVDGHDAEQIRAATILAQAEKEKPTLIICKTIIGFGSPNKSGSHDSHGAPLGDEEIALTRKALGWEYAPFEIPAEYYAEWSAKEKGSAAEKSWEEKFAAYAKAYPELAAEFKRRVSGELPANWAAESKAFIEKLQANPASIASRKASQNAIEAYAHVLPEFLGGSADLASSNLTLWSGSKPIRAHENVGGNYINYGVREFGMSAIMNGIALHGGFIPYGATFLMFYEYAHNAVRMAALMKQRALFVYTHDSIGLGEDGPTHQPVEQTASLRLIPNLETWRPCDQVESAIAWQQAVERQDGPSALIFTRQNLAQMNRTSAQLDAVKRGAYVLKDCDGTPELIFIATGSEVELAVKAADVLSAEGKKVRVVSMPSTNRFDKQDAAYRESVLPAAVTKRVAIEAGIADFWYKYVGFNGRVVGMNSFGESAPADQLFKLFGFTVENVVAKAKEIL

SEQ ID NO: 10142 - DNA, 2043 bp, Haemophilus influenzae R2866
  CDS (1)..(2043): transl_table=11
atgcgctggattatttttcaaaacgaattatcacaggagaacaaaatggcaactcgtagacaattagccaatgcaattcgtgtcttagcaatggattctgtacaaaaagcaaaatcaggtcaccctggtgcgccaatggggatggcggatattgctgaagtattatggcgcgactttttaaaacacaatccaaccaatcctaaatgggctgaccgagatcgttttgtactttctaacggccatggttctatgttgatttatagtcttttacatttaactggctatgatctttctatcgaagatttaaaacaattccgtcaattacattctaaaacccctggccacccagaatatggttatgcgcccggtgttgaaaccacgactggccctcttggtcaaggtattaccaatgctgttggtatggcaattgcagaaaaaacacttgcaggtcaatttaaccgtgaaggccatgaaattgtcgatcaccacacttatgtgttcttaggcgatggctgtttaatggaagggatctctcacgaggcttgctctttagcgggaacattaggtcttggcaaattaattgcattctacgatgacaataatatttccattgatggtcatgttgatggctggttcagcgatgatactgcagcacgttttgaagcttatggctggcaagtaattcgtaatgtagatggtcacgatgcagagcaaattcgtgctgctaccattcttgctcaagcagaaaaagaaaaaccaacgttaataatttgtaaaaccatcattggttttggttctccaaataaatcaggctctcacgatagccacggtgcgccattaggcgatgaagaaatcgctttaactcgcaaagcacttggttgggaatatgcgccatttgaaattccagctgaatactatgctgaatggtctgcaaaagagaaaggctcagcagcagaaaaatcttgggaagaaaaatttgccgcctatgcaaaagcctatcctgaattagcagcagaatttaaacgtcgtgtttctggcgaattaccagcaaattgggcggcagaatccaaagcgttcattgaaaaattacaagcaaatccagcgagcatcgcaagccgtaaagcatcacaaaatgcaatcgaggcgtacgctcacgtattacctgaattcttaggtggttctgcagacttagcaagctctaacttaaccttatggagtggttctaaaccgattcgtgcgcatgaaaacgtaggtggtaactacatcaactacggcgttcgtgaatttggtatgtctgccattatgaacggtattgctttacacggcggtttcattccttacggcgcaaccttcttaatgttctacgaatatgctcacaatgcggtgcgtatggcagcattaatgaaacaacgcacattattcgtttatacccacgattccatcggtttaggcgaagatgggcctacacaccaaccagttgagcaaactgcatcattacgcttaattccaaaccttgaaacatggcgtccatgtgaccaagttgaatcagccatcgcatggcaacaagcggttgaacgtcaagatggcccaagtgcgttaattttcactcgtcaaaatcttgctcaaatgaaccgcacttctgcacaattagatgcggttaaacgtggtgcttatgtgttaaaagactgtgatggcacacctgagttaatcttcattgcgacaggttctgaagtggaattagcagtgcaagcagccgaagcattaagtgctgaaggtaaaaaagtacgcgttgtttctatgccaagtactaaccgtttcgataaacaagatgcagcgtaccgtgaaagcgtattacctgcagcggtaaccaaacgtgttgcgattgaagcgggtattgctgacttctggtataaatacgttggattcaatggtcgtgttgtcggtatgaatagctttggcgaatccgcaccagcagatcaattattcaaactctttggtttcactgttgaaaacgtggtagcaaaagcgaaagaaattctttaa

SEQ ID NO: 10143 - protein, 680 aa, Haemophilus influenzae R2866
MRWIIFQNELSQENKMATRRQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAARFEAYGWQVIRNVDGHDAEQIRAATILAQAEKEKPTLIICKTIIGFGSPNKSGSHDSHGAPLGDEEIALTRKALGWEYAPFEIPAEYYAEWSAKEKGSAAEKSWEEKFAAYAKAYPELAAEFKRRVSGELPANWAAESKAFIEKLQANPASIASRKASQNAIEAYAHVLPEFLGGSADLASSNLTLWSGSKPIRAHENVGGNYINYGVREFGMSAIMNGIALHGGFIPYGATFLMFYEYAHNAVRMAALMKQRTLFVYTHDSIGLGEDGPTHQPVEQTASLRLIPNLETWRPCDQVESAIAWQQAVERQDGPSALIFTRQNLAQMNRTSAQLDAVKRGAYVLKDCDGTPELIFIATGSEVELAVQAAEALSAEGKKVRVVSMPSTNRFDKQDAAYRESVLPAAVTKRVAIEAGIADFWYKYVGFNGRVVGMNSFGESAPADQLFKLFGFTVENVVAKAKEIL

SEQ ID NO: 10144 - DNA, 1890 bp, Listeria monocytogenes str. 4b H7858
  CDS (1)..(1890): transl_table=11
atggctttctcgctttggaaaaatcatttaaaattcaatccagaacacccaacttggtttaaccgcgatcgcttcgttttgtcagctggtcacggttcggcaatgctttatagtttgctacatctatttggttatgatttaccaatgagcgagctgaaaaacttccgccaaactggtagtaaaacgcccggtcatcctgaattcggtcatacggttggtgtcgatgcaactaccggtccacttggtcaaggtttcgcaatgggagttgggatggcaatggccgaggctcaccttggcgccaaatttaaccaacctgaattcccggttgttgaccataatacctacgtgctatgcggagacggctgtttgatggaaggcatttcctacgaagccgcatcccttgctggtcatttaaaactgggaaaattagttgttttatatgattcgaatgatatctcactggatggcgatttaaacgagtctttttcagaagacatcgaactcagattccgagcagccggttggcaaacgctacgtgtggacgacggaaatgacttagatgcgcttgatgcagcaatccatctcgcaaaaaccgagaaatcccgccctactttaatcgaagtgaaaacggtcatcggttacggtagccctggtaaagccggaaaatcggcggcacacggctccccacttggcgaaaaagaactcaaacttgcaaaagaagcttacgattggcaaatgccaccttttgaattaccaaaaactgtcgaaaatcagaaagaattttatcattctaaaggtcgcgcgagtgaaagcagctggctccggacattcaatgcttacaaacaaaaatatccagcactcgcagaaagtttgcaacaattaatggatgataatttggatgcggattgggatgcagaacttcctgtcttcgatgaaaatgcggataaagccgttgcaacccgtgaagtatcaggaattgttctacaagaattggagaaaaaactgcctaacctatttggtggcgcggccgatttggcctcctccaataaaacccatttaaaagctagcgaacggtttgctccaggtaactatgccgccaaaaatatctcattcggcgtccgcgagttcgcaatgggagcagcagtcaacggaatgacgcttcacggcggtgttcaagctttcggcgcaaccttcttcgtattctcggattatctacgttccgcgattcgttcagcagctttaatgggcattccatccactttcatcatgacccatgattccatcgcagtcggtgaagacggtccaacgcacgaaccaatcgagcatctcgcatccttccgcgccatgccgggacttcacgtcatccgaccagctgacggcaacgaaaccgtcgaagcataccgctatgcctttactcaaaaagaacaaccaaccatgctcgttcttagccgccaaaacctgccaattttaccaaatagcgcagcaaaagcgcaaaccggacttgcaaaaggtgcttacatcttagccgattccccgcttgataaactagatattatcttactcgcttctggatccgaagtacacctaatgacagctgtcagagataatctcgctaaaaaaggcttcggagcacgcgtagtcagcatgccaagctttgatttattcgacaaacaaagccctgaatataaagagtccgttttaccaaaagcagtgaaaaatcgcttcgccgcagaaatgggcgcatcatacggctggcacaaatacctcggcgacacaggccaaatcctcgcgattgattcgtttggtatgtctggcccgggagatgagctagcaagacgatttggctttactgtagagaacttgacggagcttgcgttgaagcagttgtag

SEQ ID NO: 10145 - protein, 629 aa, Listeria monocytogenes str. 4b H7858
MAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQQLMDDNLDADWDAELPVFDENADKAVATREVSGIVLQELEKKLPNLFGGAADLASSNKTHLKASERFAPGNYAAKNISFGVREFAMGAAVNGMTLHGGVQAFGATFFVFSDYLRSAIRSAALMGIPSTFIMTHDSIAVGEDGPTHEPIEHLASFRAMPGLHVIRPADGNETVEAYRYAFTQKEQPTMLVLSRQNLPILPNSAAKAQTGLAKGAYILADSPLDKLDIILLASGSEVHLMTAVRDNLAKKGFGARVVSMPSFDLFDKQSPEYKESVLPKAVKNRFAAEMGASYGWHKYLGDTGQILAIDSFGMSGPGDELARRFGFTVENLTELALKQL

SEQ ID NO: 10146 - DNA, 1905 bp, Listeria monocytogenes str. 4b H7858
  CDS (1)..(1905): transl_table=11
atggcgtatatgctatttgcgaaacatttagtattcaacccagccaacccagaatggtttaaccgcgatcgctttgttttatcagcaggacacgggtctgcgctactttatagcatgcttcatttatttggttatgatgtaaaaatggaagacttaaaacagttccgtcaattagatagtttgacaccaggacaccctgaatttggatggactgctggagtcgatgcaacgagtggcccgcttggacaagggattggtatggcggctggaatggcgcttgcagagtctcatttagcggcggagtataaccaaccaaattatccaattgtcgaccattatacgtatgcgatttgtggtgacggagacttgatggaaggcgtggcatcagaaacagcctcacttgcaggacatttaggacttgggaaattaatcgtattgtacgattccaatgatatttgtttagatggagatttaagcgcaacgttcagtgaaaatgcagcagaccgtttccgcgcatacggctggcaagttttacgtgtagaagatggcaacaatttagcggcaattcaagaaaaaattgttcaagcaaaattagaaacatcgaaaccaacgctaatcgaagtgaaaacagtcatcggttacggcgcgccaacaaaagcaggcagctccgcaagtcacggtgctccgctcggtgaaaaagaagcaaatggtgcaaaagagcattacgaatgggcagaagagcctttcacagtaccagccgaagttcgtgattacttaagaaattacaaagctcgcggggaaaaactagagggtgcttggaacacaatgctcgctaattacaaaaaagaattcccagaacttgcaagtcaattagaccgcgtgttagcgggagaagtagctgccgattggaacgctaatttgccaacttttgaagcaggcacaaatgttgcaacgcgctctgcttctgggaaaatgattaacgcaattgcagccgaattaccggaacttttcgggggatccgctgacttaggttgctcgaacaaaacatttattgatgcgagcccagcatacagcattcaagacccagctggtaaaaatatctggttcggtgtgcgcgaatttgcgatgggagcaatgttaaacggaatggcacttcatagcggtttgcgagtgtttggctcgactttcttcgtcttctcagactatgtccgcccagcaatgcggatggctgctttaatgcaacttccagtaacgtatgtattcacgcatgacagtatcgctgtaggtgaagacggcccgacacatgaaccaatcgaacaactagcctcgcttcgtgctatgccaggcctaacagttattcgcccagccgatgccaaagaaacccgcgctgcttgggaaattgccgcaactaacacaaatggtccaatcgcacttgtattatcacgccaagacttaccagtgcttgaaaatgcacaagaagaagtggatgcaggtgtagataaaggtgcttatatcgtagcaccagcaaatagttccaaaccagacgctatcattatcgcaacaggatcagaagtgtcccttgcaattgaagcgaaagccgaacttgcgaaaaaagatatcgacgtttccgttgttagtttatccagctgggaacgctttgaaaaaacaaccgatgcttataaagaaagcattttaccaaaagaagtcacagcgagatttgcgattgaagcaggagcaacattcggttggaaagaatttattgggtcagaaggcgatatgttaggaatcgatcacttcggcgcatctgcccctgcgaaagatttgtttaacgcttatggatttacaccagaaaatgtggcggatcgtgtcgaaactgtgattgcgaaagccggtgtgcgcgtatga

SEQ ID NO: 10147 - protein, 634 aa, Listeria monocytogenes str. 4b H7858
MAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELASQLDRVLAGEVAADWNANLPTFEAGTNVATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTNGPIALVLSRQDLPVLENAQEEVDAGVDKGAYIVAPANSSKPDAIIIATGSEVSLAIEAKAELAKKDIDVSVVSLSSWERFEKTTDAYKESILPKEVTARFAIEAGATFGWKEFIGSEGDMLGIDHFGASAPAKDLFNAYGFTPENVADRVETVIAKAGVRV

SEQ ID NO: 10148 - DNA, 1884 bp, Listeria monocytogenes str. 4b H7858
  CDS (1)..(1884): transl_table=11
atggcctacgcactttggtcgcgtgtattaaatactaaccctaagaattcacattggtttaaccgagatcgttttgtactttctgctggacacggctcaatgcttttatatagtttattacacttaagtggattcaaattagaattagaagatcttaaaaatttccgtcaatgggaaagtaaaactcctggtcacccagaatatcgttatacagatggtgtagacgcaactactggtccacttggtcaaggtattgcgatggctgttggtatggctatggcagaaagacatttagaagcgaaatataataaagatggtttcccggtagtggatcattatacttatgcactatgcggagatggtgacttaatggaaggtgttgcttcagaagcggcttcttatgcaggtcatcaacaattaggaagattagttgttctctatgattccaatgatatctctcttgatggtgatttagacaaatctttctctgaaaatgtaaaacaacgctttgaagcttatggctgggaacatttattagtaaaagacggtaatgatacagctgaaattttagcagcaatcgaaaaagcgaaacaaaacacttctcaacctactatgattgaagtgaaaactgttatcggttttggtgctccaaatgccggtacaagtaaagttcacggtgctccactaggcgatgaaggtattttagaagcgaaaaaagcttatggttggaactacgaagagaaattctttgttcctgaagaagttactgctcgctttaaagaaacaattggcgaacgtggtgaaaaagcagaaacagcttggaatgagttatttgcttcctataaagcagaatatccagagcttgcgaaacaattagaagatagcttgaacaacaagttaccagctgattgggatgaggatcttccagtatatgatgattcaaaagcacttgctagccgtgcttccagtggagaagttatcaatgcgttagctggaaaaatcccaactatttttggcggatctgctgaccttgcaggttcgaataatacaacaattaaaacagacggtgaatttacaaaagcgactccagctgaaagaaacatttggtttggtgttcgtgaatttgcgatgggcgctgcattaaatggtatggcacttcacggcggattacaagtatacggtggtacattcttcgtattctctgactatgtacgtgctgctattcgtttatcagctattcaacatttaccagtaacctatgtaatgacgcatgatagtattgcagttggggaagatggcccaacacatgagccaatcgaacaacttgcaagcttacgtgcaatgccagggctttctgttattcgtcctgctgatggaaatgaagttgtggaggcttggaaacttgctatcacttctacatctacaccgcatgtacttgttcttactcgtcaaggcctaccaacactaccaaattctgctaaattaactgcagaaggcgttaaaaaaggtgcttatgttatttccccagctaaaggtgacgtgccagaagcaatcatcctagcgagtggttctgaagttaacttagctattgaagcgcaaaaagaacttcaagctcaaggaacagatgtatcagttgtcagtgtgccatcatttgatctattcgagcaacaatctgctgagtacaaagaaagtgtattaccgaatgctgttagaaaacgtgtagcagtagagatgggcgctagctttggatgggaacgttatgttggtttagatggtaaagttatcggaattgacaaatttggtgcttctgctccaggtgaaacagttattaagaattacggctttactgttgaaaacgtagttaatacagtaaaatcactttaa

SEQ ID NO: 10149 - protein, 627 aa, Listeria monocytogenes str. 4b H7858
MAYALWSRVLNTNPKNSHWFNRDRFVLSAGHGSMLLYSLLHLSGFKLELEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTARFKETIGERGEKAETAWNELFASYKAEYPELAKQLEDSLNNKLPADWDEDLPVYDDSKALASRASSGEVINALAGKIPTIFGGSADLAGSNNTTIKTDGEFTKATPAERNIWFGVREFAMGAALNGMALHGGLQVYGGTFFVFSDYVRAAIRLSAIQHLPVTYVMTHDSIAVGEDGPTHEPIEQLASLRAMPGLSVIRPADGNEVVEAWKLAITSTSTPHVLVLTRQGLPTLPNSAKLTAEGVKKGAYVISPAKGDVPEAIILASGSEVNLAIEAQKELQAQGTDVSVVSVPSFDLFEQQSAEYKESVLPNAVRKRVAVEMGASFGWERYVGLDGKVIGIDKFGASAPGETVIKNYGFTVENVVNTVKSL

SEQ ID NO: 10150 - DNA, 2016 bp, Listeria monocytogenes str. 1/2a F6854
  CDS (1)..(2016): transl_table=11
ttgaaaaaaacattagatagacaagcagtagatacgattcgttcgttatcaattgatatgattgagaaagcaaattcaggacacccgggaatgccgatgggagcagcaccaatggcgtatatgctatttgcgaaacatttagtatttaacccagccaacccagaatggtttaaccgcgaccgatttgtcttatcagcagggcacgggtccgcgctactttatagcatgcttcatttatttggttatgatgtgaaaatggaggacttaaaacagttccgtcagttagatagtttgacaccaggacatcctgaattcggatggactgcaggagttgatgcaacgagtggaccgcttggacaagggattggtatggcagctggaatggcacttgcagagtctcatttggcggcggaatataaccaaccaaactacccaattgtcgaccattacacgtatgcgatttgcggtgatggcgatttgatggaaggtgtggcatcagaaacagcctcacttgcaggacatttaggacttggaaaattaatcgtactatacgattcaaacgatatttgtttagatggtgatttaagtgcaacattcagtgaaaatgcagcagaccgtttccgtgcatacggatggcaagttttgcgcgtagaagatggcaacaacttagcagctattcaagaaaaaattgttcaagcaaaattagaaacatcgaaaccaacgctaatcgaagtgaaaacagtcatcggttacggcgcgccaacaaaagcaggcagctccgcaagtcacggtgctccgctcggtgaaaaagaagcaaatggtgcaaaagagcattacgaatgggcagaagaacctttcacagtaccagctgaagttcgtgattacttaagaaattacaaagctcgcggggaaaaactagagggtgcttggaacacaatgctcgctaattacaaaaaagaattcccagaacttgcaagtcaattagaccgcgtgttagcgggagaagtagctgccgattggaacgctaatttgccaacttttgaagcaggcacaaatgttgcaacacgctctgcttctggaaaaatgattaacgcgattgcagccgaattaccggaacttttcggtgggtctgctgacttaggttgctcgaataaaacatttattgatgcgagcccagcgtatagcattcaagacccagctggtaaaaatatttggttcggcgtgcgcgagtttgcgatgggagcaatgttaaacggaatggcacttcatagcggcttacgagtatttggctcgactttcttcgtcttctcagactatgtccgcccagcaatgcggatggctgctttaatgcaacttccagtaacatatgtattcacgcatgacagtatcgctgttggtgaagacggcccgacacatgaaccaatcgaacaattagcctcgcttcgtgccatgccaggtctaaccgttatccgaccagctgatgccaaagaaacgcgcgctgcttgggaaattgctgcaactaacacaaacggcccgatcgcacttgtattatcacgtcaagacttaccggtactcgaaaacgaccaagaagaagtagatgcagggatcgaaaaaggtgcatatatcgtagctccagcaaatagttccaaaccagacgcaatcattatcgcaacagggtccgaagtgtccctggcaatcgaagcgaaagccgaactcgcgaaaaaagatatcgacgtttccgttgtcagtttatccagctgggaacgcttcgaaaaaacaaccgatacgtataaagaaagtattttaccaaaagaagtcacagcgagatttgctattgaagccggagcaacatttggttggaaagaattcattggatcagaaggtgacatgctaggaattgatcattttggcgcatctgctccagcgaaagatttgtttaacgcttacggcttcactcctgaaaatgtggcggatcgcgtcgaagctgtaattgcgaaagccggtgtgcgcgtatga

SEQ ID NO: 10151 - protein, 671 aa, Listeria monocytogenes str. 1/2a F6854
MKKTLDRQAVDTIRSLSIDMIEKANSGHPGMPMGAAPMAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELASQLDRVLAGEVAADWNANLPTFEAGTNVATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTNGPIALVLSRQDLPVLENDQEEVDAGIEKGAYIVAPANSSKPDAIIIATGSEVSLAIEAKAELAKKDIDVSVVSLSSWERFEKTTDTYKESILPKEVTARFAIEAGATFGWKEFIGSEGDMLGIDHFGASAPAKDLFNAYGFTPENVADRVEAVIAKAGVRV

SEQ ID NO: 10152 - DNA, 1995 bp, Bacillus cereus G9241
  CDS (1)..(1995): transl_table=11
atgacacaaaacataaatcaattagcagtgaatacacttcgtacgttatcaattgatgctattaatgcggcaaattcaggtcatccaggtcttccaatgggagcagcaccgatggcttatgcattatgggcgaatcatttaaatcacaatcctaatcatccgaaatggtttaaccgtgatcgatttgttttatcagcgggacacggatcgagcttactgtatagcttacttcatttagctggatatgacgtttcaattgatgacttgaaaagctttagaaagttaaatagtaaaacaccaggacatcctgagtatggtcacacttctggagttgaagcgacgacaggaccgttaggacaagggattgcaaatgctgtcggaatggcaatggcagaagctcatttagcagcgaagttcaataaggatggtcactctattatagatcacaatacgtacgctttagttggagacggtgacttaatggagggtgtcgcttatgaagcgatgtcaatggcagggcatatgaaactcggcaagttaattgtactgtatgattcaaatgaaatttcacttgatggtgaattaaacattgctttttctgaagatatgcagaaaagggtagaatctgcacattggcaatatgtaagagttgaggatggaaacgatgttgatgcgattacaaaagcgattcaattagcgaaagacaatacggaccaacctactcttatagagattagaaccgttataggttacggaagtccaaaagttgctggaacgaacaaagcacatggtaacccgcttggagtagaagaagcgacagcgacaaaacaagtgtatggttggcattatgaggaagacttctttgtgcctaaagaagtaacagctcattttaatgatttgaaacaaaaaggtattgaaaaagagaacgaatggaatgagcagttcaacgtatacagagagtcgaaccctgcactagcagatgaattagaaaaagcgattacaggtgaggttttaatcgaagcgaaagacattctatcctttgatactgaaaaaacgatttctactcgtgttgcaagtggggaagctattaaccattatgtgaaatcgattccttctattttcggtggaagcgcggatctttctcattctacgatgacagatataaaaggtgaagcagtgtatgcagtagaatcgtatgctggtcgaaatatatacttcggtgtacgtgaacatgcaatgggcgcggcagcgaatggactggcacttcatggaggagtaaaaccgttcgtaagtacattctttgtatttaatgactatcttcgtccatcgattcgacttgcagctttgcaaaagttacctgttacctatgtatttacacatgattcgattgctgtgggagaagatggtccaactcatgaaccaattgagcatcttgctgctcttcgtgcaattcctggactgacagtaataagaccatcagatgcaaatgaaacagcgaatgcttgggcgtatgctttacagcagacagatggtccagttgcacttgttctgagtcgtcaaaacttaccagtgtttgatgaaacaagaacgaatatagaggatctttcaagaggtgcttatattttaacgcaaacaaacgagaatccagaggtaatacttattgctacgggttctgaagtttccttggctgttaatgcaaaagtacaattggaacaagaacatatatctgtttgtatcgttgcaatgccgagctgggagttatttgatcgccaatcaaaagaatataaagaatctgttcttccgtcttctataacgaaacgagtatctcttgaaatgggtatatctctcggttgggagcgttatgtagggcaagaaggaaaagtactatcaattgaaacatttggagcttcaggaactggagctgaagtcatgaatctatttggatttacgacagaaaatgttgttcaaattacaaaaaatgtattacattcttaa

SEQ ID NO: 10153 - protein, 664 aa, Bacillus cereus G9241
MTQNINQLAVNTLRTLSIDAINAANSGHPGLPMGAAPMAYALWANHLNHNPNHPKWFNRDRFVLSAGHGSSLLYSLLHLAGYDVSIDDLKSFRKLNSKTPGHPEYGHTSGVEATTGPLGQGIANAVGMAMAEAHLAAKFNKDGHSIIDHNTYALVGDGDLMEGVAYEAMSMAGHMKLGKLIVLYDSNEISLDGELNIAFSEDMQKRVESAHWQYVRVEDGNDVDAITKAIQLAKDNTDQPTLIEIRTVIGYGSPKVAGTNKAHGNPLGVEEATATKQVYGWHYEEDFFVPKEVTAHFNDLKQKGIEKENEWNEQFNVYRESNPALADELEKAITGEVLIEAKDILSFDTEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETANAWAYALQQTDGPVALVLSRQNLPVFDETRTNIEDLSRGAYILTQTNENPEVILIATGSEVSLAVNAKVQLEQEHISVCIVAMPSWELFDRQSKEYKESVLPSSITKRVSLEMGISLGWERYVGQEGKVLSIETFGASGTGAEVMNLFGFTTENVVQITKNVLHS

SEQ ID NO: 10154 - DNA, 2001 bp, Bacillus cereus G9241
  CDS (1)..(2001): transl_table=11
atgtcacattcaatcgaacaactttctatcaacacgattcgcacattatccatcgatgcgattgaaaaagcaaactctggtcacccaggaatgccaatgggtgcagcaccaatggcttatacattatggactcaatttatgaaacataatccaaataacccaacgtggtttaaccgtgatcgtttcgtattatctgcaggtcatggttcaatgttattatacagcctacttcacctatctggttatgatgtaacaatggatgacttaaagaacttccgtcaatggggaagcaaaactccaggacatcctgagtacggtcatacagctggtgtagatgcaacgactggtccacttggacaaggtattgcaactgctgtaggtatggcaatggcagaaagacatttagctgctaaatataaccgtgatgcgtataatgtagtagatcattatacatacgctatttgtggtgatggagatttaatggaaggcgtttctgctgaagcatcttcattagctgctcatttacaattaggtcgtcttgttgtgctttacgattcaaacgatatttcattagatggcgatttaaatcgttcattctctgaaagtgtagaagatcgttacaaagcatacggatggcaagtaatccgtgttgaggatggaaacgatattgaagctatcgcgaaagcaatcgaagaagcgaaagctgacgaaaaacgcccaacgctaattgaagtaagaacgacaattggtttcggttctccaaacaaatcaggaaaatcagcttcacatggttctccacttggtgtagaagaaacaaagttaacgaaagaagcatacgcttggactgctgagcaagacttccacgtagcagaagaagtatatgacaacttccgtaaaacagtacaagatgttggtgaaactgcgcaagctgagtggaacacgatgctaggtgaatatgcacaagcatacccagaattagcaaacgaattccaagcagcaatgaacggtcaacttccagaaggttgggagcaaaacttaccaacttatgaattaggatcaaaagcagcaactcgtaattcttctggtgctgtaattaatgcaattgcagagtctgtaccatcattcttcggtggatctgctgaccttgctggttctaacaaaacatacatgaataacgaaaaagactttacaagagatgattacagcggtaaaaacatctggtacggtgtacgtgagttcgcaatgggtgcagcaatgaacggtattgcactacatggtggtttaaaaacttacggtggtacgttcttcgtattctctgactacttacgtccagcaattcgtcttgcagcattaatgcaattgccggtaacatatgtgttcacacatgacagtatcgctgttggtgaagatggtccaacacatgaaccgatcgagcaattagcagcgctacgtgcgatgccaaatgtatctgttatccgtccagctgatggtaacgaatctgttgcagcttggagactagctcttgaatctacaaacaaaccaactgctttagtattaactcgtcaagatcttccaacattagaaggtgcaaaagacgatacgtatgaaaaagtagcaaaaggtgcatatatagtttctgcaagcaagaaagaaacagctgatgtaatcttacttgcaactggatcagaagtaagtctagctgttgaagctcaaaaagcattagcagtagacggtgttgacgcatctgttgtcagcatgccatctatggatcgctttgaagctcaaactgctgagtacaaagaatctgtattaccaaaagcagtaacaaaacgtttcgcaatcgaaatgggtgctacattcggatggcaccgttacgtaggtcttgaaggagatgtgttaggtatcgatacattcggtgcttctgctcctggtgagaagattatggaagagtatggatttactgtagagaacgttgttcgtaaagtaaaagaaatgctttaa

SEQ ID NO: 10155 - protein, 666 aa, Bacillus cereus G9241
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYDNFRKTVQDVGETAQAEWNTMLGEYAQAYPELANEFQAAMNGQLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYIVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 10156 - DNA, 1989 bp, Exiguobacterium sibiricum 255-15
  CDS (1)..(1989): transl_table=11
atgattgttttgacgaacatgacaacagtagaattattagcagtaaatacgattcgtaccttatccattgatgcagtacaaaaagcgaactcgggtcacccgggaatgccgatgggtgcagcaccgatggcatttacattatgggcggatcatatgaaccacaaccctaaaaatccagaatggttcaaccgtgaccgttttgtactttcagcaggacacggttcaatgcttctctactcactcctccatttatcaggttatgatctcgcgatggatgacttgaagtcattccgtcaatggaactcaaaaacaccgggtcacccggaataccgtcacacagcaggtgtcgatgcgacgactggtccactcggacaaggcatcgcgatggctgtcggtatggcgatggcagagcgtcacctcgaagcgaaatataaccgtgacgacttaaatgtcgtcgatcacttcacatacgggatttgcggagacggtgatttaatggaaggtgtttcagcagaagcggcttcactcgcaggacatttaggtcttggtaaactcgtcgttctgtatgattcaaacgatatctcgcttgacggtgaccttgataaatcgttctcggaaaacgttcaacaacgttttgaagcgtataactggcaagtcatccgtgtcgaagacggaacagatctcgattcgatttcaaaagcaatcgaagcagcgaaagcggaaacaacaaaaccgacattgatcgaagtcaaaacggtcattggattcggttcgccaaacaaatcagggaaatcagcttcacacggtgcaccactcggcgacgcggaaatcaagttgacgaaagcaagctacgtttgggatcacgaagagttctatgtgccggacgaagtcaaagacttgttcgaagagcgcatcgaaaaacgtggtgctgatacagaagcagcatggacagaaaaaatggaacaatacaaagcggcacatccggaattgcacgctgagcttgttcaagcaatcaacaacgaattgccaagcaactgggaagctgaccttccgacttacgatctgacatcgaaaaaagcaacacgtcagacaagtggtgaagttctcaatgccatcgcgaaaaacgtcccgacaatcttcggtggatcagctgacttggcaggatcaaacaacacgatgctcaaaggcgaagctgacttcgacatcgatccgagcggccgtaacatctggtttggtgtccgtgagttcgccatggcagcagctgtcaacggtatggcgttacacggtggtgtcattccttatggtgcgacattcttcgtcttctcggattacctccgtcctgcagtccgtttagcagcattgatgggtatccagtcaatcttcgtcctgacacatgactcgattgcagtcggtgaagatggtccgacacacgagccggttgaacacttgatgagcttccgtgcgatgccgaacctgacagtttaccgtccggcagatggaaaagaaacgattgccgcatggaaaacagccgttcaatcaacaaacaaaccgacacttctcgtcatgacacgtcaaggattacctgaacttgaaggtacgacggtcgaaggcgctgaaaaaggcggatatgtcatcgcgggtgacattgaaaaagcggatacaatcttaatgggaacaggttctgaagtgcacttgctcgtcgaagcacaaaaagaactcggcgaaacggcagctgtcgtctcacttccatcatgggaattgtttgaagcgcaatcagctgaatacaaagaatcggtcttgccaaaacgcatcacgaagcgtcttgcaattgaagccggagcttcgctcggttggtataaatatgtaggaacagaaggtcaagtcatcggaatcgatcgcttcggtgcttctgctcctggagatcttctgttaaaagagtacggcatgtctgtcgaaaatgtcttaaatacagtcaagcaacttggttaa

SEQ ID NO: 10157 - protein, 662 aa, Exiguobacterium sibiricum 255-15
MIVLTNMTTVELLAVNTIRTLSIDAVQKANSGHPGMPMGAAPMAFTLWADHMNHNPKNPEWFNRDRFVLSAGHGSMLLYSLLHLSGYDLAMDDLKSFRQWNSKTPGHPEYRHTAGVDATTGPLGQGIAMAVGMAMAERHLEAKYNRDDLNVVDHFTYGICGDGDLMEGVSAEAASLAGHLGLGKLVVLYDSNDISLDGDLDKSFSENVQQRFEAYNWQVIRVEDGTDLDSISKAIEAAKAETTKPTLIEVKTVIGFGSPNKSGKSASHGAPLGDAEIKLTKASYVWDHEEFYVPDEVKDLFEERIEKRGADTEAAWTEKMEQYKAAHPELHAELVQAINNELPSNWEADLPTYDLTSKKATRQTSGEVLNAIAKNVPTIFGGSADLAGSNNTMLKGEADFDIDPSGRNIWFGVREFAMAAAVNGMALHGGVIPYGATFFVFSDYLRPAVRLAALMGIQSIFVLTHDSIAVGEDGPTHEPVEHLMSFRAMPNLTVYRPADGKETIAAWKTAVQSTNKPTLLVMTRQGLPELEGTTVEGAEKGGYVIAGDIEKADTILMGTGSEVHLLVEAQKELGETAAVVSLPSWELFEAQSAEYKESVLPKRITKRLAIEAGASLGWYKYVGTEGQVIGIDRFGASAPGDLLLKEYGMSVENVLNTVKQLG

SEQ ID NO: 10158 - DNA, 2007 bp, Prosthecochloris aestuarii DSM 271
  CDS (1)..(2007): transl_table=11
atgcaacaagatcctatcgataccctttccatcaataccattcgtctgcttgccgcagacatggtcgaaaaagccggatccgggcaccccggtatgccaatgggggccgcccccatggcctatgttctctggacaaaaatcatgaaacacaatccccgggatccgcattggctgaaccgtgaccgtttcgtcctgtccgcaggtcacggttcagccctgctctactcgcttctccacctctgcggctatgagctgaccatggaggacctgcagcagttccggcagtggcagagcagaactccggggcaccctgaataccgccatacccccggtgttgaaatgacgacaggaccgctcggtcagggcatagcaaccgctgtcggcatggctgtcgccgaacggttttctgctgaacgcctgaaccgtcagagcttcaatattattgattatcatacctatgtcatctgcggagacggcgatcttatggaaggcctctcttccgaagcagcctccattgccggccatctcaagctcgaaaaactgatctgcctctatgacgacaacaggatctccatcgaaggcccgaccagcctcgcattcactgaaaatgtcggcaaacggttcgaggctttcggctggaatgttctggacgttgacggtaacgatcccgaggcggtcgaagaggcgttgcggaaagtcagaaaaggaacaggcaaaccaaacctgatcagggcaaccaccaacatcggctatggaagcccgaacaaacaggacaatgctgcatcccatggatcgccgctgggaaaagaggaacttgccatggtcaggaaaaaattcggttttcccgaagatgaatcattcgtcattcctgaagcggtaaccgctcatatgcgagctatcagcgataaaggagaacagagccaggctgagtggacaacactgtgggaagcatatagccaagcccatcctgatctggcaacccagatcaacgaccttatcaataaacgtctgccggactcctggcagacgcttcttcccgaattcaacccggaagaacagctcgccacgcgccaggcactcaataaaatcctgcatgctctgattggcaaaatccctttccttgcaggcggttcggccgatctggccccatcgaacgggacagcagtcaaaaacgctgaggatttcaatcccgacaattacggcggcacaaatttccactttggcgtcagagaacatgccatgggcgcgatcatcaacggcatggcgctttcaggaatgctcaagccctacggagcgacattcctggtctttgcagactatatgaaacctgccctgagacttgcggcactgatgcagatcccttcaacatttattttcacccatgacagcattgctgttggtgaagacgggccgacacaccagccgatcgaacagctggtcatgctgcgatcaattcctggtatgacagtcatcagacctgctgatgccaatgaaacgaaagctgcatggaaatatatcatgacagcacagaccccggtatcactgatactctctcgccaggcccttcccatactcgacagcagcctctacccctctgaagaaggaacagccagaggaggctatattctggctgattggggaaacgcttcaggcagcggatccaagccggttatcctcatcgcaacaggggcagaagtccacctggcagtgcaggcacagcaacaacttgaagaagaaggcattcctgcccgcgtgatatcgatgccatcagtcgaactcttcctgcagcagcccgaagaatatcgagaagaagtcctgccgacctcaatacgcagaagagtcgttatcgaagcagcctcaactatcggctggcaccgctttatcactgaggaaggaacgattgtgggtatcgacaggttcggctcttcggctccgggaagcagagtgctcaaggagtacggattcacggcagagcatattgtagcgacagtaaaaacccttctctga

SEQ ID NO: 10159 - protein, 668 aa, Prosthecochloris aestuarii DSM 271
MQQDPIDTLSINTIRLLAADMVEKAGSGHPGMPMGAAPMAYVLWTKIMKHNPRDPHWLNRDRFVLSAGHGSALLYSLLHLCGYELTMEDLQQFRQWQSRTPGHPEYRHTPGVEMTTGPLGQGIATAVGMAVAERFSAERLNRQSFNIIDYHTYVICGDGDLMEGLSSEAASIAGHLKLEKLICLYDDNRISIEGPTSLAFTENVGKRFEAFGWNVLDVDGNDPEAVEEALRKVRKGTGKPNLIRATTNIGYGSPNKQDNAASHGSPLGKEELAMVRKKFGFPEDESFVIPEAVTAHMRAISDKGEQSQAEWTTLWEAYSQAHPDLATQINDLINKRLPDSWQTLLPEFNPEEQLATRQALNKILHALIGKIPFLAGGSADLAPSNGTAVKNAEDFNPDNYGGTNFHFGVREHAMGAIINGMALSGMLKPYGATFLVFADYMKPALRLAALMQIPSTFIFTHDSIAVGEDGPTHQPIEQLVMLRSIPGMTVIRPADANETKAAWKYIMTAQTPVSLILSRQALPILDSSLYPSEEGTARGGYILADWGNASGSGSKPVILIATGAEVHLAVQAQQQLEEEGIPARVISMPSVELFLQQPEEYREEVLPTSIRRRVVIEAASTIGWHRFITEEGTIVGIDRFGSSAPGSRVLKEYGFTAEHIVATVKTLL

SEQ ID NO: 10160 - DNA, 2001 bp, Xylella fastidiosa Dixon
  CDS (1)..(2001): transl_table=11
atgaccaaacccacacgccgccagttggccaacgcaatccgtttccttgcagctgatgcagtacaagctgctcattctgggcacccgggcatgccgatgggaatggcagatatcgctgaagttctttggaacgatttcctacgccataaccctaacaacccgaactggtttaaccgtgaccgcttcgttctttccaacggtcacggctcgatgttgcaatatgcattgctgcatttaagtggctatgacctgccgttagatgaactcaagcgattccgtcagctgcatagcaaaacagctggtcatcctgagcgtagcgagaccccagggattgagacgactactgggccgcttggtcaggggtttgctaacgcagtgggttttgccttggccgagaaacttctagcgcaacgctacaaccgtccggaacatctcattgtcgatcaccgcacctgggtgttcatgggcgacggctgtctcatggaaggtatctcacatgaagcagccgcgctggcgggtacctggaacttaggcaaattgatttgtttctgggatgacaacaacatttctattgatggcaatactgcgggttggtttaccgaagacactccagcacgattcgaagcctatggttggcatgtaatccgcgatattgatggccatgatgcggaaaaaatcgcaaccgcaatccaagccgccgttgctcaagagaacaagccctcattgctatgctgccgtaccgtgatcggatttggctcaccaaataaagcaggtaaagaatcttcgcatggtgccccactaggagcggaggaactggaggccacgcgtaagatgttggattggccatacggcccgttcgagattccgtccgagatttacgatggttggcgtgctaacggcacaggcatgctacgtcaagctgagtgggagcaggcgttcgacaactatgcccgacagtatcctaaggaagcagctgaattaacccggcgctcccacgctgagttacctactgattttctcagccaattggatgcttacattgccaaagttcacgctgcggggccctgcattgcttcccgtaaagcatcgcagatggcgattgaagcatttgcacctttacttcccgagttaattggtggctcggctgacttggcacattccaatctaacgttgtggaaagggagccaaacagttgttggcgacgcccccaacgccaactatgcctattacggcgtacgtgagtttgggatgagtgccatcgcaaatggacttgcattgcatggcggctttatccccttcgacgcgacatttctagtattcagtgattacgcccgcaacgcagtgcgtatgagtgcattgatcccagcacatgtgattcacgtttacacacatgattcaatcggacttggcgaagacggtccaacgcatcagcctgttgaacacttagccgcactgcgctatatccccaacaatgacgtgtggcgtccctgtgacgcagttgaatctgcagtggcatggaaggcggcgatcactcgcaataacggcccgagctgtttggtgttcagccgccaaaacttgccgcaccaaccgcgccatgatgcacaacttgagcagattgcacgcggtggctatatcttggctgacgcggcgagcagcatccccgacatcattttgatcgcgaccggctcggaagtcagcctagcgatcgaagcgaaaaagacacttgatgcgatgcagctaaaaacacgcgtggtctcgatgccatcgaccaatgtgtttgaacgtcagcaccccacctaccgtgagtcggtcctcccatcgaaagtccacaagcgtgttgcaatagaagctggcgtcactggtttttggtggcagtacgtagggttacatggtgccgtgattggcctggacacctttggtgcatcagccccagcggatgtgttgtacaaacattttaatatcactgcagaacacgttgtcgaagtcgcaaaggcactttag

SEQ ID NO: 10161 - protein, 666 aa, Xylella fastidiosa Dixon
MTKPTRRQLANAIRFLAADAVQAAHSGHPGMPMGMADIAEVLWNDFLRHNPNNPNWFNRDRFVLSNGHGSMLQYALLHLSGYDLPLDELKRFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQAFDNYARQYPKEAAELTRRSHAELPTDFLSQLDAYIAKVHAAGPCIASRKASQMAIEAFAPLLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRNNGPSCLVFSRQNLPHQPRHDAQLEQIARGGYILADAASSIPDIILIATGSEVSLAIEAKKTLDAMQLKTRVVSMPSTNVFERQHPTYRESVLPSKVHKRVAIEAGVTGFWWQYVGLHGAVIGLDTFGASAPADVLYKHFNITAEHVVEVAKAL

SEQ ID NO: 10162 - DNA, 2001 bp, Xylella fastidiosa Ann-1
  CDS (1)..(2001): transl_table=11
atgaccaaacccacacgccgccagttggccaacgcaatccgtttccttgccgctgatgcagtacaagctgctcattctgggcacccgggcatgccgatgggaatggcagatatcgctgaagttctttggaacgatttcctacgccataaccctaacaacccgaactggtttaaccgtgaccgcttcattctttccaacggtcacggctcgatgttgcaatatgcattgctgcatttaagtggctatgacctgccgttagatgaactcaagcgattccgtcagctgcatagcaaaacagctggtcatcctgagcgtagcgagaccccagggattgagacgactactgggccgcttggtcaggggtttgctaacgcagtgggttttgccttggccgagaaacttctagcgcaacgctacaaccgtccggaacatctcattgtcgatcaccgcacctgggtgttcatgggcgacggctgtctcatggaaggtatctcacatgaagcagccgcgctggcgggtacctggaacttaggcaaattgatttgtttctgggatgacaacaacatttctattgatggcaatactgcgggttggtttaccgaagacactccagcacgattcgaagcctatggttggcatgtaatccgcgatattgatggccatgatgcggaaaaaatcgcaaccgcaatccaagccgccgttgctcaagagaacaagccctcattgctatgctgccgtaccgtgatcggatttggctcaccaaataaagcaggtaaagaatcttcgcatggtgccccactaggagcggaggaactggaggccacgcgtaagatgttggattggccatacggcccgttcgagattccgtccgagatttacgatggttggcgtgctaacggcacaggcatgctacgtcaagctgagtgggagcaggcgttcgacaactatgcccgacagtatcctaaggaagcagctgaattaacccggcgctcccacgctgagttacctactgattttctcagccaattggatgcttacattgccaaagttcacgctgcggggccctgcattgcttcccgtaaagcatcgcagatggcgattgaagcatttgcacctttacttcccgagttaattggtggctcggctgacttggcacattccaatctaacgttgtggaaagggagccaaacagttgttggcgacgcccccaacgccaactatgcctattacggcgtacgtgagtttgggatgagtgccatcgcaaatggacttgcattgcatggcggctttatccccttcgacgcgacatttctagtattcagtgattacgcccgcaacgcagtgcgtatgagtgcattgatcccagcacatgtgattcacgtttacacacatgattcaatcggacttggcgaagacggtccaacgcatcagcctgttgaacacttagccgcactgcgctatatccccaacaatgacgtgtggcgtccctgtgacgcagttgaatctgcagtggcatggaaggcggcgatcactcgcaataacggcccgagctgtttggtgttcagccgccaaaacttgccgcaccaaccgcgccatgatgcacaacttgagcagattgcacgcggtggctatatcttggctgacgcggcgagcagcatcccagacatcattttgatcgcgaccggctcggaagtcagcctagcgatcgaagcgaaaaagacacttgatgcgatgcagctaaaaacacgcgtggtctcgatgccatcgaccaatgtgtttgaacgtcaggaccccacctaccgtgagtcggtcctcccatcgaaagtccacaagcgtgttgcaatagaagctggcgtcactggtttttggtggcaatacgtagggttacatggtgccgtgattggcctggacacctttggtgcatcagccccagcggatgtgttgtacaaacattttaatatcactgcagaacacgttgtcgaagtcgcaaaggcactttag

SEQ ID NO: 10163 - protein, 666 aa, Xylella fastidiosa Ann-1
MTKPTRRQLANAIRFLAADAVQAAHSGHPGMPMGMADIAEVLWNDFLRHNPNNPNWFNRDRFILSNGHGSMLQYALLHLSGYDLPLDELKRFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQAFDNYARQYPKEAAELTRRSHAELPTDFLSQLDAYIAKVHAAGPCIASRKASQMAIEAFAPLLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRNNGPSCLVFSRQNLPHQPRHDAQLEQIARGGYILADAASSIPDIILIATGSEVSLAIEAKKTLDAMQLKTRVVSMPSTNVFERQDPTYRESVLPSKVHKRVAIEAGVTGFWWQYVGLHGAVIGLDTFGASAPADVLYKHFNITAEHVVEVAKAL

SEQ ID NO: 10164 - DNA, 2130 bp, Sulfitobacter sp. EE-36
  CDS (1)..(2130): transl_table=11
ttggcccggcggaaaagctctgctgcgggcgatgccctctgggccttgatctttgcggggtggctggtattgatccgcgcaatcccttttcccccttataaggaagcttgcaccgtggatctgaacgccctcgccaaagcccatcccgcccattggtccaaagcgaccgccattcgcgccctgacgctggacgctgtcgccgccgccaattccggccactcgggcatgccgatgggcatggcggatgttgccactgtcttgtttgaaaagcacctgaagttcgacgcgtccaacccgctgtggcctgaccgcgaccgttttatcctgtcggccggccacgggtccatgctgatctattcgctgctgcacctgaccggctacgagcaattccccctcgaagagatcaagaacttccgccagatgggcgcacgcaccgcgggacaccctgaaaacttcctggccgatgcgattgaaaccaccaccggcccgctgggtcaggggatcgcgaactctgtcgggtttgccatggccgaggaaatccagcgcgcgcaatacggcaagaagatcgtcgaccacttcacctatgtgatcgcgggtgacggctgcctgatggagggcatcagccacgaagcgattgcccttgccggccgccacaagctgagcaagctgatcgtgatgtgggacaacaacgacatcaccatcgacgggccggtatcgctctcggacaaagtggatcaggtcgcgcggttcaaggcggcggactggcacgtcatcgagatcgacggccacaaccccgacgagatcgacgccgccctgaccgaggcgcgcaaatccgatctgcccacgatgattgcttgcaaaacgcatatcgcgcttggtcacgccgcacaggacacgtccaaaggtcacggcgcgctgaccgacgcggaccaaatggccgccgccaaagccgcctatggctggacaaccggcccgttcgaagtccccgccgacgtgaaatccgcctgggaagagatcggcaaacgcggcgcagacgaccgccgcgcctgggaagagcgtttcgacgccatgtcgcgcacaaagcgtgaagagttcaaccgcgcgctggccggtgacgcccccaagaagctgagcgcgacgatcaaggcgttcaaaaagcagacgtcggaaaacgcgccgaaacttgccacccgcgccagcagcgaaaagacgctcgaggtgttgaacccgctctataccgaaaccgtgggcggttcggctgacctgaccggttcgaacaacacaaagaccgctgatctgggcgtgtttgatgtggataaccgtggtgggcgttatgtctactgggggatccgcgaacacggcatggccgctgcgatgaacggcatggcgctgcacggcggtatccgcccctacggcggcacgttcatgtgtttcaccgactacgcccgccccgccatgcgccttgccgcgctgatgcaggtgccaagcgtgtttgtcatgacccacgacagcatcggtctgggcgaagacggcccgacacaccaacccgtcgagcatctggccatcagccgcgcgacacccaacacctatgtgttccgccccgctgacacggttgaaacagccgaggcctgggaaatcgcgctgagcagcaagaagacaccgtcggtgctgtcgctgacccgtcagggcctgcccaccgtgcggcttgagcacaagaacaagaacctcaccgaacagggggcctatgttctggcggacgcggaaggcaaacgtcaggtcatcctgatcgccaccggctctgaagtcgagatcgcgctgaaagcccgtgacctgctgcaagccgaaggcatcggcacacgcgtcgtgtccatgccctgcatggagctgttcgccgcccaagacgaagcctaccgccgccgcgtcctccccgccggccctgtccgcgtcggcgtcgaagccgccgtacgccaaggctgggaccgctggctcaccggcgagcgtggcaagtggaacaaggccgatttcgtcggcatggaccgcttcggtgcctccgcccccgcagaagagctgttcgaaaagttcgacatcaccccgcagaacgttgccgacaaggccaaagcgctgctgtga

SEQ ID NO: 10165 - protein, 709 aa, Sulfitobacter sp. EE-36
MARRKSSAAGDALWALIFAGWLVLIRAIPFPPYKEACTVDLNALAKAHPAHWSKATAIRALTLDAVAAANSGHSGMPMGMADVATVLFEKHLKFDASNPLWPDRDRFILSAGHGSMLIYSLLHLTGYEQFPLEEIKNFRQMGARTAGHPENFLADAIETTTGPLGQGIANSVGFAMAEEIQRAQYGKKIVDHFTYVIAGDGCLMEGISHEAIALAGRHKLSKLIVMWDNNDITIDGPVSLSDKVDQVARFKAADWHVIEIDGHNPDEIDAALTEARKSDLPTMIACKTHIALGHAAQDTSKGHGALTDADQMAAAKAAYGWTTGPFEVPADVKSAWEEIGKRGADDRRAWEERFDAMSRTKREEFNRALAGDAPKKLSATIKAFKKQTSENAPKLATRASSEKTLEVLNPLYTETVGGSADLTGSNNTKTADLGVFDVDNRGGRYVYWGIREHGMAAAMNGMALHGGIRPYGGTFMCFTDYARPAMRLAALMQVPSVFVMTHDSIGLGEDGPTHQPVEHLAISRATPNTYVFRPADTVETAEAWEIALSSKKTPSVLSLTRQGLPTVRLEHKNKNLTEQGAYVLADAEGKRQVILIATGSEVEIALKARDLLQAEGIGTRVVSMPCMELFAAQDEAYRRRVLPAGPVRVGVEAAVRQGWDRWLTGERGKWNKADFVGMDRFGASAPAEELFEKFDITPQNVADKAKALL

SEQ ID NO: 10166 - DNA, 2019 bp, Roseovarius nubinhibens ISM
  CDS (1)..(2019): transl_table=11
gtggatatcgccgccctgcgcactgccaatcccgatcactggaaaaaagccactgccatccgcgcgctcacgctcgacgcggtgcacgcagccaactccggacattccggcatgccgatgggcatggccgatgtggccaccgtgctctttgaaaagcacctgaaatttgacgcctccgcccccaactggcccgaccgcgaccggttcatcctgtcggcgggccacggctcgatgctgctttattcgctgctgcatctgaccggctacaagggcatggagatcgaccagatccgcaatttccgccaatggggcgcgctgaccgcgggccatccggaaaacttcctgcatgacgcgatcgagacgaccaccggcccgctgggtcagggcatcgccaattcggtcggcttcgccatggccgaggaatcgctgcgcgcccgctatggcgccaagctgatgaaccattacacctatgtcatcgcgggcgacggctgcctgatggaaggtatcagccaagaggccatcggtcttgccggtcgtcacgagctgggccgtctcatcgtgttctgggacaataacaacatcaccatcgacggcacggtcgaactgtcggatcgcaccgatcaggtcaaacggttcaaggcgtcgggctggcatgtgatcgagatcgacggtcacgaccccaaggccatcgatgcggcgatcaccgaggccaagaagacctcgaaaccctcgatgattgcctgcaagacgcatatcgcgctgggccacgcggcacaggacacctccaagggccacggcgcacttactgacgaggcccagatggccgccgccaaagaggcctatggctggacctcggcgccctttgatgtgcctgccgacatcaagcaagcctgggaagccatcggcgcgcgcggcgcgtccgagcgtgaagcatgggaagcccgtcttgccgaggcgtccgagcgtcgtcaggccgagttcgagcgcattttcgccctcgacacgccgaaacagctctccgcccgcatcaaggcgctgaagaaacagatcagcgccgaagcgcccaaggtcgccacccgcaaaagctcggaaatggttcttgaagtggtcaacccgatcatgcccgaaaccatgggcggctcggccgacctcaccgggtcgaacaacaccaagaccggtgatctcggcgtctttgatgtcgagaaccgcaagggccgctacatctactggggcattcgtgaacatggcatggccgccgcgatgaacggcatggcgctgcatggcggtatccgcccctatggcggcacgttcatgtgcttcaccgactacgcccgccccgcgatgcgtctcgccgcgctgatgaaagtgccgagcgttttcgtcatgacccatgacagcatcggcctcggcgaagatggcccgacccaccaaccggtcgaacatctggcgatcagccgcgcgacgcccaacacgatggtgttccgcccctgtgatacggtcgagaccgccgaagcctgggaactggcgctgagctccaaggaaacgccctcggttctctcgctgacccgtcaaggcctgccgacgctgcgcaccgagcacaagaacaagaacctgaccgctcagggcgcctatgttctggccgatgccgaaggcaagcgtcaggcgatcttgctcgccaccgggtccgaggtcgagatcgccatgaaggcgcgcgacctgctgcaggccgaaggcatcggcacgcgtgtcgtctcgatgccctgctgggagctctttgagcaacaggaagaaagctatcgcaagcgcgttctgcccggcggtgccgcggtgcgcgtcgcggtcgaagcagcagcacgtcagggctgggatcgttggctctgtggtgagcgtggccgcgaggcgcgttcgggctttgtcggcatggaaggttttggcgcctccgccccggccgagacgctctttgagaagttcggcatcaccgccgaggccgtggccgagaaggtcaaatcgctgctctga

SEQ ID NO: 10167 - protein, 672 aa, Roseovarius nubinhibens ISM
MDIAALRTANPDHWKKATAIRALTLDAVHAANSGHSGMPMGMADVATVLFEKHLKFDASAPNWPDRDRFILSAGHGSMLLYSLLHLTGYKGMEIDQIRNFRQWGALTAGHPENFLHDAIETTTGPLGQGIANSVGFAMAEESLRARYGAKLMNHYTYVIAGDGCLMEGISQEAIGLAGRHELGRLIVFWDNNNITIDGTVELSDRTDQVKRFKASGWHVIEIDGHDPKAIDAAITEAKKTSKPSMIACKTHIALGHAAQDTSKGHGALTDEAQMAAAKEAYGWTSAPFDVPADIKQAWEAIGARGASEREAWEARLAEASERRQAEFERIFALDTPKQLSARIKALKKQISAEAPKVATRKSSEMVLEVVNPIMPETMGGSADLTGSNNTKTGDLGVFDVENRKGRYIYWGIREHGMAAAMNGMALHGGIRPYGGTFMCFTDYARPAMRLAALMKVPSVFVMTHDSIGLGEDGPTHQPVEHLAISRATPNTMVFRPCDTVETAEAWELALSSKETPSVLSLTRQGLPTLRTEHKNKNLTAQGAYVLADAEGKRQAILLATGSEVEIAMKARDLLQAEGIGTRVVSMPCWELFEQQEESYRKRVLPGGAAVRVAVEAAARQGWDRWLCGERGREARSGFVGMEGFGASAPAETLFEKFGITAEAVAEKVKSLL

SEQ ID NO: 10168 - DNA, 2019 bp, Oceanicola batsensis HTCC2597
  CDS (1)..(2019): transl_table=11
gtggatatcgctgccctccgttccgcccatcccgatcactggtcgaaggcgaccgcgatccgcgccctgaccctcgacgcggtggccgccgcgaactcgggacattccggcatgcccatggggatggccgacgtggcgacggtgctgttcggcaaacacctgaagttcgacgcctcggccccgctctggcacgaccgcgaccggttcatcctttcggcgggccacgggtcgatgctgctgtattcccttctccacctcacgggctacgaggactttccgctggagcagatccgcaacttccgccagctcggctcgcggacggcggggcaccccgagaacttcctcgccaaggcgatcgagacgaccaccggacctctcggccaggggatcgcgaattcggtcggcttcgccatcgccgaagaggcgctgcgggcacggttcggcaagaagctcgtcgatcaccacacctatgtcatcgccggcgacggttgcctgatggagggcgtgagccaggaggccatcgcgctggccgggcgccagcagctctccaagctgatcgtcttctgggacaacaacaacatcaccatcgacggcgaggtcggcctggccgaccgcaccgatcaggtcgcgcgcttccaggcctcgggctgggacgtgcaggagatcgacggccacgaccccgaggcgatcgacgccgccatcacccgggcgaagaagggcacgcgcccccagatgatcgcctgcaagacgcatatcgccctgggccatgcggcgcaggacacggccaaggggcacggcgcgctgaccgatgccgaccagctggccgcggccaaggaggcctatggctggacgaccggccccttcgaggttcccgccgaggtcaagtcggcctgggaggagatcgggcggcgcggcaccgaggaccgctatgcctgggagggccggctggccgatgtctcggaccgcaagcgggccgagttcgaacggaccatggcgggcgaggccccgaagaagctgacctcggtgatccgggcgctgaagaagcaggccgccgaggcgcggcacaaggtggcgacgcgcaaggcctcggagatggtgctcgaggtggtcaatccggtgatgcccgagaccatgggcggatcggcggacctgaccgggtcgaacaacaccaagaccggcgatctgggcatcttcgacatcgacagccgcgacgggcgcttcgtgcattacggcatccgcgaacacggcatggcggcggcgatgaacggcatggcgctgcatggcggcctccggccctattcgggcacgttcatgtgcttcaccgactatgcccgccccgcgatgcgcctctcggcgctgatgcagcagccggtggtctacgtgatgacgcatgacagcatcgggctgggcgaggacgggccgacccaccagccggtggaacacctggcgatttcgcgcgcgacgccgaacacgctggtcttccgcccggcggacgtggtcgagaccgccgaggcctgggaactggcgctgacgcagggcggaacgccctcggtcctgtcgctgacccggcagggcgtgccggcggtgcgccagcagcacaaggcgaagaacctcaccgaacagggcgcctatgtgctggcggacgccgaggcgggcaaacggcaggtgatcctgatcgcgaccgggtcggaggtgtcgctggccatggaggcccgcgcgacgctggaggccgaggggatcggcacgcgcgtcgtctcgatgccctgcatggagctgttcgccgcgcagcccgaggcctaccgcaagcgcgtgctgcccgccggcccggtgcggatcggggtcgaggccggggtccgcatgggctgggaccgctggcttctgggcgagcgcgggcgcgaggccaaggcggccttcgtcggcatgtcgtccttcggcgcctcggccccggccgaggtcctgttcgagcatttcggcatcaccgccgagggcgtcgtgcaggcggcgaaggacctgctctga

SEQ ID NO: 10169 - protein, 672 aa, Oceanicola batsensis HTCC2597
MDIAALRSAHPDHWSKATAIRALTLDAVAAANSGHSGMPMGMADVATVLFGKHLKFDASAPLWHDRDRFILSAGHGSMLLYSLLHLTGYEDFPLEQIRNFRQLGSRTAGHPENFLAKAIETTTGPLGQGIANSVGFAIAEEALRARFGKKLVDHHTYVIAGDGCLMEGVSQEAIALAGRQQLSKLIVFWDNNNITIDGEVGLADRTDQVARFQASGWDVQEIDGHDPEAIDAAITRAKKGTRPQMIACKTHIALGHAAQDTAKGHGALTDADQLAAAKEAYGWTTGPFEVPAEVKSAWEEIGRRGTEDRYAWEGRLADVSDRKRAEFERTMAGEAPKKLTSVIRALKKQAAEARHKVATRKASEMVLEVVNPVMPETMGGSADLTGSNNTKTGDLGIFDIDSRDGRFVHYGIREHGMAAAMNGMALHGGLRPYSGTFMCFTDYARPAMRLSALMQQPVVYVMTHDSIGLGEDGPTHQPVEHLAISRATPNTLVFRPADVVETAEAWELALTQGGTPSVLSLTRQGVPAVRQQHKAKNLTEQGAYVLADAEAGKRQVILIATGSEVSLAMEARATLEAEGIGTRVVSMPCMELFAAQPEAYRKRVLPAGPVRIGVEAGVRMGWDRWLLGERGREAKAAFVGMSSFGASAPAEVLFEHFGITAEGVVQAAKDLL

SEQ ID NO: 10170 - DNA, 1998 bp, Erythrobacter sp. NAP1
  CDS (1)..(1998): transl_table=11
atgactctcgacgccgcccgccttcagccgatggcaaatgccatccgcgcgctttccatggacgcggtgcaggccgcaaattcggggcaccccggtatgccaatgggcatggccgatgtcgccaccgtgctgttcgaccggcacctgaaattcgatccaagccgccccgactgggcagaccgcgaccgtttcgtgctgtcggcaggccatggctcaatgctgatttactcgcttcttcacctgtcaggctatgcgcgcccgacgatggatgagatcgcgaatttccgccagctgggcagcccatgcgccgggcatccggaaaacttccttctcgaaggtgtcgaatgcaccaccggtcctcttgggcaggggctcgcgatggctgtcggtatggcgatggcagagcggcacctcaatgcgcagttcggcgatgagcttgtcgatcaccgcacatgggtggtcgcaggcgatgggtgcctgatggaaggtatcaaccacgaagcaatcggccttgccgggcacttgaacctcggccgcttgatcgttctttgggacgacaatgccatcaccatcgacggcgcaaccgacctttcgaccagcgaaaacgtcaaggcgcgttacgaggcgaccgggtggcatgtcgtatcctgcgacggtcacgatttcgacgatatcgagcgcgcgatcgaagaagccaaggctgacccgcgcccatctctggtcgcgtgcaagaccatcatcggcaaaggcgctcccaacaagcagggcaccagtgccacgcacggcgcgcccctcggtcccgacgaagttgctgcggcccgcgaagtgcttggttgggaagctgagccattcaacgttccgcaagatatcctcgtcgagtggcgcaagacggccgagcgcggacgtcatgatcatggcgaatgggagcggcgtttgaacgagtcgccccatagcgatgctttcgaaaagcagctcgcgggcgttgccgaaggcgcagacaccgcgatccaacaacacattcgcacgctcgcagcagaaccgcagaaggccgcgacccgcaaggcaagcgagatggcgcttggtccgctgaccgagaacctgccgcagctgatcggtggttcagctgacctgacgggatcgaacaacaccaagacgccatcgacattgccgatgagcgcggacgattattcgggccgctacatctattatggcattcgcgagttcggcatggccgcagcgatgaacggcatggcgctgcatggaggtgttgtcccctacggcggaaccttcctgatcttctccgattattgccgcaacgcgatccgtctgtcggcgctccagaagacgcaggcgatctatgtcatgacccatgacagcatcggccttggcgaagacggacccacgcaccagccggtcgagcaagtcatgagcctgcgcctgataccgaacctctacaccttccgcccgtgcgacacgatcgagacagcggaatgctgggcgcttgcgctcaaggcggaggaaacgccttcggttctggctcttactcgtcagggtctcccgcaactgcgcggcgagggtgacgaggcatggacgggcgagagcaatcgctgcgcaaagggtggttatcgcttgcgcagcgcgagcgcggaccggcgcgtcgtgatcgtcgccagcggcagcgaagtcgctcttgcgatggaatgcgcggatcagcttgaagaagcgggcgtcggcgcggatgtcgtctcgatgccatgcaccgagctcttcgatgcgcaggacgatgcctacaaggcggacctgctgcctcacgatacgctaatcgtctcgatcgaggcgggctcgaccctgggctgggagcgttataccgggcgcggcggtctcaacatcggcatggaaagcttcggcgcctcggccccggcaagcgatctgtttgcccatttcggtttcacggcggacgcaatcgtcccccaaatccagaacaaattgaacaactaa

SEQ ID NO: 10171 - protein, 665 aa, Erythrobacter sp. NAP1
MTLDAARLQPMANAIRALSMDAVQAANSGHPGMPMGMADVATVLFDRHLKFDPSRPDWADRDRFVLSAGHGSMLIYSLLHLSGYARPTMDEIANFRQLGSPCAGHPENFLLEGVECTTGPLGQGLAMAVGMAMAERHLNAQFGDELVDHRTWVVAGDGCLMEGINHEAIGLAGHLNLGRLIVLWDDNAITIDGATDLSTSENVKARYEATGWHVVSCDGHDFDDIERAIEEAKADPRPSLVACKTIIGKGAPNKQGTSATHGAPLGPDEVAAAREVLGWEAEPFNVPQDILVEWRKTAERGRHDHGEWERRLNESPHSDAFEKQLAGVAEGADTAIQQHIRTLAAEPQKAATRKASEMALGPLTENLPQLIGGSADLTGSNNTKTPSTLPMSADDYSGRYIYYGIREFGMAAAMNGMALHGGVVPYGGTFLIFSDYCRNAIRLSALQKTQAIYVMTHDSIGLGEDGPTHQPVEQVMSLRLIPNLYTFRPCDTIETAECWALALKAEETPSVLALTRQGLPQLRGEGDEAWTGESNRCAKGGYRLRSASADRRVVIVASGSEVALAMECADQLEEAGVGADVVSMPCTELFDAQDDAYKADLLPHDTLIVSIEAGSTLGWERYTGRGGLNIGMESFGASAPASDLFAHFGFTADAIVPQIQNKLNN

SEQ ID NO: 10172 - DNA, 2010 bp, Synechococcus sp. RS9917
  CDS (1)..(2010): transl_table=11
atggtcgccgcgcccgcttccctcgacaccctctgcatcaacagcatccgcatgctggccgttgatgcggtcaacaaatccaagagcggccaccccggtctgcccatgggtgcagcgccgatgggctacaccctctgggacaagttcctgaagcacaaccccaaaaaccccctctggttcaaccgggatcggttcgtgctctcggccggccacggctgcatgctcctctacgcgttgctgcacctcaccggctacgactcggtgacgatcgacgacatcaagcagttccgtcagtggggctccaaaacccccggccacccggaaaccttcgagacccctggcgttgaagtgaccacgggcccgctcggtgccggcatctccaatgccgtgggcctggcgatcgcggaagcccatctcgcggccaaattcaacaagcccgacgccaaggtcgtcgatcactacacctacgtgatcatgggcgatggctgcaatcaggagggtgtgtcgtcggaagcctgctctttggcgggtcacctgaagctgggcaagctgatcgcgctctacgacgacaaccacatcaccatcgacggacgcaccgatgtgtccttcaccgaagatgtgctcaagcgctacgaggcttacggctggcacgtgcagcacgtggctgatggcaacaccgacgtgaatgcgatcgcccatgcgattgaggccgccaaagccgtcaccgacaagccgtcgatcatcaaggtgaccaccacgatcggctacggctctcccaacaagagcgatacggccggagtgcacggggctcccctcggcgaagaagaggcggaactcacccgcaagcagctcggctggaaccacgggccgtttgaagtgccccaggaggcctacgaccaataccgtcaggcgatcgaacgcggtgccagcctcgaggccgaatggaaccaggcgctggccagctaccgcagcaagtaccccagcgaagccgccgaatttgagcggatgctgcgcggtgagctgccccagggttgggacaaggatctgccctcctacacccccaacgacaaaggtctggccacccgcaagcactcccagatctgcctgggtgccctgggcccgaacctgcccgagctgatcggtggttccgctgacctcacccactccaactacaccgacatcgccggtgaaacgggctccttccagccggagagcccggagaagcgctatctccacttcggcgtgcgcgagcacgccatggcggcgatcctcaacggcatcgcctaccacaacagcggcttgatcccctacggcggcaccttcctggtgttcgccgactacatgcgcggctcgatgcgactctccgctctgagcgagctgggtgtgatctatgtgctcacccacgactccatcggcgttggtgaagacggccccacccaccagccgatcgagaccatcccttctctgcgggcgatgccgaacctgctggtgttccgccccggcgacggcaacgaaaccagtggcgcctacaagctggccatccagaaccgcaagcgtccgagtgcgctctgcctcagccgccaggccatggccaaccaggccaactcctcgatcgacaaggtggcccacggcggttacatcctcgaggattgcgccggcacccccgagctgatcctgatcggcaccggcactgaactcgatctctgcgtgcaagcggcgaagcagctcacggcggaaggccacaaggtgcgcgtcgtctccatgccttgcgtggagctgttcgatgagcaaagcgacgcctacaaggaagaggttctgcccagcgccgtgcgcaagcggatcgtggtggaagctgcggaagccttcggctggcatcgtttcgtgggcctcgatggcgccaccgtcaccatggatcgcttcggcgcctccgcgcccggcggcacctgcatggagaagttcggcttcaccgtggagaatgtggtggccaaagccaaagcgctgctggcttga

SEQ ID NO: 10173 - protein, 669 aa, Synechococcus sp. RS9917
MVAAPASLDTLCINSIRMLAVDAVNKSKSGHPGLPMGAAPMGYTLWDKFLKHNPKNPLWFNRDRFVLSAGHGCMLLYALLHLTGYDSVTIDDIKQFRQWGSKTPGHPETFETPGVEVTTGPLGAGISNAVGLAIAEAHLAAKFNKPDAKVVDHYTYVIMGDGCNQEGVSSEACSLAGHLKLGKLIALYDDNHITIDGRTDVSFTEDVLKRYEAYGWHVQHVADGNTDVNAIAHAIEAAKAVTDKPSIIKVTTTIGYGSPNKSDTAGVHGAPLGEEEAELTRKQLGWNHGPFEVPQEAYDQYRQAIERGASLEAEWNQALASYRSKYPSEAAEFERMLRGELPQGWDKDLPSYTPNDKGLATRKHSQICLGALGPNLPELIGGSADLTHSNYTDIAGETGSFQPESPEKRYLHFGVREHAMAAILNGIAYHNSGLIPYGGTFLVFADYMRGSMRLSALSELGVIYVLTHDSIGVGEDGPTHQPIETIPSLRAMPNLLVFRPGDGNETSGAYKLAIQNRKRPSALCLSRQAMANQANSSIDKVAHGGYILEDCAGTPELILIGTGTELDLCVQAAKQLTAEGHKVRVVSMPCVELFDEQSDAYKEEVLPSAVRKRIVVEAAEAFGWHRFVGLDGATVTMDRFGASAPGGTCMEKFGFTVENVVAKAKALLA

SEQ ID NO: 10174 - DNA, 2013 bp, Synechococcus sp. WH 5701
  CDS (1)..(2013): transl_table=11
atggtcgccgcccccactgtggacaccctgtccgtcgacaacctctgcgtcaacagcattcgcttcctggcgatcgacgcgatcaacaagtccaactcggggcaccccggcctgccgatgggcgcggcaccgatggcgtatgccctgtgggacaagcacctgcaccacaacccggccaaccccaagtggttcaaccgcgaccgcttcgtgctctcggccggccatggctgcatgctcctctatgcgctgctgcacctgagcggctacgacagcgtttcaatcgaggacatcaagcagttccgtcagtggggctccaagacccccggccaccccgaaaccttcgaaacccccggggttgaagtcaccacggggccccttggccagggcatctccaatgccgttggtctggcgatcgccgaggcccatctggccgcgaaattcaaccgaccggacgtctcactcgtcgatcaccacacctacgtgatcatgggcgacggctgccaccaggaggggatctccggtgaggctgcgtccctggccgggcacctgggcctgggcaagctgatcgccctctacgacgacaaccacatcacgatcgacggcaacaccaaggtgtcgttcaccgaggatgtgctcaaacgctacgaggcctacggctggcacgtgcagcatgtggccgatggcaacacggacatcgacgcgatcgggagggcgattgaagcggccaaggccgtcaccgacaagcccagcctgatcaaggtcaccaccactatcggctacggctcacccaacaaggccgacaccgccggggtgcacggcgccgctctgggcgctgaggaagccgacctcacccgcaagtctctgggctggagctacggcccgttcgaagtgcccgaagaggcctacgaacagtggcgcaaggcccgcgaacgcggcgcggccttggaggctgagtgggacaacatcctcgccgcctaccgcagcgagtaccccgccgaagccgccgaattcgagcggatgctgcgcggtgaactgccccagggctgggacaggaatctgccccgcttcacccccgaggacaagggcctggccacccgccagtactcctacaacgtgctcaatgcgatcggccccgacctgcctgagctgatcggtggttccgccgacctcacccactccaacctcaccgacatcaaaggtgaaggcagcttccagaagggcagcgaggccaaccgctacctgcatttcggtgtgcgcgagcatgccatggcggcgattctcaacggtattgcttatcacgacagtggcctgatcccctacggtggcaccttcctggtgtttgccggctacatggtgggcgccatgcgcctctcggccctgagtgagctgggtgtgatctacgtgctcacccacgattcgatcggcctcggcgaagacggccccacccaccagccggtggaaaccctggcctcgctgcgctcgatccccaacttgctggtgatccgccctggcgatggcaacgaaaccagcggcgcttaccaggtggcagtgaccaaccgcaagcggcccacggtgctggccctcagccgccaggcgatggtgaaccagcccaactcagcgcctgagcatgtggccaagggcggttacatccttgaagacagcaacggcagccccgacctgattctgatcggctctggtacggaactcgatctctgcgtcaaagccgccaaggagttgcgcggccagggccacaatgtgcgcgtggtctcgatgccctgcgtggagctgttcgaggaacaggacgccagctatcgcgagtcggtgctgcctggcgcggtgcgcaagcgcctggtggtggaagcctccggctccttcggctggcacaagtacgtcggcctcgacggtgacaccgtctcgatcgaccgtttcggcgcctccgccccagggcccgtgtgcctggagaagttcggcttcaccgtggaaaacgtagtcgccaaggccaaggcgctctga

SEQ ID NO: 10175 - protein, 670 aa, Synechococcus sp. WH 5701
MVAAPTVDTLSVDNLCVNSIRFLAIDAINKSNSGHPGLPMGAAPMAYALWDKHLHHNPANPKWFNRDRFVLSAGHGCMLLYALLHLSGYDSVSIEDIKQFRQWGSKTPGHPETFETPGVEVTTGPLGQGISNAVGLAIAEAHLAAKFNRPDVSLVDHHTYVIMGDGCHQEGISGEAASLAGHLGLGKLIALYDDNHITIDGNTKVSFTEDVLKRYEAYGWHVQHVADGNTDIDAIGRAIEAAKAVTDKPSLIKVTTTIGYGSPNKADTAGVHGAALGAEEADLTRKSLGWSYGPFEVPEEAYEQWRKARERGAALEAEWDNILAAYRSEYPAEAAEFERMLRGELPQGWDRNLPRFTPEDKGLATRQYSYNVLNAIGPDLPELIGGSADLTHSNLTDIKGEGSFQKGSEANRYLHFGVREHAMAAILNGIAYHDSGLIPYGGTFLVFAGYMVGAMRLSALSELGVIYVLTHDSIGLGEDGPTHQPVETLASLRSIPNLLVIRPGDGNETSGAYQVAVTNRKRPTVLALSRQAMVNQPNSAPEHVAKGGYILEDSNGSPDLILIGSGTELDLCVKAAKELRGQGHNVRVVSMPCVELFEEQDASYRESVLPGAVRKRLVVEASGSFGWHKYVGLDGDTVSIDRFGASAPGPVCLEKFGFTVENVVAKAKAL

SEQ ID NO: 10176 - DNA, 2010 bp, Synechococcus sp. WH 7805
  CDS (1)..(2010): transl_table=11
atggtcgcagcgcccgcctctctcgacacgctctgcatcaacagcattcgtttccttgctgttgacgccgtcaacaaatccaagagcggccaccctggcctgcctatgggttgcgccccgatgggctacaccctctgggacaagttcctgaggcataaccccaagaacccgaagtggttcaaccgcgaccgctttgtcctctccgctggacacggctgcatgctgttgtactccttgctgcacctcacgggctacgactcggtgagcatcgaggacatcaagcagttccgtcagtggggatcgaaaactccgggacacccggaaacgtttgaaacccccggcgtggaagtaaccactggcccactcggtgccggcatctccaatgccgtgggtctggcgattgctgagtcccaccttgcggccaagttcaacaagcccgacgcccaggtggttgatcactacacctacgtgatcatgggcgacggctgcaatcaagaaggtgtggcctcggaagcctgttctctggccggccacctgaagctgggcaagctgatcgcgctctacgacgacaaccacatcaccatcgacggccgcacggacgtgtccttcaccgaggacgtgctcaagcgctatgaagcgtatggatggcacgtgcagcacgtggccgatggcaacaccgacgtggacgccatcgccaaagcgatcgaagccgccaaggccgtcaccgacaagccctcgatcatcaaggtgaccaccaccatcggctatggctcccccaacaagggagacaccgccggtgtgcacggtgctcccctgggtgaggaagaagccgagctcacccgcaaacagctgggttggagctatggccccttcgaagtacctcaggaggcctacgaccagtaccgccaggccatagagcgtggtgccagccaagaggctgagtggaatcaaaccctcgccgcttaccgcaaccagtacccagccgaagcggctgagtttgagcgcatgctccgcggtgaactgccccagggctgggacaaggagctccccacttacacccccgacgacaaaggactggccacccgcaagcactcccagatctgcctgggtgccctgggtcccaaccttcccgagctgatcggtggttccgctgacctcactcactccaactacaccgatatcaagggtgagaccggttcgtatcaaccggaaacccccgagaagcgttatctgcacttcggtgtgcgcgagcacgccatggccgctgtgctcaacggcattgcatatcacaacagcggcctgatcccctatggcggcaccttcctggtcttcgccgactacatgcgtggctccatgcgcctgtcggcgctgagcgagctgggtgtgatctacgtcctcacccacgactccatcggcgtcggcgaagacggccccacccaccagccgatcgaaaccatcccgtccctgcgggccatccccaacatgctggtgttccgccctggtgatggcaacgaaaccagcggagcctacaagctcgccatcgagaaccgtcatcgccccagtgctctctgcctcagccgccagggcatggccaaccaggccaactcttcgatcgacaaggtcgcccacggcggctacatccttgaagactgcgacggcacgcctgagctgatcctgatcggcaccggcacagagcttgacctctgcgtgcaggccgccaaacagctcagtgctgaaggcaagaaggtgcgcgttgtgtccatgccctgtgtggagctcttcgatgagcagagcgatgcctacaaagagcaagttctgcctactgcggtgcgcaagcgcatcgtggtggaagcagccgaagctttcggctggcaccgtttcatcggcctcgatggcgacagtgtcacgatgaatcgctttggtgcctccgctcctggaggcacctgcatggagaagttcggcttcacggttgagaacgtggtagccaaatccaaggcattgctgggctga

SEQ ID NO: 10177 - protein, 669 aa, Synechococcus sp. WH 7805
MVAAPASLDTLCINSIRFLAVDAVNKSKSGHPGLPMGCAPMGYTLWDKFLRHNPKNPKWFNRDRFVLSAGHGCMLLYSLLHLTGYDSVSIEDIKQFRQWGSKTPGHPETFETPGVEVTTGPLGAGISNAVGLAIAESHLAAKFNKPDAQVVDHYTYVIMGDGCNQEGVASEACSLAGHLKLGKLIALYDDNHITIDGRTDVSFTEDVLKRYEAYGWHVQHVADGNTDVDAIAKAIEAAKAVTDKPSIIKVTTTIGYGSPNKGDTAGVHGAPLGEEEAELTRKQLGWSYGPFEVPQEAYDQYRQAIERGASQEAEWNQTLAAYRNQYPAEAAEFERMLRGELPQGWDKELPTYTPDDKGLATRKHSQICLGALGPNLPELIGGSADLTHSNYTDIKGETGSYQPETPEKRYLHFGVREHAMAAVLNGIAYHNSGLIPYGGTFLVFADYMRGSMRLSALSELGVIYVLTHDSIGVGEDGPTHQPIETIPSLRAIPNMLVFRPGDGNETSGAYKLAIENRHRPSALCLSRQGMANQANSSIDKVAHGGYILEDCDGTPELILIGTGTELDLCVQAAKQLSAEGKKVRVVSMPCVELFDEQSDAYKEQVLPTAVRKRIVVEAAEAFGWHRFIGLDGDSVTMNRFGASAPGGTCMEKFGFTVENVVAKSKALLG

SEQ ID NO: 10178 - DNA, 1992 bp, Pseudoalteromonas tunicata D2
  CDS (1)..(1992): transl_table=11
atgccgtctcgcaaagaacttgctaatgcaattcgtgtcttatcaatggacgcagtacaaaaggccaactcaggccaccctggagcccctatgggcatggctgatatcgcagaagtattatggcgcgattatcttaaccacaatccaacaaatccagagtgggtagatagagatcgatttattctctctaacggccacggttcaatgctgatttattctcttttacatttaagtggttatgagctttcaattgacgatttaaagaatttccgtcaaatgcattcaaaaacccctgggcacccagaatatggttatgcaccaggtattgaaaccactacgggtccacttggtcaagggatcacaaatgctgtcggtatggcaattgctgaaaaagcgttagcggcacaatttaatcgtgatgagcatgatattgttaaccattatacttatacttttttaggtgatggttgcttaatggaagggatttcgcacgaagcctgttcattagccggtacattaggacttggcaaactagtcgcattttgggatgacaacggtatttcaattgacggtgaagttgaggggtggtttaccgacgatactcctgcacgctttgaagcctacggctggcatgtagtgcgtaatgtcgatggtcacgatagtgaagcggtgcgtgcagctattgatgaagcccgtgcgcaaacaaataagccgactttaatttgttgcaaaactattatcggttttggctcaccaaataaatcgggtagccatgattgtcatggtgcaccgttaggtgatgcagaaattgctgcagcccgtgagtttttaggttgggaacatggcccatttgaaattcctgccgatatttatgatgcatgggataacaaagccaaaggctctgatcttgaagcgagctggaactctaaatttgctgcctacaaagctgcatatccagaattagctgctgaatttgttcgtcgtaataacagcgaattaccagcagattgggctgaaaagtcacaagcatatattgaacaattacaagcgaatcctgccaatattgcatcacgtaaagcatcacaaaatgcacttgaagcatttggtccattattgcctgagtttatgggcggttcagctgatttagctggctcaaatttaactctttggtctggctctaaaggcctaacagctgaagatgcatcgggaaattacattttctacggtgtgcgcgagtttggtatgtcagccattatgaatggtattaccttacataaagggtttgtaccttatggtgctactttcttaatgtttatggaatatgcgcgtaatgctgtgcgtatggcggcattgatgaagcaacctgctatttttgtttatacccatgattcaattggtttaggtgaagatggtccaacacatcaacctgttgaacaaattgcgagcatgcgtttaacgccaaacttagataactggcgtccatgtgaccaagttgaatcagcagttgcatggaaagcggctattgagcgcaaagatggcccaacaacacttattttttcacgtcaaaatttagcgcagcaaacgcgttctgctgagcagttagccaatgttgctaaaggtggttatgtactgtcatgtgacggtaatccagaaatcattttaattgcaaccggttctgaagtgcaattagcgcaagattcagcagcagcacttcgcgcccaaggtaaaaaagtacgtgttgtttctatgccatcaactgatgtatttgaagcgcaagatgcggcttataaagagtctgtattacctaaggctgttagtcgtcgagttgcgattgaggcgggtattgctgattactggtacaaatatgttggtttaaatggtgccgtgattggtatgacgacgtttggtgaatcagcacctgcgggtgagttattccaacactttggtttcacagtagaaaacattgttgaaaaatcaatcgcacttttttaa

SEQ ID NO: 10179 - protein, 663 aa, Pseudoalteromonas tunicata D2
MPSRKELANAIRVLSMDAVQKANSGHPGAPMGMADIAEVLWRDYLNHNPTNPEWVDRDRFILSNGHGSMLIYSLLHLSGYELSIDDLKNFRQMHSKTPGHPEYGYAPGIETTTGPLGQGITNAVGMAIAEKALAAQFNRDEHDIVNHYTYTFLGDGCLMEGISHEACSLAGTLGLGKLVAFWDDNGISIDGEVEGWFTDDTPARFEAYGWHVVRNVDGHDSEAVRAAIDEARAQTNKPTLICCKTIIGFGSPNKSGSHDCHGAPLGDAEIAAAREFLGWEHGPFEIPADIYDAWDNKAKGSDLEASWNSKFAAYKAAYPELAAEFVRRNNSELPADWAEKSQAYIEQLQANPANIASRKASQNALEAFGPLLPEFMGGSADLAGSNLTLWSGSKGLTAEDASGNYIFYGVREFGMSAIMNGITLHKGFVPYGATFLMFMEYARNAVRMAALMKQPAIFVYTHDSIGLGEDGPTHQPVEQIASMRLTPNLDNWRPCDQVESAVAWKAAIERKDGPTTLIFSRQNLAQQTRSAEQLANVAKGGYVLSCDGNPEIILIATGSEVQLAQDSAAALRAQGKKVRVVSMPSTDVFEAQDAAYKESVLPKAVSRRVAIEAGIADYWYKYVGLNGAVIGMTTFGESAPAGELFQHFGFTVENIVEKSIALF

SEQ ID NO: 10180 - DNA, 1983 bp, Photobacterium sp. SKA34
  CDS (1)..(1983): transl_table=11
atgttagcgaatgcgattcgtgccctaagcatggatggcgtacaacaagcaaattctggtcaccctggcgcacctatgggtatggcagatatcgctgaagtactttggcgtggtcacatgaatcataacccacaaaatcctaagtgggctgatcgcgaccgttttgtattatcaaacggccacggttcaatgcttatctattcgctacttcaccttacaggttacgatctttctatcgatgagctgaagaatttccgtcaacttcattctaaaacacctggtcacccagaatacggctacgctccaggtattgaaacaaccacaggtcctctaggccaaggtattactaatgcggttggtatggcacttgctgaaaaagcaatggctgcacaatttaaccgtgaaggtcatgacgttgttgatcactacacatactctttccttggtgatggctgtctaatggaaggtgtttctcacgaagcatgttcattagcaggtacattaggtcttggtaaactgatcgcgttctgggatgacaacggtatttctatcgatggtcacgttgaaggttggttcactgataacacgcctgagcgttttgaatcttacggctggcatgtcattcctgctgttgatggtcatgatgcagcagcaattaatgcggcaattgaagcagctaaagctgaaacaggtaagccaactcttatttgttgtaaaacgatcattggttttggttctccaaacaaatctggctctcacgactgtcacggtgctccactaggcgctgatgaaattaaagcagcacgtgaattcctaggttggacttacggctcatttgaaattccagcagaaatttacgctgaatgggatgcgaaagaagcaggtaaagtgaaagaagctgcatgggatgaaaagtttgccgcgtatgctgctgcttaccctgaactcgctgctgaattcaaacgtcgtatgaacggtgagctaccagcaaactgggatcaagtgacatctgaaattattgcagatcttcaagcgaaccctgcaaatatcgcttctcgtaaagcatcacaaaacgcacttgaagcattcggtaaaattctacctgaattcatgggcggttcagcagaccttgcaccatcaaacctaaccatgtggtctggctctaagtcaatcacaccaacagatgcatctggtaactacattcactacggtgtacgtgagtttggtatgactgcgatgatcaatggtatggcactacacggtggtttcgttccttacggtgcaacattcctaatgtttatggaatatgcacgtaatgcaatgcgtatggctgcgctgatgaaaattcagaacattcaagtttacacgcacgattcaatcggtttaggtgaagatggtcctacgcaccaacctgtagagcagatcgcttctctacgtctaacaccaaacatgagtacatggcgtccatgtgaccaagttgaatcagcagtcgcttggaaatacgcaatcgagcgcaaagatggcccaacatcactgatattctctcgtcaaaacctaacacaacaagatcgtgacgctgcacaagtagctaacatcgctaggggtggttacatccttaaagactgtgaaggcaaacctgagctaatcttaattgcaaccggttcagaagtaggtattgcagcagaagcttacgcacaactaacaactgaaggtcgtaaggtacgtcttgtttctatgcctgcaacagatctgtttgacaagcaagatgcagcatatcgtgaaagcgtattaccttcagatgtaacagctcgtattgctattgaagcaggtattgcagatttctggtacaagtatgttggttttgatggtcgtattatcggtatgactacatttggtgagtcagcacctgctgatgagctctttaaaatgtttggctttacaacagataatattgttgaaacagcaaaagatttattagcataa

SEQ ID NO: 10181 - protein, 660 aa, Photobacterium sp. SKA34
MLANAIRALSMDGVQQANSGHPGAPMGMADIAEVLWRGHMNHNPQNPKWADRDRFVLSNGHGSMLIYSLLHLTGYDLSIDELKNFRQLHSKTPGHPEYGYAPGIETTTGPLGQGITNAVGMALAEKAMAAQFNREGHDVVDHYTYSFLGDGCLMEGVSHEACSLAGTLGLGKLIAFWDDNGISIDGHVEGWFTDNTPERFESYGWHVIPAVDGHDAAAINAAIEAAKAETGKPTLICCKTIIGFGSPNKSGSHDCHGAPLGADEIKAAREFLGWTYGSFEIPAEIYAEWDAKEAGKVKEAAWDEKFAAYAAAYPELAAEFKRRMNGELPANWDQVTSEIIADLQANPANIASRKASQNALEAFGKILPEFMGGSADLAPSNLTMWSGSKSITPTDASGNYIHYGVREFGMTAMINGMALHGGFVPYGATFLMFMEYARNAMRMAALMKIQNIQVYTHDSIGLGEDGPTHQPVEQIASLRLTPNMSTWRPCDQVESAVAWKYAIERKDGPTSLIFSRQNLTQQDRDAAQVANIARGGYILKDCEGKPELILIATGSEVGIAAEAYAQLTTEGRKVRLVSMPATDLFDKQDAAYRESVLPSDVTARIAIEAGIADFWYKYVGFDGRIIGMTTFGESAPADELFKMFGFTTDNIVETAKDLLA

SEQ ID NO: 10182 - DNA, 1995 bp, Oceanospirillum sp. MED92
  CDS (1)..(1995): transl_table=11
atgtcttctcgtagagaacttgccaacgcgattcgcgcgctgagcatggatgccgtacagaaagctaaatctggtcacccgggtgccccaatgggtatggcggatatcgctgaagtgctgtggaatgatttcatgcagcacaacccaactaacccgcagtggtttgatcgcgaccgtttcgtactgtccaatggtcatggctctatgctgatttacagcctgctgcacctgactggctacgatgtatcgatcgaagacctgaaaaacttccgtcagcttcactctaaaacagcaggtcaccctgaatacggttactgcccaggtgttgaaacgacaacaggccctctggggcagggtatcactaacgcagtaggttttgctgttgcagagaaaaccctggcggctcagttcaaccgcgaaggtcatgagatcgttgaccacaacacatatgtgttcatgggcgatggctgtctgatggaaggtatctctcacgaagcttgctccctggcaggtacgctgggtctgggcaaactgatcgcgttctgggatgacaatggcatctcgatcgacggtgaagttgaaggttggtacaccgacgataacgttaagcgtttcgaatcttacggttggcaggtgatcccaggtgttgatggtcacgatgctgatcagattcgcgcagcgattgaacaggcgaaagaaaacacagagcagccaacgctgatctgctgtaaaacaattatcggttttggttctcctaataaagaaggtaaggaagactgccacggtgcgccactgggtgatgatgaaatcgctctgacacgtgagcgtctgggctggactcatcctgcttttgaagttccttctgaaattgctgaagactggaatgcacaggaagcaggcattcacgctgaaaatgagtggaacgaacgtttcgctgcataccgtgcggaattccctgagctggcggatgagctacttcgtcgtatctctggtgaactgccagctgatttctctgaaaaagcagatgcttacatcgctgagattgcagagaaaggcgaaacaattgcgtcccgtaaagcgtctcagaatgcactgaatgcatacggccctatgctgcctgaactgctgggtggctctgctgacctggcgggttctaacctgacactgtggtctggctgtaaaggtgtagagaagaatgatgcatctggtaactacctgttctacggtgtacgtgaattcggtatgtccgcgatcatgaacggtatcgcactgcacggtggtttcatcccttacggtgcgaccttcctggtatttatggaatacgcgcgtaatgcggtacgtatggctgcactgatgaagcagcgtgcgatccatgtttacacgcacgattctatcggtctgggtgaagacggtccgactcaccagccagttgaacaggtggctaacctgcgtcacacaccaaacatgagcacttggcgtccatgtgacgcggttgaatccgcagttgcctggaaatcagcacttgaacgtgccgatggcccaacggcgatgatcttctctcgtcagggcctgccgcaccaggcgcgttctgaagagcaggtggctaacatcgctaagggtggttacatcctgcgtgatacagacggtcagccagatgcaattcttatcgctaccggttctgaagttggtctggcgatggatgcagctgaagcgctggctgctgacggcgtgaaagcacgcgttgtttctatgcctgaaaccggtctgtttgatcagcagtctgcggaataccgtgaatcggtactgccggcggcggttactgcacgtgttgcggttgaagccctgcaggctgacttctggtacaagtatgttggtttgaacggtgccatcgtaggtatgcgtaccttcggtgaatctgcgcctgcaggtgagctgttcaaacacttcggtttcactactgaaaacgtagttgaaacggttaaatctgttctgtaa

SEQ ID NO: 10183 - protein, 664 aa, Oceanospirillum sp. MED92
MSSRRELANAIRALSMDAVQKAKSGHPGAPMGMADIAEVLWNDFMQHNPTNPQWFDRDRFVLSNGHGSMLIYSLLHLTGYDVSIEDLKNFRQLHSKTAGHPEYGYCPGVETTTGPLGQGITNAVGFAVAEKTLAAQFNREGHEIVDHNTYVFMGDGCLMEGISHEACSLAGTLGLGKLIAFWDDNGISIDGEVEGWYTDDNVKRFESYGWQVIPGVDGHDADQIRAAIEQAKENTEQPTLICCKTIIGFGSPNKEGKEDCHGAPLGDDEIALTRERLGWTHPAFEVPSEIAEDWNAQEAGIHAENEWNERFAAYRAEFPELADELLRRISGELPADFSEKADAYIAEIAEKGETIASRKASQNALNAYGPMLPELLGGSADLAGSNLTLWSGCKGVEKNDASGNYLFYGVREFGMSAIMNGIALHGGFIPYGATFLVFMEYARNAVRMAALMKQRAIHVYTHDSIGLGEDGPTHQPVEQVANLRHTPNMSTWRPCDAVESAVAWKSALERADGPTAMIFSRQGLPHQARSEEQVANIAKGGYILRDTDGQPDAILIATGSEVGLAMDAAEALAADGVKARVVSMPETGLFDQQSAEYRESVLPAAVTARVAVEALQADFWYKYVGLNGAIVGMRTFGESAPAGELFKHFGFTTENVVETVKSVL

SEQ ID NO: 10184 - DNA, 2004 bp, delta proteobacterium MLMS-1
  CDS (1)..(2004): transl_table=11
atggccccgacccgtaaagatctcgccaacgccatccgtgccctgagcatggatgccatccagcaggccaactccgggcatcccggcgcccccctgggcatggctgatatcgcccaggtactgtggaacgattttttaaaacacaatcccgccaaccccagttggcccgatcgtgaccgttttgttttctccaacggccatggttcgatgctgctttactcggtactgcatctgaccggttaccagttgaccatcgaggatctcaaaaacttccgccagctccattccccaaccccgggtcatcccgaatatggctacacccccggggtggagaccacctccgggcccctgggacaggggattgccaacgcggtggggatggcgatcgccgaacgtaccctggccgcccagtttaaccaccccggtcatgcgatcatcgaccatcacacctacgtctttttaggcgatggctgcctgatggaagggatctcccatgaggcctgctcgctggccggcaccctggggcttaacaagctgatcgccatctacgatgacaacgggatttccatcgacggcgaggtggacggctggttcaccgaggatattcccgggcgctttgaggcttacggctggcgagtgatcccggcggtggacggccacgatccggaagcggtcaaacaggccattgagcaggcccgggccgaagagcagcgccccaccctgatctgctgtaaaaccatcatcggctgctgctcccccaacaagcagggcaaggagatctgccacggcgccccgctgggcgatgaggaaatcgaactgacccgtaaagagatgaactggccccatcccccctttgtgatccctgaagagatcgccgccgcctggaacgcccggcagcggggcgaccaggccgaagccgcctggcgggatcggctggccgcctaccggcagcaatttccggcccaagccgccgagctggagcgtcggctggccggtgaattgcccgccaactggccgcaacaggccaccgactttatcgccgccagcgaagagaaggcggccaaggtggccagccgcaaggcttcgcagttgaccctggagggctacgggccgctgttgccggagctgatcggcggttccgccgacctggccggctccaacctgaccatctggagcggcagccgggatatcaaacaacaggccgacggcaattatatctacttcggggtccgggagtttgccatggtcgccatcggcaacggcctggccctgcacggcggctttatcccctacaccgccaccttcctgatcttttccgattacgcccgcaacgccatccggatggcggccctgatgaaacagcgggccatcttcgtgctgacccacgactccatcggcctgggcgaggatggccccacccaccagcccatcgaacaggccgcctccctgcggctgatccccaacctccatgtctggcgaccctgcgacgcggtggagacggcggtggcctggaaggcgggcgtggagcgggttgacggcccctccgccctgctgctctcccgccagggactgccccaccagtcccggaccgcgcagcaaagcgctgatatcgcccgtggcggttatgtgctgctggactgccaggggcaaccggaaaccattttgctggccaccggttcggaggtggaactggccatggcagcagcccggcagctcaacgagcagggccgtaaaatacgggtggtctcgctgccctgcctggagctctttgcggcccaggacgaggcgtaccggcagcaggtattgcccgatagcgtggaacaccgggtagccatcgaagccggctgcaccgccggctggtacaagtatgtcggccgccggggccaggtgatcggcctggatcgtttcggcgagtcggccccggccgagcagctctttgagctctttggctttacggtggagaaggtggtggcggcggtggtaagcgttcaccagggccaatga

SEQ ID NO: 10185 - protein, 667 aa, delta proteobacterium MLMS-1
MAPTRKDLANAIRALSMDAIQQANSGHPGAPLGMADIAQVLWNDFLKHNPANPSWPDRDRFVFSNGHGSMLLYSVLHLTGYQLTIEDLKNFRQLHSPTPGHPEYGYTPGVETTSGPLGQGIANAVGMAIAERTLAAQFNHPGHAIIDHHTYVFLGDGCLMEGISHEACSLAGTLGLNKLIAIYDDNGISIDGEVDGWFTEDIPGRFEAYGWRVIPAVDGHDPEAVKQAIEQARAEEQRPTLICCKTIIGCCSPNKQGKEICHGAPLGDEEIELTRKEMNWPHPPFVIPEEIAAAWNARQRGDQAEAAWRDRLAAYRQQFPAQAAELERRLAGELPANWPQQATDFIAASEEKAAKVASRKASQLTLEGYGPLLPELIGGSADLAGSNLTIWSGSRDIKQQADGNYIYFGVREFAMVAIGNGLALHGGFIPYTATFLIFSDYARNAIRMAALMKQRAIFVLTHDSIGLGEDGPTHQPIEQAASLRLIPNLHVWRPCDAVETAVAWKAGVERVDGPSALLLSRQGLPHQSRTAQQSADIARGGYVLLDCQGQPETILLATGSEVELAMAAARQLNEQGRKIRVVSLPCLELFAAQDEAYRQQVLPDSVEHRVAIEAGCTAGWYKYVGRRGQVIGLDRFGESAPAEQLFELFGFTVEKVVAAVVSVHQGQ

SEQ ID NO: 10186 - DNA, 2004 bp, delta proteobacterium MLMS-1
  CDS (1)..(2004): transl_table=11
atggccccgacccgtaaagatctcgccaacgccatccgtgccctgagcatggatgccatccagcaggccaactccgggcatcccggcgcccccctgggcatggctgatatcgcccaggtactgtggaacgattttttaaaacacaatcccgccaaccccagttggcccgatcgtgaccgttttgttttctccaacggccatggttcgatgctgctttactcggtactgcatctgaccggttaccagttgaccatcgaggatctcaaaaacttccgccagctccattccccaaccccgggtcatcccgaatatggctacacccccggggtggagaccacctccgggcccctgggacaggggattgccaacgcggtggggatggcgatcgccgaacgtaccctggccgcccagtttaaccaccccggtcatgcgatcatcgaccatcacacctacgtctttttaggcgatggctgcctgatggaagggatctcccatgaggcctgctcgctggccggcaccctggggcttaacaagctgatcgccatctacgatgacaacgggatttccatcgacggcgaggtgggcggctggttcaccgaggatattcccgggcgctttgaggcttacggctggcgagtgatcccggcggtggacggccacgatccggaagcggtcaaacaggccattgagcaggcccgggccgaagagcagcgccccaccctgatctgctgtaaaaccatcatcggctgctgctcccccaacaagcagggcaaggagatctgccacggcgccccgctgggcgatgaggaaatcgaactgacccgtaaagagatgaactggccccatcccccctttgtgatccccgaagagatcgccgccgcctggaacgcccggcagcggggcaaccaggccgaagccgcctggcgggatcggctggccgcctaccggcagcaatttccggcccaagccgccgagctggagcgtcggctggccggtgagttgcccgccaactggccgcaacaggccaccgactttatcgccgccagcgaagagaaggcggccaaggtggccagccgcaaggcctcgcagttgaccctggagggctacgggccgctgctgccggagctgattggcgggtccgccgacctggccggctccaacctgaccatctggagcggcagccgggatatcaaacaacaggccgacggcaattatatctacttcggggtccgggagtttgccatggtcgccatcggcaacggcctggccctgcacggcggctttatcccctacaccgccaccttcctgatcttttccgattacgcccgcaacgccatccggatggcggccctgatgaaacagcgggccatcttcgtgctgacccacgactccatcggcctgggcgaggatggccccacccaccagcccatcgaacaggccgcttccctgcggctgatccccaacctccatgtctggcgaccctgcgacgcggtggagacggcggtggcctggaaggcgggcgtggagcgggttgacggcccctccgccctgctgctctcccgccagggactgccccaccagtcccggaccgcacaacaaagcgctgatatcgcccgtggcggttatgtgctgctggactgccaggggcaaccggagaccattttgctggccaccggttcggaggtggaactggccatggcagcagcccggcagctcaacgagcagggccgtaaaatacgggtggtctcgctgccctgcctggagctctttgcggcccaggacgaggcataccggcagcaggtattgcccgatagcgtggaacaccgggtagccatcgaagccggctgcaccgccggctggtacaagtatgtcggccgccggggccaggtgatcggcctggatcgtttcggcgagtcggccccggccgagcagctctttgagctctttggctttacggtggagaaggtggtggcggcggtggtaagcgttcaccagggccaatga

SEQ ID NO: 10187 - protein, 667 aa, delta proteobacterium MLMS-1
MAPTRKDLANAIRALSMDAIQQANSGHPGAPLGMADIAQVLWNDFLKHNPANPSWPDRDRFVFSNGHGSMLLYSVLHLTGYQLTIEDLKNFRQLHSPTPGHPEYGYTPGVETTSGPLGQGIANAVGMAIAERTLAAQFNHPGHAIIDHHTYVFLGDGCLMEGISHEACSLAGTLGLNKLIAIYDDNGISIDGEVGGWFTEDIPGRFEAYGWRVIPAVDGHDPEAVKQAIEQARAEEQRPTLICCKTIIGCCSPNKQGKEICHGAPLGDEEIELTRKEMNWPHPPFVIPEEIAAAWNARQRGNQAEAAWRDRLAAYRQQFPAQAAELERRLAGELPANWPQQATDFIAASEEKAAKVASRKASQLTLEGYGPLLPELIGGSADLAGSNLTIWSGSRDIKQQADGNYIYFGVREFAMVAIGNGLALHGGFIPYTATFLIFSDYARNAIRMAALMKQRAIFVLTHDSIGLGEDGPTHQPIEQAASLRLIPNLHVWRPCDAVETAVAWKAGVERVDGPSALLLSRQGLPHQSRTAQQSADIARGGYVLLDCQGQPETILLATGSEVELAMAAARQLNEQGRKIRVVSLPCLELFAAQDEAYRQQVLPDSVEHRVAIEAGCTAGWYKYVGRRGQVIGLDRFGESAPAEQLFELFGFTVEKVVAAVVSVHQGQ

SEQ ID NO: 10188 - DNA, 1992 bp, Oceanobacter sp. RED65
  CDS (1)..(1992): transl_table=11
atgacagatcgtcgccacctcgccaatgctattcgtgctttgagtatggatgccgttcaaaaggccaaatcaggtcaccccggagcacccatgggtatggcggacatcgcagaagttctgtggaacgaccacctaaagcataatccgagcaacccagattgggcggatcgtgaccgctttgttttatccaatggtcacggctccatgctgatttactctttgcttcatctaaccggttacgaccttagcttggatgagttgaaaaacttccgtcaaatgcactccaaaacaccgggtcacccagaatacggttacgctccaggcatcgaaaccaccactggcccactaggtcaaggtattgccaatggtgtgggtatggcgcttgcggaaaaagtactggcagcgcagttcaataaaccaggtcatgaaatcgttgatcacaacacttatgtgttcttaggcgatggctgcatgatggaaggcattagtcacgaggcttgttcactggcgggcaccttgggtctaggtaagctggtggctttctatgacgacaacggtatttctatcgatggtgaagtagaaggctggttcacagacgataccgttaagcgttttgaatcctatggttggcacgtgattcctgcggtagacggtcacgatagcgcagccatcgaagcggcgattcaagcggccaaagcagaaagcgataagccaacactgatctgctgtaagactatcattggttttggttctcctaacaaagaaggtaaagaagattgccacggtgcaccgctaggtgacgatgaaattgtggcaaccaaagagcgtcttggctggaaatacggttcgtttgaagtaccgcaagacgtatatgacgcttgggatgctaagggcaccggcgcaagcgcagagcaagcgtggaatgaaaaatttgatgcataccaagctgcttaccctgagttggcggcggagtttaaacgccgtatggccggtgatttgccagctgactttgaagcgcaagcggatgcctatatcgctgcatgccaagagaaaggcgaagatgtggcttcgcgtaaagcatcgcaaaataccattaaagaatttgcacctaagctgccagagattctaggcggttctgcagaccttgcgggttctaacctaaccctatggccagaagccaaaggtgttgaagcgaaagacgctaacggtaactacatctattacggtgtacgtgagtttggcatgagcgccattatgaacggcattgcattgcacaaaggtttcgtaacctatggcgcaacattcttgatgttcatggaatacgcgcgcaacgctgtgcgcatggccgctttgatgaagcagcgtgccattcacgtttatactcacgactctattggtctgggtgaagacggcccgacgcaccaaccggttgagcagttaacggcgcttcgcagcacacctaatctcaatacttggcgtccatgtgacaccgtagaaacggcagtagcgtggaagtctgcggttatgcgtgacaatggtcctactgcgttgatttattctcgccaaggcttaccgcaccaagaccgcatgcctgcacaagtggatgccattgcgaaaggtgcctatgtattgaaagacagtgccgatgccaaagcgattttgatcgccaccggttccgaagtgggtcttgctatggaagcggccgaacagttggaggccaaaggcacagcagtacgtgtcgtttcaatgccatgtgctgaagtcttcatgcagcaagatgcggattacattgaatccgtattgccttctgctattacggctcgtgtcgcggtagaagcggcacacaaagattactggtacaagtttgttggcctaaaaggcgcggttgtgggcatggaaacctttggtgagtctgccccaattaaagacttgatgcagcattttggtttcactgctgagaatgtagtggcaaccgttgaaagtgttttgtag

SEQ ID NO: 10189 - protein, 663 aa, Oceanobacter sp. RED65
MTDRRHLANAIRALSMDAVQKAKSGHPGAPMGMADIAEVLWNDHLKHNPSNPDWADRDRFVLSNGHGSMLIYSLLHLTGYDLSLDELKNFRQMHSKTPGHPEYGYAPGIETTTGPLGQGIANGVGMALAEKVLAAQFNKPGHEIVDHNTYVFLGDGCMMEGISHEACSLAGTLGLGKLVAFYDDNGISIDGEVEGWFTDDTVKRFESYGWHVIPAVDGHDSAAIEAAIQAAKAESDKPTLICCKTIIGFGSPNKEGKEDCHGAPLGDDEIVATKERLGWKYGSFEVPQDVYDAWDAKGTGASAEQAWNEKFDAYQAAYPELAAEFKRRMAGDLPADFEAQADAYIAACQEKGEDVASRKASQNTIKEFAPKLPEILGGSADLAGSNLTLWPEAKGVEAKDANGNYIYYGVREFGMSAIMNGIALHKGFVTYGATFLMFMEYARNAVRMAALMKQRAIHVYTHDSIGLGEDGPTHQPVEQLTALRSTPNLNTWRPCDTVETAVAWKSAVMRDNGPTALIYSRQGLPHQDRMPAQVDAIAKGAYVLKDSADAKAILIATGSEVGLAMEAAEQLEAKGTAVRVVSMPCAEVFMQQDADYIESVLPSAITARVAVEAAHKDYWYKFVGLKGAVVGMETFGESAPIKDLMQHFGFTAENVVATVESVL

SEQ ID NO: 10190 - DNA, 2010 bp, Synechococcus sp. RS9916
  CDS (1)..(2010): transl_table=11
atggtcgccgcgcccgcatccatcgacacgctctgcgtcaacagcatccgcatgctggccgttgacgccatcaacaagtccaagagcggccaccccggcctcccgatgggctgcgcacccatgggctacgcgctgtgggacaagttcctgaagcacaaccccaagaaccccaagtggttcaaccgtgaccgcttcgtgctgtcggccggccatggctgcatgctgctgtacgcactgctccacctcaccgggtacgactcggtgaccatcgacgacatcaagaccttccgccagtggggctccaaggcacccggtcaccccgaaacctttgagacacctggtgtcgaagtgactaccggccctctcggcgctggcatctccaacgccgttggtctggctatcgctgaagcccacctggccgccaagttcaacaagcccgacgccaacctcgtcgaccactacacgtatgtggtgatgggtgacggctgcaaccaagaaggtgtgtcgtcggaagctgcctccctcgctggtcacctgaagctgggcaagctgatcgccctctacgacgacaacaacatcaccattgatgggcgcaccgacgtctcctttaccgaggacgttctcaagcgctacgaggcctatggctggcatgttcagcacgtggccgatggcaacactgatgtagatgccatcgccaaggcgattgaggccgccaaggctgtcaccgacaagccttcgatcatcaaggtgaccaccaccatcggctacggctcccccaacaagagcgacaccgccggtgtgcacggtgctcctctgggtgatgacgaaaccgctctgacccgtcagcagctcaactggaactacggccccttcgaggtgccccaggaggcctacgaccagttccgccaagccatcgagcgcggcgccagcctcgaggccgagtggaaccagaccctggccacctaccgcacgcagtaccccgctgaagcagcactgttcgagcgcatgctgcgcggcgaactgcctgagggctgggacaaggatctccccacctacacccctgaagatggcggcttagccactcgtaagcactcccagatctgtctgggtgctctgggccccaacctgcccgaactgattggcggctccgctgacctcacccactccaactacaccgacatcaagggcgagaccggttccttccaggccgacagccccgacaagcgctatctgcacttcggtgtgcgcgagcacgccatggccgcgatcctcaacggcatcgcgtaccacaacagcggtctgatcccctacggcggcacgttcctggtcttcgccgattacatgcgcggctccatgcgcctctcggcgctgagcgaactgggcgtgatctacgtgctcacccacgactccatcggcgtgggcgaagacggccccacccaccagccgatcgagaccatcccctccctacgggcgatgcccaacatgctggtgttccgcccgggcgacggcaacgaaaccagcggttcctacaagctggcgattgagaaccgcaaacgccccagcgctctgtgcctcagccgtcagggaatggtcaaccaggccaactcctcgatcgagaaagtggccttcggcggctacatcctcgaagactgcgagggcacccctgagctgatcctgatcggtaccggcaccgaactcgacctctgcgtccaggctgccaagcagctgagcgctgaaggcaagaaagtgcgcgtggtgtccatgccctgtgtggagctgttcgacgagcaaagcgacgcctacaaggagcaggtgctcccctccgccgtgcgcaagcgcatcgtggtggaagcagcagaagccttcggttggcaccgtttcatcggcctcgatggcgacagcgtgaccatgaaccgctttggtgcttccgcccccggcggcgtctgcatggagaagtttggcttcactgtcgacaacgtggtggccaagtccaaggcactgctgggctga

SEQ ID NO: 10191 - protein, 669 aa, Synechococcus sp. RS9916
MVAAPASIDTLCVNSIRMLAVDAINKSKSGHPGLPMGCAPMGYALWDKFLKHNPKNPKWFNRDRFVLSAGHGCMLLYALLHLTGYDSVTIDDIKTFRQWGSKAPGHPETFETPGVEVTTGPLGAGISNAVGLAIAEAHLAAKFNKPDANLVDHYTYVVMGDGCNQEGVSSEAASLAGHLKLGKLIALYDDNNITIDGRTDVSFTEDVLKRYEAYGWHVQHVADGNTDVDAIAKAIEAAKAVTDKPSIIKVTTTIGYGSPNKSDTAGVHGAPLGDDETALTRQQLNWNYGPFEVPQEAYDQFRQAIERGASLEAEWNQTLATYRTQYPAEAALFERMLRGELPEGWDKDLPTYTPEDGGLATRKHSQICLGALGPNLPELIGGSADLTHSNYTDIKGETGSFQADSPDKRYLHFGVREHAMAAILNGIAYHNSGLIPYGGTFLVFADYMRGSMRLSALSELGVIYVLTHDSIGVGEDGPTHQPIETIPSLRAMPNMLVFRPGDGNETSGSYKLAIENRKRPSALCLSRQGMVNQANSSIEKVAFGGYILEDCEGTPELILIGTGTELDLCVQAAKQLSAEGKKVRVVSMPCVELFDEQSDAYKEQVLPSAVRKRIVVEAAEAFGWHRFIGLDGDSVTMNRFGASAPGGVCMEKFGFTVDNVVAKSKALLG

SEQ ID NO: 10192 - DNA, 2013 bp, Vibrio sp. Ex25
  CDS (1)..(2013): transl_table=11
atgtactcaggagcagacatgtcgtctcgtaaacatcttgccaatgcaattcgtgctctaagcatggatggtgttcaacaagctaactcaggccacccaggcgcaccaatgggtatggctgatatcgctgaagttctttggcgctctcacctaaaccacaacccatcaaacccagagtgggccgaccgcgaccgcttcgtgctatcaaacggtcacggctcaatgcttatttactctctactgcacttaagcggttatgagctatctattgacgatctgaaaaacttccgtcaattgcactcaaaaaccccaggtcacccagagtacggttacgcgcctggtatcgagacaacaacgggtcctcttggccaaggcatcactaatgctgttggtatggctatcgcagagaaagcactagcggcacagttcaacaaagaaggccacgacatcgttgaccactttacgtatgtgttcatgggtgacggctgtctaatggaaggcatctcgcacgaagcatgctctctagcaggtacgctaggtctaggcaaactgatcgcgttttgggatgacaacggtatctctatcgacggtcacgttgaaggttggttctctgacgatacacctaagcgtttcgaagcttacggctggcacgtaatcccagcggtagacggtcacgatcctgaagcaatcaacgcagcgattgaagcggctaaagcggatcctcgcccgactctaatctgtactaaaacaattatcggtttcggttctcctaacaagtctggctcgcacgactgtcacggtgcgccattaggtcacgatgagattcaagcggctcgcgaatacctaggttgggagtacggtccatttgaaatccctgcagatgtttacgctgagtgggacgcaaaagaagcaggtgcagcgaaagaagcggcttggaatgaaaagttcgaagcatacgcagcagcttaccctgcagaagcagcagagcttaaacgtcgtctaaacggcgaacttccagcggaatgggaagaaaaagcgaaccaaatcattgctgatcttcaagcaaacccagcgaacattgcatcacgtaaagcatcgcaaaatgcactagaagcgtttggtcaaatgcttcctgagtttatgggtggttctgctgacctagcgccttctaacctgaccatgtggtctggttctaagtctctagaaacggatgacttctctggcaactacatccactacggtgtacgtgaattcggtatgaccgctatcatcaacggtatcgcattgcacggtggtttcgttccctacggtgcgacattcctaatgttcatggaatacgctcgtaacgcaatgcgtatggctgcgctgatgaaaattcagaatatccaagtgtacacgcacgattcgatcggtcttggcgaagatggcccaactcaccaacctgttgagcaaatggcatctctacgcgtaacgccaaacatgagcacatggcgtccatgtgaccaggttgagtctgccgtagcatggaaactagcgattgaacgtaaagatgcaccaacagcacttatcttctctcgtcaaaacttagcgcaacaagatcgtacagctgagcaagtagcgaacatcgcgaaaggtgcttacatcctgaaagattgtgaaggcaagccagagcttatccttatcgcaacaggctctgaagttgagctagcagtagaagctgcgactcaactaacagcagaaggtaagaaagtgcgcgtggtttcaatgccatcaacagatgcattcgacaaacaagacgccgcttaccgtgaagcagtattgccatcagacgtaacggcacgcatcgctatcgaagcgggcatcgcagacttctggtacaagtacgttggtttcgacggtcgcatcatcggcatgacgacatttggtgaatctgcacctgctggtcaactattcgagatgtttggcttcacgactgaaaacgtagtgaacacagcaaaagaattgctagcgtaa

SEQ ID NO: 10193 - protein, 670 aa, Vibrio sp. Ex25
MYSGADMSSRKHLANAIRALSMDGVQQANSGHPGAPMGMADIAEVLWRSHLNHNPSNPEWADRDRFVLSNGHGSMLIYSLLHLSGYELSIDDLKNFRQLHSKTPGHPEYGYAPGIETTTGPLGQGITNAVGMAIAEKALAAQFNKEGHDIVDHFTYVFMGDGCLMEGISHEACSLAGTLGLGKLIAFWDDNGISIDGHVEGWFSDDTPKRFEAYGWHVIPAVDGHDPEAINAAIEAAKADPRPTLICTKTIIGFGSPNKSGSHDCHGAPLGHDEIQAAREYLGWEYGPFEIPADVYAEWDAKEAGAAKEAAWNEKFEAYAAAYPAEAAELKRRLNGELPAEWEEKANQIIADLQANPANIASRKASQNALEAFGQMLPEFMGGSADLAPSNLTMWSGSKSLETDDFSGNYIHYGVREFGMTAIINGIALHGGFVPYGATFLMFMEYARNAMRMAALMKIQNIQVYTHDSIGLGEDGPTHQPVEQMASLRVTPNMSTWRPCDQVESAVAWKLAIERKDAPTALIFSRQNLAQQDRTAEQVANIAKGAYILKDCEGKPELILIATGSEVELAVEAATQLTAEGKKVRVVSMPSTDAFDKQDAAYREAVLPSDVTARIAIEAGIADFWYKYVGFDGRIIGMTTFGESAPAGQLFEMFGFTTENVVNTAKELLA

SEQ ID NO: 10194 - DNA, 1992 bp, Vibrio sp. Ex25
  CDS (1)..(1992): transl_table=11
atggatcgtaaatatctagcaaatgcaattcgtgcgctaagcatggatggtgttcaacaagctaactctggtcacccaggtgcacctatgggcatggctgatatcgctgaagttctttggcgctctcacctaaaccacaacccatcaaaccctgagtgggcagaccgcgaccgtttcgtactgtctaacggccacggctcaatgctaatttactctctactgcacttgagcggttacgagctatctatcgatgatctgaaaaacttccgtcagcttcactctaagactcctggtcacccagagtacggctacgcgccaggtatcgagaccacaacgggtcctctaggtcaaggcatcactaatgcggttggtatggctctagctgagaaagcgctagcagcacagttcaacaaagaaggccacgacatcgttgaccacttcacttacgtgttcatgggcgacggctgtctaatggaaggtatctcgcacgaggcatgttctctagcaggtacgctaggcctaggcaaactgatcgcattctgggatgacaacggcatttctatcgacggtcacgttgaaggttggttctctgacgacacgcctaagcgttttgaagcgtacggctggcacgtaatcccggcagtagatggtcacgattctgaagcgatcaacgcagcaatcgaagcggcgaaagcggatccacgtcctacacttatctgtactaagacaatcatcggttttggttcaccaaacaaatctggttcacacgattgtcacggtgcgccactaggtgcagaagaaatcgcagcaacacgcaaagaactaggttgggagcacggtccttttgaaattccgcaagaagtctacgcagaatggtcagcgaaagaaacaggcgcagctaaggaagcagcgtggaacgagaaatttgcagcttatgaagcagcgtaccctgagctggcagctgaatttaaacgccgcgtaaacggtgagcttcctgcacagtgggaagagaaagcaagccaaatcattgccgatcttcaagcaaacccagcaaacattgcatcacgtaaagcatctcaaaacgctctagaagcatttggtactctactacctgagttcatgggcggctctgctgacctagcgccttctaacctaaccatgtggtctggttctaagtctctagaagcaagtgacttctctggtaactacatccactacggtgtacgtgaattcggtatgacggcgatcatgaacggtattgcgctacacggtggtttcgttccttacggtgcaaccttcctaatgttcatggagtacgcacgtaacgcaatgcgtatggcggctctgatgaagattcagaacatccaagtgtacacgcacgattctatcggtcttggcgaagatggcccaactcaccaaccggttgagcaaatggcatcgctacgtctaacgccaaacatgagcacatggcgtccatgtgaccaagttgaatcagcagtggcttggaaactagcgattgaacgtaaagatgcaccaactgcgcttatcttctctcgtcagaacctagcgcaacaagagcgtgatacggagcaattagcaaacatcgcgaaaggtggttacatcctgaaagattgcgaaggcaagccagagctaatccttatcgcaacaggttctgaagttgaactagcagtagaagcagcagcacagctaactgctgaaggtaagaaagtacgcgttgtttcaatgccatcaacagatgcatttgacaagcaagacgccgcttaccgtgaagccgttctaccatcagacgtaacagctcgtatcgctatcgaagcaggtatcgctgacttctggtacaagtacgtaggcttcgacggtcgcatcatcggtatgacttcattcggtgaatctgcacctgctggtgaactgttcaaaatgttcggtttcactacggaaaacgtagtaaatacagcaaaagaactactagcgtaa

SEQ ID NO: 10195 - protein, 663 aa, Vibrio sp. Ex25
MDRKYLANAIRALSMDGVQQANSGHPGAPMGMADIAEVLWRSHLNHNPSNPEWADRDRFVLSNGHGSMLIYSLLHLSGYELSIDDLKNFRQLHSKTPGHPEYGYAPGIETTTGPLGQGITNAVGMALAEKALAAQFNKEGHDIVDHFTYVFMGDGCLMEGISHEACSLAGTLGLGKLIAFWDDNGISIDGHVEGWFSDDTPKRFEAYGWHVIPAVDGHDSEAINAAIEAAKADPRPTLICTKTIIGFGSPNKSGSHDCHGAPLGAEEIAATRKELGWEHGPFEIPQEVYAEWSAKETGAAKEAAWNEKFAAYEAAYPELAAEFKRRVNGELPAQWEEKASQIIADLQANPANIASRKASQNALEAFGTLLPEFMGGSADLAPSNLTMWSGSKSLEASDFSGNYIHYGVREFGMTAIMNGIALHGGFVPYGATFLMFMEYARNAMRMAALMKIQNIQVYTHDSIGLGEDGPTHQPVEQMASLRLTPNMSTWRPCDQVESAVAWKLAIERKDAPTALIFSRQNLAQQERDTEQLANIAKGGYILKDCEGKPELILIATGSEVELAVEAAAQLTAEGKKVRVVSMPSTDAFDKQDAAYREAVLPSDVTARIAIEAGIADFWYKYVGFDGRIIGMTSFGESAPAGELFKMFGFTTENVVNTAKELLA

SEQ ID NO: 10196 - DNA, 1992 bp, Alteromonadales bacterium TW-7
  CDS (1)..(1992): transl_table=11
atgccatctcgcaaagaacttgcaaatgctattcgcgtcttgtcaatggacgcagtacaaaaggccaaatctggtcaccctggagcccctatgggcatggctgatatcgcagaagtattatggcgcgattatctaaaacataatccatcaaatccagagtgggcagaccgagatcgatttatactgtcaaacggccacggttcaatgcttatctattctttattgcacttaagtggttatgatttaccgttggacgaaattaaaaacttccgtcaaatgcactctaaaacaccaggccacccagaatacggttatgcgccaggtatcgagaccactacgggcccactaggccaagggatcacaaatgcggtaggcatggcaattgctgaaaaagcgcttgcggcacaatttaaccgtgaaggtcacgacattgttgatcaccatacctatgcattcatgggcgacggttgtttaatggaaggcatttcgcatgaagcctgttcgcttgccggtacattaggcctaggcaagctggttgctttttgggatgacaacggcatttctattgatggtgaagttgaaggctggtttagcgatgacacaccagcacgttttaaagcgtacggctggcacgtaattagtgacgttgatggccacgatagcgatgcagtaagtgctgcaattagcgaagcaaaaagcgtgactgataaaccaacactaatttgttgtaaaacaattattggttacggttcacctaataaatcgggtagccacgactgtcacggtgcaccacttggcgatgacgaaattaaagcatcgcgtgagtttttaggttggacgggcgatgcctttgaaatccctgaagacatttacgcacagtgggatggaaaagctaaaggccaagagcttgaatcaagctgggacgaaaagtttgcagcctatgcaaaagcattcccagagcttgcagctgagtacaaacgccgtacaaattcagatttacctgccgattgggctgaaaagtcacaagcgtatattgagcaattacaagcaaacccggcaaatccagcatctcgtaaagcgtcacaaaatgcattaaatgcatttggtccattattaccagaatttatgggtggctctgccgatttagcaggttcaaacttaacaatttgggaaggctctaaaggcctaacagcggatgatgcaagtggtaactacgtttactacggtgtgcgtgagtttggtatgtcggcaattatgaacggtattgcacttcataaaggctttattccttacggtgcaacgttcttaatgtttatggaatatgcacgcaacgcggttcgtatggctgcattaatgaagcaaccaagcatttttgtatacacgcacgattcaattggtttaggtgaagatggtccaactcaccaaccagtagagcaaattgccagcatgcgtttaacgcctaacctttataactggcgcccgtgtgaccaagttgagtcagcaattgcatggcaacaagctattgaacgtaaagacggtcctacatcgttaatattcacacgccaaggtcttgagcaacaggcgcgtgacgcacaacagttaagcgacgtcaaaaagggtggttacatccttagctgtgacggcaacccagagctaattattattgcaaccggttctgaggtgcaattagcacaagattcagctactgaattacgcagccaaggtaaaaaggtacgtgttgtatctatgccatgtactgatgcatttgaagatcaatcgcctgagtacaaagaaagcgtattaccagcaagcgtttctcgtcgcgtagcgattgaagcaggtattgctgattattggtacaagtatgtaggcctaaatggtgctgtagtcggtatgaccacttttggtgagtctgcaccagctaacgagttgtttgagcactttggctttacggttgaaaacatcgtaaacaaagcaaacgcacttttttaa

SEQ ID NO: 10197 - protein, 663 aa, Alteromonadales bacterium TW-7
MPSRKELANAIRVLSMDAVQKAKSGHPGAPMGMADIAEVLWRDYLKHNPSNPEWADRDRFILSNGHGSMLIYSLLHLSGYDLPLDEIKNFRQMHSKTPGHPEYGYAPGIETTTGPLGQGITNAVGMAIAEKALAAQFNREGHDIVDHHTYAFMGDGCLMEGISHEACSLAGTLGLGKLVAFWDDNGISIDGEVEGWFSDDTPARFKAYGWHVISDVDGHDSDAVSAAISEAKSVTDKPTLICCKTIIGYGSPNKSGSHDCHGAPLGDDEIKASREFLGWTGDAFEIPEDIYAQWDGKAKGQELESSWDEKFAAYAKAFPELAAEYKRRTNSDLPADWAEKSQAYIEQLQANPANPASRKASQNALNAFGPLLPEFMGGSADLAGSNLTIWEGSKGLTADDASGNYVYYGVREFGMSAIMNGIALHKGFIPYGATFLMFMEYARNAVRMAALMKQPSIFVYTHDSIGLGEDGPTHQPVEQIASMRLTPNLYNWRPCDQVESAIAWQQAIERKDGPTSLIFTRQGLEQQARDAQQLSDVKKGGYILSCDGNPELIIIATGSEVQLAQDSATELRSQGKKVRVVSMPCTDAFEDQSPEYKESVLPASVSRRVAIEAGIADYWYKYVGLNGAVVGMTTFGESAPANELFEHFGFTVENIVNKANALF

SEQ ID NO: 10198 - DNA, 2013 bp, marine gamma proteobacterium HTCC2143
  CDS (1)..(2013): transl_table=11
atgccatctcgtagcgaattagccagcgcaatacgcgctctcagtatggatgccgtgcagcaggccaatagtggccatccaggagctccaatggggatggccgatattgccgaagtcctctggaacgattatcttaagcacaatccggccaatcccaactgggcggacagagaccgttttgtgctgtccaatggccatggctcgatgttgatatactcgctactgcatctgagtggttatgaccttcccatagaagagttgaagaactttcgccagctgcattcaaaaacgccggggcatccggaatacggttatgcccccggcgtagaaaccacaacggggccgttggggcagggactcaccaatgcagtcggtatggctgccgctgagaaaatactggctgctcagttcaatagagacgggcatgctattgtcgaccaccatacctatacctttcttggtgatggttgcttaatggagggggtttctcacgaggcaagctcgttggcaggaacattgggactgggcaagctcatttgtttttacgatgacaatgggatttctatcgacggcgaagtcgaaggttggtttaccgatgatacgccaaagcgttttgaagcctatggatggcaagttattcctgcagtcgatggtcatgacagcgcggctattgcggcggctatagaagaaggtcgggcagataccagcagaccgacgctaatttgttgtaaaacaatcattggtaagggttcacccaacaagcaagggacagaagattgccatggcgcagcgttgggattagacgaagtggccttagtccgtgaaacgatcggttggcagcatcccccattttttatccccagtgatatttatgcgggctggagtgcccgcgataaaggtgcaaattcagaaagtgagtggaatcagcgctttgacagctatgcgcaggcacatcctgatctggctatcgaattggctcgtcggctgactggagagttgcctgacaattttgccgagcagtgtgatgagtatattcgccaattgcaggagcaaggtgccagcatagcttcccgcaaggcttcacagaattgtctggagcaatatgccccgatgcttcctgaattactgggtgggtcagcggatttggcagggtcaaacttgacgctatggagtggttcgaaaggcgttagtgcagacgacgcctcgggcaattacttgttctacggtgtccgtgaattcggtatgtcggcgatgatgaacggtatcgcattacacggtggctttgttccctacggcgcaaccttcctgatgtttatggaatacgcgcgaaatgctgtgcgtatggcagcactgatgcggctgcgcacggtctttgtctatacccacgattctattggtttgggtgaagatggtccaacgcatcagccggtagagcagctgacttcgctgcgtgcaacgcctaatctggatacttggcgtccctgtgataccgtcgagtcggccgtgtgttggaaggctgctctgcagcgtaccgaaggccctgcggcccttattttctcgcgccagagcctggcgcatcagcagcgcgatgaacagcaactggccgatatagctcgcggaggttacattcttagcgattgcgaagcgaccaacggcgaaaaggatccagatgcgatcattatagctaccggatctgaagttcagctcgctatggatgctaaggctgttttggagcaacaagggcgtcgtatccgtgtcgtctccatgccttctacctctgtatttgatgcccaggatgtggcgtatagagaatcggtattacccagtaatgtgttgccgcgcgttgccgtagaggcaggtcataaggacttttggtacaaatatgtaggtttggacggtcgtatcgtcggcatggaaactttcggtgaatccgcgccaataaaagagctcatggaacactttggttttaccgttgatgccgttgttgaagcggtagaagatgcgctaggttga

SEQ ID NO: 10199 - protein, 670 aa, marine gamma proteobacterium HTCC2143
MPSRSELASAIRALSMDAVQQANSGHPGAPMGMADIAEVLWNDYLKHNPANPNWADRDRFVLSNGHGSMLIYSLLHLSGYDLPIEELKNFRQLHSKTPGHPEYGYAPGVETTTGPLGQGLTNAVGMAAAEKILAAQFNRDGHAIVDHHTYTFLGDGCLMEGVSHEASSLAGTLGLGKLICFYDDNGISIDGEVEGWFTDDTPKRFEAYGWQVIPAVDGHDSAAIAAAIEEGRADTSRPTLICCKTIIGKGSPNKQGTEDCHGAALGLDEVALVRETIGWQHPPFFIPSDIYAGWSARDKGANSESEWNQRFDSYAQAHPDLAIELARRLTGELPDNFAEQCDEYIRQLQEQGASIASRKASQNCLEQYAPMLPELLGGSADLAGSNLTLWSGSKGVSADDASGNYLFYGVREFGMSAMMNGIALHGGFVPYGATFLMFMEYARNAVRMAALMRLRTVFVYTHDSIGLGEDGPTHQPVEQLTSLRATPNLDTWRPCDTVESAVCWKAALQRTEGPAALIFSRQSLAHQQRDEQQLADIARGGYILSDCEATNGEKDPDAIIIATGSEVQLAMDAKAVLEQQGRRIRVVSMPSTSVFDAQDVAYRESVLPSNVLPRVAVEAGHKDFWYKYVGLDGRIVGMETFGESAPIKELMEHFGFTVDAVVEAVEDALG

SEQ ID NO: 10200 - DNA, 2001 bp, marine gamma proteobacterium HTCC2080
  CDS (1)..(2001): transl_table=11
atgacgtcacgcttgcaactcgccaatgccatcagggcgttaagtatggatgccgtgcaagcggccaatagcggacaccccggtgcccctatgggtatggcggacatcgcggaagtcctctggaacggctatctgaaacacaaccccaacaatccggactggcccgatcgtgaccgctttgtactctctaatggtcatggctcaatgttgctctacagcttgctccatctctcggggtacgaccttactattgaagatttaaaaaatttccggcaatttcatgctaagacagcggggcacccggaatacggttatgcccccggcgtcgaaaccacgacggggcctctaggtcagggattagccaacgccgttggtatggcgcttgccgaaaaaacccttgccgctcaatttaatacagaaaaacatacgctaattgaccaccgaacctgggccttccttggggatggctgccttatggaaggcatctcccacgaagcttgctcccttgcaggaacgcttgggctgggcaagcttgtcgccttttatgacgataacggtatttccatcgacggcgaagtgaccggctggttcaccgacgatacaaccaagcgcttcgaaagctatggctggcaggtcattccaaatgtcgacgggcacgatcatgccagtatcagcgctgcgatcgatctcgcacttcaggacggagaaaaaccaactctcatctgctgtcgcaccattattggtaaaggtgcgcccaacaagcagggtaccgagtcatgccacggggcgcctttgggtgcggatgagattgccgctacgcgggctgcactgggctgggagcacgggccttttgaaattccggaagccgtctatgagggctgggacgccaaagcacgaggggccgagcaagagcaagactggcattcgagatttgccgacttttcaaaggcggcaccccagcaagccgaagaactcgaacggaggctggaaggtactcttcctgatacgtttgaggcgcaaatggacgattacattacccagtgtgccgaggccggtacagacatggcctcacgaaaagcctcgcaacaaaccctcaacacactcgggccattgctacccgagatgctgggtggctcagcagatcttgcgggctctaacttaaccctgtggcagggctccaaaggcgtcactgcgaccgacgcctcaggtaattacgtttactacggcgtccgagaatttgcgatgtctgccatgatgaacggtgtcgcattgcataagggtttcatcccttacggcgccacgttcctcatcttcatggaatacgctagaaatgcggtgcgaatggctgcactcatgcgtcaacgggtgatctttgtgtacacccatgactcaataggtctcggtgaagatgggcccacccatcaacctgttgaacaactcacagcgcttcgcagtacacccaatctcgagacctggcgcccctgcgatacggtagagtccgctgttgcgtggaaaatggcggtaatgcgcgacgctgggccagccgcgctcatcttttcacgtcagacattaccccaccaagaccgtgcagaagagggcgttaaagcaatagagcgcggtggttacaccttaatttcagagacgggagaactcgatgccatcattatcgcgaccggatctgaggtgggtctcgcagtagccgccgctcaaaccttggccgagaacggtcggggtattcgagtcgtgtcgatgccctgtgccgaacgtttcatggcccaagaggtcacctatcgtgaatccatattgcccagtgacgtactggcgcgggttgcggtggaagctgctcatgcagactattggtacaaattcgtcggcctcgatggtcgagttgtcggcatgcaaagcttcggtgagtctgcacccggcggggagctgatggcgcatttcggctttactgtcgaaaacgtggtggctgcggtagaagacgtatttctcgactaa

SEQ ID NO: 10201 - protein, 666 aa, marine gamma proteobacterium HTCC2080
MTSRLQLANAIRALSMDAVQAANSGHPGAPMGMADIAEVLWNGYLKHNPNNPDWPDRDRFVLSNGHGSMLLYSLLHLSGYDLTIEDLKNFRQFHAKTAGHPEYGYAPGVETTTGPLGQGLANAVGMALAEKTLAAQFNTEKHTLIDHRTWAFLGDGCLMEGISHEACSLAGTLGLGKLVAFYDDNGISIDGEVTGWFTDDTTKRFESYGWQVIPNVDGHDHASISAAIDLALQDGEKPTLICCRTIIGKGAPNKQGTESCHGAPLGADEIAATRAALGWEHGPFEIPEAVYEGWDAKARGAEQEQDWHSRFADFSKAAPQQAEELERRLEGTLPDTFEAQMDDYITQCAEAGTDMASRKASQQTLNTLGPLLPEMLGGSADLAGSNLTLWQGSKGVTATDASGNYVYYGVREFAMSAMMNGVALHKGFIPYGATFLIFMEYARNAVRMAALMRQRVIFVYTHDSIGLGEDGPTHQPVEQLTALRSTPNLETWRPCDTVESAVAWKMAVMRDAGPAALIFSRQTLPHQDRAEEGVKAIERGGYTLISETGELDAIIIATGSEVGLAVAAAQTLAENGRGIRVVSMPCAERFMAQEVTYRESILPSDVLARVAVEAAHADYWYKFVGLDGRVVGMQSFGESAPGGELMAHFGFTVENVVAAVEDVFLD

SEQ ID NO: 10202 - DNA, 2007 bp, Marinobacter sp. ELB17
  CDS (1)..(2007): transl_table=11
atgttgatgccctctcgtaaagatctcgccaacgccattcgcgcgctgagcatggatgcggttcagaaagccaaatccggccatccgggtgcgcccatgggcatggctgatatcgccgagttgctgtggaatgattacctgagccacaatcctgccaacccgcagtgggccaatcgcgaccgttttatactgtctaacggccacggttccatgttgcagtactccttactgcacctgagcggttacgacgtttccattgatgacatcaaaaacttccgccaactgcactccaaaaccccgggccacccggaatacggctataccccgggtgttgaaaccaccaccgggcctttggggcagggtttggcaaacgccgtgggttttgccctggctgagaaaaccctggcggcgcagttcaaccgcccgggccacgacattgttgaccactacacctatacctttgtaggcgatggctgcctgatggaaggcctctcccacgaagtgtcgtcgctggccggcacgctggggctgggcaagctgatctgcttctacgacgacaacggcatctctattgacggcaaagtagacggctggttcaccgacaacaccccgcagcgctttgaagcttacggctggcaggtaattgccgacgtagacggccacaacgccgacgccctgagtgcggccattgaagtggcccgcgccaacaccgagcagcccacgctgatttgctgcaaaaccgtgattggctttggctcgcccaacaagcagggcagcgaatcggcccacggcgcaccgctgggcgaagacgaaatcgttctgacccgcgaagcactgggctggaaacacggcgcctttgaagtgccggacgacatttacgcccagtggaacggaaaagaaaaaggccagaccgccgaaagcgcctggaacgacaccttcgccgcgtatcagaaagccgagccggaactggccgcagagttcaaacgccgcatggccggtgatctgcccgccgacttctctggaaaagcccaggcttacattcagagcgttcaggacaaaggtgaaaccatcgccagccgcaaggcgtcccagaacagcttgaacacctatggcccgatgctgccggaactgttgggcggctctgccgacctggccggttccaacctgaccatctggagtggctgtaacaccgtcaccaaagaagatgccagcggcaactacatcaattacggcgtgcgcgagttcggcatggccgccatcatgaatggcctggccctgcacggcggattcgtaccctacggcgccaccttcctgatctttatggaatactgccgcaacgcggtacgcatggccgcactgatgaagcagcgcgccatctacgtgttcacccacgattccatcggcctgggtgaagacggccccacgcaccagcccgttgaacagctcgccagcctgcgcaccacgcccaacatgagcacttggcgcccggccgacgccgtagaatccgccgttgcctggaaagccgcgcttgagcgcaccgacggccccactgcgttggtattcagccgccagaacctgccccaccaaaaccgttcggcgcagcaacttgccgacgttgcccgcggtgcctatgtgttgtcagacagcgaaggcacgccagagctgattctgattgcaacaggttccgaagttggcttggcgcaagacgtagccgccaagctacgcgagcagggcaaggccgttcgcgtggtgtctatgccgtcgaccgacaccttcgatgcgcaaagtgccgactacaaacagcaggtattgccgctggacgtcaccaaccgcatcgcggtggaagcctccattgccgattactggttcaagtacgtcggcctggacggtcgcattgtgggcatgaccacctttggcgaatcggcacccgcgggcgaactgttcaaggaattcggctttaccgtcgataacgtcctggacgtagccgccgagctattggaagcctga

SEQ ID NO: 10203 - protein, 668 aa, Marinobacter sp. ELB17
MLMPSRKDLANAIRALSMDAVQKAKSGHPGAPMGMADIAELLWNDYLSHNPANPQWANRDRFILSNGHGSMLQYSLLHLSGYDVSIDDIKNFRQLHSKTPGHPEYGYTPGVETTTGPLGQGLANAVGFALAEKTLAAQFNRPGHDIVDHYTYTFVGDGCLMEGLSHEVSSLAGTLGLGKLICFYDDNGISIDGKVDGWFTDNTPQRFEAYGWQVIADVDGHNADALSAAIEVARANTEQPTLICCKTVIGFGSPNKQGSESAHGAPLGEDEIVLTREALGWKHGAFEVPDDIYAQWNGKEKGQTAESAWNDTFAAYQKAEPELAAEFKRRMAGDLPADFSGKAQAYIQSVQDKGETIASRKASQNSLNTYGPMLPELLGGSADLAGSNLTIWSGCNTVTKEDASGNYINYGVREFGMAAIMNGLALHGGFVPYGATFLIFMEYCRNAVRMAALMKQRAIYVFTHDSIGLGEDGPTHQPVEQLASLRTTPNMSTWRPADAVESAVAWKAALERTDGPTALVFSRQNLPHQNRSAQQLADVARGAYVLSDSEGTPELILIATGSEVGLAQDVAAKLREQGKAVRVVSMPSTDTFDAQSADYKQQVLPLDVTNRIAVEASIADYWFKYVGLDGRIVGMTTFGESAPAGELFKEFGFTVDNVLDVAAELLEA

SEQ ID NO: 10204 - DNA, 2007 bp, Bacillus sp. SG-1
  CDS (1)..(2007): transl_table=11
atgtttgataaaactgatcaattagccattaatacaattaggacgctttcaattgatgcgattgaaaaagcgaattctggacatccgggtatgcctatgggtgctgcaccgatggcatatgcgttatggtccaaaatcatgaatcataaccctagaaaccctgaatgggcaaacagggacagatttgttctttcagctggacatggatctatgctcctgtacagcttgctgcacctttcaggttatgatgtttcaatggacgatttgaaacagttcagacagtggggaagcaagactccagggcaccctgaatatggacatactcctggcgttgaagcaactactggacctcttggccaaggcttcgcaatgtctgttggtatggccatggctgaacgtcacctggcatctgtttacaatcgtgacaactacaacatagttgatcattatacatatagcatctgtggtgacggagacttaatggaaggtatttcttctgaagcagcttccctggcagcacatcttaagctgggccgcttgatcgttatgtatgattctaatgacatctctttagatggtgatttggacaggtccttctctgaaaatgtaaaaggtcgttttgaatcatatggctggcagtacatccgtgtcgaagatggaaatgatactgaagctattgctaaagcactcgaagaggcaaagagtgatgagaatcatccaacactgatcgaaatcaaaacggttatcggttacggtgctcctaataaatcaggtaagtctgatgttcacggcgccccgcttggtgtagaagaaatgaaaatgacaaaagaagcgtacaaatggaccttcgaacaagatttccatgttccttccgaagtccaagaccgcttcaaagaacacatcgttgatacgggtgagaaaaaagaacaggaatggaatgagctattttctcagtataaagaaaaatatccagaacttgcagcgcaatttgaatctgcaatgaaaggtgaacttcctgaaggatgggataaagacatccctgtctatgaagagggaagcagccttgccagccgtgcttcttccggagaagtgatgaacgcagttgccaaaaatatgccttcattgattggtggttctgcagatcttgccggttccaacaaaacaatgataaaagggcagaaggattttacacctgaatcttatgaaggccgaaacatctggttcggtgttcgtgaatttgggatgggtgcagctatgaacggtatggccctgcatggaggaataaaagtatttggaggaacattctttgtattctctgattatttaagaccggcaatccgcttggctgcccttatgggacttccagtaacatatgtattcacacacgacagtatcgctgttggtgaagatggtcctacacatgagccggttgaacagcttgcgtcattaagagcgatgccgaatctttctgtcattcgtcctgcagatggaaatgaaactgccgcagcatggaaaactgctttgacttctaaagataaaccgacagcgcttgtattgaccagacaaaatcttcctactttaaaaggtacagatgccaaggctcaaacaggtgtggaaaaaggtgcttatgttgtttctcctgctgggaaagaacagcctgatgcacttctgcttgcatcaggttctgaagtaagtcttgctgtggaagctcaggcagtacttgcaaaagacggtctcgctgtttcagtcatcagcatgccgtcatgggatcgatttgagcagcagtctaaagaatataaggaatcaatcattccaaaagcggttaaaaaacgccttgccattgaagtggcttctccacttggctgggaccgttatgcgggagatgaaggggacattcttgccattgatggttttggtgcttccgctcctggtgaaaagatcatggaagagtacggtttcactgtagaaaatgttgtttctcgtgtgaaagcgctgcttgaaagataa

SEQ ID NO: 10205 - protein, 668 aa, Bacillus sp. SG-1
MFDKTDQLAINTIRTLSIDAIEKANSGHPGMPMGAAPMAYALWSKIMNHNPRNPEWANRDRFVLSAGHGSMLLYSLLHLSGYDVSMDDLKQFRQWGSKTPGHPEYGHTPGVEATTGPLGQGFAMSVGMAMAERHLASVYNRDNYNIVDHYTYSICGDGDLMEGISSEAASLAAHLKLGRLIVMYDSNDISLDGDLDRSFSENVKGRFESYGWQYIRVEDGNDTEAIAKALEEAKSDENHPTLIEIKTVIGYGAPNKSGKSDVHGAPLGVEEMKMTKEAYKWTFEQDFHVPSEVQDRFKEHIVDTGEKKEQEWNELFSQYKEKYPELAAQFESAMKGELPEGWDKDIPVYEEGSSLASRASSGEVMNAVAKNMPSLIGGSADLAGSNKTMIKGQKDFTPESYEGRNIWFGVREFGMGAAMNGMALHGGIKVFGGTFFVFSDYLRPAIRLAALMGLPVTYVFTHDSIAVGEDGPTHEPVEQLASLRAMPNLSVIRPADGNETAAAWKTALTSKDKPTALVLTRQNLPTLKGTDAKAQTGVEKGAYVVSPAGKEQPDALLLASGSEVSLAVEAQAVLAKDGLAVSVISMPSWDRFEQQSKEYKESIIPKAVKKRLAIEVASPLGWDRYAGDEGDILAIDGFGASAPGEKIMEEYGFTVENVVSRVKALLER

SEQ ID NO: 10206 - DNA, 1980 bp, Erythrobacter sp. SD-21
  CDS (1)..(1980): transl_table=11
atgagtctcgacacgccgcgcatggtcccgatggccaatgcaatcagggccctttcgatggacgcggtgcaggcggcgaattcgggtcaccccggcatgccgatgggcatggccgacgtcgccaccgtgctgtggaccgaatacctcaagcacgatgctgccgcccccgactgggctgatcgcgaccgtttcgtgctgtcggcaggtcacggctcgatgctgatctacagcctgctccacctttccggttacgcccatccgacgatggaagacatccgcaatttccgccagctcgaatccccttgcgccggccatccggaaaacttccttctcgacggtgtggaatgcaccaccggcccgctgggtcagggccttgcgatggcggtcggcctggcgattgcggagcgcaagctgaacgccgacttcggtgacgccatcgtcgaccacaagacctgggtcatcgccggcgacggctgcctgatggaaggcatcaatcacgaggccatcggccttgccgggcatctgaagctcggccggatgaacgtgctgtgggatgacaaccagatcaccatcgatgggtcgaccgacctttcgaccagcgaagacatcaaggctcgctatgaagcgaccggctggcacgtcaccagctgcgacggccacgacttcgacgacatccgccgcgcgctcgacgaagcgcaggccgatgaacgtccttcgctgattgcctgccgtacggtcatcggcaaaggcgcgcccaacaagcagggcaccagcgccacgcatggcgcgccgctcggcgacgaggaaatttccgctgcgcgcgacgtgctgggctgggattacaagcccttcgaaattcccgagcaggtgcttagcgactggcggggcacggcggacgccggggcgaaggcacattcgcaatggacggaccgcctctcaggtcacgaccagaaggccgacttcgaacgccgcatgtcgggcgatctcccagccaagttcagcctcgacaactacatccagtcgctgatgaaggacccggtcaaggtcgccacccgcaaggcgagcgaaatggcgctggagcagatcaacgccatgctgcccgacaccttgggcggaagcgctgatctcacaggctcgaacaataccaaggctggcgggatcggcccgttcacggcggacgattactcgggccgctatatctattacggtatccgcgaattcggcatggccgccgcgatgaacggtatggcgctgcacggcggcgttatcccttacggcggcaccttcctcgtgtttaccgactactgccgcgccgcgatccgtctttcggccctccagcagacgcgcgccatctacgtgatgacgcatgacagcatcggtctcggcgaagacggacccacccaccagccggtcgagcatgtgcagagcctgcgcatgatcccgaacctgctggtaatgcgccccgccgacgcggtcgagaccgccgagtgctgggacatcgcgctacgcagcaaggaccgcccgacggttctcgcgctgacccgccagggcctcccacaggtgcgcaaccatcccgaagagatcgatatgtgtttgaagggggcctaccgcctcaaggaggccggcaacgcgcacaaggtcacgctcatcgccagcggctccgaagtacacctcgctctggcttgtgccgaggaactggaaaagcagggtgtcggcgccagcgtcgtctcgatggtctgcacccagctcttcgacgagcaggacgaggcgtaccgcaaggacctgatcccggcatcgagcctgctcgtcagcatcgaggcgggcaccactttcggctgggaacgctacaccggcgagaatggcctcaatatcggtctggaccgcttcggcgccagtgcgccggcacccgacctcttcaagaaattcggtttcactgcggacgccatcgtgccgcaaatcatgaacaaattaaacggttaa

SEQ ID NO: 10207 - protein, 659 aa, Erythrobacter sp. SD-21
MSLDTPRMVPMANAIRALSMDAVQAANSGHPGMPMGMADVATVLWTEYLKHDAAAPDWADRDRFVLSAGHGSMLIYSLLHLSGYAHPTMEDIRNFRQLESPCAGHPENFLLDGVECTTGPLGQGLAMAVGLAIAERKLNADFGDAIVDHKTWVIAGDGCLMEGINHEAIGLAGHLKLGRMNVLWDDNQITIDGSTDLSTSEDIKARYEATGWHVTSCDGHDFDDIRRALDEAQADERPSLIACRTVIGKGAPNKQGTSATHGAPLGDEEISAARDVLGWDYKPFEIPEQVLSDWRGTADAGAKAHSQWTDRLSGHDQKADFERRMSGDLPAKFSLDNYIQSLMKDPVKVATRKASEMALEQINAMLPDTLGGSADLTGSNNTKAGGIGPFTADDYSGRYIYYGIREFGMAAAMNGMALHGGVIPYGGTFLVFTDYCRAAIRLSALQQTRAIYVMTHDSIGLGEDGPTHQPVEHVQSLRMIPNLLVMRPADAVETAECWDIALRSKDRPTVLALTRQGLPQVRNHPEEIDMCLKGAYRLKEAGNAHKVTLIASGSEVHLALACAEELEKQGVGASVVSMVCTQLFDEQDEAYRKDLIPASSLLVSIEAGTTFGWERYTGENGLNIGLDRFGASAPAPDLFKKFGFTADAIVPQIMNKLNG

SEQ ID NO: 10208 - DNA, 2007 bp, Rickettsiella grylli
  CDS (1)..(2007): transl_table=11
atggcttaccaaaaaaaatatgcggatgcgcttcggttcttaacattagatgccgtagaaaaagccaattcaggtcatcctggcatgccaatgggaatggcggacatcgcaaccgttttatggaacgattttttagtgcataaccctaataatcccaattggagcaatcgcgatcgttttatcttatcaaacggccatggatcgatgttgcattatgcgttacttcatttaacagggtatgatctttctttgcatgaaatgaagcgatttcgccaacttcattctaaaacgcccggtcatcctgaagttggcttaactcccggcatagaaacaacaacaggtccgctcggccaaggatttgcaaatgccgtcggcatggcattagccgaaaaaaacttggctgctcattttaatcagccctctcatctcattatcgatcattttacgtatgtatttctaggggatggctgtttaatggagggtatttcccatgaagccgcttccttagcgggatgtttaggtttaggtaaattaattgctttttgggacaataattctatttctattgatggtcacgtttcaggttggtttaaagataatacaccggaacgttttaaggcctatcattggcacgttatttctgatattgatggtcatgatccccaacaaattaaaacagccattgaaaaagcgcgtgatattacggataaaccgagcctactttgctgtaaaacacaaattgcatggggcgctccccatttcgttggaagccatcgttcacatggtgccgcattaggagaaaaagaagttgccgctacgcgaatagcgctccaatggaattatcctccttttgaaataccccaagaaatttaccacgcttgggatgcgcgttccaaaggggcggctttagaaaaaacgtgggaagaaaaatggaatcgttatcaatcaaaatttcccgaactcgcaaacgaatatcaacgtagagttgataaaaaaatccctaagaattggaacttagaaaccaaaaaattgatagaaaaaatttttaaagatccgccccaaaaaatagcaacgcgcaaagcttctcaaaatacactgaatgcttttgctcctcttttacctgaattactcgggggatcggctgatctcaccgaatcaaattcaaccttttggaagggcgctcaggttttatcgaaagaaaatcctgctggtaattacatccattatggtgtacgtgaattcgggatgtctgccatgatgaatggcattgcactgcatgggggatttatcccttatggcggaacttttctcgtttttagtgattatgcacgtaatgctattcgtttgtctgctttaatgaaacaaaaggttatttttgtttatacacacgattcgattggattaggagaagatggtccaacacatcaacctatcgaacacctgaatagtttacgtcttattcctcaactttctgtttggcgaccttgtgatgcgttagaaaccgctatcgcctggcaacaggcaatacaacatgaaggaccaacttgtttagtattgactcgacaatcggtacaggcacaatcacacaatcttgaaacgttacagtcgattcatcgaggcgcttatattcttcttgacagtccatctctacccgaagcgattatcatcgccacgggctctgaagtaagtttagccataaacgctgcacaaacgttaaatcaaaacggtagacatattagagtcgtatcgataccctgtgctgatcgttttgaacaacaagacgctgcttataaagcgaaaattttaccgaattccatcactttacgcgtcgctatcgaagcagggaatccagatttttggtaccgttatgtaggccttaagggaaaaatcattggacttcatcaatttggtgaatctgcacccggatcagatgtttttaaacattttggctttacgacagaaaacataattaaaacacttaaccaattattagctgatgaagcttaa

SEQ ID NO: 10209 - protein, 668 aa, Rickettsiella grylli
MAYQKKYADALRFLTLDAVEKANSGHPGMPMGMADIATVLWNDFLVHNPNNPNWSNRDRFILSNGHGSMLHYALLHLTGYDLSLHEMKRFRQLHSKTPGHPEVGLTPGIETTTGPLGQGFANAVGMALAEKNLAAHFNQPSHLIIDHFTYVFLGDGCLMEGISHEAASLAGCLGLGKLIAFWDNNSISIDGHVSGWFKDNTPERFKAYHWHVISDIDGHDPQQIKTAIEKARDITDKPSLLCCKTQIAWGAPHFVGSHRSHGAALGEKEVAATRIALQWNYPPFEIPQEIYHAWDARSKGAALEKTWEEKWNRYQSKFPELANEYQRRVDKKIPKNWNLETKKLIEKIFKDPPQKIATRKASQNTLNAFAPLLPELLGGSADLTESNSTFWKGAQVLSKENPAGNYIHYGVREFGMSAMMNGIALHGGFIPYGGTFLVFSDYARNAIRLSALMKQKVIFVYTHDSIGLGEDGPTHQPIEHLNSLRLIPQLSVWRPCDALETAIAWQQAIQHEGPTCLVLTRQSVQAQSHNLETLQSIHRGAYILLDSPSLPEAIIIATGSEVSLAINAAQTLNQNGRHIRVVSIPCADRFEQQDAAYKAKILPNSITLRVAIEAGNPDFWYRYVGLKGKIIGLHQFGESAPGSDVFKHFGFTTENIIKTLNQLLADEA

SEQ ID NO: 10210 - DNA, 2022 bp, Sulfobacillus acidophilus
  CDS (1)..(2022): transl_table=11
atggcaatcaacaatccgtctgccgaactcgaccaacgtatgattaatacgctgcgcacgctggccatcgatgcggtggaacaagccaattcgggacatcccggaatgcccatgggagccgccccaatggcgcatgtgttgtggacccggtttcttcgacataaccccaaaaatcctcgctgggtcaatcgtgaccgctttatcctgtccgccggtcacggttcgatgttgctctatgcccttttatatctcacgggctatgacattagcctggatgacttaaaacggtttcgccaatgggggtcgaaggccgccggccatccggaatacggctggaccccgggagtggaaaccaccaccggcccgttaggccagggatttgccaccggcgtggggatggccattgccgaacgccatttggctgcccgctataaccagccgggctttcccctcattgatcactatacgtacgccatcgtcagtgacggcgacttaatggaaggcatcgcctcagaagccgcgtccttggccggccatctcaaactgggcaaactgatttatctctacgataacaaccatatttccattgaaggcactaccgacgtggcgttcaccgaaaatgtgggagcccgctttaaagcttatggctggcatgtactcacggtagatgacgggaacgacattcaagccatccacgaagcgatcgtcagtgcacgctcgacccctgaccagcccagcttgataatggtccgaacccatatcggctatggtagtcctaacaaacaagacaccccggatgcgcatggagcccctctcggtaaagaagaagcccgtttagccaaacaagcttatggctggccggaagatcagccgttttgggttcccacggaagtactgagtcaataccgtacccaggaatctctaggaccgttatgggagcggcaatggcaaacgctatggcgagagtatcaacagaagtttccggaactggcccggtctttgcgatcgatatgggaagccgatagtccgagctggcccgatgtgcccccctttccgtccggacaagaaatggccacgcgtaccgcgtccggccgcgtgattaacctcattgccgaccaacgcccccattttatcggcgggtcggccgatttgggcccatccaacgaaacccgcatcaaaaacgggggcgattttaccccggacactcccgacggcagaaatcttcacttcggggtgcgggaacatgcgatgggagccctcttgaacgggatttccttacatggggagttccgggtcttcggcggcacctttctcattttttcggattacatgttgcccgccatgcggctcgccgccctcatgcatcaaccggtcacctatgttttgactcacgactcgattggcgtcggggaagacggaccgacccaccaacccattgagcaagtgacccatttgcgggcaatccccaatttagtcttgattcggcccgcagacgccaacgaaacgcgagaagcctggcgcctagcgttcaccagtcaatcccgcccggtggcattggccctgacccgccaaaaagttccggtgctggacgccgatcgaacgaccggcgttgcccaaggggcctatattctcgaggacgcctcgacaggtcgaccccgatgcattctgttggctagcggctcggaagtgcacttggctcttgccgcacgacaaaccttagaagccaaagggattcccacccgcgtggtcagtatgccgtcttgggcactctttgaagaacaatcggatgaatatcgtcagagggtcattcctccggacgtgccggcgcgcatcgcgattgaagcggcttctccgctgggctgggaccgctatgtaggcccccaaggccagattttggccatgcgccgatttggtgcctccgcccccggtcccgaactctaccgtcagtttgggtttaccccggaaaatatcgtggcaatcgccgaatcgttggtcgccagtctcgatctggatcgagtataa

SEQ ID NO: 10211 - protein, 673 aa, Sulfobacillus acidophilus
MAINNPSAELDQRMINTLRTLAIDAVEQANSGHPGMPMGAAPMAHVLWTRFLRHNPKNPRWVNRDRFILSAGHGSMLLYALLYLTGYDISLDDLKRFRQWGSKAAGHPEYGWTPGVETTTGPLGQGFATGVGMAIAERHLAARYNQPGFPLIDHYTYAIVSDGDLMEGIASEAASLAGHLKLGKLIYLYDNNHISIEGTTDVAFTENVGARFKAYGWHVLTVDDGNDIQAIHEAIVSARSTPDQPSLIMVRTHIGYGSPNKQDTPDAHGAPLGKEEARLAKQAYGWPEDQPFWVPTEVLSQYRTQESLGPLWERQWQTLWREYQQKFPELARSLRSIWEADSPSWPDVPPFPSGQEMATRTASGRVINLIADQRPHFIGGSADLGPSNETRIKNGGDFTPDTPDGRNLHFGVREHAMGALLNGISLHGEFRVFGGTFLIFSDYMLPAMRLAALMHQPVTYVLTHDSIGVGEDGPTHQPIEQVTHLRAIPNLVLIRPADANETREAWRLAFTSQSRPVALALTRQKVPVLDADRTTGVAQGAYILEDASTGRPRCILLASGSEVHLALAARQTLEAKGIPTRVVSMPSWALFEEQSDEYRQRVIPPDVPARIAIEAASPLGWDRYVGPQGQILAMRRFGASAPGPELYRQFGFTPENIVAIAESLVASLDLDRV

SEQ ID NO: 10212 - DNA, 2145 bp, Oryza sativa subsp
  CDS (1)..(2145)
atggcgacagcgacgcaagctcccacctcgcccgccgccgcgtccgggcgtggctccgttctccccctcctccgtggccgcccctccacccgcgtccgcctcgccgttggccggcgaccgcagaccgccctccgcgcgcagccgccgggggcggcggaggtggtggagcagtcggtgaacaccatccggttcctcgccgtggactccgtggagaaggccaagtccggccacccgggactccccatggggtgcgcgccgctgggccacgtcctattcgacgagttcctccggttcaaccccaagaacccctactggttcgaccgcgaccgcttcatcctctccgccggccatggatgcatgctccagtacgcactgcttcacctcgccggatacgacagcgtcacgatggatgatctgaaagctttccggcagtggggaagcataactcctggtcacccagaaaacttcgaaacacctggtgttgaagtcactactggtcctctggggcagggttttgcaaatgctgttggcctagcgcttgctgagaaacatctagctgcccgtttcaataagcctgatttgaaaatcgtggatcatcacacgtatgttatacttggggatggctgccaaatggaaggtgtgtcaaatgaggcatcctcccttgctggtcactggggtctcgggaaactaattgccttctacgatgacaatcatatatcaattgatggtagcacaggcatttctttcactgaagatgcacttgcccgatatgaggcactaggttggcatactatctgggtgaaaaatggtaacacagggtatgatgacatccgtgctgcaattaaggaagcaaaggcagtcaaagacaagccaactcttatcaaggtgactactactattggttatggatccccaaacaaagcaaacacttatagtgttcatggtagcgctctaggtaccaaagaagtagaggcaaccaaaaacaatctttcttggcatcatgaacctttccatgttcctgatgaggtgaaaaggcactggagtcaccatattgatgagggtgcttctctggaagctgaatggaataaaaaaattgttgaatatgaaaagaaatatcgccaggaggctgctgagttaaagagcataatttcaggagaactgccttccgggtgggacaattctcttccaaaatatactcctgaaaatcctgctgatgctacaaggaacttatctcaacaatgcttgaatgctcttgctaaagcaatacctggatttcttggaggtagtgccgatctcgcaacatcaaatatgacattactaaaaatgtttggtgattttcaaaaagacacacctgaagaaagaaacatccgttttggtgtgagagagcatgcaatgggtgccatttccaacggcattgcattgcacagtcctggactaataccttactgtgcaacattctttgtgtttactgactatatgagagctgccattcgtctttcggccttatgtggatcaagggtgatctttgtaatgactcatgattcaattggccttggagaagatgggccaacacatcagcctgttgaacagttattcagcctccgcgccatgccaaacatactaatgcttcgacctgcagatggaaacgagacttctggagcttacaagattgcagttcttaataggcaaaggccctctgtccttgccctttctaggcagaagcttcaacagctgaaaggaacatcagtggaaggcgttgccaagggaggatacattatttctgataattcatcaggaaacaaaccagatatcattctcatcggcactggttctgaacttgagattgtagaaaaagccgcagatgagctgaggaaagatgggaagactgtacgagtagtttcactggtttgctgggaattgtttgaggagcagtcggagaaatacaaggagagtgtttttccaagtgaagtaacttctaggatcagcgtcgaggctggggtcacatttggatgggagaaatatatcggagaaaaaggtaaagctattggtgttgaccgttttggttctagtgcgcctgctgggaaaatatacaaggagcttggtttgacagtggaaaatgtcattgcaacggccaagtcactgtga

SEQ ID NO: 10213 - protein, 714 aa, Oryza sativa subsp
MATATQAPTSPAAASGRGSVLPLLRGRPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSITPGHPENFETPGVEVTTGPLGQGFANAVGLALAEKHLAARFNKPDLKIVDHHTYVILGDGCQMEGVSNEASSLAGHWGLGKLIAFYDDNHISIDGSTGISFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSVEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 10214 - DNA, 1887 bp, Oryza sativa subsp
  CDS (1)..(1887)
atggggcacatcctctacgacgaggtcatgcggtacaaccccaagaacccctactggttcaaccgcgaccgcttcatcctctccgccggccacggctgcatgctccagtacgccctgctccacctcgccggctacgacgccgtcttggaggaggacttgaagcaattcaggcaatggggaagcaagactccaggccatcccgagaacttcgagacgcccggagttgaagttaccactggacctcttggtcagggtattgcaaatgcagttgggctggcccttgctgagaagcacctggctgctcgtttcaacaagcccgacagcgagattgttgatcactacacctactgtattttgggagatgggtgccagatggagggtatctccaatgaagcttgctcgttggctggccattggggtcttggcaagctgattgcattctatgatgacaaccacatttccattgacggagacacagagattgcattcactgaggatgtgagtgctcgctttgaggctcttgggtggcatacaatctgggttaagaatggaaacgatggctatgatgagattcgtgccgccattaaggaagcaaaggcggtaactgacaagccaacactaatcaaggtgaccaccacaatcggttttggatcacccaacaaggccaactcatacagcgtccacggaagtgctttgggtaccaaagaggttgaagcaaccagagagaaccttggatggccctatgagccattctttgtgcctgaggatgtgaagagccactggagccgccatgtgcctcaaggtgctgcttttgaggctgactggaatgctaagttcgccgagtatgagaagaagtacccagaagatgcagcgaccttgaagagcattgtctcaggggagttgcctgctggctgggctgacgctcttcctaaatacactccagagagccctgcagatgccaccaggaatctgtcacagcagtgcttaaacgcacttgctaaagttgttcctggtcttcttggaggaagtgctgatcttgcatcctccaacatgacattgcttaagatgttcggtgacttccagaaggatacgcctgaggagcgcaatgtccgatttggagtcagggagcatggaatgggcgccatttgcaacggcattgctctgcacagcccaggactcattccatactgtgctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattctgatgcttcgtcctgctgatggtaacgagactgctggggcatacaaaatcgcggtcctcaacaggaagaggccatccgtccttgctctctccaggcaaaagcttgctcagctgcctggtacctcgattgagggtgttgagaagggtgggtacatcgtctctgacaactcaactggcaacaagcctgacttcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaa

SEQ ID NO: 10215 - protein, 628 aa, Oryza sativa subsp
MGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 10216 - DNA, 2238 bp, Vitis vinifera
  CDS (1)..(2238)
  misc_feature (1818)..(1818): y is t or c
atggcttcttcgtcttctctctccatttctcaagccattgtcgccggagccctcaaccaccgcggctccactaattcctctgatcgcctacccctgcggtcattcactattcccaccttctccggcctcaaatccaccacctcagctgcttcatgcccttctcgcctcggctcagctcggcggaggctgtgccggagattggcggtgcaggctgcttcggtggagaccttggagaagacggaaactaccttgatcgagaaatcggtgaacaccatccggtttctggccgtcgattcggtggagaaggcgaactcgggtcacccgggtttgccaatgggttgtgctccaatgggccatgttttatacgatgagttcatgaagtttaaccccaagaacccctactggttcaatcgtgatcgctttgttctctctgccggacatggatgcatgcttcagtatgctctgcttcaccttgctggctacgacagtgtcagggaagaagacttgaaaagtttccgtcaatggggaagcacaacacctggtcacccagaaaattttgagacgcctggtgttgaagtcactactggtcctcttggtcagggtattgccaatgctgttggcttggctcttgcggagaggcacttggctgctcgattcaacaaaccagacaatgagattgttgatcactacacatacgtgatactgggggatggttgtcaaatggagggtgttgcacatgaagcttgttcacttgctggacattggggtcttgggaagctgatagctttgtatgatgataaccacatctctattgatggtgacactgagattgctttcacggagaatgttgacttacgttttgaggctcttggttggcatgttatctgggtgaagaatggaaatactggctatgatgagattcgtgctgccatcaaggaagcaaagactgtcaaagacaaacccactttaatcaaggtgactacaaccattggttatggatccccaaacaagtcaaactcatacagtgtacatggaagtgcactaggtcctaaggagttggatgccacaaggaagaaccttcgatggccatatgagcctttccatgtacccgaggatgtcaagaagcattggagccgccatgtccctgaaggtgcagctctggaagctgaatggaatgcccagtttgctgaatacgaacgcaagtataaagaagaagctgcagtattgaagtctctcatcaatggtgaattacctgcaggttgggagaaggcacttccgacgtatactccagagagcccagcagaagccacgagaaattcatcacaacaatgtctaaatgcccttgcaaatgttctccctggtctgcttggtggcagtgctgatcttgcttcctccaacctgtcggtgatgaagcagtttgggaacttccaaaagggcacaccagaagagcgcaatgtcaggtttggtgttcgggagcatggaatgggagccatctgcaatgggattgtccttcactgccccggccttattccatattgtgcaactttctttgttttcactgactacttgagacctgccatgaggatttctgccttgtgtgaagctggagtcatctatgttatgacacacgattcaattgggcttggagaagatggacctacacatcagcctatagagcacttggcaagttttcgggctatgcccaacattttgatgcttcgccctgctgatgggactgagacagctgcagcttacaagattgcagtccttaacaggaagagaccctcagtccttgcccttggtcggcgagatgtctcycagcttcgtggaacatccattgagggagttgagaagggaggttacatcgtaacagacaactcttcaggcaacaaaccagatattatattgattggaactggttcggaattggaaattgctgccaaagcagctgatgaactcagaaaggaagggaaagctgtcagggttgtttccttggttagctgggcgctttttgatgaacaatcagatgcttacaaggaaagtgttttgccagcagctgtatcagcccgggtcagcgttgaagctgcatcaacatttgggtgggagaagtttgttgggagcaaagggaagtcaattggtattgatcggtttggggcaagtgcacctgcactaaagttgtacaaggagcttggcgtaacagcagaggctgttatagcggcagctaaatcaatttgctag

SEQ ID NO: 10217 - protein, 745 aa, Vitis vinifera
MASSSSLSISQAIVAGALNHRGSTNSSDRLPLRSFTIPTFSGLKSTTSAASCPSRLGSARRRLCRRLAVQAASVETLEKTETTLIEKSVNTIRFLAVDSVEKANSGHPGLPMGCAPMGHVLYDEFMKFNPKNPYWFNRDRFVLSAGHGCMLQYALLHLAGYDSVREEDLKSFRQWGSTTPGHPENFETPGVEVTTGPLGQGIANAVGLALAERHLAARFNKPDNEIVDHYTYVILGDGCQMEGVAHEACSLAGHWGLGKLIALYDDNHISIDGDTEIAFTENVDLRFEALGWHVIWVKNGNTGYDEIRAAIKEAKTVKDKPTLIKVTTTIGYGSPNKSNSYSVHGSALGPKELDATRKNLRWPYEPFHVPEDVKKHWSRHVPEGAALEAEWNAQFAEYERKYKEEAAVLKSLINGELPAGWEKALPTYTPESPAEATRNSSQQCLNALANVLPGLLGGSADLASSNLSVMKQFGNFQKGTPEERNVRFGVREHGMGAICNGIVLHCPGLIPYCATFFVFTDYLRPAMRISALCEAGVIYVMTHDSIGLGEDGPTHQPIEHLASFRAMPNILMLRPADGTETAAAYKIAVLNRKRPSVLALGRRDVSQLRGTSIEGVEKGGYIVTDNSSGNKPDIILIGTGSELEIAAKAADELRKEGKAVRVVSLVSWALFDEQSDAYKESVLPAAVSARVSVEAASTFGWEKFVGSKGKSIGIDRFGASAPALKLYKELGVTAEAVIAAAKSIC

SEQ ID NO: 10218 - DNA, 2091 bp, Vibrio sp
  CDS (1)..(2091)
atgaggttttggactggaaaacgtttgcacacccaacagggctttgagagaattatgacctacttttcgtttcgcttaatgtactcaggagcagacatgtcgtctcgtaaacatcttgccaatgcaattcgtgctctaagcatggatggtgttcaacaagctaactcaggccacccaggcgcaccaatgggtatggctgatatcgctgaagttctttggcgctctcacctaaaccacaacccatcaaacccagagtgggccgaccgcgaccgcttcgtgctatcaaacggtcacggctcaatgcttatttactctctactgcacttaagcggttatgagctatctattgacgatctgaaaaacttccgtcaattgcactcaaaaaccccaggtcacccagagtacggttacgcgcctggtatcgagacaacaacgggtcctcttggccaaggcatcactaatgctgttggtatggctatcgcagagaaagcactagcggcacagttcaacaaagaaggccacgacatcgttgaccactttacgtatgtgttcatgggtgacggctgtctaatggaaggcatctcgcacgaagcatgctctctagcaggtacgctaggtctaggcaaactgatcgcgttttgggatgacaacggtatctctatcgacggtcacgttgaaggttggttctctgacgatacacctaagcgtttcgaagcttacggctggcacgtaatcccagcggtagacggtcacgatcctgaagcaatcaacgcagcgattgaagcggctaaagcggatcctcgcccgactctaatctgtactaaaacaattatcggtttcggttctcctaacaagtctggctcgcacgactgtcacggtgcgccattaggtcacgatgagattcaagcggctcgcgaatacctaggttgggagtacggtccatttgaaatccctgcagatgtttacgctgagtgggacgcaaaagaagcaggtgcagcgaaagaagcggcttggaatgaaaagttcgaagcatacgcagcagcttaccctgcagaagcagcagagcttaaacgtcgtctaaacggcgaacttccagcggaatgggaagaaaaagcgaaccaaatcattgctgatcttcaagcaaacccagcgaacattgcatcacgtaaagcatcgcaaaatgcactagaagcgtttggtcaaatgcttcctgagtttatgggtggttctgctgacctagcgccttctaacctgaccatgtggtctggttctaagtctctagaaacggatgacttctctggcaactacatccactacggtgtacgtgaattcggtatgaccgctatcatcaacggtatcgcattgcacggtggtttcgttccctacggtgcgacattcctaatgttcatggaatacgctcgtaacgcaatgcgtatggctgcgctgatgaaaattcagaatatccaagtgtacacgcacgattcgatcggtcttggcgaagatggcccaactcaccaacctgttgagcaaatggcatctctacgcgtaacgccaaacatgagcacatggcgtccatgtgaccaggttgagtctgccgtagcatggaaactagcgattgaacgtaaagatgcaccaacagcacttatcttctctcgtcaaaacttagcgcaacaagatcgtacagctgagcaagtagcgaacatcgcgaaaggtgcttacatcctgaaagattgtgaaggcaagccagagcttatccttatcgcaacaggctctgaagttgagctagcagtagaagctgcgactcaactaacagcagaaggtaagaaagtgcgcgtggtttcaatgccatcaacagatgcattcgacaaacaagacgccgcttaccgtgaagcagtattgccatcagacgtaacggcacgcatcgctatcgaagcgggcatcgcagacttctggtacaagtacgttggtttcgacggtcgcatcatcggcatgacgacatttggtgaatctgcacctgctggtcaactattcgagatgtttggcttcacgactgaaaacgtagtgaacacagcaaaagaattgctagcgtaa

SEQ ID NO: 10219 - protein, 696 aa, Vibrio sp
MRFWTGKRLHTQQGFERIMTYFSFRLMYSGADMSSRKHLANAIRALSMDGVQQANSGHPGAPMGMADIAEVLWRSHLNHNPSNPEWADRDRFVLSNGHGSMLIYSLLHLSGYELSIDDLKNFRQLHSKTPGHPEYGYAPGIETTTGPLGQGITNAVGMAIAEKALAAQFNKEGHDIVDHFTYVFMGDGCLMEGISHEACSLAGTLGLGKLIAFWDDNGISIDGHVEGWFSDDTPKRFEAYGWHVIPAVDGHDPEAINAAIEAAKADPRPTLICTKTIIGFGSPNKSGSHDCHGAPLGHDEIQAAREYLGWEYGPFEIPADVYAEWDAKEAGAAKEAAWNEKFEAYAAAYPAEAAELKRRLNGELPAEWEEKANQIIADLQANPANIASRKASQNALEAFGQMLPEFMGGSADLAPSNLTMWSGSKSLETDDFSGNYIHYGVREFGMTAIINGIALHGGFVPYGATFLMFMEYARNAMRMAALMKIQNIQVYTHDSIGLGEDGPTHQPVEQMASLRVTPNMSTWRPCDQVESAVAWKLAIERKDAPTALIFSRQNLAQQDRTAEQVANIAKGAYILKDCEGKPELILIATGSEVELAVEAATQLTAEGKKVRVVSMPSTDAFDKQDAAYREAVLPSDVTARIAIEAGIADFWYKYVGFDGRIIGMTTFGESAPAGQLFEMFGFTTENVVNTAKELLA

SEQ ID NO: 10220 - DNA, 1986 bp, Vitis vinifera
  CDS (1)..(1986)
atgcgatgcgtggataatgttaggatgctgatcgtggacgcagtgcaaaccgccaaggctgggcactcgggaatgcctcttggcatggccaaagttgggtatattctgtacaggcatgtgatgaggtacaaccccagaaatcctaaatggtttaacagggacaggtttgttttgagcgctggccatggatgcctcctccagtatatctgtcttcatcttgctggatttcaatcagttcaagtatctggaagacctgcaaaggctttgcttggtagtaggaccccaggtcaccctgagaatgtggttaccgatggcattgaagtcactacaggtacaaaaagtgtagctaacgcagttggccttgccctggcagaagctcattctgctgctagattcaacaaacccgatgctgtcattgttgatcacaggacattctgcatcatgggtgatggatgtgtcatggaagggatatcacatgaagctgcatctttggctgcacattggaaactcaacaagcttacactaatttatgatgataaccttaataccattgatggagccacctccctagctttttctgaagatatatcggcacgatttaaggctcttcggtggaacacaatcacagtggatgatacacacaatgacatggaagccatcaagaatgcccttctctctgcttttagggaaacagagaaaccaactttcataagggtttgtaaattgtctgaaaagaaaggaatttccaaagctcatcatggtacttttgatgaaaaggatgtgaagaaaatgagacggaaagttagctggagtgatcgagaaccattccatgtcattcctatgatctataggcttgtatttaaatctgctgcagggaaatgcagatacaagcagagtatggaatggcattcaaggctatgttattaccagaccaaatatccacaagagtttgtagaattcaagattctccttgatggtggtttgcttcctggctgggaaagctcattaccgaagtttcctacatcggatccggtggatgccactcaagggtactctgagaagtgcttaagccagcttgctaaagtgctcccggggttgatccgtggaagtgcagaccttgcaacctccaacaaagcttacctccacggccatgaagacttcagccagcctaactccccatggggctgcaacattcgctatggggttagagagcatgcaatggctggaatttcaaatggtattgcattgcatggaagtggcttgatcccatttgcagccactttcctcgttttctccgactacatgaagaactccattagactttctgctctaagccatgctggggtcatctacatcatgacccatgactctattggtctgggggaagatggaccaacacaccaacctgcagtggaacagcttgctggcctacgggcagtgccacagctcctagttttccggcctgcagatgggaatgagactgctggagcatacaaagtggctgttgccaatcgcaatgtaccaagcctcattgcattatcaaggcaaaaggtggctgcaaatttggaaggaacatcaagagcttcagttgaaagaggtggttacattgtgagtgataattctgaagacaagttgccagacataatactgattggcaccggatcagaactgtgcctctgcgatgagggtgccaaaatgctgagacaagaagggaggacagtgagggtggtttccctcgtctgctggcggctctttgacatgcagccacaacagtataaggagtttgtcttgccaccaagcgtgtcaaagcgggtaagcgtcgaggcagcctcccccatcgggtggagggaatatgtgggagaggaaggagtggtggttggggtggaggagtttggtgccagtggggcttatttggatactttcaagaagtttggtttcactgaagggaacataacaaggattgcaaagtcattgctatctcaataa

SEQ ID NO: 10221 - protein, 661 aa, Vitis vinifera
MRCVDNVRMLIVDAVQTAKAGHSGMPLGMAKVGYILYRHVMRYNPRNPKWFNRDRFVLSAGHGCLLQYICLHLAGFQSVQVSGRPAKALLGSRTPGHPENVVTDGIEVTTGTKSVANAVGLALAEAHSAARFNKPDAVIVDHRTFCIMGDGCVMEGISHEAASLAAHWKLNKLTLIYDDNLNTIDGATSLAFSEDISARFKALRWNTITVDDTHNDMEAIKNALLSAFRETEKPTFIRVCKLSEKKGISKAHHGTFDEKDVKKMRRKVSWSDREPFHVIPMIYRLVFKSAAGKCRYKQSMEWHSRLCYYQTKYPQEFVEFKILLDGGLLPGWESSLPKFPTSDPVDATQGYSEKCLSQLAKVLPGLIRGSADLATSNKAYLHGHEDFSQPNSPWGCNIRYGVREHAMAGISNGIALHGSGLIPFAATFLVFSDYMKNSIRLSALSHAGVIYIMTHDSIGLGEDGPTHQPAVEQLAGLRAVPQLLVFRPADGNETAGAYKVAVANRNVPSLIALSRQKVAANLEGTSRASVERGGYIVSDNSEDKLPDIILIGTGSELCLCDEGAKMLRQEGRTVRVVSLVCWRLFDMQPQQYKEFVLPPSVSKRVSVEAASPIGWREYVGEEGVVVGVEEFGASGAYLDTFKKFGFTEGNITRIAKSLLSQ

SEQ ID NO: 10222 - DNA, 1863 bp, Vitis vinifera
  CDS (1)..(1863)
atgaagtttaaccccaagaacccctactggttcaatcgtgatcgctttgttctctctgccggacatggatgcatgcttcagtacgctctgcttcaccttgctggctacgacagtgtcagggaagaagacttgaaaagtttccgtcaatggggaagcacaacacctggtcacccagaaaattttgagacacctggtgttgaagtcactactggtcctcttggtcagggtattgccaatgctgttggcttggctcttgcggagaggcacttggctgctcgattcaacaaaccagacaatgagattgttgatcactacacatacgtgatactgggggatggttgtcaaatggagggtgttgcacatgaagcttgttcacttgctggacattggggtcttgggaagctgatagctttgtatgatgataaccacatctctattgatggtgacactgagattgctttcacggagaatgttgacttacgttttgaggctcttggttggcatgttatctgggtgaagaatggaaatactggctatgatgagattcgtgctgccatcaaggaagcaaagactgtcaaagacaaacccactttaatcaaggtgactacaaccattggttatggatccccaaacaagtcaaactcatacagtgtacatggaagtgcactaggtcctaaggagttggatgccacaaggaagaaccttcgatggccatatgagcctttccatgtacccgaggatgtcaagaagcattggagccgccatgtccctgaaggtgcagctctggaagctgaatggaatgcccagtttgctgaatacgaacgcaagtataaagaagaagctgcagtattgaagtctctcatcaatggtgaattacctgcaggttgggagaaggcacttccgacgtatactccagagagcccagcagaagccacgagaaattcatcacaacaatgtctaaatgcccttgcaaatgttctccctggtctgcttggtggcagtgctgatcttgcttcctccaacctgtcggtgatgaagcagtttgggaacttccaaaagggcacaccagaagagcgcaatgtcaggtttggtgttcgggagcatggaatgggagccatctgcaatgggattgtccttcactgccccggccttattccatattgtgcaactttctttgttttcactgactacttgagacctgccatgaggatttctgccttgtgtgaagctggagtcatctatgttatgacacacgattcaattgggcttggagaagatggacctacacatcagcctatagagcacttggcaagttttcgggctatgcccaacattttgatgcttcgccctgctgatgggactgagacagctgcagcttacaagattgcagtccttaacaggaagagaccctcagtccttgcccttggtcggcgagatgtctcccagcttcgtggaacatccattgagggagttgagaagggaggttacatcgtaacagacaactcttcaggcaacaaaccagatgttatattgattggaactggttcggaattggaaattgctgccaaagcagctgatgaactcagaaaggaagggaaagctgtcagggttgtttccttggtttgctgggcgctttttgatgaacaatcagatgcttacaaggaaagtgttttgccagcagctgtatcagcccgggtcagcgttgaagctgcatcaacatttgggtgggagaagtttgttgggagcaaagggaagtcaattggtattgatcggtttggggcaagtgcacctgcactaaagttgtacaaggagcttggcgtaacagcagaggctgttatagcggcagctaaatcaatttgctag

SEQ ID NO: 10223 - protein, 620 aa, Vitis vinifera
MKFNPKNPYWFNRDRFVLSAGHGCMLQYALLHLAGYDSVREEDLKSFRQWGSTTPGHPENFETPGVEVTTGPLGQGIANAVGLALAERHLAARFNKPDNEIVDHYTYVILGDGCQMEGVAHEACSLAGHWGLGKLIALYDDNHISIDGDTEIAFTENVDLRFEALGWHVIWVKNGNTGYDEIRAAIKEAKTVKDKPTLIKVTTTIGYGSPNKSNSYSVHGSALGPKELDATRKNLRWPYEPFHVPEDVKKHWSRHVPEGAALEAEWNAQFAEYERKYKEEAAVLKSLINGELPAGWEKALPTYTPESPAEATRNSSQQCLNALANVLPGLLGGSADLASSNLSVMKQFGNFQKGTPEERNVRFGVREHGMGAICNGIVLHCPGLIPYCATFFVFTDYLRPAMRISALCEAGVIYVMTHDSIGLGEDGPTHQPIEHLASFRAMPNILMLRPADGTETAAAYKIAVLNRKRPSVLALGRRDVSQLRGTSIEGVEKGGYIVTDNSSGNKPDVILIGTGSELEIAAKAADELRKEGKAVRVVSLVCWALFDEQSDAYKESVLPAAVSARVSVEAASTFGWEKFVGSKGKSIGIDRFGASAPALKLYKELGVTAEAVIAAAKSIC

SEQ ID NO: 10224 - DNA, 1863 bp, Vitis vinifera
  CDS (1)..(1863)
atgaggtacaacccctccaacccctactggttcaatcgtgatcgattcgttctctccgctggccacggctgtatgttgcagtatgctttacttcatcttgctggctatgacagtgttaaggaagaggatttgaagtctttccgacaatggggaagtagaactcctggtcacccagagaacttcgagacacctggggttgaagtgacaactggccctcttggtcagggtattgccaatgctgttggtttggccgctgtggagaagcatttggctgcaagattcaacaaacctgacaatgagattgtcgaccactacacgtatgtgatacttggtgatggatgtcaaatggaaggaatttcaaatgaagtttgttcccttgctgggcactgggggcttgggaagctgattgcattttatgatgataaccacatttcaattgatggtgacactgaaattgcatttactgaaagtgttgacacccgttttgagggacttgggtggcatgtgatttgggtgaagaatggtaacactgggtatgatgaaattcgtgctgccatcaaggaagcaaaggctgttaaagacaagcccacattgattaaggtgacaactaccattggttatggttctcctaacaaggcaaactcatatagtgttcatgggagtgcattgggtgctaaagaagtagatgcaacaaggaagaaccttggttggcctcacgagccattccacgtgccagaggatgtcaaaaagcactggagccgccacatccctgatggagctgcccttgaagctgaatggaatgccaagtttgcagagtatgagaagaaatacaaagaagaagcagcagaattaaagtccatcatcactggtgaactacctgctggttgggataaagcacttccgacttacactcctgaaagtgctgctgatgctaccagaaatctgtctcaacaatgtcttaatgctctggccaaagttcttcctgggctcctaggtggcagtgcagatcttgcttcctccaacatgactttgctgaaaatgtttggtgacttccaaaaaggcacccctgaagagcgaaatgtccgttttggtgtcagggagcacggaatgggtgccatctgcaatggaattgctctgcacagccttggccttattccctactgtgcgaccttctttgttttcaccgactacatgagggccgccattaggatttctgccttaagtgaagctggagttatttatgtgatgacccatgattcaattgggcttggagaggatggaccaactcatcaaccaattgagcatctggcaagcttcagagccatgccaaatattctaatgctccgtcctgctgatggaaatgagactgctggtgcatataaggttgcagttgttaacagaaagagaccctcgattcttgctctctcacgtcaaaagcttcctcagcttcctggaacatccattgcaggagttgagaaaggaggttacgccatttctgacaattcttcaggcaataagccagatgttattttgattggaactgggtccgaattggagattgctgccaaggcaggagatgagctgaggaaggaaggaaagactgtaagggtggtatccctggtttcctgggagttgtttgatgaccagtccgatgcatacaaggaaagtgtcctcccagctgctgtaacagctagagtcagtattgaagcaggatccacatttggatgggagaagattgtaggaagcaagggaaaggcgattggcattgaccgatttggagcaagtgcaccagcaggaaagatctacaaggagtttggaattacagtggaggctgtaattgaagcagctaaggcagtttggtag

SEQ ID NO: 10225 - protein, 620 aa, Vitis vinifera
MRYNPSNPYWFNRDRFVLSAGHGCMLQYALLHLAGYDSVKEEDLKSFRQWGSRTPGHPENFETPGVEVTTGPLGQGIANAVGLAAVEKHLAARFNKPDNEIVDHYTYVILGDGCQMEGISNEVCSLAGHWGLGKLIAFYDDNHISIDGDTEIAFTESVDTRFEGLGWHVIWVKNGNTGYDEIRAAIKEAKAVKDKPTLIKVTTTIGYGSPNKANSYSVHGSALGAKEVDATRKNLGWPHEPFHVPEDVKKHWSRHIPDGAALEAEWNAKFAEYEKKYKEEAAELKSIITGELPAGWDKALPTYTPESAADATRNLSQQCLNALAKVLPGLLGGSADLASSNMTLLKMFGDFQKGTPEERNVRFGVREHGMGAICNGIALHSLGLIPYCATFFVFTDYMRAAIRISALSEAGVIYVMTHDSIGLGEDGPTHQPIEHLASFRAMPNILMLRPADGNETAGAYKVAVVNRKRPSILALSRQKLPQLPGTSIAGVEKGGYAISDNSSGNKPDVILIGTGSELEIAAKAGDELRKEGKTVRVVSLVSWELFDDQSDAYKESVLPAAVTARVSIEAGSTFGWEKIVGSKGKAIGIDRFGASAPAGKIYKEFGITVEAVIEAAKAVW

SEQ ID NO: 10226 - DNA, 2061 bp, Coprinopsis cinerea okayama7
  CDS (1)..(2061)
atggccagcttcgccccccaccagaacgacgatgtcgccgtcgccactatccgtattctctccgtcgacaccgtcgccaaagccaactctggccatccaggtgcacccatgggtttggcccccgccgcccatatccttttctctaggttcttgaacgccaaccccaaaaaccccaattggttcaaccgcgatcgattcgtcttgtccaacggtcatggatgcgctctccaatacgttctcctccatctccttggttacaacctcactttggacgacctcaaggccttccgacaattggactccaagacccctggtcaccctgaggctggccataccgagggtattgaggttaccaccggccctctcggacagggcttcgccaacgctgttggtttggccatcgcccaagcccaccttggtgctgtcttcaacaaggatggcttcgacctcatcaacaactacacctatgtcttcactggagatggttgcttgatggagggtgtcgccgccgaagccgcctccctcgccggtcacttgaagctgggcaacctcgttgttatctatgatgacaaccacatctccatcgatggagacaccaacgtggccttcactgaagacgttgagcaacggttcctgtcctacggttggcaggttctccacgtccatgacggtgatactgatctcgccagtatctacgcctccatcgctgctgctcgggaggagaaggacaagccgaccatcatcaagctgaggaccaccatcggctacggttccaaggagcagggaacccatggagttcacggatctcctctcaaggccgatgacattgtttccctcaagcagaagttcggcttcaaccctgaggagaagttcgccgtccctcaaggtacctacgacctttactccgagttcggcaagcgtggtgctgccctcgaggagcagtggaacgcccttctcgctgcctacgccgagaagtacccacaggagcatgccgaattgacccgtcgcattgctggaaagttgcccgaaggttgggagaaggctttgcccgtctacaaacccaccgatgccgctgtcgcttcccggaaactgtctgagatcgctctgactgccctcgcccccgtcctccccgagttgattggtggctctgctgatctcactggcagcaacttgaccaaggtcaagaactcgaccgacttccaacaccccagcaccggtctcggaaactacgctggtacctacatccgctatggtgtccgtgagcacggaatgggtgccattgccaacggtatttccgcctacggtggcgccattccctatgtcgctaccttcttgaacttcgtgtcttatgcatccggtgccgtccgattgtccgctctcagccagcaccatgttatctgggtcgctacccacgactccatcggtcttggtgaggacggtcctacccaccagcccgttgagacccaaattgccctccgagcgacccccaaccttgccttctggaggccagctgacggaaatgagacctctgctgcgtacctcgtcgccttgaaatccaacaagactccttccgttttgtctctctcccgacaaaaccttcctcagctcgacggctcttccatcgagaaggccagtcgcggtggctacgtcctcgttgaggaggacaacgaagacctcaccattgtcagcactggcagtgaagtcagcatcgctgtcgatgctgccaagaagctgaaggagcagggcatcaagactcgcgttgtcagcttaccttgctggctcgttttcgatcaacagcctttggagtaccgcctgagcgtccttcgaagcggtgctcccatcctctctctcgaggctgcctcgactgctggatgggccaaatacagccacgagcaatggggtctccctgcctggggtggctctgctccttaccagaagctctacgagcgattcggcatcactggttccaatattgccgaggttggcaagaaggttgttgacttctacaagcagcgcggtggcaagcttgcttctccccttgagaaggctgtcaatctttaa

SEQ ID NO: 10227 - protein, 686 aa, Coprinopsis cinerea okayama7
MASFAPHQNDDVAVATIRILSVDTVAKANSGHPGAPMGLAPAAHILFSRFLNANPKNPNWFNRDRFVLSNGHGCALQYVLLHLLGYNLTLDDLKAFRQLDSKTPGHPEAGHTEGIEVTTGPLGQGFANAVGLAIAQAHLGAVFNKDGFDLINNYTYVFTGDGCLMEGVAAEAASLAGHLKLGNLVVIYDDNHISIDGDTNVAFTEDVEQRFLSYGWQVLHVHDGDTDLASIYASIAAAREEKDKPTIIKLRTTIGYGSKEQGTHGVHGSPLKADDIVSLKQKFGFNPEEKFAVPQGTYDLYSEFGKRGAALEEQWNALLAAYAEKYPQEHAELTRRIAGKLPEGWEKALPVYKPTDAAVASRKLSEIALTALAPVLPELIGGSADLTGSNLTKVKNSTDFQHPSTGLGNYAGTYIRYGVREHGMGAIANGISAYGGAIPYVATFLNFVSYASGAVRLSALSQHHVIWVATHDSIGLGEDGPTHQPVETQIALRATPNLAFWRPADGNETSAAYLVALKSNKTPSVLSLSRQNLPQLDGSSIEKASRGGYVLVEEDNEDLTIVSTGSEVSIAVDAAKKLKEQGIKTRVVSLPCWLVFDQQPLEYRLSVLRSGAPILSLEAASTAGWAKYSHEQWGLPAWGGSAPYQKLYERFGITGSNIAEVGKKVVDFYKQRGGKLASPLEKAVNL

SEQ ID NO: 10228 - DNA, 2007 bp, Microcystis aeruginosa PCC 7806
  CDS (1)..(2007): transl_table=11
atggttgtcgcctctcaatccctcgaagaactttgtattaatgccgtgcgttttttagcggtggatgccgtagaaaaagctaaatctggacaccccggactgccgatgggagctgctcccatggcctttgttctctgggatcaattcctgcgttttaacccgaaaaacccccaatgggtcaatcgcgatcgttttgttctctccgccggtcacggttgtatgctgcagtacgctttgatgtatctgacgggatacgatagcgttcccctagaagaaattaaacaattccggcagtggaaatcgaaaacccccggccaccccgaaaatttcgtcacggaaggggtagaagtgaccactggtcctctgggtcaagggattgccaatggtgtgggtttggccctagcagaagcccatttagcggcccgtttcaacaaaccggatgccaaaattatcgaccattacacctatgtgattttaggtgatggttgcaatatggaggggatttccggggaagcttgttctttggccggtcactggggtttaggcaagttaatcgctctctatgatgataaccatatctcgatcgatggttccaccgatatcgcttttaccgaagacgtgagcaagcgttttgaagcctacggttggcacgttcagcacgtcgagaatggtaacaccgatttagatgccattgccaatgcgatcgcggctgccaaagctgtcaccgataaaccctcgatgattaaaatcaccaccaccatcggttatggttcccccaataagtctaataccgccgatgttcacggggcagctttgggagcaacagaaatcgagttaacccggaaagccttaggttgggaatacgagccgtttgtggttcccgatgaggtgttaaatcgtttccggcaagcagtggacaagggagcgacggcagaaacggactggaataagttatttaacgaatatcaggctaaatatcccgcagaagcggctttatttgagcagttaaccaccggtcaactgccggaaggttgggagcaagctttaccggtttataaacccgaagataaggcgctcgctagtcgtaaacactcggaaatctgcttaaatgcgcttgcgggggttttacccggtttaatcggtggttcggcggatttaacccactctaactacacggaattagagcattttggtaatttccaaaaaggcagttatcaggagcgtaacgtccattttggcgtgcgagaacacgcgatgggggcgatttgtaacgggattgctctccataacacgggattgattccctacggggcaactttcctgattttcaccgactatatgcggaattctatccgtttatcggcattgtcagaaactcgcgtcatctgggtaatgactcacgattccattgccctaggggaagatggaccgactcaccaacccgtggaacacgttgcttctctgcgcgctattcctaacctcttagtcatgcgtccgggggatggtacggaaacttctggcgcttataaagtagcggtgagtgaaactaagcgcccgacgttactagcattatcccgtcaaaatctgcccaatttagcaggaacttcccttgagggtgtggccaaaggtgcttatattatcaccgattgtgaaggtactcccgatgtcattctcatcggtacgggtggcgagttgtatctctgcgataaagcggctgcggtgttgaaagaagcaggaattaaagcccgcgtcgtttctatgccctgttgggagctattcgaggaacaatcggcagaatacaaagaatcggtattgccgaaagcagtgaaaaaacgtctcgcggtggaagcgggttcaactatgggttggcatcgctacatcaccgatgagggggatgtgttgggggttgataccttcggcgcttctgctccaggaggtgtgattctagagaagttcggttttaccgtggataacgtggtagcgaaggcaaaagcgttgttaggttaa

SEQ ID NO: 10229 - protein, 668 aa, Microcystis aeruginosa PCC 7806
MVVASQSLEELCINAVRFLAVDAVEKAKSGHPGLPMGAAPMAFVLWDQFLRFNPKNPQWVNRDRFVLSAGHGCMLQYALMYLTGYDSVPLEEIKQFRQWKSKTPGHPENFVTEGVEVTTGPLGQGIANGVGLALAEAHLAARFNKPDAKIIDHYTYVILGDGCNMEGISGEACSLAGHWGLGKLIALYDDNHISIDGSTDIAFTEDVSKRFEAYGWHVQHVENGNTDLDAIANAIAAAKAVTDKPSMIKITTTIGYGSPNKSNTADVHGAALGATEIELTRKALGWEYEPFVVPDEVLNRFRQAVDKGATAETDWNKLFNEYQAKYPAEAALFEQLTTGQLPEGWEQALPVYKPEDKALASRKHSEICLNALAGVLPGLIGGSADLTHSNYTELEHFGNFQKGSYQERNVHFGVREHAMGAICNGIALHNTGLIPYGATFLIFTDYMRNSIRLSALSETRVIWVMTHDSIALGEDGPTHQPVEHVASLRAIPNLLVMRPGDGTETSGAYKVAVSETKRPTLLALSRQNLPNLAGTSLEGVAKGAYIITDCEGTPDVILIGTGGELYLCDKAAAVLKEAGIKARVVSMPCWELFEEQSAEYKESVLPKAVKKRLAVEAGSTMGWHRYITDEGDVLGVDTFGASAPGGVILEKFGFTVDNVVAKAKALLG

SEQ ID NO: 10230 - DNA, 2235 bp, Populus trichocarpa
  CDS (1)..(2235)
atggcttccacttcttctcttactctgtctcaagcccttttggctagagctatttctcatcacgccactgaccaacgccgtgacagccgcctctctcttgtctccctccctgctttctccggcctcaaatccaccacctctacagcctcacgcgccaccacaaccactaaccgccggcgtcgtgtgtcttcccgtcatgtaagggcggcggcagtggagacattggatgcgacgacagagacttcactggtggagaagtcggttaatacaattagatttcttgctattgatgctgttgaaaaggccaattcgggtcaccccggtttacctatggggtgtgctccgatgggtcatattttgtacgatgaggttatgaggtataatccgaagaacccatactggttcaatcgtgatcggtttgttttgtctgctggtcatggctgtatgttacagtatgctctgcttcaccttgctggttatgatagtgtcaaggaagaagacttgaagagtttccgtcaatggggaagcaggacacctggacatcctgagaacttcgagactcctggcgttgaagtcacaactggtcctcttggacagggtgttgccaatgctgttggtttggcacttgctgagaagcacttggctgctcgcttcaacaaaccggacagtgaaattgttgaccactacacatatgctatattgggggacggttgtcaaatggagggtatttcaaatgaggcttgctccttggctgcacattgggggcttggaaagctgattgctttctatgatgacaaccatatctccattgatggtgacactgagattgcgttcaccgaggatgttgacaaacgttttgagggtcttgggtggcatgttatctgggtgaagaatggaaacaatggatatgatgagattcgggctgccatcaaggaggccaaggctgtaaaagacaaacccactttgatcaaggtcactacaaccattggttatggatctccaaacaaagcaaactcatacagtgtccatgggagtgcattgggtgccaaggaagttgatgctacgaggcagaaccttggatggccatttgagcctttccatgttccagaggatgttaagcagcactggagccgccacatcccagctggtgctgctttcgaagccgaatggaacaccaagtttgctgagtatgagaagaagtatagtgaagaagctgcagagttcaagtctatcatgactggtgaactacctactggttgggagaaagcacttcccacatacactcccgagagcccagcagatgccaccagaaatctatctcagcaaaacttaaatgcacttgcaaaagtgctccctggtcttcttggtggcagtgcagatctcgcctcttctaacatgaccttgttgaaaatgtttggggacttccaaaaggatacccctgaggaacgcaatgtcaggtttggtgttagagagcatggaatgggaagcatctgcaatggcattgcacttcacagtcctggcttgattccctactgtgctactttctttgttttcactgactacatgagaggtgccataaggatttctgctttgagtgaggctggagtcatctatgtcatgacccatgattccattggacttggagaagatggaccaacccatcaaccaattgagcacttggcaagcttccgtgcaatgcccaacattctgatgctccgcccggctgatggaaatgaaactgctggtgcatacaaagttgctgtcctcaacagtaagagaccctctatccttgccctctccaggcaaaagctaccccaacttcccggaacctcgatcgagggagttgaaaagggtggctacatcatttcagataactcctctggtaacaagcctgatgtcatcctgatgggtactggttcagagttggaaattgcagctaaagctgccgaggaacttagaaaggagggcaaggctgtgagagttgtctcctttgtttcatgggagctttttgatgagcaatcagttgcgtacaaggaaagtgttctgccagcagctgtaacagctagggttagcattgaagctggatcaacatttgggtggcagaagcttgttggagccaaaggcaaggctattggaattgaccggtttggagcaagcgcaccagcaggtaaaatatacaaggagtttggtattaccgcggaggctgttatcgcagcagccaaagaagttagctag

SEQ ID NO: 10231 - protein, 744 aa, Populus trichocarpa
MASTSSLTLSQALLARAISHHATDQRRDSRLSLVSLPAFSGLKSTTSTASRATTTTNRRRRVSSRHVRAAAVETLDATTETSLVEKSVNTIRFLAIDAVEKANSGHPGLPMGCAPMGHILYDEVMRYNPKNPYWFNRDRFVLSAGHGCMLQYALLHLAGYDSVKEEDLKSFRQWGSRTPGHPENFETPGVEVTTGPLGQGVANAVGLALAEKHLAARFNKPDSEIVDHYTYAILGDGCQMEGISNEACSLAAHWGLGKLIAFYDDNHISIDGDTEIAFTEDVDKRFEGLGWHVIWVKNGNNGYDEIRAAIKEAKAVKDKPTLIKVTTTIGYGSPNKANSYSVHGSALGAKEVDATRQNLGWPFEPFHVPEDVKQHWSRHIPAGAAFEAEWNTKFAEYEKKYSEEAAEFKSIMTGELPTGWEKALPTYTPESPADATRNLSQQNLNALAKVLPGLLGGSADLASSNMTLLKMFGDFQKDTPEERNVRFGVREHGMGSICNGIALHSPGLIPYCATFFVFTDYMRGAIRISALSEAGVIYVMTHDSIGLGEDGPTHQPIEHLASFRAMPNILMLRPADGNETAGAYKVAVLNSKRPSILALSRQKLPQLPGTSIEGVEKGGYIISDNSSGNKPDVILMGTGSELEIAAKAAEELRKEGKAVRVVSFVSWELFDEQSVAYKESVLPAAVTARVSIEAGSTFGWQKLVGAKGKAIGIDRFGASAPAGKIYKEFGITAEAVIAAAKEVS

SEQ ID NO: 10232 - DNA, 2235 bp, Populus trichocarpa
  CDS (1)..(2235)
atggcttccacttcttctctaactctctctcaagcccttttggctagagccgtctctcacaatgccattgacaacctccgtgacagccgtctctctctcgtctcccttcctgctttctccggcctcaaatccaccacctgtacagccacacgcgccacaacaacaactagccgccgccgccgcgtgtcttcccgacaagtaagggcggcggcagtggagacactggatgcgacaacagagacttcattggtggagaagtcggttaatacgattagatttctcgctattgatgctgtcgaaaaggctaattcaggtcaccctggtttgcctatggggtgtgctccgatgggtcatattttgtacgatgaggtcatgaggtacaatccgaagaacccatattggttcaatcgtgaccggtttgttttgtctgctggccatggctgtatgttgcaatatgctctgcttcaccttgctggatatgatagtgtcaaggaagaagacttgaagagtttccgccagtggggaagcaggacacctggacatcctgagaactttgagactcctggtgttgaagtcacaactggtcctcttggacagggtattgccaatgctgttggtttggcacttgcagagaagcacttggctgctcgctacaacaaaccagacaatgagattgttgaccactacacatatgttatattgggagatggttgtcaaatggagggtatttcaaacgaggcttgttcgttggccgcacactggggacttggaaagctgattgctttctatgatgacaaccatatctctattgatggtgacactgagattgcattcactgaggatgttgacaaacgttttgagggtcttgggtggcatgttatctgggtgaagaatggaaacactggatatgatgagattcgtgctgccattaaggaggctaagtctgtgaaggacaaacccactttgataaaggtgactacaaccattggttatggatctccaaacaaagcaaactcttacagtgtacatgggagtgcattgggtgccaaggaagttgatgctaccaggcagaaccttggatggccatatgagcctttccatgttccagaggatgttaagcagcactggagccgccacaccccagctggtgcagcttttgaagccgaatggaatgccaagtttgccgagtatgagaagaagtacagtgaagaagctgcagagttgaagtctattgccaatggtgaactgcctgctggttgggagaaagcacttcctacatatactccggagagcccagcagatgccaccagaaatctatctcagcaaaacctaaatgcacttgcaaaagtgctccctggtcttcttggtggcagcgcagatcttgcctcttccaacatgaccttgttaaaaatgtttggggacttccaaaaggacacccctgaggaacgcaatgtcaggtttggtgtcagagagcatggaatgggagccatctgcaatggcattgcacttcactgtcctggcttgatcccctactgtgctactttctttgttttcacagattacatgagagctgctatgaggatttctgctttgagtgaggctggagtcatatatgtcatgacccatgattccattggtcttggagaggatggaccaacccatcaaccaattgagcacttggcaagcttccgtgcaatgcccaacattttgatgttacgcccagctgatggaaatgaaactgctggcgcatacaaggttgctgtcctcaacagaaagagaccctctatcctagccctctccaggcaaaagctaccccaacttcctggaacctccattgagggagttgaaaagggtggctacatcatttcagataactcctctagtaataagcctgatgttatcttgattggtactggttcagagctggaaattgctgctaaagctgccgaggaacttagaaaggaaggcaaggctgtaagagttgtttcctttgtttcatgggagctttttgatgaacaatcagatgcctacaaggaaagtgttttgccagcagctgtagaagctagggttagcatcgaagctggatcaacatttggatgggagaagattgttggagacaaaggaaaggctattggaattgaccggtttggagcaagtgcaccagcaggtaaaatatacaaggagtacggtattactacagaggctgttatcgcagctgccaaagaagtcagctag

SEQ ID NO: 10233 - protein, 744 aa, Populus trichocarpa
MASTSSLTLSQALLARAVSHNAIDNLRDSRLSLVSLPAFSGLKSTTCTATRATTTTSRRRRVSSRQVRAAAVETLDATTETSLVEKSVNTIRFLAIDAVEKANSGHPGLPMGCAPMGHILYDEVMRYNPKNPYWFNRDRFVLSAGHGCMLQYALLHLAGYDSVKEEDLKSFRQWGSRTPGHPENFETPGVEVTTGPLGQGIANAVGLALAEKHLAARYNKPDNEIVDHYTYVILGDGCQMEGISNEACSLAAHWGLGKLIAFYDDNHISIDGDTEIAFTEDVDKRFEGLGWHVIWVKNGNTGYDEIRAAIKEAKSVKDKPTLIKVTTTIGYGSPNKANSYSVHGSALGAKEVDATRQNLGWPYEPFHVPEDVKQHWSRHTPAGAAFEAEWNAKFAEYEKKYSEEAAELKSIANGELPAGWEKALPTYTPESPADATRNLSQQNLNALAKVLPGLLGGSADLASSNMTLLKMFGDFQKDTPEERNVRFGVREHGMGAICNGIALHCPGLIPYCATFFVFTDYMRAAMRISALSEAGVIYVMTHDSIGLGEDGPTHQPIEHLASFRAMPNILMLRPADGNETAGAYKVAVLNRKRPSILALSRQKLPQLPGTSIEGVEKGGYIISDNSSSNKPDVILIGTGSELEIAAKAAEELRKEGKAVRVVSFVSWELFDEQSDAYKESVLPAAVEARVSIEAGSTFGWEKIVGDKGKAIGIDRFGASAPAGKIYKEYGITTEAVIAAAKEVS

SEQ ID NO: 10234 - DNA, 1905 bp, Arabidopsis thaliana
  CDS (1)..(1905)
atgggctgtgctccgatgtctcacattttgtacgatgaagtcatgaagtataaccccaagaatccttactggtttaaccgtgatcgtttcgttctctctgctggacatggatgcatgttgcaatacgctctgcttcaccttgctggctacgacagcgttagggaggaagatttgaagagcttccgtcaatggggaagtaagactccaggacatcctgagaattttgagactcctggtgttgaagccactactggtcctcttggacaaggtattgcaaatgctgttggtttagctcttgcggagaagcatttggctgctagatttaacaaacctgacaatgagattgttgaccactacacgtattcgattcttggagatggttgtcagatggaagggatttcaaatgaagtttgctctctagctggtcactggggacttggaaagctaatcgctttctacgatgacaatcacatttccattgatggagacacagatattgcttttaccgagagcgtggacaaacgctttgaagctcttggatggcatgttatctgggtaaagaatggaaacaatggttatgatgagatccgtgctgccattagggaagctaaggctgtaacagacaagcccactttgattaaggtcactactacaattggttatggttctcccaacaaggcaaactcatacagtgtccatggagctgcgcttggtgagaaggaagttgaggctacccgaaacaatcttgggtggccatatgagccgttccatgtacctgaggatgtcaaaagccattggagccgtcacacgcccgaaggggctgctcttgaagctgattggaatgccaaatttgcagcttatgagaagaaatatccggaggaagctgcagagttgaaatctattatctcaggtgaattgcccgttggttgggagaaggcacttcctacatatacaccagactctccgggtgatgccaccagaaacctgtctcagcaatgtcttaacgcacttgcgaaagctgtgcctggttttcttggtgggagtgctgaccttgcatcttccaacatgacaatgcttaaagcattcggcaacttccaaaaagccacacctgaagaaagaaaccttagatttggtgtcagggaacatggtatgggagctatctgcaacggcattgcccttcacagccccggttttatcccttactgcgcaactttctttgtgtttactgactatatgagagctgcaatgagaatctcggctttgtctgaagctggtgttatatacgttatgacccatgactccattggtcttggagaagatggaccaacccaccaacccatcgaacacttatccagtttccgtgccatgcccaatattatgatgttccgtccagctgatgggaacgaaacagccggtgcatacaaaatcgctgtcacaaaacgtaagacaccttctgtcttagccttatctagacaaaagctgcctcaacttccaggaacatctattgagagcgtcgagaaaggtggatacaccatttctgacaactcaaccggtaacaaacccgatgtgatcttgatcggaactggatcagagctagagattgctgctcaagctgcagagaagttaagggaacaaggcaaaagtgtgagagttgtttcctttgtatgttgggagcttttcgacgagcaatcagatgcatacaaggaaagtgttttgccatctgatgtatcagctagagttagtatcgaagctggatcgacttttggatggggaaagatcgtcggaggaaaagggaaatcgattggaattgatacgtttggagcaagtgcaccagcaggaaagctttataaagagtttggtatcaccattgaagctatggttgaagcagccaagtcacttatttaa

SEQ ID NO: 10235 - protein, 634 aa, Arabidopsis thaliana
MGCAPMSHILYDEVMKYNPKNPYWFNRDRFVLSAGHGCMLQYALLHLAGYDSVREEDLKSFRQWGSKTPGHPENFETPGVEATTGPLGQGIANAVGLALAEKHLAARFNKPDNEIVDHYTYSILGDGCQMEGISNEVCSLAGHWGLGKLIAFYDDNHISIDGDTDIAFTESVDKRFEALGWHVIWVKNGNNGYDEIRAAIREAKAVTDKPTLIKVTTTIGYGSPNKANSYSVHGAALGEKEVEATRNNLGWPYEPFHVPEDVKSHWSRHTPEGAALEADWNAKFAAYEKKYPEEAAELKSIISGELPVGWEKALPTYTPDSPGDATRNLSQQCLNALAKAVPGFLGGSADLASSNMTMLKAFGNFQKATPEERNLRFGVREHGMGAICNGIALHSPGFIPYCATFFVFTDYMRAAMRISALSEAGVIYVMTHDSIGLGEDGPTHQPIEHLSSFRAMPNIMMFRPADGNETAGAYKIAVTKRKTPSVLALSRQKLPQLPGTSIESVEKGGYTISDNSTGNKPDVILIGTGSELEIAAQAAEKLREQGKSVRVVSFVCWELFDEQSDAYKESVLPSDVSARVSIEAGSTFGWGKIVGGKGKSIGIDTFGASAPAGKLYKEFGITIEAMVEAAKSLI

SEQ ID NO: 10236 - DNA, 2235 bp, Capsicum annuum
  CDS (1)..(2235): transl_table=11
atggcttcttcctccctccctctctctcaggccatcctctctcgctcaatccctcgccatggctcctcttcctccaccaactcccaattctccccttcttccctttccctccccactttctccggcctcaaatccaccacctccaccaccttccgccgccgcactcttccgtcccccgtcgccgtacggtcgccggaaattagagcttcggcggctgtggagactttagagaaaacggataatgcactggttgagaaatctgtaaatacgatacgatttttggcaattgatgcagttgaaaaggccaattcaggtcatccaggtttacctatgggatgtgcacctatcggacatatattgtatgatgagatcatgagatataatcctaagaatccttattggtttaatcgtgatcgctttgttctctccgctggacatggttgtatgcttcagtatgctttgcttcatctcgctggttatgatgctgttagggaagaggacttgaagagcttccgccagtggggaagcaaaacccctggacaccctgaaaactttgagacacctggtgttgaagtcaccactgggcctcttggacaagggattgccaatgccgttggcttggccctctcagagaagcacttggctgctcgtttcaataagcctggcgctgagattgtagaccactacacatattgtattctcggtgatggttgccagatggagggtatttcacaagaagcggcttctcttgctggacactgggggctcggaaagctgattgctttctatgatgacaaccacatctcaattgatggggacacagaaatcgctttcactgaggatgttggtgcccgttttgaggctcttggttggcatgtaatctgggtgaagaacggtaacactggttatgatgagattcgtgctgccattaaggaagcaaaagcagtcacagacaaacccactatgatcaaggtaactacaaccattggttttggctcacccaacaaggcaaatagttacagtgtacatggaagcgcacttggagctaaggaagtagaggccacgaggcagaacttgggatggccttatgagcctttccatgtgcctgaagatgtcaagagccactggagccgtcatgttcccgagggtgctgctcttgaagctggatggaataccaagtttgctgaatatgagaagaagtacccagaggaagctgcagatctcaaatccatcatcactggtgaactacctgctggctgggagaaagctcttcctacctacacacctgaaagtccagcagatgccaccagaaacctgtcccaacaaaacctgaatgctcttgccaaggttcttcctggtttcctcggtggtagtgctgatcttgcctcatcaaacatgaccctcatgaaaatgtttggcgatttccaaaagaacaccccagaggagcgaaatttaaggtttggtgttcgtgaacatggtatgggagccatttgtaatggaattgctctgcacagccccggcttaattccctactgtgccactttctttgtttttactgattacatgagagcagccattagaatttcagctttgtctgaatcgcgtgttatctatgttatgacccacgattcaattgggcttggagaagatggacctacacatcagcccattgagcacttggcaagtttccgtgcaatgcccaatgttctgatgctccgtccagcagatggtaatgagacagctggtgcttataaggtggccatcctcaagagtaagacaccatcaatcctggccctttctcgacaaaagttgccccaacttgctggaacttctattgaaggaacagcaaagggtggctacgttacatcagacaactcttcaggcaacaatcctgatgtcattttgattggtaccgggtcagagctggaaattgctgtcaaggctgctgatgaactcagaaaggaaggaaaggcggtgagagttgtctccctcgtttcttgggagcttttcgatgagcaatcagcggagtacaaggaaagtgttcttccagcagctgttactgctagagttagcattgaagctggatccacatttgggtgggagaagatcgtcggatccaaagggaaggccattggaattgacagattcggtgccagtgcccctgctggaaaaatatacaaggagtatggaattacagcagaggctgtaatagctgcagctaaacaagtctcttaa

SEQ ID NO: 10237 - protein, 744 aa, Capsicum annuum
MASSSLPLSQAILSRSIPRHGSSSSTNSQFSPSSLSLPTFSGLKSTTSTTFRRRTLPSPVAVRSPEIRASAAVETLEKTDNALVEKSVNTIRFLAIDAVEKANSGHPGLPMGCAPIGHILYDEIMRYNPKNPYWFNRDRFVLSAGHGCMLQYALLHLAGYDAVREEDLKSFRQWGSKTPGHPENFETPGVEVTTGPLGQGIANAVGLALSEKHLAARFNKPGAEIVDHYTYCILGDGCQMEGISQEAASLAGHWGLGKLIAFYDDNHISIDGDTEIAFTEDVGARFEALGWHVIWVKNGNTGYDEIRAAIKEAKAVTDKPTMIKVTTTIGFGSPNKANSYSVHGSALGAKEVEATRQNLGWPYEPFHVPEDVKSHWSRHVPEGAALEAGWNTKFAEYEKKYPEEAADLKSIITGELPAGWEKALPTYTPESPADATRNLSQQNLNALAKVLPGFLGGSADLASSNMTLMKMFGDFQKNTPEERNLRFGVREHGMGAICNGIALHSPGLIPYCATFFVFTDYMRAAIRISALSESRVIYVMTHDSIGLGEDGPTHQPIEHLASFRAMPNVLMLRPADGNETAGAYKVAILKSKTPSILALSRQKLPQLAGTSIEGTAKGGYVTSDNSSGNNPDVILIGTGSELEIAVKAADELRKEGKAVRVVSLVSWELFDEQSAEYKESVLPAAVTARVSIEAGSTFGWEKIVGSKGKAIGIDRFGASAPAGKIYKEYGITAEAVIAAAKQVS

SEQ ID NO: 10238 - DNA, 1875 bp, Ascidia sydneiensis samea
  CDS (1)..(1875)
atggctgaataccatgcacctgataacaaaacagttcatgaactgaacaacattgctaacaggattagaatcaacagcattctgtctacttccaagtccaactcaggacatcccacttcatcatcgagctgtgctgagattttgtctgttttattctttcgcataatgaagtacaaggtcgatgtgccgagggatatttcatcagatagattcgttatgtcaaagggtcatgcatgccctgccttgtactcagcttgggtggaaactggtcacatgaccaaggaacaactgatgaccttgagggaaaatggaagtgtctatgaaggtcatccaacaccgaaaattgacttcattgacgttgccactggatcactaggacaaggccttggaatggctgctggcatggcttatgttggaaaatacattgacaagtcaaactatcgagtgtactgcctgttaggggatggtgaagtggctgaaggggctgtatgggaggctatggcctttgcaagccattacaagttggacaatctggtggctatcatcgatgtgaccagattgggtcaatctgaagaaaccgcactcggtcatcacaccgagatctacaaaaagagagcagaagcttttggttggaactcaattgaagtggatggccactgtgtctctgagttgagcaagtcattccatctcgctgagtcatgcaaggacctgcctacttgccttgtagctaaaactttcaagggaaaaaacatgatcgggcaagaaaatcttcatggcttccatgggaaacctgtatctcccgcatccaaggaggaaatcctcaatcatcttgagaagcttgtctccgaaaattctggggtcaaattaactccaactcttccagtggatgacaccaaacccgtggacatctccaacattaaactaagttcacctcctgattatgagctcggacaaaagattgcaaccagagccggctacggaaaagctctgataaaaattggccaaaggtgcgatcgagtttactcactagatggcgatatgaagaattcaacttttgctcaggactataagaaagcctttcctgaccattttatcgagtgcttcattgcagaacagaatatggttggggttggtattggaatggcaactcgggatagaactgttgtcttcctcagcacatttgctgcttttatggctcgtgcttacgaccacatcaggatgggagctgtgtgtcacaccaacatcaacattttcggatcccattgtgggatttctattggagctgatggaccttcccaaatggctttggaagatcttgccatgttcagagccgtgcaaggatccacggtcttctatccatctgatgttgtctctgttgaaagggctgttgagctttctgctaacacaaaagggatttgtttcatacgaggagcgagggccgccacaccagtcgtttatgacaaggacactaagttcgaagttggccgttgccagatattgaaacaaaagtctggtgacaaagtgacaatcgttgctggtgggataacatttgctgaagcactgaaggcttttgacaaactacaaactgacggcattggagtgaccttgattgacatcttctctgtgaagccggtagataaggatgggatctatcaggctgcatggcaaccggggaaagatcctcacggtggagatcattacgaggagggaggaatcgggtccgccgtcgctgaggcattgtccgagtgcacaggaatcacccagaaaaggctcgcggttaggggactcccctacagtgcagctcccaatgagcttctggccgctttcaagattgattgtgacgcaatagtggaggccgttaagtcaatgctataa

SEQ ID NO: 10239 - protein, 624 aa, Ascidia sydneiensis samea
MAEYHAPDNKTVHELNNIANRIRINSILSTSKSNSGHPTSSSSCAEILSVLFFRIMKYKVDVPRDISSDRFVMSKGHACPALYSAWVETGHMTKEQLMTLRENGSVYEGHPTPKIDFIDVATGSLGQGLGMAAGMAYVGKYIDKSNYRVYCLLGDGEVAEGAVWEAMAFASHYKLDNLVAIIDVTRLGQSEETALGHHTEIYKKRAEAFGWNSIEVDGHCVSELSKSFHLAESCKDLPTCLVAKTFKGKNMIGQENLHGFHGKPVSPASKEEILNHLEKLVSENSGVKLTPTLPVDDTKPVDISNIKLSSPPDYELGQKIATRAGYGKALIKIGQRCDRVYSLDGDMKNSTFAQDYKKAFPDHFIECFIAEQNMVGVGIGMATRDRTVVFLSTFAAFMARAYDHIRMGAVCHTNINIFGSHCGISIGADGPSQMALEDLAMFRAVQGSTVFYPSDVVSVERAVELSANTKGICFIRGARAATPVVYDKDTKFEVGRCQILKQKSGDKVTIVAGGITFAEALKAFDKLQTDGIGVTLIDIFSVKPVDKDGIYQAAWQPGKDPHGGDHYEEGGIGSAVAEALSECTGITQKRLAVRGLPYSAAPNELLAAFKIDCDAIVEAVKSML

SEQ ID NO: 10240 - DNA, 2238 bp, Ostreococcus tauri
  CDS (1)..(2238)
atgtcctcccaactcgctcaagccccggcgctggtcgccctccgagctaagctcaacgcgaaggttcactcccgccgcggtcgccgccccggccggggtctccacggagacggtgaacgattcgatcaataccattcgtttcttggcgatcgatgcgatcaacaagagcaactccggtcacccgggtctcccgatgggttgcgcgccgatgggctacgtgatttaccgcgaggcgatgacgcacaacccgaagaacaccaagtggttcaaccgcgatcgattcgtgttgtccgcgggacacgggtgcatgttgcattattcattgctccacttgaccggttacccgagcgtttcggtgcgtgcgcacgcgagaagactcgagagagaacgcgcgatcgaggagagttggataagccctggttctgggacgccggaggacgggcccgcggaacgcgaggagtggatcaaaagagcgagacgactgacgttaatgtgacttttacgcgaacgcagattgaagacatcaagcagttccgccagtgggactccaagaccccgggtcacccggagaacttcatcaccgacggtatcgaagtcaccacgggtccgctcggtatgggcatctgtaacgccgtcggtctcgcgatggtcgaaaagcacctcgccggtcgcttcaacaagccggactgcgagattgtcgatcactacacctactgtatcatgggcgacggttgcaacatggaaggcatgtctggcgaaggcgcctccctcgccggtcactggggcctcggcaagctcatcgtcttctacgatgacaaccacatctccatcgacggccacaccgacatctccttcacggaagatgtccaagcccgcttcgacgcgtacggctggcacacgcaacacgtccaaaacggtaacacggacgttgacgccatccgcgccgcggtgaacgccgccaaggctgacccgcgcccgtccctcatcaaggtgacgacgctcatcggctacggttccccgaacaagtccaacacccacgacgtgcacggcgcgccgctcggtaaggatgaaactgccgccacccgcgagaacttgaagtggaagtacggcgagttcgaagtgccggaagccgtcgccaaggccatggactgcaccgaaaagggcgccgccgccgaagctgagtggaacgccaagtgggcgacctacaagagcaagtacccggaagacgccgctgaactcgactccatcatgtccggtaagctcccggccgactgggccaagtctctcccgaccttcacgccggaagacaagggtgtcgccacgcgcatccactcccaaacgatgctcaacgccctcggtggtgcgatcccgggtttcatgggtggctccgccgatcttgctccgtccaacatgacgctgatgaagcaattcggtgacttccaaaaggacactccggccgagcgcaacgttcgcttcggcgtccgtgagcacggtatgggtgccattgccaacggcatgaagctccactccccgggtatcattccgtactgcgccaccttcttcatcttctccgactacatgcgctgtgccatgcgcatcgccgcgctttcccaagccggtaccatcttcgtcatgacgcacgactccatcggcgtcggtgaagacggtccgacgcaccagccgattgagcacgtcgcgtccttccgcgctatgccgggcatggacatgatgcgcccggctgacggcaacgagaccgccgcctgctacaagatggccgtcgagaactccatgaacggtgctccgaccaccttggcgctctctcgtcaagttgtcccgaacttgccgggtacctccatggaaggcgcccaaaagggtgcgtacgttgtccaaggcgccgcggctggcgaagcgtgcgacgtcatcctcatcggtaccggtaccgaactcgagctcgcctgcaaggctggtgccgagctcgagtccaagggtaagaaggttcgcgttgtctccatgccgtgctgggaagtcttcgagcgccaaccggcctcttaccaagattccgtcttgccgaagtccatgtacgccaacactgcctccatcgaggcgggtaccaccttcggttggtcgaagtacgccgccaagtccatcggtcacgatgacttcggtgcgtctgccccggccccgatcctctacaaggagttcggcatcacggccgaaaagctggccgcgctcttctaa

SEQ ID NO: 10241 - protein, 745 aa, Ostreococcus tauri
MSSQLAQAPALVALRAKLNAKVHSRRGRRPGRGLHGDGERFDQYHSFLGDRCDQQEQLRSPGSPDGLRADGLRDLPRGDDAQPEEHQVVQPRSIRVVRGTRVHVALFIAPLDRLPERFGACAREKTRERTRDRGELDKPWFWDAGGRARGTRGVDQKSETTDVNVTFTRTQIEDIKQFRQWDSKTPGHPENFITDGIEVTTGPLGMGICNAVGLAMVEKHLAGRFNKPDCEIVDHYTYCIMGDGCNMEGMSGEGASLAGHWGLGKLIVFYDDNHISIDGHTDISFTEDVQARFDAYGWHTQHVQNGNTDVDAIRAAVNAAKADPRPSLIKVTTLIGYGSPNKSNTHDVHGAPLGKDETAATRENLKWKYGEFEVPEAVAKAMDCTEKGAAAEAEWNAKWATYKSKYPEDAAELDSIMSGKLPADWAKSLPTFTPEDKGVATRIHSQTMLNALGGAIPGFMGGSADLAPSNMTLMKQFGDFQKDTPAERNVRFGVREHGMGAIANGMKLHSPGIIPYCATFFIFSDYMRCAMRIAALSQAGTIFVMTHDSIGVGEDGPTHQPIEHVASFRAMPGMDMMRPADGNETAACYKMAVENSMNGAPTTLALSRQVVPNLPGTSMEGAQKGAYVVQGAAAGEACDVILIGTGTELELACKAGAELESKGKKVRVVSMPCWEVFERQPASYQDSVLPKSMYANTASIEAGTTFGWSKYAAKSIGHDDFGASAPAPILYKEFGITAEKLAALF

SEQ ID NO: 10242 - DNA, 2145 bp, Oryza sativa
  CDS (1)..(2145)
atggcgacggcgacgcaagctcccacctcgcccgccgccgcgtccgggcgtggctccgttctccccctcctccgtggccgcccctccacccgcgtccgcctcgccgttggccggcgaccgcagaccgccctccgcgcgcagccgccgggggcggcggaggtggtggagcagtcggtgaacaccatccggttcctcgccgtggactccgtggagaaggccaagtccggccatccgggactccccatggggtgcgcgccgctgggccacgtcctattcgacgagttcctccggttcaaccccaagaacccctactggttcgaccgcgaccgcttcatcctctccgccggccatggatgcatgctccagtacgcactgcttcacctcgccggatacgacagcgtcacgatggatgatctgaaagctttccggcagtggggaagcagaactcctggtcacccagaaaacttcgaaacacctggtgttgaagtcactactggtcctctggggcagggttttgcaaatgctgttggcctagcgcttgctgagaaacatctagctgcccgtttcaataagcctgatttgaaaatcgtggatcatcacacgtatgttatacttggggatggctgccaaatggaaggtgtgtcaaatgaggcatcctcccttgctggtcactggggtctcgggaaactaattgccttctacgatgacaatcatatatcaattgatggtagcacaggcattgctttcactgaagatgcacttgcccgatatgaggcactaggttggcatactatctgggtgaaaaatggtaacacagggtatgatgacatccgtgctgcaattaaggaagcaaaggcagtcaaagacaagccaactcttatcaaggtgactactactattggttatggatccccaaacaaagcaaacacttatagtgttcatggtagcgctctaggtaccaaagaagtagaggcaaccaaaaacaatctttcttggcatcatgaacctttccatgttcctgatgaggtgaaaaggcactggagtcaccatattgatgagggtgcttctctggaagctgaatggaataaaaaaattgttgaatatgaaaagaaatatcgccaggaggctgctgagttaaagagcataatttcaggagaactgccttccgggtgggacaattctcttccaaaatatactcctgaaaatcctgctgatgctacaaggaacttatctcaacaatgcttgaatgctcttgctaaagcaatacctggatttcttggaggtagtgccgatctcgcaacatcaaatatgacattactaaaaatgtttggtgattttcaaaaagacacacctgaagaaagaaacatccgttttggtgtgagagagcatgcaatgggtgccatttccaacggcattgcattgcacagtcctggactaataccttactgtgcaacattctttgtgtttactgactatatgagagctgccattcgtctttcggccttatgtggatcaagggtgatctttgtaatgactcatgattcaattggccttggagaagatgggccaacacatcagcctgttgaacagttattcagcctccgcgccatgccaaacatactaatgcttcgacctgcagatggaaacgagacttctggagcttacaagattgcagttcttaataggcaaaggccctctgtccttgccctttctaggcagaagcttcaacagctgaaaggaacatcagtggaaggcgttgccaagggaggatacattatttctgataattcatcaggaaacaaaccagatatcattctcatcggcactggttctgaacttgagattgtagaaaaagccgcagatgagctgaggaaagatgggaagactgtacgagtagtttcactggtttgctgggaattgtttgaggagcagtcggagaaatacaaggagagtgtttttccaagtgaagtaacttctaggatcagcgtcgaggctggggtcacatttggatgggagaaatatatcggagaaaaaggtaaagctattggtgttgaccgttttggttctagtgcgcctgctgggaaaatatacaaggagcttggtttgacagtggaaaatgtcattgcaacggccaagtcactgtga

SEQ ID NO: 10243 - protein, 714 aa, Oryza sativa
MATATQAPTSPAAASGRGSVLPLLRGRPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSRTPGHPENFETPGVEVTTGPLGQGFANAVGLALAEKHLAARFNKPDLKIVDHHTYVILGDGCQMEGVSNEASSLAGHWGLGKLIAFYDDNHISIDGSTGIAFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSVEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 10244 - DNA, 2124 bp, Phaeosphaeria nodorum
  CDS (1)..(2124)
atgcatctctctcagaattccccagccgtcaatggatcgaccgaatacggcaataatgtgaccaaagcactgcaggaagaggaaagactagagaaatcatcggtgcagaaactttcaaaagagcaagatcatgtcttgaagaccttcagactgttgatcgcagacctttgccaacaattcaatggcggccaccctggcggtgcgattggtatggcggccattggagttgcactctggaagtacgtgatgaaatatgcaccgcatactcccacgtacttcaaccgcgatagattcgtcctttcaaatgatatgacatttgatcagctcaagtcataccactccgagcgcgtagatgcactatgcccaggtcatcctgagattgaacacgagggcatcgaagttacgacgggcccactcggacaaggtgtcgcaaatgccgttggactggccatagcaacaaagagcctccaggctaactacaacaaaccggggtttgaggtcgtctcgaatcatacctggtgcatgattggagacgcatgtttgcaagaaggagtcgctttggaagcaatctcttttgcgggacatttgaaactgaacaacctcacagtaatctacgacaacaatcagatcacctgtgacggtagtgttgatctcacaaacactgaagatgttaacacaaagatgcgtgcgtgtggttgggaggtgatcgatatcgaagacggatgctttgacattgagggacttgtcgcagctttgaatcaggcgcgtgcctcagtcgataaacctacctttatcaatgtgaaaaccatcatcggcttgggctctgccgttgcaggcgatgctgttgcacacggagtcgctcttggagcggaagacgtggcaaagatgaagaaagcttatgatttcaatccagaggagcatttcactgtaagcgatgaagttcgaactttcttcgaggatctgcccgccaaaggtcaagaactcgtgcggtcgtgggaagagttggtcaaaaagtacgagaccaaacacccggatttaggcgcggagttccggcaacgcatcgaaggtcgcctgcccgagacttggaaagatctaatcccaagctcattccctgaaacacccacagcgacaaggaaggcttccggattggtcataaaccccatcgcagaaaaagtaaagagctttgtagttggcacagcggacctgacaccgtcagtaaatatggcatggaaagacaaagtcgacttccagcatcctgatttgaagaccacttgcggcatcacaggcaactacagtggccggtacatccactatggcgtccgagaacacgcaatggcggcaatcagcaatggacttgctgcattcgcacctaactcgttcattcccgtcacttcctctttcttcatgttctatctttatgcagctccagcagtccgaatgggtgcgttgcaacagctgcaggtcattcatgctgcaacacatgactccattggcatgggcgaagatggtccaacacatcagccgatcgagttagctaacctctaccgcgctatgcccaacttgctgtatatacgaccagccgacagcgaagaaacggctggagcgtggattacagcaatagaggccaaaaacacaccgagcattatttcaacatcgagacatacgctaccacagctcaagcaaacgcgtcgagacttggtagcaaagggcgcgtacgttctggaggaggtcgacgatgccgacatcacgctgatcggagttggtgctgagctgtgtcacgcggttgacacggccaaggagctgaagtccaagaacatcaaagcacgtgttatcagcttcccatgtcaacgcttgtttgaagcccaatccacaatgtacaagcgcgacacactccgtcgtcatgaaggaatacccgccgttgttattgagcctttcagcccgaatggatgggaaaggtgggcagatgcgggagcttgtatgaggcgatttggtcacagtctgccaggcaaagccgcttacaagtactttgggtttgacgttcctgcactcacagccaaggtcgagagttatctgcagcaggtacgggaggatccgttactgaagggtgagtttgtcgatctttga

SEQ ID NO: 10245 - protein, 707 aa, Phaeosphaeria nodorum
MHLSQNSPAVNGSTEYGNNVTKALQEEERLEKSSVQKLSKEQDHVLKTFRLLIADLCQQFNGGHPGGAIGMAAIGVALWKYVMKYAPHTPTYFNRDRFVLSNDMTFDQLKSYHSERVDALCPGHPEIEHEGIEVTTGPLGQGVANAVGLAIATKSLQANYNKPGFEVVSNHTWCMIGDACLQEGVALEAISFAGHLKLNNLTVIYDNNQITCDGSVDLTNTEDVNTKMRACGWEVIDIEDGCFDIEGLVAALNQARASVDKPTFINVKTIIGLGSAVAGDAVAHGVALGAEDVAKMKKAYDFNPEEHFTVSDEVRTFFEDLPAKGQELVRSWEELVKKYETKHPDLGAEFRQRIEGRLPETWKDLIPSSFPETPTATRKASGLVINPIAEKVKSFVVGTADLTPSVNMAWKDKVDFQHPDLKTTCGITGNYSGRYIHYGVREHAMAAISNGLAAFAPNSFIPVTSSFFMFYLYAAPAVRMGALQQLQVIHAATHDSIGMGEDGPTHQPIELANLYRAMPNLLYIRPADSEETAGAWITAIEAKNTPSIISTSRHTLPQLKQTRRDLVAKGAYVLEEVDDADITLIGVGAELCHAVDTAKELKSKNIKARVISFPCQRLFEAQSTMYKRDTLRRHEGIPAVVIEPFSPNGWERWADAGACMRRFGHSLPGKAAYKYFGFDVPALTAKVESYLQQVREDPLLKGEFVDL

SEQ ID NO: 10246 - DNA, 1965 bp, Spiroplasma citri
  CDS (1)..(1965): transl_table=4
atgaaaaaatcaattgatacaatcaaaatgttgggaattgaagcaattaataaagcaaattcaggccatccgggaattgttcttggtgctgcgccaatggcatatactttatttacaagacacttagttgttaacccccaagtggacaaatgaataaatcgtgatcgatttgttttagcagcaggacatggtagtgctttattatattcgttattgcatttatcaggatttgatctgaatattgatgatttacgaaattttcgtcaagttgattcaattacgcctggtcaccccgaatcacatttaactccaggagttgatgttgcgacaggccctcttggacaaggacttgcagcagcagttggtttagcgttggcagaaactcatttagcagcaagatacaataccaaaaaatatccgctttatgatcattatacttatgttttatgtggtgatggtgatttacaagaaggagttacacaagaagcaatttctttagcaggacattgaaaactaaataaattaattgtattgtttgattcaaatgatgtgcaattggataatatggttaatgttgcacaaagtgaaaacattgctgatcgctttaaagcagcaaattgaaattatctttttgtcaaagatgggaatgatattgaggcaattgatcaagctattataaaagcaaaaaaaagtaataaaccaaccttaattgaagtaaaaacaataattggtgatgggacaactaaacaaggaacaccagcagtacatggtgctccgttgggaagtgatattgagacagttcgtaaaatgttagaatgaaattataaaccatttgaagttcctagtgaagtttataaggattttgaagtcaatgttaaacaacggggaattaaaaaatatcaacaatggttaaaaatgtatcaaggtctttgcaaagaaaatcctgctttagcaaaagaacttgatgatgcagtttatgggaattttaattttaatccacaagattttcgtgatttaaaaccaattaaaccacaagcaacacggattagtagtggtgcaatacttgatcgtctttctaatattattccaggtttaattggtggtagtgctgatttaagtggtagtacaaaagcaaaaggagctgatggtgtttatagtgctgaaaatcggttaggtcgtaatttagcatatggggtacgagaatttgcaatggctgccattaataatggaatttgtttacaccgaggattaattccttttgcaagtggtttctttgtttttgctgattatatgaagccagctattcggttgagttcattaatggaaattccagctatttatattttatcgcatgattcaattgctgttggtgaagatggtccaacacatcagccaattgaacaattagccatgttacgtagtcaaccaaacttaaatgtttttcgcccagctgattttaatgaaacattaggagcttatcatatggctttacaatcaaaacatactccaagtgttattttaattacacgtcaagatttaccaaaattagaacattcaaatgttgagctggttaaaaaaggagcttatcaagtttatggacaagaagataataatcatgttgtgttgttagcaacaggtagtgaagtaagtatggcaattgctgttgcaaaaaaattagagcatgataaaaaaattaaagtaaaagtagtatcaatgccttgttgagaattatttgagcaacaagatgctaaatataaacaaagattgttagaaccgttggctttaattgcttcaattgaattagggacaacctttggctgagaacgttatacttcaaatagtgggttaaactttggaattaataccttcggtcaatcagggccatttcaagatgttttagaatattttagttttaatgttgaaaaaattgttaatgttattaataaaaaaatgcaagtgttgtaa

SEQ ID NO: 10247 - protein, 654 aa, Spiroplasma citri
MKKSIDTIKMLGIEAINKANSGHPGIVLGAAPMAYTLFTRHLVVNPQVDKWINRDRFVLAAGHGSALLYSLLHLSGFDLNIDDLRNFRQVDSITPGHPESHLTPGVDVATGPLGQGLAAAVGLALAETHLAARYNTKKYPLYDHYTYVLCGDGDLQEGVTQEAISLAGHWKLNKLIVLFDSNDVQLDNMVNVAQSENIADRFKAANWNYLFVKDGNDIEAIDQAIIKAKKSNKPTLIEVKTIIGDGTTKQGTPAVHGAPLGSDIETVRKMLEWNYKPFEVPSEVYKDFEVNVKQRGIKKYQQWLKMYQGLCKENPALAKELDDAVYGNFNFNPQDFRDLKPIKPQATRISSGAILDRLSNIIPGLIGGSADLSGSTKAKGADGVYSAENRLGRNLAYGVREFAMAAINNGICLHRGLIPFASGFFVFADYMKPAIRLSSLMEIPAIYILSHDSIAVGEDGPTHQPIEQLAMLRSQPNLNVFRPADFNETLGAYHMALQSKHTPSVILITRQDLPKLEHSNVELVKKGAYQVYGQEDNNHVVLLATGSEVSMAIAVAKKLEHDKKIKVKVVSMPCWELFEQQDAKYKQRLLEPLALIASIELGTTFGWERYTSNSGLNFGINTFGQSGPFQDVLEYFSFNVEKIVNVINKKMQVL

SEQ ID NO: 10248 - DNA, 1989 bp, Spiroplasma citri
  CDS (1)..(1989): transl_table=4
atgaaaagcacaaataataatattgaaacaaaaagtttaagtaatttaagaattttaggcttagatcctattatttataataaaactggtcacccagggattgtattaagtgcagcaccactaatgcaagcaatttatttagataatttaattgctaatccggcagtacccgattgaatcaatcgtgatcgttttgtattatccccaggacatgcttcaactttacaatatgcgattttacatttagctggttataatttgacaattgatgatttaaaaaattatcgtcatattaattcaaaaactccagctcatccagaatatggcgttactcctggagtcgataattcttctggccccctagggcaaggagttggctatggggttgggatggcattatctgaacaacatctagcggctaaatttaataaaccagattataaaatcattgaccattatacttatgttttatgtagtgacggtgatttacaagaaggaggagcaattgaggcaattcaattagctggggtgtgaaaattaaataaattaattatgttatatgattcaaatgattgtcaattagatacaaaatgtgatgctgttttaaagattgattatcaacgtttttttgaagcacaaaattgaaattatattcgaattgaaaacgcagatgaggacttgccagcaattcaaaaagcaattgaacaagctcaaaaatctgataaaccaacattaattgaatgtaaaacaattattggttatgggcatccaaaacaaggttcaccaatgcattcttcaccatttacttctgaggagatggaccaagtaaaagcattttatgattttaatcatcctcaattttatgttgacaatgatgttaaaaaacactgacaagatacttttgctaaacgaggagcaataaaatatgaagagtgaaagaaaaaaataactgcttacaaaacagagtttccaaaggaatatgaagaattatttgctattccatcggttgatttaaaatcttttgcagaattattaacaacagataaagataaaaaagcaggaacacgaattattatgggagatgtatttaaatattatcaacaaaaatgtttaaataatatgtttggaggtagtgctgatttaggaactgcaaccaaaatcattggttataatggatcatgaacaacatcaaccccacaaaataataatgtccattttggagtgcgagaatttgcggccggaacaattagcattggtgttgaattacaccaaggtttgaaaggatttaattcaacatttttaatttttgctgattatatgaaaccatgtgttcgaatggcgtgtattcaaaacttaccagttattttttctttttcccatgattcaattggtgttggttttgatggaaaatcacatcagccagttgagcaattagcaatgttacgaaattgtccgaatttaaatgtttttcggccagcggatattaaagaagcaattggatgtttgaaagcaagcgtggaagcaaaaagtactccatcagctttgatcttatcgcgacaagataccccatatcaattatcagaaacatgctgagaacaaacactaaaaggtggatatattgttgttgctgaagatgagacaaaaccattggaggcaattattattgcaacaggaactgaagtagcaccagcaattattgcagctaagacaattaagaaaaacattcgtgttgtatcaatgccttgtgttgaattatttgaacaacaaccaagggcttatcaagaaaaaattgttccaaaaaatataacaaaagtaattgcaattgaattttcaaatgattatgtttgatataaatttgttggtaaaactggtttagttctgggtgttgatgattatggtttatcgggaagtgctgatgctgttattaagtataagcaattagatcaaagttctattattaatagaattacagcatatttagaagaataa

SEQ ID NO: 10249 - protein, 662 aa, Spiroplasma citri
MKSTNNNIETKSLSNLRILGLDPIIYNKTGHPGIVLSAAPLMQAIYLDNLIANPAVPDWINRDRFVLSPGHASTLQYAILHLAGYNLTIDDLKNYRHINSKTPAHPEYGVTPGVDNSSGPLGQGVGYGVGMALSEQHLAAKFNKPDYKIIDHYTYVLCSDGDLQEGGAIEAIQLAGVWKLNKLIMLYDSNDCQLDTKCDAVLKIDYQRFFEAQNWNYIRIENADEDLPAIQKAIEQAQKSDKPTLIECKTIIGYGHPKQGSPMHSSPFTSEEMDQVKAFYDFNHPQFYVDNDVKKHWQDTFAKRGAIKYEEWKKKITAYKTEFPKEYEELFAIPSVDLKSFAELLTTDKDKKAGTRIIMGDVFKYYQQKCLNNMFGGSADLGTATKIIGYNGSWTTSTPQNNNVHFGVREFAAGTISIGVELHQGLKGFNSTFLIFADYMKPCVRMACIQNLPVIFSFSHDSIGVGFDGKSHQPVEQLAMLRNCPNLNVFRPADIKEAIGCLKASVEAKSTPSALILSRQDTPYQLSETCWEQTLKGGYIVVAEDETKPLEAIIIATGTEVAPAIIAAKTIKKNIRVVSMPCVELFEQQPRAYQEKIVPKNITKVIAIEFSNDYVWYKFVGKTGLVLGVDDYGLSGSADAVIKYKQLDQSSIINRITAYLEE

SEQ ID NO: 10250 - DNA, 1851 bp, Streptomyces kanamyceticus
  CDS (1)..(1851): transl_table=11
atgaccagcatcagtgaactcgcagacgtcgcgcgtcagttgcgcgtcgactcgatccgggccgcggccgccgcgggctccgggcaccccacctcgtcgatgtccgcggccgatctgatggcggtgctcatcggcggccacttccgctacgacttcgagcggcccgcccaccccggcaacgaccggttcatcctctccaaggggcacgcctcgccgctgctctacgccgcgtacaaggcggcgggcgccctcaccgacgaggaactcctcaccttccgcaaggagggcagcaggctcgaagggcatccgacgccgcgggccctgccctgggtcgaggtcgccaccgggtcgctcgggcaggggctgcccgtcggcgtcggcatggcgctctccggcaagcggctcgaccggatcccctaccgcgtctgggtgctgtgcggcgacagcgaactggccgagggttcggtctgggaggcggccgagcacgccgggtacgaacacctcgacaacctcaccgcgatcgtcgacgtcaaccgcctcggccagcgcggcccgacccgccacgagtggcgcctggccgcctacgccgaccgcttcgccgcctccggctggcacgtcgtcgagatcgacgggcacgacatcgacgacatcggccgcgcctacgacgaggccgcgtccaccgcgggccagcccaccgtgatcctcgcgcgcaccctcaagggcaagggtgtcgccgccgtcgaggaccgcgagggcctgcacggcaagccgctgcgggaccccgaagcggcgatccaggaactgggcggggtgcgcgacgtccgcgtcgaggtgcgcgaacccgccgccgcgcgcgcgatgcacgccgtgcgcagcggacacctggaactgccgcgccacgaggtgggcgacgccgtggccacccgcaccgcctacggccaggcgctcgccgcgctcggcaccgcgcgcggcgacgtcgtcgccctggacggcgaggtcggcgactcgacccgggccgagtacttcgccaaggagcaccccgaccgcttcttcgagtgctacatcgccgagcagcaactcgtcgcggccgccgtcgggttggcggcgcgcggctgggtgccgtacgcgtcgacgttcgccgcgttcctcacccgcgcccacgatttcgtccgcatggcggcgatcagcggcgcgggaatcaacctggtcggctcgcacgcgggcgtggccatcggccaggacggcccctcccagatgggcctggaggacctggcggtcttccgcgccgtgcacggctccaccgtcctctacccgtgcgacgcccaccagacggggcgcctggtggcggagatggcggggctcgaaggggtgcgctatctgcgtacgtcgcgcggcgacacacccgtcatctacggtcccggcgaggagttccccgtcggcggctccaaggtcctgcgcgccagcgacgcggaccgcctcaccgtcgtcgccgccggggtgaccgtccacgaggcgctggccgccgcggagacgctcgacggcgcgggcatccaggtccgcgtcatcgacctgtactcggtcaagcccgtcgacaggacgaccctgcgcgaggcggccgagcgcaccggctgtctgctcaccgtcgaggaccacaggcccgagggcggcatcggtgacgcggtgctcgacgcgttcaccgacggcaggccggtgccgcgcctggtacggctcgcggtgcggaggatgccgggctcggcctcgcccgccgaacagttgcgcgcggcgggcatcgacgccgactcgatcgcggcggcggcgcggctcctcgtggagcagggggtggtgcggtga

SEQ ID NO: 10251 - protein, 616 aa, Streptomyces kanamyceticus
MTSISELADVARQLRVDSIRAAAAAGSGHPTSSMSAADLMAVLIGGHFRYDFERPAHPGNDRFILSKGHASPLLYAAYKAAGALTDEELLTFRKEGSRLEGHPTPRALPWVEVATGSLGQGLPVGVGMALSGKRLDRIPYRVWVLCGDSELAEGSVWEAAEHAGYEHLDNLTAIVDVNRLGQRGPTRHEWRLAAYADRFAASGWHVVEIDGHDIDDIGRAYDEAASTAGQPTVILARTLKGKGVAAVEDREGLHGKPLRDPEAAIQELGGVRDVRVEVREPAAARAMHAVRSGHLELPRHEVGDAVATRTAYGQALAALGTARGDVVALDGEVGDSTRAEYFAKEHPDRFFECYIAEQQLVAAAVGLAARGWVPYASTFAAFLTRAHDFVRMAAISGAGINLVGSHAGVAIGQDGPSQMGLEDLAVFRAVHGSTVLYPCDAHQTGRLVAEMAGLEGVRYLRTSRGDTPVIYGPGEEFPVGGSKVLRASDADRLTVVAAGVTVHEALAAAETLDGAGIQVRVIDLYSVKPVDRTTLREAAERTGCLLTVEDHRPEGGIGDAVLDAFTDGRPVPRLVRLAVRRMPGSASPAEQLRAAGIDADSIAAAARLLVEQGVVR

SEQ ID NO: 10252 - DNA, 1986 bp, Streptococcus salivarius
  CDS (1)..(1986): transl_table=11
atgacttttgatgcaattgaccaaatggcggtcagcactattcgttcgctttcgatcgaggcaattcaagccgcgaattctgggcacccaggtcttcctatgggtgcagcgccaatggcttatgtgctttggaaccatgtgatgaatgttaatccaaagactagccgtaactggacaaaccgtgaccgttttgttctttctgctggtcatggttctgccttgctttatagtctattgcacctttctggctatgatgtaacaatggatgacttgaagaatttccgtcaatggggatctaagactccaggtcaccctgaagttaaccatactgatggtgttgaagcaacatcaggtcctcttggtcaagggattgctaatgctgtaggtatggcaatggctgaagcacacttggcagctaaatttaacaaacctggttttgatattgttgaccattatacttatgctctccatggcgatggttgtttgatggaaggtgtttcgcaagaagctgccagtcttgctggtcaccttaaacttggtaagttggtacttctttacgattcaaatgatatctcacttgatggaccaacttcaatggctttcactgaagatgttaaggctaagtttgaagcttatggttggcaacacattcttgtcaaagatggtaatgatttggaagctattgctaaagccatcgaagaagctaaggctgagacagataaaccatctatcattgaagttaagacaatcattggttatggagctgaaggacaaggaacatcagctgtccacggtgctccaatcggtcaagatggcattgatcacgcaaaaggtgtgtacggttatgatgcaccggcatttacagttccagatgaagttgctcgtcgttttgaagctggtattaaattccgtggtgaagctgctgaaaatgcttggcaaactaaatttgcagaatatgaaagtgcttacccagaattggctgctgaatacaaggctgcctttgcaaatgaacctgtacacgttgacttgaatgctcatgaattgggttcagcagtagctagccgtgtatcaagccaacaagctatccaacagatttctgagcaagttccttcattctggggaggttcagcagacctttcagcttctaacaatactatggttaaggctgagtctgatttccaagcagacaactatgctggacgtaatatttggtttggtgtgcgtgaatttgctatggctgcagcgatgaatggtattgctcttcatggtggtactcgtgtttatggtggtaccttcttcgtcttctcaaactacttgcttccagcagtacgtatggcagctcttcaaaacctgccagtaacttatgtaatgacacacgactcagtagcagttggtgaagatggacctactcacgaaccaatcgaacaattggcaagtgtgcgttcaatgcctaaccttaacgttatccgtcctgcagatggtaatgaaactaatgctgcatggaaacgtgccttggctgagactgaacgtccaacaatgctagtcttgacacgtcaaaacttgccagtccttgatggtactgctgaaaatgctgaaactggtgtcaataaaggagcttacatcatctcagaagcaaacggtgatcttgatggtatcatcattgcaactggttctgaagtgaaattggctcttgatacgcaggctgctcttgaagctgaaggtgtgcatgttcgtgttgtttcaatgccatcacaaaacctctttgatgaacaagatgctgcatataaagaagaagtccttccagcagctgtgacaaaacgtttggctatcgaagctggaactagctttggttggggcaaatacgttggtcttgcaggtaaaatacttactattgatacttggggtgcctcagcacctggtgaccgtatctttaaagaatatggtttcactgttgaaaatgcaagtcaactttacaaatcattgtaa

SEQ ID NO: 10253 - protein, 661 aa, Streptococcus salivarius
MTFDAIDQMAVSTIRSLSIEAIQAANSGHPGLPMGAAPMAYVLWNHVMNVNPKTSRNWTNRDRFVLSAGHGSALLYSLLHLSGYDVTMDDLKNFRQWGSKTPGHPEVNHTDGVEATSGPLGQGIANAVGMAMAEAHLAAKFNKPGFDIVDHYTYALHGDGCLMEGVSQEAASLAGHLKLGKLVLLYDSNDISLDGPTSMAFTEDVKAKFEAYGWQHILVKDGNDLEAIAKAIEEAKAETDKPSIIEVKTIIGYGAEGQGTSAVHGAPIGQDGIDHAKGVYGYDAPAFTVPDEVARRFEAGIKFRGEAAENAWQTKFAEYESAYPELAAEYKAAFANEPVHVDLNAHELGSAVASRVSSQQAIQQISEQVPSFWGGSADLSASNNTMVKAESDFQADNYAGRNIWFGVREFAMAAAMNGIALHGGTRVYGGTFFVFSNYLLPAVRMAALQNLPVTYVMTHDSVAVGEDGPTHEPIEQLASVRSMPNLNVIRPADGNETNAAWKRALAETERPTMLVLTRQNLPVLDGTAENAETGVNKGAYIISEANGDLDGIIIATGSEVKLALDTQAALEAEGVHVRVVSMPSQNLFDEQDAAYKEEVLPAAVTKRLAIEAGTSFGWGKYVGLAGKILTIDTWGASAPGDRIFKEYGFTVENASQLYKSL

SEQ ID NO: 10254 - DNA, 1977 bp, Streptococcus vestibularis
  CDS (1)..(1977): transl_table=11
atgtctaacctttcagtaaatgctatccgttttctaggggtagatgcgattaaccaagctaactctggtcaccctggtgtggtaatgggtgcagcaccaatgggttacactttgtttactaagcaaattcatgtcaatcctgaagttccaaattggattaatcgtgaccgttttgttttgtcggcaggtcatggttcaatgcttctttatgcgctccttcatttgtcaggatttaaagatttgagtattgaagagcttaaacaattccgtcaatggggttctaagacacctggtcacccagaatttggtcatacagttggtgtagatgctacctcaggtccacttgggcaaggtattgctacagctgttggtatggcacaagcggagcgtttcttggcttctcgttacaacaaggaaggtttcccaatctttgaccattatacttatgttattgcgggggatggttgctttatggaaggcgtttctggcgaagcgtcatcttatgctggtcttcaaaaattggataaattgattgtcttgtacgattcaaatgatatcaaccttgacggtgaaactaaagattcatttactgaagacgtacgtgcacgttatgaagcctatggttggaatactgagtttgttcaagatggaacggatgttgaagctatcaatgctgctattgaaagtgcaaaagcaagtggtaaaccatctttgattgaggttaagactgttattggtcatggtgctcctaataaacaaggaaccaacggtgttcacggtgctcctcttggaccagatgaaacagcagctgcaagagaaaacttgggttggaactatgctccatttgaagttccaaaagaagtttatgctgatttcaaggaaaatacagttgatcgtggtcgtcaggcctatgacgcttggattgctttggtagatgagtacaaacaatcttacccagaacttggtgctgaacttgaacgcattcttgaaggtaaggatgcagttgaattccaagcttcagacttcccagctcttgaaaatggttattcacaagcaactcgtaattcaagtcaagatgctttgaatgttatcgctgataaagtgccaacattcctaggtggttctgcggatttggctcactcaaatatgacttacattaaatctgacggtctacaagatgatgcacatcgtcttaaccgtaacattcaatttggtgtacgtgagtctgcgatgggaacagtcttgaatggtatgtctctccatggtggacttcgtgtttacggtggtaccttcttcgtattctcagactatgtaaaagcagcagttcgtttgtctgcacttcaaggacttccagttacttatgtctttactcacgactctattgcagtcggtgaagatggaccgactcatgaaccaatcgaacatctagctggacttcgtgctattccaaaccttaatgtttatcgtccggcagatgcgcgtgaaacacaagctgcatggtatcaagctgtaacttctaaatcaacacctacggcgcttgttttgacacgtcaaaacttgactgttgaagaaggaacagattttgataaagtctcaaaaggtgcttatgttgttcatgaaacagcagcagattttgatactattctccttgcttctggttcaaaagtaaatcttgcagtagcatcagcaaaagctttggaatcagaaggttacaaagttcgtgttgtgagtgttccatcaacagatgtctttgatgcacaagatcaagcctacaaagaggaagttcttccaaatgcagttcgtcgtcgtgtagcaatcgaaatggcagcaagtctaccatggtataaatacgttggtttagacggtgctgtgattggaattgatacatttggtgcctcagctccagctgctaaaattattgaagaatatggctttacagtagaaaatgtcgttgaaacagtaaaaggtatgaactaa

SEQ ID NO: 10255 - protein, 658 aa, Streptococcus vestibularis
MSNLSVNAIRFLGVDAINQANSGHPGVVMGAAPMGYTLFTKQIHVNPEVPNWINRDRFVLSAGHGSMLLYALLHLSGFKDLSIEELKQFRQWGSKTPGHPEFGHTVGVDATSGPLGQGIATAVGMAQAERFLASRYNKEGFPIFDHYTYVIAGDGCFMEGVSGEASSYAGLQKLDKLIVLYDSNDINLDGETKDSFTEDVRARYEAYGWNTEFVQDGTDVEAINAAIESAKASGKPSLIEVKTVIGHGAPNKQGTNGVHGAPLGPDETAAARENLGWNYAPFEVPKEVYADFKENTVDRGRQAYDAWIALVDEYKQSYPELGAELERILEGKDAVEFQASDFPALENGYSQATRNSSQDALNVIADKVPTFLGGSADLAHSNMTYIKSDGLQDDAHRLNRNIQFGVRESAMGTVLNGMSLHGGLRVYGGTFFVFSDYVKAAVRLSALQGLPVTYVFTHDSIAVGEDGPTHEPIEHLAGLRAIPNLNVYRPADARETQAAWYQAVTSKSTPTALVLTRQNLTVEEGTDFDKVSKGAYVVHETAADFDTILLASGSKVNLAVASAKALESEGYKVRVVSVPSTDVFDAQDQAYKEEVLPNAVRRRVAIEMAASLPWYKYVGLDGAVIGIDTFGASAPAAKIIEEYGFTVENVVETVKGMN

SEQ ID NO: 10256 - DNA, 2013 bp, Candidatus Kuenenia stuttgartiensis
  CDS (1)..(2013): transl_table=11
atgaaaataagcgccatacaaaaagaaacagcagaacttgcagtcaatacattaaaaatgctttccgccgacgcagttgaaaaggcgcaatcagggcatccgggattgcctatggggtgtgcggatgttgcgtttgttctttggacacagtttttacaatttaatccggaagacccgaattggcccaaccgggaccggtttatcctttccgcaggccatggttctatgctgctctattccttattgcacctctatggatatgacctgtcgctggatgaaataaaacaattccggcagcttaacagtaaaacaccgggacatccggaatacggccatacccctggcgtggaagtcactacaggccctttggggcaaggatttgcaaatggcgttggaatggcaatagcagaacgtttgcttgcggcacggtttaataaagttggcaaaaaaattatcggtcacaccatttacggggttgtaagcgatggagatctgatggaaggaatttcctccgaggctgcttccattgcggggcatcttgggctttccaacattatctacctttacgacaacaaccacatcacgatagagggaaacacctcacttgcttttacagaagacgtggcaaaacgttttgaagcatactcatggaaggtttttaaaattgacgggcacaatcataatgaaattgcgaatgccatacaatctgctcaaaatgaaaaagaaagaccctctcttattatcgcgacaacccatattggaaaagggagtccgaataagcagaacaatgcgtccgctcacggggagccgcttggagaaaaagaacttgcattaacaaaggaaaatatcggctggccaaaaaccccgactttttacattcccgatgaagtaaggcaactatgtgctaaccgtgtaaaagagttaaaagatgtttacgaaaactggcaaaatgcctttcatacccgcttaaaagaggatccggatttttccggagagtggaatgcttatatgaataaagctatcccggacaaccttgaatctaagctgcttgagaccatcaaaaaagattcagtcgcaacaagggctgcttccggagatatgatgcagataattgcacagcaaataccgtccttcatcggcggctctgccgatcttaacccctccactaaaacgtttattaaggggtcgcctgccatcagcaaaaactcatttattggaaaaaatatccacttcggggttagagaacacgccatgggcgctgttctcaacggcatggcgctttatggcggcattattccccatggttccacgtttctgatattttccgactacatgagaccttctatccggcttgctgcgttgatgaagcttcaggtaatttatgtatttacccatgacagcatatttctcggagaagacggcccaacgcatcagccgattgaacagctaccctccttgaggcttattccaaacctgttgacaataaggccttcggacgcaaccgaaacggctgcggcctggataacggcgctgaatcacaaaaacggtccaacagcactgatacttacccgccagaatattccggttattgaccgctctgtgtatccttcgtcagagggattaaaacacggcgcctacatactaaaggattccatgggtactccggatataatcctcatggcgtctgggtccgaggtatcaatcgcccttgaagcaacactaaaactgcaggaaaagggcgttgctgcacgtctcgtaagctttccttgtttagaattattcaggaacaacccggaggcatataaagacaatatccttccaccgtcatgtacaaggcgtgtctccattgaagcagcggcaaaaggaatctggcatgaatttactggcatcaatggccttatcatcggaattgaccactttggtgcatctgctcccgcaaaggccctggcagaacactttggatttaccacaaaaaatattttaaatgagattgaaaaaaagtggggtatataa

SEQ ID NO: 10257 - protein, 670 aa, Candidatus Kuenenia stuttgartiensis
MKISAIQKETAELAVNTLKMLSADAVEKAQSGHPGLPMGCADVAFVLWTQFLQFNPEDPNWPNRDRFILSAGHGSMLLYSLLHLYGYDLSLDEIKQFRQLNSKTPGHPEYGHTPGVEVTTGPLGQGFANGVGMAIAERLLAARFNKVGKKIIGHTIYGVVSDGDLMEGISSEAASIAGHLGLSNIIYLYDNNHITIEGNTSLAFTEDVAKRFEAYSWKVFKIDGHNHNEIANAIQSAQNEKERPSLIIATTHIGKGSPNKQNNASAHGEPLGEKELALTKENIGWPKTPTFYIPDEVRQLCANRVKELKDVYENWQNAFHTRLKEDPDFSGEWNAYMNKAIPDNLESKLLETIKKDSVATRAASGDMMQIIAQQIPSFIGGSADLNPSTKTFIKGSPAISKNSFIGKNIHFGVREHAMGAVLNGMALYGGIIPHGSTFLIFSDYMRPSIRLAALMKLQVIYVFTHDSIFLGEDGPTHQPIEQLPSLRLIPNLLTIRPSDATETAAAWITALNHKNGPTALILTRQNIPVIDRSVYPSSEGLKHGAYILKDSMGTPDIILMASGSEVSIALEATLKLQEKGVAARLVSFPCLELFRNNPEAYKDNILPPSCTRRVSIEAAAKGIWHEFTGINGLIIGIDHFGASAPAKALAEHFGFTTKNILNEIEKKWGI

SEQ ID NO: 10258 - DNA, 2016 bp, Candidatus Kuenenia stuttgartiensis
  CDS (1)..(2016): transl_table=11
ttgaacaacatgaaccctaaaacaggaacacttgaacagcagggtatcaatacggttcggatactcgctgcagatgccgtacaaaaagcaaattcaggtcatcccggaacacccatggggcttgcatccgttggccatgttctgtgggcgcaaatcatgaactataatccccagaatccagcatgggcaaacagagaccgctttattttatcctgcggccatgcctgcatgttgcagtatagttttttgtacttaacgggttatcccatcacgctcgacgatatcaaaaaattccggcaattacacagtaaaacagcggggcatcctgaatacggattgttacccggtattgaagtaacgaccggcccgctagggcagggatttgccaacggcgtagggtttgccattgcacaaagatatatggcagcccgctacaataaacctggttttgatatttttaattataaggtttatgctatttgcagcgatggcgatattatggaaggtattagttctgaagctgcttctatagccggacatcttcagttaggcaacatgatttatttgtacgacgataaccatataactattgaaggcaataccgatcttgcatttgatgaagacgtggcaaaacgctttgaagcgtatggctggcatgttcaggagcttccggatggtaatgatttaggtgctttatcaacagcaataaaaaatgcgcaaaaggaaacagaccgtccttcactgataaaggtgcgcacacacattggttatggcagccccaacaaacaagatacggccgctgcacatggctctgccttaggcgaagcagaagtgaagctcgtgaaggagaattttggctttgaccctgataaacattttgttgtgcccgacgatgtattaaattattatcgtgaagcaggtaagaaaggaatagataaagaaaagaactggaacgatctttataaaaggtacaaagaaaaatatatcgaactatccaatgaatatgagttgttgagcagcggtaaattaccggaaggatgggaagagagggtgcctgtttttaaaactgaagaagaaatggcgacacgcaaagcctctggcaaagtgttaaatgcaatagccgattatttgccgaatttaataggcggctcggcggaccttgctccttctaccgacaccaacctggagaaatacaaatcatttttagcgacaaattatgatggtcgcaattttcactttggcatcagggaacacgccatgggcgctatcttaaatggattagtgcttagtaaatacctcattccttacggggctacattcctggtattctccgattacatgcggccacccatccggctggcagcgattatgaaaatacggcccatatatgtttttacacacgacagcatagcgttaggagaagatggcaccacccaccagcccgtagaacaactcatcggtttgcgatcagttcccaacctaacagtaattcgcccggcagacgccaatgaaaccgtgcaagcctggcggatagcaattgaacattccggtggaccagttgcattaattttaactcgccagaaaattccggtaatcgaccaggaaaaatatacaaaggcgattgaattggaaaagggggcttacattctttcggaatcaaaaacacagcccgacattattttaattggtacgggttcggaagtgcagttgctgctggcagctcagcaaagattaaaagaagaaaacatcgccgcacgtgtggtaagcatgccatcgtgggaactattcgaaaaacaggataaaacttataaagaaaagatatttcccgcctcattgcggaaacgactggcagtagaagccggatcacctttgggctggcttaaatatgtaactgaccagggcgacatcatcggcatcgacagatttggagaatctgctcctggtgaagaggtgatgaaagaatatggctttactgtggaaaatgtagtaaaaagagcgaaagctttgattgaataa

SEQ ID NO: 10259 - protein, 671 aa, Candidatus Kuenenia stuttgartiensis
MNNMNPKTGTLEQQGINTVRILAADAVQKANSGHPGTPMGLASVGHVLWAQIMNYNPQNPAWANRDRFILSCGHACMLQYSFLYLTGYPITLDDIKKFRQLHSKTAGHPEYGLLPGIEVTTGPLGQGFANGVGFAIAQRYMAARYNKPGFDIFNYKVYAICSDGDIMEGISSEAASIAGHLQLGNMIYLYDDNHITIEGNTDLAFDEDVAKRFEAYGWHVQELPDGNDLGALSTAIKNAQKETDRPSLIKVRTHIGYGSPNKQDTAAAHGSALGEAEVKLVKENFGFDPDKHFVVPDDVLNYYREAGKKGIDKEKNWNDLYKRYKEKYIELSNEYELLSSGKLPEGWEERVPVFKTEEEMATRKASGKVLNAIADYLPNLIGGSADLAPSTDTNLEKYKSFLATNYDGRNFHFGIREHAMGAILNGLVLSKYLIPYGATFLVFSDYMRPPIRLAAIMKIRPIYVFTHDSIALGEDGTTHQPVEQLIGLRSVPNLTVIRPADANETVQAWRIAIEHSGGPVALILTRQKIPVIDQEKYTKAIELEKGAYILSESKTQPDIILIGTGSEVQLLLAAQQRLKEENIAARVVSMPSWELFEKQDKTYKEKIFPASLRKRLAVEAGSPLGWLKYVTDQGDIIGIDRFGESAPGEEVMKEYGFTVENVVKRAKALIE

SEQ ID NO: 10260 - DNA, 2109 bp, Bifidobacterium breve
  CDS (1)..(2109): transl_table=11
atgaccgaattcaaggagaccgagctcgacgagcgcgccatcaagatggcgaaggccctttcggctgacgcggtggagaacgccggttccggccaccccggttcccccgtttccctggcgcccatcgcctacacgctgtaccagcatttcatcaagcacgatccgaacgatcccaactgggagggccgtgatcgcttcatcctttccggtggccacgcctccctcacccagtacgtccagctgtacttctccggttatggcctgaccctggacgacctcaagcacttccgtggtggcgctgacacccgtaccccgggtcaccccgagtacggcctgacccccggtatcgaaatgaccaccggcccgctgggccagggcttcgcttccgccatcggctttgcctacggcgagcgtttccagcgtggtctgctcgatccggaaaccccgaaggaagactccccgttctaccacaagatttgggctatctgcggtgaaggcgatatcgaagagggcatctccggcgaagccgctgcccttgccgccaaccagaagctcggcaacgtcaccgtgatcttcgacgccaaccgcatccagatcgaaggcgacaccaacctggtgctggccgaggatgtgctcaagcgtttccaggcctacggctggtacaccgacgagttcagcttcatccagcccgacggctcctacaaggaggacgtcgagggtctggccgacgttatcgccaaggccgaggccgctgctccggatcagccgaagctcatcaaggtcgacaccctgattgcttggccgaccccgggcaagaccaacgatccgtcctctcacggctccaagctgggcgccgaggccgttgccggcctcaaggaagtcctcggctacgatccggcagagaacttccacgttgacgaagaggctctggctcacgcccgcaaggttgctgagcgcggtctcgaggcccacaaggaatgggacgagaagttcgacgcatggcgcaaggccaacccggacaaggctgccctgtacgaccgcatcaaggccggcgagctgccggaaggcttcgacaaggccatcgatgaccttgaggccaccttcgaggtcggaaagggtgtcgccacccgtggcgcctccggctccgtgctcaatgccatcgccgctgtcatgccggaactctggggtggctccgccgacctcggtggctccaacaagaccgacctcaagggcgctgccaccttcgctccggctgagtgcgccaccaagcagtggccggtctgcaacgagttcggtcgtcagctgcacttcggcgtgcgcgagttcaccatgggttgcatcaccaacggcatcctgctaggctcccacacccgtccgttcggcggcaccttcttcatgttctccgactacgagcgttccgccgttcgtctggccgccctcatggagatcccgaacctgtacgtgtggacgcacgactccgtcgccgtcggcgaggatggcccgacccaccagccggttgagcaccttgcttccttccgcgctatcccgcagcttgaggtcgttcgcccggccgatgccttcgagaccgccgaagcctaccgctacttcttcgagaagaagaacacgctgccggctgccatggtgctgtcccgtcagggcgtcccggttctcgccgagaccgctgccaaggccaaggacggtgtccgcaagggcgcttacgtcctggtcgacaccgaaggcactccggatgtcatcctgatggccaccggttccgaagtccagctggccgtcaaggccgccaagaccctcgctgaggaaggcgtcaaggcccgcgtggtctccgtgccgtccctcgaatggttcgaggagcaggacgccgagtacaaggaggccgtgcttcctgccggtgtcaaggctcgcgtctccgtcgaggccggcgttgccatgccgtggtacaagtacctcggttcctacggcaagcctgtctccatcgagcagttcggtctgcagggcgacggtgctcagaacctcatcgacctcggcatcaccgccgagcacgtggtggaagccgccaaggcctccatcgccgaagtcgaagccgccaagtga

SEQ ID NO: 10261 - protein, 702 aa, Bifidobacterium breve
MTEFKETELDERAIKMAKALSADAVENAGSGHPGSPVSLAPIAYTLYQHFIKHDPNDPNWEGRDRFILSGGHASLTQYVQLYFSGYGLTLDDLKHFRGGADTRTPGHPEYGLTPGIEMTTGPLGQGFASAIGFAYGERFQRGLLDPETPKEDSPFYHKIWAICGEGDIEEGISGEAAALAANQKLGNVTVIFDANRIQIEGDTNLVLAEDVLKRFQAYGWYTDEFSFIQPDGSYKEDVEGLADVIAKAEAAAPDQPKLIKVDTLIAWPTPGKTNDPSSHGSKLGAEAVAGLKEVLGYDPAENFHVDEEALAHARKVAERGLEAHKEWDEKFDAWRKANPDKAALYDRIKAGELPEGFDKAIDDLEATFEVGKGVATRGASGSVLNAIAAVMPELWGGSADLGGSNKTDLKGAATFAPAECATKQWPVCNEFGRQLHFGVREFTMGCITNGILLGSHTRPFGGTFFMFSDYERSAVRLAALMEIPNLYVWTHDSVAVGEDGPTHQPVEHLASFRAIPQLEVVRPADAFETAEAYRYFFEKKNTLPAAMVLSRQGVPVLAETAAKAKDGVRKGAYVLVDTEGTPDVILMATGSEVQLAVKAAKTLAEEGVKARVVSVPSLEWFEEQDAEYKEAVLPAGVKARVSVEAGVAMPWYKYLGSYGKPVSIEQFGLQGDGAQNLIDLGITAEHVVEAAKASIAEVEAAK

SEQ ID NO: 10262 - DNA, 2055 bp, Aspergillus oryzae
  CDS (1)..(2055)
atgggttacactgatttggatcaattggctatcaacacgatccgtgttctcgcggtcgatgccacctccaaggccaactccggtcaccccggtgcccctatgggcatggcccccgtttctcacgtcctcttcaacaagttcatgaacttcaacccccagaaccccgactgggttaaccgtgatcgctttgttctctctaacggccacggttgcatgctccaatatgctcttctccacctcttcggctaccagctctctctggatgacctgaagaacttcagacaactcgacagcatcacccccggtcaccccgaggctcacgacacccccggtgttgaggtcaccaccggccccctgggtcagggtttctccaacgctgttggtctggctattgcccaggctcacactgccgctatctacaacaagcccggctacgatctcatcaacaactacacatacaccttcttcggtgatggctgtgctatggagggtgttgccagcgaggctgcctctttggctggtcacctgaagcttggtaacctcattgccatctacgatgacaaccatatctccatcgacggtgacaccaagtgtgctttcactgaggatgtcatgaagcgtttcgagtcctatggctggcaccacgtctgggtcaaggacggtgacaatgaccttgaggccattgagaaggccatccaggagtgccgtgaggttaaggacaagccctccgttatccgtttgaccaccaccatcggtttcggttccaagctgcagggcaccggtggcgttcacggtaaccccctgaaggctgacgatgccgagagtgttaaggccaagttcggcttcgaccccaagcagagcttcgtcgtcccccagcaggtctacgacctctaccacaagactgcttctcagggtgctgctaaggagcaggagtggaaccagctcttcgagaagtacgcctctgagtacaaggatgagcacgctgacctcactcgtcgtcttgctggcaagcttcctgagggttgggagaagagcctgcccacctacaagcccaccgaccccgctgtcgcctcccgtaagctgtccgaggccgtcctggagaaggtccacagtgtcatccccgagctgctttccggctctgctgatctgactggctccaacaacacccgctggaagaacgccgtcgacttccagccccctgagtacaacattggtgactggtccggccgctacctccgctacggtgtccgtgagcacgccatggctgctatcatgaacggtcttgctgcctacggtaccgtcatccccgctgccggtaccttcctgaacttcgtctcctacgctgccggtgccgtccgtctgtccgctctctcccgcgttcgcgtcatccacgtcgctacccacgactccatcggtctgggtgaggacggtcctactcaccagcctattgagaccctagctcacttccgtgctctccccaactgcatggtctggcgtcccgctgatggcaacgagaccagtgctgcctactactctgctctcacctctaagcacacccccagcattctggcccttacccgtcagaacctgccccagcttgagaattccagcattgaggctgctctgaagggtgcgtacgtcgccattgaggcccccaacgctgccgttaccatcatctccaccggttccgaggtcagcatcgccatcgaggctgccacctacctcaaggagaaccacaacgttgttgcccgtgtcgtctccgttccttgcttcgaggtcttcgatgcccaggacaaggactacaagctcaaggtcctccccgacggtatccccgtcctctccgtcgaggctgcctccaccatgggctgggagcgttacgctcacgagcagttcggtctcaaccgcttcggtgcctccggcccttacaagcaggtctacgagaaattcgagttcacccctgccggtatcagcaagcgcgccctcgctaccatcgacttctacaagggccaccccgtgcgctcccccatcaaccgtgctttccagcagattctgtag

SEQ ID NO: 10263 - protein, 684 aa, Aspergillus oryzae
MGYTDLDQLAINTIRVLAVDATSKANSGHPGAPMGMAPVSHVLFNKFMNFNPQNPDWVNRDRFVLSNGHGCMLQYALLHLFGYQLSLDDLKNFRQLDSITPGHPEAHDTPGVEVTTGPLGQGFSNAVGLAIAQAHTAAIYNKPGYDLINNYTYTFFGDGCAMEGVASEAASLAGHLKLGNLIAIYDDNHISIDGDTKCAFTEDVMKRFESYGWHHVWVKDGDNDLEAIEKAIQECREVKDKPSVIRLTTTIGFGSKLQGTGGVHGNPLKADDAESVKAKFGFDPKQSFVVPQQVYDLYHKTASQGAAKEQEWNQLFEKYASEYKDEHADLTRRLAGKLPEGWEKSLPTYKPTDPAVASRKLSEAVLEKVHSVIPELLSGSADLTGSNNTRWKNAVDFQPPEYNIGDWSGRYLRYGVREHAMAAIMNGLAAYGTVIPAAGTFLNFVSYAAGAVRLSALSRVRVIHVATHDSIGLGEDGPTHQPIETLAHFRALPNCMVWRPADGNETSAAYYSALTSKHTPSILALTRQNLPQLENSSIEAALKGAYVAIEAPNAAVTIISTGSEVSIAIEAATYLKENHNVVARVVSVPCFEVFDAQDKDYKLKVLPDGIPVLSVEAASTMGWERYAHEQFGLNRFGASGPYKQVYEKFEFTPAGISKRALATIDFYKGHPVRSPINRAFQQIL

SEQ ID NO: 10264 - DNA, 2127 bp, Aspergillus oryzae
  CDS (1)..(2127)
atggctgttggtccggttactatcaacggcagcggcaaatctgccctgccgctggttcagcaaatgtccaaagaccatgacattgtgctgaagacattccgtatgctcatttcggacttatgccagcagttcggaggaggtcaccctggtggcgccatcggtatggccgctatcggtgtcgctctctggcgctatgtgatgcgctatgctcctcacacccccgatttcttcaaccgcgatcgctttattctctcgaatggccatacctgtctattccagtactccttcctgcacttgaccgggtacaaggctatgacctttgaccaactcaaatcctaccactcggatcgcgtcgatgcactttgtcctggccaccctgagatcgaacacgagggcatcgaagttactacaggacccctgggtcagggtgttgctaacgccgtcggtttggcgatggcgaccaagaacttggctgcgaagttcaatcaaccaggatacgatgttgtaaacaaccacacctggtgtatgattggagatgcgtgtctgcaggagggtgttggattggaagctatttcgtatgcgggtcatctgaagcttaacaacctgactatcatctacgacaacaaccaaatcacctgtgatggatcagtcgatctgaccaacactgaagacattaacggcaagatgcgcgcttctgggtgggacgtgattgacgtcgaggacggttgctacgatgtcgagggtcttgtgcgggctctggaacaggctcgcgcctccacagagaagccaaccttcatcaacgtccgcacagtcattggccttggtagcaatgttgccggtcaggccgcagcccacggtgctgcattcggagctcccaacgtggcgcagatgaagaaggagaacgggttcaacccggacgagcactttgttatcggagagacggtacggaagtttttcgaagatcttcctgcgcgtggtgaatctctcgtccaggaatggaaggaccttgtgaagcaatataccgctcaataccctgagcttggcgcagaattccagcgccgcatgagcggagagttgccgtccaactggaaggacctgatccctgccagcttcccagagaagcctaccgcttcacgagcctcgtctggcttggtcttcaaccccattgctaaggagattgagaacttcatggtcggcactgctgacctctcgccctccgtaaacatgatctggcctggaaaggtagacttccaacaccctgatctgcgcaccacttgcggcatcaacggcaactacggcggtcgctatatccactatggtgtgcgtgaacacgccatgtgcgctatctctaacggcttggccgcctatgcccctaacaccttcatccccatcacctcatccttcttcatgttctacctctacgctgctcccgctgtgcgcatgggcgcattgcagcacctccagatcatccacgccgccacacacgactccatcggtatgggtgaggatggcccgacccatcagcctatcgaactggccgcattataccgtgccatgccaaaccttctctatatccgcccgggtgatagcgaagaaaccgccggtgcctggatcgccgccatcgaagccaagaagacacccaccatcatctccacttcccgtcacactctgccccaattgaagcaaacctctcgcgacagtgtcgcgcgcggtgcatatgtcctcgaagaggccgagaatgcagctgttaccctcatcggtgtgggtgcagaattgtccttcgccctggaggtcgccaacaagctcaaggagaagggcgtcgtcgcgcgggtggtcagtttcccctgccagcgtttgttcgagcaacaatccctcgaatacaagcgctctgttctgcagaggcaccgtggtattcctgctgttgttatcgagccttatgcacctaacggctgggagcgatatgcggacgctggcgtctgcattaagcgctttggtcacagtttgcctggcaaggtggcgtacaagtacttcggttatgacattgataccttgaccgagaaggttcacggttatctgggacaggttgagaaggatgaactcttgaagcatgagtttgttgagctgtga

SEQ ID NO: 10265 - protein, 708 aa, Aspergillus oryzae
MAVGPVTINGSGKSALPLVQQMSKDHDIVLKTFRMLISDLCQQFGGGHPGGAIGMAAIGVALWRYVMRYAPHTPDFFNRDRFILSNGHTCLFQYSFLHLTGYKAMTFDQLKSYHSDRVDALCPGHPEIEHEGIEVTTGPLGQGVANAVGLAMATKNLAAKFNQPGYDVVNNHTWCMIGDACLQEGVGLEAISYAGHLKLNNLTIIYDNNQITCDGSVDLTNTEDINGKMRASGWDVIDVEDGCYDVEGLVRALEQARASTEKPTFINVRTVIGLGSNVAGQAAAHGAAFGAPNVAQMKKENGFNPDEHFVIGETVRKFFEDLPARGESLVQEWKDLVKQYTAQYPELGAEFQRRMSGELPSNWKDLIPASFPEKPTASRASSGLVFNPIAKEIENFMVGTADLSPSVNMIWPGKVDFQHPDLRTTCGINGNYGGRYIHYGVREHAMCAISNGLAAYAPNTFIPITSSFFMFYLYAAPAVRMGALQHLQIIHAATHDSIGMGEDGPTHQPIELAALYRAMPNLLYIRPGDSEETAGAWIAAIEAKKTPTIISTSRHTLPQLKQTSRDSVARGAYVLEEAENAAVTLIGVGAELSFALEVANKLKEKGVVARVVSFPCQRLFEQQSLEYKRSVLQRHRGIPAVVIEPYAPNGWERYADAGVCIKRFGHSLPGKVAYKYFGYDIDTLTEKVHGYLGQVEKDELLKHEFVEL

SEQ ID NO: 10266 - DNA, 2214 bp, Aspergillus oryzae
  CDS (1)..(2214)
atggcacctacgctggagctcctcgaggagcctgccgggaatctgccggtcaaggcagtctcagccatccgcaatgggaattctgccgatgacctcaaactagaaagcccagagaagcatcaacgggtgatgaatgttttcagagccttcattgctgatatctgccagcaatatggcgaaggccacgctggatctcccatgggcatggctgccattggtattgccctatggaagtatgtcatgaagtactctccaaacaactgcaactacttcaaccgggaccgctttgttctttcgaacggccatgcctgcttgtggcagtaccttttcctgcaccttgttggcgtcaagagcatgacactcgagcagttgaagtcttaccactcaacgaagctcgactcggtctgtcctggccaccccgaaattgagaatgagggcatagaggtcacaactgggcccctcggtcagggtctcgccaatgcagttggccttgccatggccactaaaaaccttgccgcgacatacaacaagcctggccacgaggtggtaaataatatgacgtggtgcatggtcggtgacgcttgtattcaggaaggtgttggtctcgaggcactctccctcgctggtcactggaggctaaacaatctctgtgttatatttgacaacaactcggttacgtgtgacggaaccgcggacgttgccaacaccgaggatatcaacaccaagatgcgggctactggttacaacgtggtagatgtgtataatggagactcggacgttgctgccatcgtaaacgcccttgttgccgctcgatcgagcgacaagccaacctttatcaacattcgcaccacgattggcttcggatctgctctggccggcacggccgacgtacacggagctgccctcggagtcgatgaagtggccaacgtcaagaggtcgttcggtctcaaccccgacgagcacttccacatcccccaggacgtctacgatttcttcagtgacatccctggccgtggcgaagcccacgaggcgagctggcaagcggccctggtgaagtatcatgaggaagaccccgtactggccgctgaattcgagctccgtgtcatggggaaattgcctgaggattggtccaaatgtattcctcgcaaagaagagcagcctactgcatccacagcctcacgaaagtccgccggcgtcattaccaacgcccttggacagaatatcaattcattcttagtcggtacagcggatctgactccctcggtcaatgtcgcatacaaaaacaaggttgacttccaatctcctgaactccgaacagcctgcggcctgaatggaaactacagcggtcgatacatccactacggtatccgcgagcacgccatgtgcgccatctccaacggactagctgccttcaacaaaggcaccttcatccccatgacaagcacatactttgtcttccacttatacgccgccgccgctgtgcgcatggcggcgctccaaggcctccaacaaatccacatcgccactcacgacagcatcggtgttggcgagaatggccctacgcaccaacccgtcgccgttgctgccctttaccgcgccatgcccaatgttctttacatccgtccatgcgacgccgaagaagtagctggcgcctacatcgccgccatccaggccactgagacgcctactattatctccctctcccgtcaaggcctgacccagtacccgcaatactcctcgcgcgagggcacacttaagggcgcctacgtcttcgtcgaggacaacgatttcgatgtgactttaatcggagtcgggtccgagatgggcttcgcaatgcagactcgggagttgcttttcaaggaacacggtatcaaatcacgggttgtttccttcccttgcattaggcttttcgagcagcagtcgcgcgaatacaagcattcggttttgaagccgcgtgctggaaagcccactgttgttatcgaggcgtatccgtcttacggatgggaacgctatgctgatgcgtcggtgtcgatgaatagctttgggaagagtcttccttcaaaggagatatatgagcactacggattttcaccggagagcatcgcgcctaaagttaaggatctagtggaggaagtcaggcgcgatggtattgagatcctgaggggcgactttagggatttcaatggtggtctgcggattggtcttgagcattag

SEQ ID NO: 10267 - protein, 737 aa, Aspergillus oryzae
MAPTLELLEEPAGNLPVKAVSAIRNGNSADDLKLESPEKHQRVMNVFRAFIADICQQYGEGHAGSPMGMAAIGIALWKYVMKYSPNNCNYFNRDRFVLSNGHACLWQYLFLHLVGVKSMTLEQLKSYHSTKLDSVCPGHPEIENEGIEVTTGPLGQGLANAVGLAMATKNLAATYNKPGHEVVNNMTWCMVGDACIQEGVGLEALSLAGHWRLNNLCVIFDNNSVTCDGTADVANTEDINTKMRATGYNVVDVYNGDSDVAAIVNALVAARSSDKPTFINIRTTIGFGSALAGTADVHGAALGVDEVANVKRSFGLNPDEHFHIPQDVYDFFSDIPGRGEAHEASWQAALVKYHEEDPVLAAEFELRVMGKLPEDWSKCIPRKEEQPTASTASRKSAGVITNALGQNINSFLVGTADLTPSVNVAYKNKVDFQSPELRTACGLNGNYSGRYIHYGIREHAMCAISNGLAAFNKGTFIPMTSTYFVFHLYAAAAVRMAALQGLQQIHIATHDSIGVGENGPTHQPVAVAALYRAMPNVLYIRPCDAEEVAGAYIAAIQATETPTIISLSRQGLTQYPQYSSREGTLKGAYVFVEDNDFDVTLIGVGSEMGFAMQTRELLFKEHGIKSRVVSFPCIRLFEQQSREYKHSVLKPRAGKPTVVIEAYPSYGWERYADASVSMNSFGKSLPSKEIYEHYGFSPESIAPKVKDLVEEVRRDGIEILRGDFRDFNGGLRIGLEH

SEQ ID NO: 10268 - DNA, 2067 bp, Propionibacterium freudenreichii subsp
  CDS (1)..(2067): transl_table=11
atgagcgacctgaagtggactgacgaagatcgcgaggcggtcaacatcgcccgcacactggccgcggatgccgtggaggcagccggcagtggccaccccggaacggcgatctcgctggcaccgctggcttatctgctgtatcagaaggtgatgaacgtcgaccccgacgacgagcactggatcggtcgcgaccgcttcctgctgtcggccgggcatgcctcggtgctgcagtactcccagctctacctgggcggtctcggccttgagctggaagacctcaagtacctgcgccaggcgggctcgcggactcccggccaccccgagtacggccacacgaagttcatcgaggccaccaccggcccgctgggcgccggcatctcgatggccgtcggcatggccatggccgcccgtcgcgagcgcggcctgtacgacccggacaacaccggcgccagcgtgttcgaccgctacgtctactcgatcgccggcgacggctgcatgcaggaaggcgtgcagtccgaggccgcgtcgctggccggcgtgcaggagctcggcaacctcatcgtcttctacgacgacaaccgcatcaccatcgaggggaagacccgcatcgccttcgatgaggacgtcgaggcccgctacgccgcctacagctgggatgtgcagcacatcgactggaccaacggtggcgaccactacgaagagaacgtgcaggccctgttcgacgccatcgaggcggccaagaaggtcaccgacaagccgagcctgatccgcctcaccacggtgatcggctggccgctgccccatatggccggcagtgcccatgtgcacggcgccgccatcggcgaggacgagatcaacgccatgaagaaggtgatcggattccccaccgagcccttcaccttcaaccaggacatcgttgccgacacccgcaaggccctggccgagcgcggcaggagcgcccgggccgcctgggacgagcgcttcgcggcatggcagggctcgcatgcggagcaggccgcactgctcgaccgcgtgctggcccgcaagctgcccgacgacctgcaggtgcccagcttcgaggccggtgcggtgagcacccgcaaggccagtggcaaggtgatctcggccctggccgagcagctgcccgagctgtggggcggctccgccgacctcgccggctcgaacaacaccacgatcgagggtgccgagagcttcctgcccgccgaccgcgccaccgatgagtggcccggcaacccctacggacgcgtgttgcacttcggcatccgtgagcatgcgatgggtggtgccctcaacggcatcaacctgtcgggcctcacccgtgccttcggtggcaccttcttcgtgttcgccgactacatgcgtcccccggtacgcctggcggccctcatgggcgcgccctcggtgttcgtgtggacgcacgactcggtcggcgtcggcgaggacggccccacccaccagccggtggagcacctggccagctaccgcgccattccgggcctggacatcgtgcgcccggccgatgccaacgagacggccgccgcgtgggtcgagatcctgtcgcaccacgatcgtccggccggcatcgtgctgacgcgccagaatgtgcgcaccgtcgaccgcacctcgggtgagttcgcctccaccgacggcgtcgccaagggtgcctatgtgctgcgcgaggcccgcaacggcaagcccgaggtgatcctgatcgccaccggttccgaggtggagccggcactggacgcccaggacatcctggagacccagggcattgccacccgcgtggtgtcgatgccgtgccaggaatggttcgacgcccagcccgcggagtaccgcgaagaggtgctgccctccagcatcgacgcccgtgtgagcgtcgaggcggggctgtcgctcggctggtcgaagtacgtcggcttcaagggcgcctcggtgagcctggagcactacggtgcttcggccaagggctcgctgctcatggaggagttcggcttcaccggcgagcacgtggccgaggtcgccaagggcgtgctcggtaagtga

SEQ ID NO: 10269 - protein, 688 aa, Propionibacterium freudenreichii subsp
MSDLKWTDEDREAVNIARTLAADAVEAAGSGHPGTAISLAPLAYLLYQKVMNVDPDDEHWIGRDRFLLSAGHASVLQYSQLYLGGLGLELEDLKYLRQAGSRTPGHPEYGHTKFIEATTGPLGAGISMAVGMAMAARRERGLYDPDNTGASVFDRYVYSIAGDGCMQEGVQSEAASLAGVQELGNLIVFYDDNRITIEGKTRIAFDEDVEARYAAYSWDVQHIDWTNGGDHYEENVQALFDAIEAAKKVTDKPSLIRLTTVIGWPLPHMAGSAHVHGAAIGEDEINAMKKVIGFPTEPFTFNQDIVADTRKALAERGRSARAAWDERFAAWQGSHAEQAALLDRVLARKLPDDLQVPSFEAGAVSTRKASGKVISALAEQLPELWGGSADLAGSNNTTIEGAESFLPADRATDEWPGNPYGRVLHFGIREHAMGGALNGINLSGLTRAFGGTFFVFADYMRPPVRLAALMGAPSVFVWTHDSVGVGEDGPTHQPVEHLASYRAIPGLDIVRPADANETAAAWVEILSHHDRPAGIVLTRQNVRTVDRTSGEFASTDGVAKGAYVLREARNGKPEVILIATGSEVEPALDAQDILETQGIATRVVSMPCQEWFDAQPAEYREEVLPSSIDARVSVEAGLSLGWSKYVGFKGASVSLEHYGASAKGSLLMEEFGFTGEHVAEVAKGVLGK

SEQ ID NO: 10270 - DNA, 1902 bp, Oryza sativa subsp
  CDS (1)..(1902)
atggggtgcgcgcccatggggcacatcctctacgacgaggtcatgcggtacaaccccaagaacccctactggttcaaccgcgaccgcttcatcctctccgccggccacggctgcatgctccagtacgccctgctccacctcgccggctacgacgccgtcttggaggaggacttgaagcaattcaggcaatggggaagcaagactccaggccatcccgagaacttcgagacgcccggagttgaagttaccactggacctcttggtcagggtattgcaaatgcagttgggctggcccttgctgagaagcacctggctgctcgtttcaacaagcccgacagcgagattgttgatcactacacctactgtattttgggagatgggtgccagatggagggtatctccaatgaagcttgctcgttggctggccattggggtcttggcaagctgattgcattctatgatgacaaccacatttccattgacggagacacagagattgcattcactgaggatgtgagtgctcgctttgaggctcttgggtggcatacaatctgggttaagaatggaaacgatggctatgatgagattcgtgccgccattaaggaagcaaaggcggtaactgacaagccaacactaatcaaggtgaccaccacaatcggttttggatcacccaacaaggccaactcatacagcgtccacggaagtgctttgggtaccaaagaggttgaagcaaccagagagaaccttggatggccctatgagccattctttgtgcctgaggatgtgaagagccactggagccgccatgtgcctcaaggtgctgcttttgaggctgactggaatgctaagttcgccgagtatgagaagaagtacccagaagatgcagcgaccttgaagagcattgtctcaggggagttgcctgctggctgggctgacgctcttcctaaatacactccagagagccctgcagatgccaccaggaatctgtcacagcagtgcttaaacgcacttgctaaagttgttcctggtcttcttggaggaagtgctgatcttgcatcctccaacatgacattgcttaagatgttcggtgacttccagaaggatacgcctgaggagcgcaatgtccgatttggagtcagggagcatggaatgggcgccatttgcaacggcattgctctgcacagcccaggactcattccatactgtgctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattctgatgcttcgtcctgctgatggtaacgagactgctggggcatacaaaatcgcggtcctcaacaggaagaggccatccgtccttgctctctccaggcaaaagcttgctcagctgcctggtacctcgattgagggtgttgagaagggtgggtacatcgtctctgacaactcaactggcaacaagcctgacttcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaa

SEQ ID NO: 10271 - protein, 633 aa, Oryza sativa subsp
MGCAPMGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 10272 - DNA, 2064 bp, Xanthobacter flavus
  CDS (1)..(2064): transl_table=11
atgaccgcccacgccgctgcactcgccgctgccgacgctccggcgcctgtcgaccgttctcccggcgcgctcggctggccggttacggcggccctgcgcgccctcgccatggacggcgtggagcaggcaaaatcgggccatcccggcgcgcccatgggcatggccgagatcgccgccgtgctctggcgcgagcatctgcggcataatccggcagatccctcctggcccgaccgcgaccgcttcgtgctctccaacgggcacggctccatgctgatctacgcgctgcttcacctcaccggctacgatctgcccatcgccgagctgaagcgcttccgccagctgcattcgcgcacccccggccatcccgaactcggcatgacgccgggcgtggagaccaccaccggtccgctcggccagggccttgccaatgcggtgggcatggccatcgccgaaaagacgctggccgcccagttcaaccggccgggcctctccatcgtcgatcaccgcaccttcgtcttcctcggcgacggctgcttgatggagggcgtgagccacgaggcgtgctcgctggccgggcgcctcggcctcggcaagctcgtcgccttctatgacgacaacggcatctccatcgacggcaaggtggaagagtggttcccggacgacacccccgcccgcttcgccgcctatggctggcacgtgatccgcaacgtggacggccacgatccggccatgctgcgcgatgcggttgaggcggctctgtccgagaccggcaagccgacgctgatctgctgcaagaccaccatcggccgtggcgcgcccaccaaggaaggccaccaggacacccacggcgccccgctcggcgccgaggagatcgcccgcacccgcgccgccatgggctgggaccacgcgcccttcgaggtgcccgaggacatctacgccctgtgggatgcccgccgttccggcgcggcccgccagtcggcctgggacgcgcgcatggaagcctatgagcgcgcctatccggcggaagcggccgaattccgccgccggctcaaaggagacctctcccccgccttcgctgcgacctacgcggcggccctgaaggccaccgtggagaaggccgagacggtggcgacccgcaaggcgagccagctggcccttgccgccctcgctccggcggtgccggaattcctgggcggctcggcggacctcgcccactccaacctcaccaccttccccggcgccgtgccgatcacccgcgatcccgccggcaaccagatcttctacggcgtgcgcgaattcggcatgtcagccatcgccaacggcatcgccctgcacggcgggttcatccccttcgtcgccaccttcctcgtgttctcggattacgcccgcaacgccatgcgcatgagcgcgctcatgggccagcgggtcatctacatcctcacccacgattccatcggcctcggcgaggacggccccacccaccagccggtggagcatgtggagagcctgcgcctcatccccaacctcgacgtgtggcgccccgccgacacggtggagacgctggccgcctggcacgccgccttgacacgcacgaatggcccgagcgccttcatcctgtcgcggcagaacctgccgtgctggccgcgtgacgcggcgcagatcgaaggtatcgaggccggtgcctacgtgctgcgcgagagcgagggcctcgcccgtgccgtgctcgtcgccaccggctcggaagtgaagctggcagcggcggcggcggacctgctcgacaccgcgggcattcccacccgcatcgtctccatgccctgccgcgagcgtttcgaggcgctgaccgagaccgagcgcgcggccctcttccccaagggcgtgccggtggtggcggtggaagcgggcgtcacccgcggctggcgcggcctctccggcacccgcgccgacggcatcatcgccatcggcatcgaccgcttcggcgaatcggcgccggaaaaggacctgtggccgctgttcggctttacaccggaagctgtggccgacgcggtgcgccgcgcggtagggtga

SEQ ID NO: 10273 - protein, 687 aa, Xanthobacter flavus
MTAHAAALAAADAPAPVDRSPGALGWPVTAALRALAMDGVEQAKSGHPGAPMGMAEIAAVLWREHLRHNPADPSWPDRDRFVLSNGHGSMLIYALLHLTGYDLPIAELKRFRQLHSRTPGHPELGMTPGVETTTGPLGQGLANAVGMAIAEKTLAAQFNRPGLSIVDHRTFVFLGDGCLMEGVSHEACSLAGRLGLGKLVAFYDDNGISIDGKVEEWFPDDTPARFAAYGWHVIRNVDGHDPAMLRDAVEAALSETGKPTLICCKTTIGRGAPTKEGHQDTHGAPLGAEEIARTRAAMGWDHAPFEVPEDIYALWDARRSGAARQSAWDARMEAYERAYPAEAAEFRRRLKGDLSPAFAATYAAALKATVEKAETVATRKASQLALAALAPAVPEFLGGSADLAHSNLTTFPGAVPITRDPAGNQIFYGVREFGMSAIANGIALHGGFIPFVATFLVFSDYARNAMRMSALMGQRVIYILTHDSIGLGEDGPTHQPVEHVESLRLIPNLDVWRPADTVETLAAWHAALTRTNGPSAFILSRQNLPCWPRDAAQIEGIEAGAYVLRESEGLARAVLVATGSEVKLAAAAADLLDTAGIPTRIVSMPCRERFEALTETERAALFPKGVPVVAVEAGVTRGWRGLSGTRADGIIAIGIDRFGESAPEKDLWPLFGFTPEAVADAVRRAVG

SEQ ID NO: 10274 - DNA, 2268 bp, Gluconobacter oxydans
  CDS (1)..(2268): transl_table=11
gtgtttcgtccgggcgccaggcctctggatttcggtaatgacgcccgtcgaaatgtggcaggttgtcatcaagcacaagagcgtgtttcacaatatggtttaccaatcagccattgcgtccggcgcgacttcgcgtcatgccgtggcagcagatgcgggggatatcgttgcgtttcttcccgtcagtcacaagccggagaccccattccgatgagtacgcttccccaactcgccatcaatacgatccgtaccctttcgatggaaggtgtcgaacgcgccaattccggccatcccggcacggccatggcccttgctcccgcaatgtacgcggtgtggcagcatgacctgaaatacgatccggccgatccgtgctggccggcgcgtgaccgttttgtcctttcggtcggccatgcttcgatgctgctgtactccaccctgttcctgacgggcgtgaaggatatccgggacggcaaggtcgttgacgcaccgtcgctcactgtcgaggatctctcgcagttccgtcagttgaactccaagacgccgggccatccggaataccgctttaccgctggtgtcgagaccacgaccggtccgctcggccagggctgcggcaattccgtcggcatggcgatcgcgcagaagtggatgtccgcgcgctatgaccgtccgggcttcaagctgttcgactaccacgtgacggtgttctgtggtgatggcgacatgatggaaggcgtggcctccgaagctgcctccacggccgggcatcttgcgctggggaacctgacctggatctatgattccaatcagatttccatcgagggttcgacggatctggccttcacggaaaacgtgggcaagcgcttcgaggcctatggctggcatgtccagacgctgacagacggcaacgatgtcgacgccattctggcagcactgaaggctgcacgcgcggtgacggaccgtccgagcctgatcgttctcaagacggtcatcggctatggtgcgcccaagaaggccggtacggcgtcggcacatggcgagccgctgggtgcggacgagatcaagggtgcgaagcaggcttatggctggccggaagatgctccggatttctacgtgccggacggcgtgaaggagcacttcgccgaaggcctcggcaagcgtggtgcggaagcccatgcggaatggcgcgagctgttctcggcctatcgtgaggcgcatccggaactggcagctgaaatcgattgcatcatcgagcatcgtctgccggaaggctgggacaaggacatcccgacgttcgacgccgatgcgaagggcattgcttcgcgtgcaagctccggtcaggtgctgaacgcggttgcgaagaacctgccctggatgatcggtggttctgctgacctgacgccgtccaccaagacggacaccaagggcggtggctccttccagccggaaaaatggaacggcagctatggcggccggaatatccatttcggtgtgcgcgaacatgcgatgggttcgatctgcaacggcatcgcgctgtcggggatccgcgcttacggttcgggcttcctgatcttctccgattacatgaaggccccgatccgtctgtcggccatcatggaactgccggttctgtacatcttcacgcatgactccatcggtgtgggtgaagacggaccgacgcatcagccgatcgagcagcttgcccagctgcgtgccacgccgggcatcatgacgatccgtccgtccgacgccaatgaagtggctgaagcctggcgcacgctgatcccgatgacgcacaagccggccgtgctggccctgagccgtcagaacctgccgacgatcgaccgcacgaaatatgcctccgccgccggtctggcgaaggggggctatgtgctggcgagctgtgagggcaagccggacgtcatcctgattgcttcgggttcggaagtcagcctcgtggttgcggcttacgagaagctgacggaagagggcatcaaggcccgcgtgatctccatgccgagcttcgacctgttcgaagagcagagccaggaataccgcgattccgtgctgccgcctgacgtgatcggtcgcgtggcggtcgagcaggctgcggccttcggctgggatcgttatgtcggtctgggtggcgcgatcatcgccatgaacacgttcggtgcgtcggctccggcctcggcactgcttacgaaattcggtttcacgcctgaggcggtctatgacgcggcgaagcgtcaggccctgcgcggcaagtaa

SEQ ID NO: 10275 - protein, 755 aa, Gluconobacter oxydans
MFRPGARPLDFGNDARRNVAGCHQAQERVSQYGLPISHCVRRDFASCRGSRCGGYRCVSSRQSQAGDPIPMSTLPQLAINTIRTLSMEGVERANSGHPGTAMALAPAMYAVWQHDLKYDPADPCWPARDRFVLSVGHASMLLYSTLFLTGVKDIRDGKVVDAPSLTVEDLSQFRQLNSKTPGHPEYRFTAGVETTTGPLGQGCGNSVGMAIAQKWMSARYDRPGFKLFDYHVTVFCGDGDMMEGVASEAASTAGHLALGNLTWIYDSNQISIEGSTDLAFTENVGKRFEAYGWHVQTLTDGNDVDAILAALKAARAVTDRPSLIVLKTVIGYGAPKKAGTASAHGEPLGADEIKGAKQAYGWPEDAPDFYVPDGVKEHFAEGLGKRGAEAHAEWRELFSAYREAHPELAAEIDCIIEHRLPEGWDKDIPTFDADAKGIASRASSGQVLNAVAKNLPWMIGGSADLTPSTKTDTKGGGSFQPEKWNGSYGGRNIHFGVREHAMGSICNGIALSGIRAYGSGFLIFSDYMKAPIRLSAIMELPVLYIFTHDSIGVGEDGPTHQPIEQLAQLRATPGIMTIRPSDANEVAEAWRTLIPMTHKPAVLALSRQNLPTIDRTKYASAAGLAKGGYVLASCEGKPDVILIASGSEVSLVVAAYEKLTEEGIKARVISMPSFDLFEEQSQEYRDSVLPPDVIGRVAVEQAAAFGWDRYVGLGGAIIAMNTFGASAPASALLTKFGFTPEAVYDAAKRQALRGK

SEQ ID NO: 10276 - DNA, 2226 bp, Arabidopsis thaliana
  CDS (1)..(2226)
atggcttctacttcttccctcgctctctctcaagctctcctagctcgtgcaatctctcaccatggttctgaccaacgtggatctttaccagctttctctggactcaaatccaccggttcacgcgcctcagcttcgtctcgtcgacgtatcgctcaatccatgaccaaaaaccgatctctccgtcctcttgttcgcgctgcagctgttgagactgttgagccaaccactgattcgtcgattgtggacaaatcggtcaactcgattaggtttttggctatcgatgcggtggagaaggccaaatcaggtcatcctggtcttcctatgggttgtgctccgatggctcacattttgtatgatgaggtcatgaggtataaccccaagaacccttattggttcaaccgtgaccgattcgttctatctgctggacatggatgtatgttgctctacgcgttgcttcatcttgccggctacgacagcgtccaggaggaagatttgaagcagttccgtcaatggggaagcaagacaccaggacatcctgagaatttcgagactcctggaattgaagtcactactggtcctcttggacaaggaatcgctaatgctgttggtttagctcttgctgagaagcatttggctgctagattcaacaaacctgatgctgaagtagtcgaccactacacatatgcgatccttggagatggttgtcagatggagggtatttctaatgaagcttgctctctagctggccattggggacttggaaagctcattgctttctacgatgacaatcacatttctatagatggagacacagaaattgccttcactgagaacgtggaccagcgatttgaagcccttggatggcatgttatctgggtgaagaatggaaacactgggtatgacgagatccgtgctgccattaaggaagctaaaactgttactgacaagcctactttgatcaaggtcactactaccattggttatgggtctcccaacaaggcgaactcatacagtgtccatggagctgcacttggcgagaaggaagttgaggctaccagaaataaccttggatggccgtatgagccgttccaggtacctgacgatgtaaaaagccactggagtcgtcatacacctgaaggagctactcttgaatctgactggagtgcaaagtttgcagcatatgaaaagaagtacccagaggaagcttctgagttgaaatctattatcactggtgaattacctgctggctgggagaaggctctacctacatacacaccagagtctccaggtgatgccaccagaaacctgtcacagcaatgtcttaacgcccttgctaaagttgttcccggtttccttggtggaagtgctgaccttgcatcatccaacatgacattgctgaaagcctttggcgacttccaaaaggccacacctgaagaaagaaatgttaggtttggtgttagggagcacggaatgggagccatctgcaatggcattgcccttcacagccccggtcttatcccttactgtgcgacgttctttgtcttcaccgactacatgagaggtgccatgagaatctcagctttgtctgaagctggtgttatctatgttatgacccatgattccattggtcttggagaagatggaccaacccatcagcccattgagcacattgcaagtttccgtgctatgcccaacactcttatgttccgtcctgctgatggaaatgaaacagccggtgcatacaagatcgctgtcaccaagcgcaagacaccatctatcttagctctgtctaggcaaaagctgcctcatcttccaggtacatccatcgaaggagtggaaaagggtggatatacaatttctgacgactcttcaggcaacaaacccgatgtgatcttgattggaactggttctgagctagagattgctgcacaggctgcggaggtgctcaggaaagacggcaaaaccgttagagttgtttctttcgtgtgctgggaactatttgacgagcaatcagatgaatacaaggagagtgtgttgccatcggatgtatcagctagagttagcattgaagcagcttcgactttcggatggggaaagattgttggaggcaaaggaaagtccattggtattaattcattcggagccagcgcaccagcacccttactctacaaggagtttggtatcaccgttgaagctgttgttgatgcggccaagtcattcttctaa

SEQ ID NO: 10277 - protein, 741 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNVRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 10278 - DNA, 2055 bp, Aspergillus niger
  CDS (1)..(2055)
atgggttacaacgacgtggaccaattggccatcaacaccatccgcactctcgcggttgatgccaccttcaaggccaactccggtcaccccggtgcccctatgggcatggcccccgtgtcccacgtccttttcaacaagttcatgagcttcaacccccaaaatcccgactgggctaaccgtgaccgcttcgttctctccaacggccacggctgcatgctccaatatgctctccttcaccttttcggctaccaggtctccatggatgacctgaagtccttcagacaactcgacagcatcacccccggtcaccccgaggctcacgacacccccggtgttgaggtcaccactggtcccctgggccagggtttcgccaacgccgttggtcttgctattgccgagcgtcactccgctgctgtcttcaacaagcccggctacaccctcttcaacaactacacatactgcttcttcggtgatggctgcgccatggagggtattgccagcgaggccgcctccatggctggtcacctgaagctcggtaacctcattgctatctacgacgacaacggaatctccatcgacggtgacaccaagtgcgccttcactgaggatgttatgaagcgttttgagccgtacggctggcacaccgagtacgtcaaggacggtgaccacgacctcgagggcattgaggctgctatcaagaagtgccaggctgtcactgacaagccctccgtcattcgtctgactactaccatcggtttcggttccaagctccagggtactggcggtgtccacggtaaccccctgaaggctgacgactgcgagggcgtcaagcagctcttaggcttcgaccccaagcagaccttcgtcgttccccagcaggtctacgacctctaccacaagcacgccgctgagggtgctgctaaggagcaggagtggaaccagctcctccagaagtacgcttctgagtaccccaaggagcacgctgagctcacccgccgtctctccggcaagcttgccgagggctgggagaagagcctgcccgtctacaagcccaccgacgctgccgttgctacccgtaagctctccgaggctgtcctcgagaagatccacgatgtcgtccccgagcttctgtccggctctgccgacttgactggctccaacaacacccgctggaagaacgccgttgacttccagccccccgagtacaacatcggtgactggtccggccgctacctccgctacggtgtccgtgagcacgccatggccgctgtcatgaacggtcttgccgcctacggcaccgtcatccccgctggtggtaccttcctgaacttcgtctcctacgccgccggtgctgtccgtctgtcggccctctcccgtgtccgcaccatctacgttgccacccacgactccatcggtctgggtgaggacggtcctactcaccagcccattgagactctggctcacttccgtgctctgcccaactgcatggtttggcgccctgctgacggcaacgagaccagcgctgcctactactctgctctgacctccaagcacacccccagcattctggccctcacccgtcagaacctgccccagctcgaggcttccaccatcgagaaggccctcaagggtgcctacgttgccctcgaggcccccgacgctgccgtcaccctcatctccaccggttccgaggtcagcatctgtatcgaggctgccacctacctcaaggagaagcacggcatcgctgcccgcgttgtctccgttccttgcttcgaggtcttcgatgcccaggacaaggcctacaagctccaggtcctccccgacaacatccccgtcctctccgtcgaggctctcaccaccatgggctgggagcgctacgctcacgagcagttcggtctcaaccgcttcggtccctctggcccctacaaggatgtctacaagaaattcgagttcactcctgagggcattagcaagcgcgctgtcgccaccattgacttctacaagggtcacaccgtgcgctcccccatcaaccgtgctttccagcagattctgtaa

SEQ ID NO: 10279 - protein, 684 aa, Aspergillus niger
MGYNDVDQLAINTIRTLAVDATFKANSGHPGAPMGMAPVSHVLFNKFMSFNPQNPDWANRDRFVLSNGHGCMLQYALLHLFGYQVSMDDLKSFRQLDSITPGHPEAHDTPGVEVTTGPLGQGFANAVGLAIAERHSAAVFNKPGYTLFNNYTYCFFGDGCAMEGIASEAASMAGHLKLGNLIAIYDDNGISIDGDTKCAFTEDVMKRFEPYGWHTEYVKDGDHDLEGIEAAIKKCQAVTDKPSVIRLTTTIGFGSKLQGTGGVHGNPLKADDCEGVKQLLGFDPKQTFVVPQQVYDLYHKHAAEGAAKEQEWNQLLQKYASEYPKEHAELTRRLSGKLAEGWEKSLPVYKPTDAAVATRKLSEAVLEKIHDVVPELLSGSADLTGSNNTRWKNAVDFQPPEYNIGDWSGRYLRYGVREHAMAAVMNGLAAYGTVIPAGGTFLNFVSYAAGAVRLSALSRVRTIYVATHDSIGLGEDGPTHQPIETLAHFRALPNCMVWRPADGNETSAAYYSALTSKHTPSILALTRQNLPQLEASTIEKALKGAYVALEAPDAAVTLISTGSEVSICIEAATYLKEKHGIAARVVSVPCFEVFDAQDKAYKLQVLPDNIPVLSVEALTTMGWERYAHEQFGLNRFGPSGPYKDVYKKFEFTPEGISKRAVATIDFYKGHTVRSPINRAFQQIL

SEQ ID NO: 10280 - DNA, 2022 bp, Escherichia coli O6
  CDS (1)..(2022): transl_table=11
gtgcccttcatcatccgatctggagtcaaaatgtcctcacgtaaagagcttgccaatgctattcgtgcgctgagcatggacgcagtacagaaagccaaatccggtcacccgggtgcccctatgggtatggctgacattgccgaagtcctgtggcgtgatttcctgaaacacaacccgcagaatccgtcctgggctgaccgtgaccgcttcgtgctgtccaacggccacggctccatgctgatctacagcctgctgcacctcaccggttacgatctgccgatggaagaactgaaaaacttccgtcagctgcactctaaaactccgggtcacccggaagtgggttacaccgcaggtgtagaaaccaccaccggtccgctgggtcagggtattgccaacgcagtcggtatggcgattgcagaaaaaacgctggcggcgcagtttaaccgtccgggccacgacatcgtcgaccactacacctacgccttcatgggcgacggctgcatgatggaaggcatctcccacgaagtttgctctctggcgggtacgctgaagctgggtaaactgattgcgttctacgatgacaacggtatttctatcgatggtcacgttgaaggctggtttaccgacgacaccgcaatgcgtttcgaagcttacggctggcacgttattcgcgatatcgacggtcatgacgcggcatccatcaaacgcgcagtagaagaagcgcgcgcagtgactgacaaaccgtccctgctgatgtgcaaaaccatcatcggtttcggttccccgaacaaagccggtacccacgactcccacggtgcgccgctgggcgacgctgaaattgccctgacccgcgaacagctgggctggaaatacgcgccgttcgaaatcccgtctgaaatctatgctcagtgggatgcgaaagaagcaggccaggcgaaagaattcgcatggaacgagaaattcgctgcttacgcgaaagcttatccgcaggaagctgctgaatttacccgccgtatgaaaggcgaaatgccgtctgacttcgacgccaaagcgaaagagttcatcgctaaacttcaggctaatccggcgaagatcgccagccgtaaagcgtctcagaatgctatcgaagcgttcgggccgctgttgccggaattcctcggcggttctgcagacctggcgccgtctaacctgaccctgtggtctggttctaaagcaatcaacgaagatgctgcgggtaactacatccactacggtgtacgtgaattcggtatgactgcgattgccaacggtatctccctgcacggtggtttcctgccgtatacctcaaccttcctgatgttcgtggaatacgcacgtaatgccgtacgtatggctgcgctgatgaaacagcgtcaggtgatggtttacacccacgactccatcggtctgggcgaagatggcccgactcaccagccggtagaacagatcgcttctctgcgcgtgaccccgaacatgtctacatggcgtccgtgtgaccaggttgaatccgcagtagcgtggaaatacggcgttgagcgtcaggacggcccgactgcgcttatcctctcccgtcagaacctggcgcagcaggaacgtactgaagagcagctggcaaacatcgcgcgcggtggttatgtgctgaaagactgtgctggtcagccggaactgatcttcatcgcgaccggttctgaagttgaactggctgttgccgcctacgaaaaactgactgccgaaggcgtgaaagcgcgcgtggtttccatgccgtctaccgacgcattcgacaagcaggacgcggcttaccgtgaatccgtactgccgaaagcggttaccgctcgtgttgcggtggaagctggcattgctgactactggtacaagtatgttggcctgaacggtgctatcgtcggcatgaccaccttcggtgaatctgctccggcagagcagctgtttgaagagttcggcttcaccgttgacaacgttgttgcgaaagcaaaagcgctgctgtaa

SEQ ID NO: 10281 - protein, 673 aa, Escherichia coli O6
MPFIIRSGVKMSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKEFAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQIASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAEQLFEEFGFTVDNVVAKAKALL

SEQ ID NO: 10282 - DNA, 2067 bp, Escherichia coli O6
  CDS (1)..(2067): transl_table=11
ttgatcaacgcaaactggaagatcttcttgccgccaaactataaaccagccacggagtgttatatgtcccgaaaagaccttgccaatgcgattcgtgcactcagtatggatgcggtacaaaaagccaattctggtcatcccggcgcgccgatgggcatggctgatattgccgaagtgctgtggaacgattttcttaaacataaccccaccgacccaacctggtatgaccgtgaccgctttattctttccaacggtcacgcgtcgatgctgctctacagtttgctgcatctgaccggttacgacctgccactggaagaactgaagaacttccgtcagttgcattcgaaaacccctggtcacccggaaatcggctatacgccaggtgttgaaaccaccaccggtcctcttggacaaggtttggcgaacgccgtcgggctggcgatagcagagcgtacgctggcggcgcaatttaatcagccggatcatgaaattgtcgatcacttcacctatgtgtttatgggcgacggctgcctgatggaaggtatctctcacgaagtctgttcgctggcgggcacgctggggctgggcaagctgattggtttttacgatcacaacggtatttccatcgacggtgaaaccgaaggctggtttaccgacgatacggcaaaacgttttgaagcctatcactggcatgtgatccatgaaatcgacggccacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccgctgggggaagaagaagtagctctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgtcggatgagcggcggtttgccgaaggactgggagaaaacgactcagaaatatatcaatgagttgcaggcgaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccggcgggcaactacattcactacggggtgcgtgaatttggtatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggtctgggcgaagatggtccgacgcaccaggctgttgagcaactggctagtctgcgcttaacgccaaatttcagcacctggcgaccgtgcgatcaggtggaagcggcggttggctggaagctggcggttgagcgccacaacggaccgacagcactgatcctctcaaggcagaatctggcacaggtagaacgaacaccggatcaggttaaagagattgctcgtggcggttatgtgctgaaagacagcggcggtaagccagatattattctgattgccaccggttcagagatggaaatcaccctgcaagcggcagagaaattagcgggagaaggtcgcaatgttcgcgtagtttccctgccctcgaccgatattttcgatgcccaggatgagaaatatcgggagtcggtactgccttcaaatgtttctgcccgcgtggcagtagaagcgggtattgccgattactggtacaaatatgttggcctgaaaggggcaattgtcgggatgacaggttatggggaatcagctccggcggataagctgttcccgttctttggctttaccgccgagaatattgtggcaaaagcgcataaggtactgggagtgaaaggtgcctga

SEQ ID NO: 10283 - protein, 688 aa, Escherichia coli O6
MINANWKIFLPPNYKPATECYMSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEKYRESVLPSNVSARVAVEAGIADYWYKYVGLKGAIVGMTGYGESAPADKLFPFFGFTAENIVAKAHKVLGVKGA

SEQ ID NO: 10284 - DNA, 1995 bp, Photorhabdus luminescens
  CDS (1)..(1995): transl_table=11
atgaccactcgtaaaacccttgctaatgctattcgcttcctgagcatggatgctgtgcagaaagcaaaatcagggcaccctggcgcgcctatgggaatggctgatatcgctgaagttttatggcgtgattatttgaatcataacccaactgatccacattgggttgatcgtgaccgctttgtattatctaacggtcatggttctatgctgatttatagcctgttgcatctcaccggttatgatgtttccgttgatgatctgaaaaatttccgtcagttacactctaaaaccccaggccatcctgagtatggttatactccaggcgtagaaactacgacaggtcctttagggcagggaattgccaacgcagtaggttttgcgattgctgaacgcactctggccgcgcaatttaaccgtcctggtcatgagatcgttaaccataatacttatgcctttatgggtgatggttgtatgatggagggcatttctcatgaagtttgctctctggcgggtactttaaagctaggcaaattgattgctttctatgatgacaatggcatttccattgatggtcatgttgaaggctggtttacggatgatacggcaagccgttttgaagcttatggctggcatgtgattcgcggtattgatggccataatgcagcttcagttaaagctgctattgaagaagcacgtaaagttgctgataaaccttctctgttaatgtgcaaaacagttatcggttttggcgcgccaaccaaagcgggtacccatgattctcatggcgcgccattgggtgatgcggaaattgccgcgactcgtgaagcactggattggaattatccggcatttgagattccagcggacatctatgctgagtgggatgcaaaagaagctggcaatgtgaaacaagccgcttggaatgaaaaattcgctgcctatgaaaaagcttatcctgaattagctgctgaattcaaacgtcgtaccagtggcgaattaccggcagactgggaagctgaatccaaagcatttatcgaacagttgcaaaaaaatccggccaatattgccagccgcaaagcatcccagaatgccttggaagcgtttggcaaggtgttgcctgaatttatgggcggatctgctgatttggcgccaagtaaccttacgatgtggtcaggttctaagccattgaacgaagatctggctggtaactacatccattacggcgttcgtgagtttggcatgtcagccattatgaacggtatcgctctgcatggtggttttgtgccttatggcgcaactttcctgatgttcgttgaatatgcccgtaacgcagtgcgtatggcggcattgatgaaaattcgcagcatctttgtttacacccatgactcaatcggtttgggtgaagatggcccgactcatcagccggtagaacagcttgccagtttgcgtgtgacgccaaatctgagtacatggcgtccatgtgaccaggttgagtctgcggtggcgtggaaatatgctatcgaacgtaaaacaggtccatcagcgctgattttctctcgccagaatctggcacaacaagaacgcactgccgagcagttggctaatattgagaaaggggcttacatcctgaaagattgtcaggggcagccagaactgattctgatcgcaaccggttcagaaattgaattggcggtgagtgcttacaaccaattgactgaggaaggtcgccaggtacgcgtagtctcaatgccgtctactgatgcttttgataagcaagatgctgcataccgagaagcggttctgcctgctgtggtttcggcacgtgttgcaatcgaagcgggtatcgtcgattactggtttaaatatgtcggtataaatggcgctatcgttggtatggatacatttggtgagtcagcgcctgctgatcaactgtttaaagcgtttggtttcactgtagagaatgtggtcgctaaggctaaagctctgctgaaataa

SEQ ID NO: 10285 - protein, 664 aa, Photorhabdus luminescens
MTTRKTLANAIRFLSMDAVQKAKSGHPGAPMGMADIAEVLWRDYLNHNPTDPHWVDRDRFVLSNGHGSMLIYSLLHLTGYDVSVDDLKNFRQLHSKTPGHPEYGYTPGVETTTGPLGQGIANAVGFAIAERTLAAQFNRPGHEIVNHNTYAFMGDGCMMEGISHEVCSLAGTLKLGKLIAFYDDNGISIDGHVEGWFTDDTASRFEAYGWHVIRGIDGHNAASVKAAIEEARKVADKPSLLMCKTVIGFGAPTKAGTHDSHGAPLGDAEIAATREALDWNYPAFEIPADIYAEWDAKEAGNVKQAAWNEKFAAYEKAYPELAAEFKRRTSGELPADWEAESKAFIEQLQKNPANIASRKASQNALEAFGKVLPEFMGGSADLAPSNLTMWSGSKPLNEDLAGNYIHYGVREFGMSAIMNGIALHGGFVPYGATFLMFVEYARNAVRMAALMKIRSIFVYTHDSIGLGEDGPTHQPVEQLASLRVTPNLSTWRPCDQVESAVAWKYAIERKTGPSALIFSRQNLAQQERTAEQLANIEKGAYILKDCQGQPELILIATGSEIELAVSAYNQLTEEGRQVRVVSMPSTDAFDKQDAAYREAVLPAVVSARVAIEAGIVDYWFKYVGINGAIVGMDTFGESAPADQLFKAFGFTVENVVAKAKALLK

SEQ ID NO: 10286 - DNA, 2226 bp, Arabidopsis thaliana
  CDS (1)..(2226)
atggcttctacttcttccctcgctctctctcaagctctcctagctcgtgcaatctctcaccatggttctgaccaacgtggatctttaccagctttctctggactcaaatccaccggttcacgcgcctcagcttcgtctcgtcgacgtatcgctcaatccatgaccaaaaaccgatctctccgtcctcttgttcgcgctgcagctgttgagactgttgagccaaccactgattcgtcgattgtggacaaatcggtcaactcgattaggtttttggctatcgatgcggtggagaaggccaaatcaggtcatcctggtcttcctatgggttgtgctccgatggctcacattttgtatgatgaggtcatgaggtataaccccaagaacccttattggttcaaccgtgaccgattcgttctatctgctggacatggatgtatgttgctctacgcgttgcttcatcttgccggctacgacagcgtccaggaggaagatttgaagcagttccgtcaatggggaagcaagacaccaggacatcctgagaatttcgagactcctggaattgaagtcactactggtcctcttggacaaggaatcgctaatgctgttggtttagctcttgctgagaagcatttggctgctagattcaacaaacctgatgctgaagtagtcgaccactacacatatgcgatccttggagatggttgtcagatggagggtatttctaatgaagcttgctctctagctggccattggggacttggaaagctcattgctttctacgatgacaatcacatttctatagatggagacacagaaattgccttcactgagaacgtggaccagctatttgaagcccttggatggcatgttatctgggtgaagaatggaaacactgggtatgacgagatccgtgctgccattaaggaagctaaaactgttactgacaagcctactttgatcaaggtcactactaccattggttatgggtctcccaacaaggcgaactcatacagtgtccatggagctgcacttggcgagaaggaagttgaggctaccagaaataaccttggatggccgtatgagccgttccaggtacctgacgatgtaaaaagccactggagtcgtcatacacctgaaggagctactcttgaatctgactggagtgcaaagtttgcagcatatgaaaagaagtacccagaggaagcttctgagttgaaatctattatcactggtgaattacctgctggctgggagaaggctctacctacatacacaccagagtctccaggtgatgccaccagaaacctgtcacagcaatgtcttaacgcccttgctaaagttgttcccggtttccttggtggaagtgctgaccttgcatcatccaacatgacattgctgaaagcctttggcgacttccaaaaggccacacctgaagaaagaaatcttaggtttggtgttagggagcacggaatgggagccatctgcaatggcattgcccttcacagccccggtcttatcccttactgtgcgacgttctttgtcttcaccgactacatgagaggtgccatgagaatctcagctttgtctgaggctggtgttatctatgttatgacccatgattccattggtcttggagaagatggaccaacccatcagcccattgagcacattgcaagtttccgtgctatgcccaacactctaatgttccgtcctgctgatggaaatgaaacagccggtgcatacaagatcgctgtcaccaagcgcaagacaccatctatcttagctctgtctaggcaaaagctgcctcatcttccaggtacatccatcgaaggagtggaaaagggtggatatacaatttctgacgactcttcaggcaacaaacccgatgtgatcttgattggaactggttctgagctagagattgctgcacaggctgcggaggtgctcaggaaagacggcaaaaccgttagagttgtttctttcgtgtgctgggaactatttgacgagcaatcagatgaatacaaggagagtgtgttgccatcggatgtatcagctagagttagcattgaagcagcttcgactttcggatggggaaagattgttggaggcaaaggaaagtccattggtattaattcattcggagccagcgcaccagcacccttactctacaaggagtttggtatcaccgttgaagctgttgttgatgcggccaagtcattcttctaa

SEQ ID NO: 10287 - protein, 741 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQLFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 10288 - DNA, 1872 bp, Drosophila melanogaster
  CDS (1)..(1872)
atgtcgaacgctaagctggacagtaaggtcgttcagaacctgaaggacgtggcccaaaagctgcggatccactcgatcacctcgacgcaggcggccaagtcgggacatccgacgtcctgtgcctcgttggccgagataatgacggtgctgttctttcagcagatgcgcctaaatctgaagcatcctcgcgatccttccagcgatcgattggttctgtccaagggacatgctgcacccattctgtacgccgtttgggcggaggctggactcttcccggtggaggagctgcgaaatttgcgcaaggtggacagtgatctagagggtcatcccactccacggctgagtttcgtcgatgtgagcaccggatccctgggacagggcatctccgtggccgctggaatggcctatgtgggcaaacacctggacaaggccgactatcgtacatatgtgatcgtgggcgatggcgaggctaccgaaggagcagtctgggaatcgctccactttgccggccactactgcctggacaacctgtgcgtaatcttcgatatgaacaagatcttctgctcggacataggcactgaaatggaggtttatcgggagaggttggacgccttcgggttcaatgccctagtcttaaatggccacgatattgatgagctggccaaggccttcattaatgcggccagcacgaagggtaagcccacggctcttttagccaggacgactaagggaaaggactttctgggcatcgaaggaatcgaagaaatgcatgcacagccactgggtaagagggccgaatctgcaatcaagcatttgcagatgaaaatcgcaaatcccaacgtccgcctgacacccaaaaaggtgggaaagtgcggccacgcccccgaggtgcatattaacaatataatgctgtgcagtccgcccaattatcggctgggagattcggtagccccacgcttagcctacggaaccgccttggccaaaatcgctgctgataatcctcgggtaatagcccttgatggcgatacaaagaactcgacatatgcggacaaaatgaggaatgcatttccagagcgtttcatcgagtgcttcacagcacagcagaatctggtgggcgtggccgtgggagccacctgtcgacgtcgcactgtggccttcgtttcgacgtatgcgacctttttcacacgggcctttgatcagatccgcatgggcgcaatttcgcacacgaatgtgaacttcgcgggctcccactgtggctgcagcatcggcgaggatggtccctcccaaatgggactggaggacatagccatgttcaggagcattcccgggagcacggtcttctatcccacggacgcagtgagcacggagagggcggtggaactggctgccaatactaagggcgtgtgctacatccgcaccacgtatccgagcacaacggtgatctacaacaatgacgaggtgtttgccgtgggactgggcaaagtggtgcgccagaagccctcggatgaggtgctcctgattggagccggcgtcacattgtacgagtgcctggccgcagcggaaagattggaggaggattgcattacggcacgagtgatcgacccctttacagtgaagcccctcgatgtcggattaatcgtgaagcatggaaagctgtgtcgtggaagaatcgtcgtggtggaggatcattaccagcaaggcggattgggcgaggcggtcctcagtgctctggccgactatcgaaactttgtggtcaagcatctctatattaccactgtaccgagatcaggccctcctgctgttctgctggacatgtttggcgtctcctccagaaatatatacaaagcaagcctggccatcatgaagaagtga

SEQ ID NO: 10289 - protein, 623 aa, Drosophila melanogaster
MSNAKLDSKVVQNLKDVAQKLRIHSITSTQAAKSGHPTSCASLAEIMTVLFFQQMRLNLKHPRDPSSDRLVLSKGHAAPILYAVWAEAGLFPVEELRNLRKVDSDLEGHPTPRLSFVDVSTGSLGQGISVAAGMAYVGKHLDKADYRTYVIVGDGEATEGAVWESLHFAGHYCLDNLCVIFDMNKIFCSDIGTEMEVYRERLDAFGFNALVLNGHDIDELAKAFINAASTKGKPTALLARTTKGKDFLGIEGIEEMHAQPLGKRAESAIKHLQMKIANPNVRLTPKKVGKCGHAPEVHINNIMLCSPPNYRLGDSVAPRLAYGTALAKIAADNPRVIALDGDTKNSTYADKMRNAFPERFIECFTAQQNLVGVAVGATCRRRTVAFVSTYATFFTRAFDQIRMGAISHTNVNFAGSHCGCSIGEDGPSQMGLEDIAMFRSIPGSTVFYPTDAVSTERAVELAANTKGVCYIRTTYPSTTVIYNNDEVFAVGLGKVVRQKPSDEVLLIGAGVTLYECLAAAERLEEDCITARVIDPFTVKPLDVGLIVKHGKLCRGRIVVVEDHYQQGGLGEAVLSALADYRNFVVKHLYITTVPRSGPPAVLLDMFGVSSRNIYKASLAIMKK

SEQ ID NO: 10290 - DNA, 2031 bp, Corynebacterium glutamicum
  CDS (1)..(2031): transl_table=11
gtggacaccaaggctgtagacactgttcgtgtcctcgctgcagacgctgtagaaaactgtggctccggccacccaggcaccgcaatgagcctggctccccttgcatacaccttgtaccagcgggttatgaacgtagatccacaggacaccaactgggcaggccgtgaccgcttcgttctttcttgtggccactcctctttgacccagtacatccagctttacttgggtggattcggccttgagatggatgacctgaaggctctgcgcacctgggattccttgaccccaggacaccctgagtaccgccacaccaagggcgttgagatcaccactggccctcttggccagggtcttgcatctgcagttggtatggccatggctgctcgtcgtgagcgtggcctattcgacccaaccgctgctgagggcgaatccccattcgaccaccacatctacgtcattgcttctgatggtgacctgcaggaaggtgtcacctctgaggcatcctccatcgctggcacccagcagctgggcaacctcatcgtgttctgggatgacaaccgcatctccatcgaagacaacactgagatcgctttcaacgaggacgttgttgctcgttacaaggcttacggctggcagaccattgaggttgaggctggcgaggacgttgcagcaatcgaagctgcagtggctgaggctaagaaggacaccaagcgacctaccttcatccgcgttcgcaccatcatcggcttcccagctccaactatgatgaacaccggtgctgtgcacggtgctgctcttggcgcagctgaggttgcagcaaccaagactgagcttggattcgatcctgaggctcacttcgcgatcgacgatgaggttatcgctcacacccgctccctcgcagagcgcgctgcacagaagaaggctgcatggcaggtcaagttcgatgagtgggcagctgccaaccctgagaacaaggctctgttcgatcgcctgaactcccgtgagcttccagcgggctacgctgacgagctcccaacatgggatgcagatgagaagggcgtcgcaactcgtaaggcttccgaggctgcacttcaggcactgggcaagacccttcctgagctgtggggcggttccgctgacctcgcaggttccaacaacaccgtgatcaagggctccccttccttcggccctgagtccatctccaccgagacctggtctgctgagccttacggccgtaacctgcacttcggtatccgtgagcacgctatgggatccatcctcaacggcatttccctccacggtggcacccgcccatacggcggaaccttcctcatcttctccgactacatgcgtcctgcagttcgtcttgcagctctcatggagaccgacgcttactacgtctggacccacgactccatcggtctgggcgaagatggcccaacccaccagcctgttgaaaccttggctgcactgcgcgccatcccaggtctgtccgtcctgcgtcctgcagatgcgaacgagaccgcccaggcttgggctgcagcacttgagtacaaggaaggccctaagggtcttgcactgacccgccagaacgttcctgttctggaaggcaccaaggagaaggctgctgaaggcgttcgccgcggtggctacgtcctggttgagggttccaaggaaaccccagatgtgatcctcatgggctccggctccgaggttcagcttgcagttaacgctgcgaaggctctggaagctgagggcgttgcagctcgcgttgtttccgttccttgcatggattggttccaggagcaggacgcagagtacatcgagtccgttctgcctgcagctgtgaccgctcgtgtgtctgttgaagctggcatcgcaatgccttggtaccgcttcttgggcacccagggccgtgctgtctcccttgagcacttcggtgcttctgcggattaccagaccctgtttgagaagttcggcatcaccaccgatgcagtcgtggcagcggccaaggactccattaacggttaa

SEQ ID NO: 10291 - protein, 676 aa, Corynebacterium glutamicum
MDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSING

SEQ ID NO: 10292 - DNA, 1863 bp, Persicaria tinctoria
  CDS (1)..(1863)
atgaggtataaccccaaaaaccccttctggttcaaccgcgaccgctttgtcctctccgccggccatggctgtatgctccagtacgccctccttcacctcgctggctatgacagtgtcaaggaggaagatcttaagcagttcaggcaatggggaagcaagactcccggtcaccccgagaacttcgagacaatcggaattgaagtcaccactggaccccttggccaaggtattgccaatgcggttggtttggccctcgccgagaagcacttggcggcgagattcaacaagcccgacagcgagatcgtagaccactacacgtatgtaattcttggagatggttgccaaatggagggtattgcaaatgaggcttgctcacttgctggacactgggggcttggaaaactcattgctttctacgacgataaccacatatccatcgatggagacactgagattgcgtttactgagagcgttgacaagcgttttgaggcgttggggtggcatgttatctgggtcaagaatggaaacaccggttatgatgagatccgggctgccattgaggaagccaagaaagttaaagataagccaactatgatcaaggtgaccacgactatcggctttggctcacccaacaagtcgaactcttacagtgttcacggggctgcactgggagccaaggaggtggaggcgacgaggaagaacctcggttggccatatgagcctttccatgtcccagaagaagtcgaaaagcattggagtcgccatgtccctgaaggagctgctctcgaagccgagtggaatgccaagtttgcggaatacaagagcaagtacccgacagaagcagccgagttgaagagtatcatagagggcgaattccctgccggttgggagaaggcacttcctacttacacccccgaaagccccggtgatgcgacacgaaacctgtcacagacatgcctaaatgcccttgcgccagtcgtcccaggcctgctcggaggtagtgcagatcttgcttcttccaacatgacgctattgaagtcgttcggagacttccaaaaggacactcccgaggaacgtaatgtccgattcggtgtcagagaacacggaatgggtgccatctgcaacggcattgctctccacagcccgggattcgtcccctactgtgccacattcttcgtcttcaccgactacatgagaggcgcaataaggatatccgccctttccttggcaagggtcatctatgtcatgactcacgactccatcggtctaggagaggatggaccgacccaccagcccatcgagcacctggctagcttcagggcgatgccaaacatcttgatgatgcgcccagccgatgggaacgagacagctggttcatatagagttgctgtcctcaagaagcagacgccgtccatccttgctctctcgcggcaaaagctcccaaacctcccaggaacatccattgaaggtgtcgagaagggaggctacactatcaccgacaactctacagggaacaagccggatgtgatcctcatcggaacaggatcagagctggagatagcagccaaggccggagatgagcttaggaaagccgggaaggcggtgagggtggtgtcatttgtgtgctgggagctgtttgaggagcagtctgatgagtacaaggagagtgttctgccagctgcagtgacagccagggttagtattgaggctggatcgaccttcgggtgggaaaagatcgtcggatccaaggggaaggccatcgggattgaccggtttggagcgagtgcaccggctgggaggatatacaaggagtatgggatcacagtggaggccgtcattgaagctgcaaattctgtttcctaa

SEQ ID NO: 10293 - protein, 620 aa, Persicaria tinctoria
MRYNPKNPFWFNRDRFVLSAGHGCMLQYALLHLAGYDSVKEEDLKQFRQWGSKTPGHPENFETIGIEVTTGPLGQGIANAVGLALAEKHLAARFNKPDSEIVDHYTYVILGDGCQMEGIANEACSLAGHWGLGKLIAFYDDNHISIDGDTEIAFTESVDKRFEALGWHVIWVKNGNTGYDEIRAAIEEAKKVKDKPTMIKVTTTIGFGSPNKSNSYSVHGAALGAKEVEATRKNLGWPYEPFHVPEEVEKHWSRHVPEGAALEAEWNAKFAEYKSKYPTEAAELKSIIEGEFPAGWEKALPTYTPESPGDATRNLSQTCLNALAPVVPGLLGGSADLASSNMTLLKSFGDFQKDTPEERNVRFGVREHGMGAICNGIALHSPGFVPYCATFFVFTDYMRGAIRISALSLARVIYVMTHDSIGLGEDGPTHQPIEHLASFRAMPNILMMRPADGNETAGSYRVAVLKKQTPSILALSRQKLPNLPGTSIEGVEKGGYTITDNSTGNKPDVILIGTGSELEIAAKAGDELRKAGKAVRVVSFVCWELFEEQSDEYKESVLPAAVTARVSIEAGSTFGWEKIVGSKGKAIGIDRFGASAPAGRIYKEYGITVEAVIEAANSVS

SEQ ID NO: 10294 - DNA, 1911 bp, Carsonella ruddii
  CDS (1)..(1911): transl_table=11
atgttatataacataataaataatattagattaatttgtattaaatcaatttcaaaagctaattctggacatcccggtatgcctcttggaatttgtgatgtatttacgattttttttttaaatttttataaaataaattttaacaatttaaaatcaattaataaagataaacttataatttcaaatgggcatggaataattacaaattatgtattactttatttatacaatgtatataaaataaaagatttaataaattttagaaggtttaattctaatacaccaggtcatcctgaaattggaaattttattgatgcttcaactggtccattaggacaaggaattggaattggaattggaattggtttaaaaagtaaaaagtataaaaataaatttaataatttttttaatatattcaataataaagtttggatattttgtggagatggatgtttaatggaaggagtgtcctccgaatcatgttctttttgtggatgctataatattaacaatattatattattatatgatagtaataatatttcaatagatggaaatgttaaaaattattttaatgaaaatattaagttaaaatttatttcattaaattggaatgttattggaccaataaatggacattgttatttttcaataattaaatctttattaaaagcaaaaaaaagttattttccaacaattataatttacaatactataataggatttatttctccatgtaaatcatataaagaaaattctcatggaaatatttttacaaaatttgaatttttagaaattttaaaaaattttacattaacatatgattatgttaaaaaaatgttttttgataataaaaaaaaatatttaatatactacaaaaaaaaatataaaaaatatttttttgagttaataagaatttttaataacattataccaaaaataaattttttaaaattatattttaaatactataaaataaatttaaataagtctactagatttgtttgttctaatatattaaaaaatatatatgcaataaatgaaacatttggaggaagcgcagatttaacaaattctaacttaacaaaaaacaattttattaattctattagatataaaaattttaaaaatagatatataaattatggagtacgagaatttacaatgggattaataaattacggattatcttctgataaaataggaataaattattgttctacttttttagttttttcaaattatatgtatagtgcaataagaaatttttgtttatctaaacttaaaaatatttttatatttacacatgattcaattttagttggtgaagatggaccatcacatcaaccaattgaacaattacattcaattagaataataccaagaaattatatatttagaccatataattatatagaattaattctatgttggatattaattttgaaatttttaaataattgttcgtctctaattttatcaagacaaaattttaaaaacaattttattaaaatatataatattaaaaatattataactggtacttattcatgtttttataaaaaaaaaatagaattaataattgtttctaatggatcagatttagaaatctgctttgaatgttattttttcttaaaaaaatattttattattcaaataatttcattattctgcaataaattatttgataaacaaaaaaaaatatataaaaacaaaattttaaattgtaaaaaaataatttttgttgaatcttcaaatgatgatttttggtataaatataaaaaatactttacgtatgtgttaaacataaaaaaatttggatattctagtaacgaactagaactaaaaaaaaaaactaatttaaacaaaaaatttttaattaaactatgtttgtttgtaataaaattataa

SEQ ID NO: 10295 - protein, 636 aa, Carsonella ruddii
MLYNIINNIRLICIKSISKANSGHPGMPLGICDVFTIFFLNFYKINFNNLKSINKDKLIISNGHGIITNYVLLYLYNVYKIKDLINFRRFNSNTPGHPEIGNFIDASTGPLGQGIGIGIGIGLKSKKYKNKFNNFFNIFNNKVWIFCGDGCLMEGVSSESCSFCGCYNINNIILLYDSNNISIDGNVKNYFNENIKLKFISLNWNVIGPINGHCYFSIIKSLLKAKKSYFPTIIIYNTIIGFISPCKSYKENSHGNIFTKFEFLEILKNFTLTYDYVKKMFFDNKKKYLIYYKKKYKKYFFELIRIFNNIIPKINFLKLYFKYYKINLNKSTRFVCSNILKNIYAINETFGGSADLTNSNLTKNNFINSIRYKNFKNRYINYGVREFTMGLINYGLSSDKIGINYCSTFLVFSNYMYSAIRNFCLSKLKNIFIFTHDSILVGEDGPSHQPIEQLHSIRIIPRNYIFRPYNYIELILCWILILKFLNNCSSLILSRQNFKNNFIKIYNIKNIITGTYSCFYKKKIELIIVSNGSDLEICFECYFFLKKYFIIQIISLFCNKLFDKQKKIYKNKILNCKKIIFVESSNDDFWYKYKKYFTYVLNIKKFGYSSNELELKKKTNLNKKFLIKLCLFVIKL

SEQ ID NO: 10296 - DNA, 2193 bp, Mycobacterium sp
  CDS (1)..(2193): transl_table=11
gtgcggccgccagaggccgatgaaccgaaggggagaaatcgtgactcagacagcagatgcgatccttgccgagcccaattcgacaccgtcggtgttgaactggacaaccgaggaccagcgtgccgtggacaccgtccgggtgctggccgcggatgcgtggagaaggtcggcaacggtcatccgggtacggcgatgagcctggctccggcggcgtacctgttgttccagaagctgatgcgccacgacccccgcgaccctgactgggtgggcggtgaccggttcatcctctcgccgggccattcgtccgtgacgctgtacatccagctgttccttgccggttacgggctggagctggaggatctgaagtccttccgcacctggggttctctgacgcccggccatccggagtacaagcacaccaagggcgtggagatcaccaccggcccgctgggtcagggtctcgcgtcgtcggtcggattcgcgtactcgcagcgccggatgcgcgggctgctcgacccggacgcagccccgggaacctcaccgttcgaccacacgatctgggtgatcgcatccgacggtgacctgcaggaaggtgtgacgtccgaggcttcctccctcgccgggcaccaggagctgggcaacctcgtcgtggtctacgacgagaaccacatctcgatcgaggacgacaccgacatctcgttcaccgaggacgtcctggggcgctacgagtcctatggctggcacgtccagcgcgtggactggacccgcaccggtgagtaccgggaagacgtcgaggaactgttcgcggctctgctggcgcgaaggcggaaacctcgaagccgtccatcattcgtgcgcaccatcatcggctacccggccccgaagaagcagaacacgggcaagatccacggttctgcgttgggcgccgaggaagtcgcggcggtgaaggaagtgctcggcttcgaccccgctaagtccttcgacgtcgacccggcaatcctggcccacgcccgtgcggcaatcgaccgcggcgcggccgcgcgtagcgaatgggacgagtcgttccagtcctggcaggccgccaatccggacgccgccgcgttgctgcgacgcatcgaggccaggcagcttcccgacggtgtcgacgccgtcctaccggttttcgaagcgggcaaggacgtctcgacccgtgcggcatccggcaaggttctcaacgcgctcggtccggtcctccccgaactctggggcggttcggccgacctggccgagtcgaacaacacgaccatcgagggatcaccgtcgttcattccggtctcgcgttcggcgaatgcgtggaaaggcaacccgtacggacgggttcttcacttcggcatccgtgagcagctgccgcggtcgatcgtcaacggcatctcgctgcacggccccacgcgcgcgttctccggcacgttcctgatcttcagtgactaccagcgcccggccatccggctgtccgcgctgatgggtgtgccgtctgtctacgtctggtcgcacgactccatcggcctgggtgaggatggcccgacccaccagcccgtggaacagctttcgaccctgcgtgcgatccccggcctggacgtagtcggtcccggcgacgccaacgaggtcggcatcgcgtggaagaccatcctggagaaccacgagaacccggcaggagtcgtgctgacccgccagaacatcccgacctttgcccgtggcgaaggcgcagccgagggtgacacgttcgcatccgcggccggggtggcgaaaggtggttacgtgctggccgaggcttcccgggacggcgccaccgtgccggcccaggtgctgctgatcgccaccggctccgaggtccaactggcggtccaggcccgagaagcgctccaggccgaaggcatccccacccgcgtgatctccatgccgtgcgtcgaatggttcaacaagcaggacgccgcctaccgcgagtccgtgcttcctgccgccgtgacggcccgtgtctcggtcgaggccggattggccctgggctggaaggagttcgtcggcgacgccggacgttcggtcagccttgagcacttcggggcatcggcggattacaagcgcctgttccaggagttcggcatcaccgcagacgcggtcgtcgccgccgccaaggactccatcaccgcggcaggcaactaa

SEQ ID NO: 10297 - protein, 730 aa, Mycobacterium sp
MRPPEADEPKGRNRDSDSRCDPCRAQFDTVGVELDNRGPACRGHRPGAGRGCVEKVGNGHPGTAMSLAPAAYLLFQKLMRHDPRDPDWVGGDRFILSPGHSSVTLYIQLFLAGYGLELEDLKSFRTWGSLTPGHPEYKHTKGVEITTGPLGQGLASSVGFAYSQRRMRGLLDPDAAPGTSPFDHTIWVIASDGDLQEGVTSEASSLAGHQELGNLVVVYDENHISIEDDTDISFTEDVLGRYESYGWHVQRVDWTRTGEYREDVEELFAALLARRRKPRSRPSFVRTIIGYPAPKKQNTGKIHGSALGAEEVAAVKEVLGFDPAKSFDVDPAILAHARAAIDRGAAARSEWDESFQSWQAANPDAAALLRRIEARQLPDGVDAVLPVFEAGKDVSTRAASGKVLNALGPVLPELWGGSADLAESNNTTIEGSPSFIPVSRSANAWKGNPYGRVLHFGIREQLPRSIVNGISLHGPTRAFSGTFLIFSDYQRPAIRLSALMGVPSVYVWSHDSIGLGEDGPTHQPVEQLSTLRAIPGLDVVGPGDANEVGIAWKTILENHENPAGVVLTRQNIPTFARGEGAAEGDTFASAAGVAKGGYVLAEASRDGATVPAQVLLIATGSEVQLAVQAREALQAEGIPTRVISMPCVEWFNKQDAAYRESVLPAAVTARVSVEAGLALGWKEFVGDAGRSVSLEHFGASADYKRLFQEFGITADAVVAAAKDSITAAGN

SEQ ID NO: 10298 - DNA, 2031 bp, Corynebacterium glutamicum
  CDS (1)..(2031): transl_table=11
gtggacaccaaggctgtagacactgttcgtgtcctcgctgcagacgctgtagaaaactgtggctccggccacccaggcaccgcaatgagcctggctccccttgcatacaccttgtaccagcgggttatgaacgtagatccacaggacaccaactgggcaggccgtgaccgcttcgttctttcttgtggccactcctctttgacccagtacatccagctttacttgggtggattcggccttgagatggatgacctgaaggctctgcgcacctgggattccttgaccccaggacaccctgagtaccgccacaccaagggcgttgagatcaccactggccctcttggccagggtcttgcatctgcagttggtatggccatggctgctcgtcgtgagcgtggcctattcgacccaaccgctgctgagggcgaatccccattcgaccaccacatctacgtcattgcttctgatggtgacctgcaggaaggtgtcacctctgaggcatcctccatcgctggcacccagcagctgggcaacctcatcgtgttctgggatgacaaccgcatctccatcgaagacaacactgagatcgctttcaacgaggacgttgttgctcgttacaaggcttacggctggcagaccattgaggttgaggctggcgaggacgttgcagcaatcgaagctgcagtggctgaggctaagaaggacaccaagcgacctaccttcatccgcgttcgcaccatcatcggcttcccagctccaaccatgatgaacaccggtgctgtgcacggtgctgctcttggcgcagctgaggttgcagcaaccaagactgagcttggattcgatcctgaggctcacttcgcgatcgacgatgaggttatcgctcacacccgctccctcgcagagcgcgctgcacagaagaaggctgcatggcaggtcaagttcgatgagtgggcagctgccaaccctgagaacaaggctctgttcgatcgcctgaactcccgtgagcttccagcgggctacgctgacgagctcccaacatgggatgcagatgagaagggcgtcgcaactcgtaaggcttccgaggctgcacttcaggcactgggcaagacccttcctgagctgtggggcggttccgctgacctcgcaggttccaacaacaccgtgatcaagggctccccttccttcggccctgagtccatctccaccgagacctggtctgctgagccttacggccgtaacctgcacttcggtatccgtgagcacgctatgggatccatcctcaacggcatttccctccacggtggcacccgcccatacggtggaaccttcctcatcttctccgactacatgcgtcctgcagttcgtcttgcagctctcatggagaccgacgcttactacgtctggacccacgactccatcggtctgggcgaagatggcccaacccaccagcctgttgaaaccttggctgcgctgcgcgccatcccaggtctgtccgtcctgcgtcctgcagatgcgaatgagaccgcccaggcttgggctgcagcacttgagtacaaggaaggccctaagggtcttgcactgacccgccagaacgttcctgttctggaaggcaccaaggagaaggctgctgaaggcgttcgccgcggtggctacgtcctggttgagggttccaaggaaaccccagatgtgatcctcatgggctccggctccgaggttcagcttgcagttaacgctgcgaaagctctggaagctgagggcgttgcagctcgcgttgtttcagttccttgcatggattggttccaggagcaggacgcagagtacatcgagtccgttctgcctgcagctgtgaccgctcgtgtgtctgttgaagctggcatcgcaatgccttggtaccgcttcttgggcacccagggccgtgctgtctcccttgagcacttcggtgcttctgcggattaccagaccctgtttgagaagttcggcatcaccaccgatgcagtcgtggcagcggccaaggactccattaacagttaa

SEQ ID NO: 10299 - protein, 676 aa, Corynebacterium glutamicum
MDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSINS

SEQ ID NO: 10300 - DNA, 2121 bp, Candida boidinii
  CDS (1)..(2121)
atggctctcgcaaaagctgcttcaattaacgatgatatccatgatttaacaatgagagcattccgttgttatgtcttggatttagttgaacaatatgaaggtggtcatcctggttctgctatgggtatggttgccatgggtattgcattatggaaatatacaatgaaatattctacaaatgatccaacatggttcaatcgtgatagatttgttttatcaaatggtcatgtttgtttatttcaatatttatttcaacatttatcaggtttgaaatctatgactgaaaagcaattaaaatcttatcattcatcagattaccattctaaatgtcctggacatccagaaattgaaaatgaagctgttgaagttactactggtccattaggtcaaggtatttctaattctgttggtttagctattgcatctaaaaatttgggtgcattatataacaagccaggatatgaagttgttaataatactacatattgtattgttggtgatgcttgtttacaagaaggtccagcattagaatctatttcatttgcaggtcatttaggattagataatttagttgttatttatgataacaatcaagtttgttgtgatggttctgttgatattgctaatactgaagatatttcagctaagtttagagcttgtaattggaatgttattgaagttgaagatggtgctagagatgttgctactattgtcaaggcattggaactagctggtgctgaaaagaatagaccaacattaattaatgttcgtactattattggtactgattcagctttccaaaatcattgtgctgctcatggtagtgctttaggtgaagaaggtattagagaattgaaaatcaaatatggttttaatccatctcaaaaattccattttccacaagaagtttatgatttctttagtgatattccagctaaaggtgacgaatatgtttctaattggaataaattagttagtagttatgttaaagaatttcctgaattaggagctgaatttcaatcaagagttaaaggtgaattaccaaagaattggaaatcattattaccaaataatttaccaaatgaagatacagcaacaagaacatcagctagagctatggttagagcattagctaaagatgttccaaatgttattgctggttcagcagatttatcagtttcggttaatttaccatggcctggatctaaatattttgaaaatccacaattagcaacacaatgtggattagctggtgattattctggtagatatgttgaatttggtattagagaacattgtatgtgtgctattgctaatggtttagctgcttttaacaaaggtacatttttaccaattacttcatcattttatatgttttatctctatgcagccccagcattaagaatggctgcattacaagaattaaaggcaattcatattgctacacatgattctattggtgctggtgaagatggaccaacacatcaacctattgcacaatctgctttatggagagcaatgcctaatttctattatatgagaccaggtgatgctagtgaagtacgtggattatttgaaaaagctgttgaattaccattatctacattattttcattatctagacatgaagttccacaatatccaggtaaatcaagtattgaattagctaaaagaggtggttatgtatttgaagatgctaaagatgctgatattcaattaattggtgctggttcagaattagaacaagctgttaaaactgctagaattttaagatctagaggattaaaagttcgtattttatctttcccatgtcaacgtttatttgatgaacaatctgttggatatagaagatctgttttacaaaggggtaaagttccaactgttgttattgaagcttatgttgcttatggttgggaaagatatgctacagcaggttatactatgaatacatttggtaaatcattacctgttgaagatgtttatgaatattttggttttaacccatctgaaatttctaaaaaaattgaaggttatgttagagcagttaaagctaatcctgatttattatatgaatttattgatttaaccgaaaaaccaaaacatgatcaaaatcatttataa

SEQ ID NO: 10301 - protein, 706 aa, Candida boidinii
MALAKAASINDDIHDLTMRAFRCYVLDLVEQYEGGHPGSAMGMVAMGIALWKYTMKYSTNDPTWFNRDRFVLSNGHVCLFQYLFQHLSGLKSMTEKQLKSYHSSDYHSKCPGHPEIENEAVEVTTGPLGQGISNSVGLAIASKNLGALYNKPGYEVVNNTTYCIVGDACLQEGPALESISFAGHLGLDNLVVIYDNNQVCCDGSVDIANTEDISAKFRACNWNVIEVEDGARDVATIVKALELAGAEKNRPTLINVRTIIGTDSAFQNHCAAHGSALGEEGIRELKIKYGFNPSQKFHFPQEVYDFFSDIPAKGDEYVSNWNKLVSSYVKEFPELGAEFQSRVKGELPKNWKSLLPNNLPNEDTATRTSARAMVRALAKDVPNVIAGSADLSVSVNLPWPGSKYFENPQLATQCGLAGDYSGRYVEFGIREHCMCAIANGLAAFNKGTFLPITSSFYMFYLYAAPALRMAALQELKAIHIATHDSIGAGEDGPTHQPIAQSALWRAMPNFYYMRPGDASEVRGLFEKAVELPLSTLFSLSRHEVPQYPGKSSIELAKRGGYVFEDAKDADIQLIGAGSELEQAVKTARILRSRGLKVRILSFPCQRLFDEQSVGYRRSVLQRGKVPTVVIEAYVAYGWERYATAGYTMNTFGKSLPVEDVYEYFGFNPSEISKKIEGYVRAVKANPDLLYEFIDLTEKPKHDQNHL

SEQ ID NO: 10302 - DNA, 2133 bp, Pichia angusta
  CDS (1)..(2133)
atgagtatgagaatccctaaagcagcgtcggtcaacgacgaacaacaccagagaatcatcaagtacggtcgtgctcttgtcctggacattgtcgagcagtacggaggaggccacccgggctcggccatgggcgccatggctatcggaattgctctgtggaaatacaccctgaaatatgctcccaacgaccctaactacttcaacagagacaggtttgtcctgtcgaacggtcacgtgtgtctgttccagtatatcttccagcacctgtacggtctcaagtcgatgaccatggcgcagctgaagtcctaccactcgaatgacttccactcgctgtgtcccggtcacccagaaatcgagcacgacgccgtcgaggtcacaacgggcccgctcggccagggtatctcgaactctgttggtctggccatagccaccaaaaacctggctgccacgtacaacaagccgggctttgatatcatcaccaacaaggtgtactgcatggttggcgatgcgtgcttgcaggagggccctgctctcgagtcgatctcgctggccggccacatggggctggacaatctgattgtgctctacgacaacaaccaggtctgctgtgacggcagtgttgacattgccaacacggaggacatcagtgccaagttcaaggcctgcaactggaacgtgatcgaggtcgagaacgcttccgaggacgtggctaccattgtcaaggccttggagtacgcgcaggccgagaagcacagaccaacacttatcaactgcagaactgtgattggatcgggtgctgcgttcgagaaccactgtgctgcgcacggtaacgctctgggcgaggacggtgtgcgcgagctcaaaatcaagtacggcatgaacccggcccagaagttctacattccgcaggacgtgtacgacttcttcaaggagaagccggccgagggcgacaagctggtggccgaatggaagagtctcgtggccaagtacgtcaaggcgtaccctgaggagggccaggagtttttggcgcggatgagaggcgagctgccaaagaactggaagtcgttcctgccgcagcaggaattcaccggcgacgctcctacaagggccgctgccagagagcttgtgagagccctggggcagaactgcaagtcggtgattgccggttgcgcagacctgtctgtgtctgtcaatttgcagtggccaggggtgaaatatttcatggacccctcgctgtccacgcagtgtggcctgagcggcgactactccggcagatacattgagtacggaatcagagaacacgccatgtgtgctatcgccaatggccttgccgcctacaacaagggcacgttcctgccgatcacgtcgactttcttcatgttctacctgtacgctgccccagccatcagaatggccggcctgcaggagctcaaggcgatccacatcggcacccacgactcgatcaatgagggtgagaacggccctacgcaccagccggtcgagtcgccagcattgttccgggccatgccaaacatttactacatgagaccggtcgactctgcagaagtgtttggcctgttccaaaaagccgtcgagctgccattcagctcgattctgtcgctctcgagaaacgaggtgctgcaataccctggcaagtcgagcgcagagaaggcgcaacgcggcggctatattctggaggatgcggagaacgccgaggtgcagattattggagttggtgcagagatggagtttgcatacaaggccgccaagatcttgggcagaaagttcaggaccagagttctctccatcccatgcacgcggctgtttgacgagcagtcgatcggctatagacgctcggttttgagaaaggacggcagacaggtgccaacggtggtggtggacggccacgttgcgttcggctgggagagatacgctacggcgtcctactgtatgaacacgtacggcaagtctctgcctccagaagtgatctacgagtactttggatacaacccggcaacgattgccaagaaggtcgaagcgtacgtccgggcgtgccaaagagaccctttgctgctccacgacttcctggacctgaaggaaaagcctaaccacgataaagtaaataagctctga

SEQ ID NO: 10303 - protein, 710 aa, Pichia angusta
MSMRIPKAASVNDEQHQRIIKYGRALVLDIVEQYGGGHPGSAMGAMAIGIALWKYTLKYAPNDPNYFNRDRFVLSNGHVCLFQYIFQHLYGLKSMTMAQLKSYHSNDFHSLCPGHPEIEHDAVEVTTGPLGQGISNSVGLAIATKNLAATYNKPGFDIITNKVYCMVGDACLQEGPALESISLAGHMGLDNLIVLYDNNQVCCDGSVDIANTEDISAKFKACNWNVIEVENASEDVATIVKALEYAQAEKHRPTLINCRTVIGSGAAFENHCAAHGNALGEDGVRELKIKYGMNPAQKFYIPQDVYDFFKEKPAEGDKLVAEWKSLVAKYVKAYPEEGQEFLARMRGELPKNWKSFLPQQEFTGDAPTRAAARELVRALGQNCKSVIAGCADLSVSVNLQWPGVKYFMDPSLSTQCGLSGDYSGRYIEYGIREHAMCAIANGLAAYNKGTFLPITSTFFMFYLYAAPAIRMAGLQELKAIHIGTHDSINEGENGPTHQPVESPALFRAMPNIYYMRPVDSAEVFGLFQKAVELPFSSILSLSRNEVLQYPGKSSAEKAQRGGYILEDAENAEVQIIGVGAEMEFAYKAAKILGRKFRTRVLSIPCTRLFDEQSIGYRRSVLRKDGRQVPTVVVDGHVAFGWERYATASYCMNTYGKSLPPEVIYEYFGYNPATIAKKVEAYVRACQRDPLLLHDFLDLKEKPNHDKVNKL

SEQ ID NO: 10304 - DNA, 2034 bp, Candida albicans
  CDS (1)..(2034): transl_table=12
atgccttctcttgatgaattaactatcagtacaattagaggtttgtcagttgacgctgtttccgctgccaactcaggtcatccaggtgccccattgggtttagctccagctgcccatgtcgtttggcaaaaaatgaagttcaacccaaaagacccaaactggatcaacagagatagatttgttttatccaatggtcacgcttgtgctttgttatactccttgttggttttatacaaatttgaattgactgtcgatgacttgaaacaattcagacaattgggttttaaaaccccaggtcacccagaagccactgacactgctggtgttgaagtcaccaccggtccattgggtcaaggtatctcaaatgctgttggtattgctattgctcaaaaacaatttgccgccacctacaacaagccagatatcaccctttctgactcttatgtttacacttttgttggtgatggttgtttgatggaaggtgtttcttctgaaacctcttccttggctggtcacttgcaattgaacaatttaattgccttctgggatgataacagaatttccattgatggtgacactgctgtttctttcactgaaaacgtcccagatagatacagagcctatggttggaatgtcctcgaagtgccagatgctaacaccaatatcgaagccattgccgctgctgttgacgaagccaagaaatccactgacaaaccaactttgattagattggttaccaccattggttacggttctttgaaacaaggttcccatgatgtgcacggttctccattgaagccagatgacatcaaacaattgaagaaaagttggggtttcaaggaagatgttgactttttcattccagaagaagtttctgaatatttggccaaacacgtgtctgaaaaccaaaaagttcaaaaggaatgggaagccaaacttgctgaatataaaaagaaataccctactgaaggtgctgaaatccaaagaagattggatggtaaattaccagaaggttggaaggaatacttgccaaaatacactccagctgacaagccattggctaccagaaaattgtctgaaaatgttatcaatgccttgcacggtaagattccagaattcattggtggttctgctgatttgactggttccaacttgaccagagcagaaggctctgttgatttccaaccaccatctactggcttaggtaactatgatggtgtctacatcagatatggtgttagagaacatggtatgggtgctatcatgaacggtattgctgcctttggtgccaactacaagaactacggtggtactttcttgaactttgtttcatacgctgctggtgctcttagattgtcagccttatcccaccatccagttatctgggttgctactcacgattccattggtttgggtgaagatggtccaacccatcaacctatcgaaactttagctcatttcagagccattccaaacttgtctgtgtggagaccagctgatggtaatgaagtttctgctgcttatgctgctgctattgaatctacttctcatccatctgttattgccttgactagacaaaacttgccacaattggaaggttcatctattgaaaacgccttgaagggtggttacactcttgtcaagaaagacaacccagacgttattattgtttcttctggttctgaagtttcaatttctgttgctgctagtgaagaattagctaaacaaggagttaaggctaatgttgtttccttgccagactttttcaccttcgaccaacaatctgatgaatatagattgtcagttctcccagatggtgttccaatcttgtctgttgaagtcatgtccaccttcggatggtctaaatactctcatgaacaatttggtttgaacagatttggtgcttcaggtaaggctgctgatttgtacaagtactttgagtttactccagaaggaattgccgaaagagctcaaaagactattaaatattacgaaggtaaacaattgttgtctcctttagacagagctttctaa

SEQ ID NO: 10305 - protein, 677 aa, Candida albicans
MPSLDELTISTIRGLSVDAVSAANSGHPGAPLGLAPAAHVVWQKMKFNPKDPNWINRDRFVLSNGHACALLYSLLVLYKFELTVDDLKQFRQLGFKTPGHPEATDTAGVEVTTGPLGQGISNAVGIAIAQKQFAATYNKPDITLSDSYVYTFVGDGCLMEGVSSETSSLAGHLQLNNLIAFWDDNRISIDGDTAVSFTENVPDRYRAYGWNVLEVPDANTNIEAIAAAVDEAKKSTDKPTLIRLVTTIGYGSLKQGSHDVHGSPLKPDDIKQLKKSWGFKEDVDFFIPEEVSEYLAKHVSENQKVQKEWEAKLAEYKKKYPTEGAEIQRRLDGKLPEGWKEYLPKYTPADKPLATRKLSENVINALHGKIPEFIGGSADLTGSNLTRAEGSVDFQPPSTGLGNYDGVYIRYGVREHGMGAIMNGIAAFGANYKNYGGTFLNFVSYAAGALRLSALSHHPVIWVATHDSIGLGEDGPTHQPIETLAHFRAIPNLSVWRPADGNEVSAAYAAAIESTSHPSVIALTRQNLPQLEGSSIENALKGGYTLVKKDNPDVIIVSSGSEVSISVAASEELAKQGVKANVVSLPDFFTFDQQSDEYRLSVLPDGVPILSVEVMSTFGWSKYSHEQFGLNRFGASGKAADLYKYFEFTPEGIAERAQKTIKYYEGKQLLSPLDRAF

SEQ ID NO: 10306 - DNA, 1992 bp, Escherichia coli
  CDS (1)..(1992): transl_table=11
atgtcctcacgtaaagagcttgccaatgctattcgtgcgctgagcatggacgcagtacagaaagccaaatccggtcacccgggtgcccctatgggtatggctgacattgccgaagtcctgtggcgtgatttcctgaaacacaacccgcagaatccgtcctgggctgaccgtgaccgcttcgtgctgtccaacggccacggctccatgctgatctacagcctgctgcacctcaccggttacgatctgccgatggaagaactgaaaaacttccgtcagctgcactctaaaactccgggtcacccggaagtgggttacaccgctggtgtggaaaccaccaccggtccgctgggtcagggtattgccaacgcagtcggtatggcgattgcagaaaaaacgctggcggcgcagtttaaccgtccgggccacgacattgtcgaccactacacctacgccttcatgggcgacggctgcatgatggaaggcatctcccacgaagtttgctctctggcgggtacgctgaagctgggtaaactgattgcattctacgatgacaacggtatttctatcgatggtcacgttgaaggctggttcaccgacgacaccgcaatgcgtttcgaagcttacggctggcacgttattcgcgacatcgacggtcatgacgcggcatctatcaaacgcgcagtagaagaagcgcgcgcagtgactgacaaaccttccctgctgatgtgcaaaaccatcatcggtttcggttccccgaacaaagccggtacccacgactcccacggtgcgccgctgggcgacgctgaaattgccctgacccgcgaacaactgggctggaaatatgcgccgttcgaaatcccgtctgaaatctatgctcagtgggatgcgaaagaagcaggccaggcgaaagaatccgcatggaacgagaaattcgctgcttacgcgaaagcttatccgcaggaagccgctgaatttacccgccgtatgaaaggcgaaatgccgtctgacttcgacgctaaagcgaaagagttcatcgctaaactgcaggctaatccggcgaaaatcgccagccgtaaagcgtctcagaatgctatcgaagcgttcggtccgctgttgccggaattcctcggcggttctgctgacctggcgccgtctaacctgaccctgtggtctggttctaaagcaatcaacgaagatgctgcgggtaactacatccactacggtgttcgcgagttcggtatgaccgcgattgctaacggtatctccctgcacggtggcttcctgccgtacacctccaccttcctgatgttcgtggaatacgcacgtaacgccgtacgtatggctgcgctgatgaaacagcgtcaggtgatggtttacacccacgactccatcggtctgggcgaagacggcccgactcaccagccggttgagcaggtcgcttctctgcgcgtaaccccgaacatgtctacatggcgtccgtgtgaccaggttgaatccgcggtcgcgtggaaatacggtgttgagcgtcaggacggcccgaccgcactgatcctctcccgtcagaacctggcgcagcaggaacgaactgaagagcaactggcaaacatcgcgcgcggtggttatgtgctgaaagactgcgccggtcagccggaactgattttcatcgctaccggttcagaagttgaactggctgttgctgcctacgaaaaactgactgccgaaggcgtgaaagcgcgcgtggtgtccatgccgtctaccgacgcatttgacaagcaggatgctgcttaccgtgaatccgtactgccgaaagcggttactgcacgcgttgctgtagaagcgggtattgctgactactggtacaagtatgttggcctgaacggtgctatcgtcggtatgaccaccttcggtgaatctgctccggcagagctgctgtttgaagagttcggcttcactgttgataacgttgttgcgaaagcaaaagaactgctgtaa

SEQ ID NO: 10307 - protein, 663 aa, Escherichia coli
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAELLFEEFGFTVDNVVAKAKELL

SEQ ID NO: 10308 - DNA, 2040 bp, Kluyveromyces lactis
  CDS (1)..(2040)
atgtctcaatacactgatatcgatcgtttagccgttagcacgatcagattgttagcagtcgaccaagtctctgctgccaactctggtcatccaggtgccccattgggtttggctccagctgcccatgtgatctggaagcaaatgagattgaatcctaagaatccagaatggatcaaccgtgacagatttgtcttgtccaacggtcatgcctgtgcattgttgtactctttgttacacttgttcggttacgacatgtccatcgaagatttgaagcatttcagacatctgggttctaagacccctggtcacccagaatttgaattgccgggtgttgaagttactaccggtccattgggtcaaggtatctctaacgctgttggtatggctattgctcaagccaacttcgctgccacttacaacaagccagattacgaattgtctgattcttacacttacgttttcttgggtgacggttgtttgcaagaaggtgtttcttctgaagcctcttctttggcaggtcatttgaggttgaagaacttgattgccttctatgatgataaccaaattaccatcgatggtaacatcaacgtttctttcgatgaagacgttagcaagagatacgaagcctacggttgggaagtcttgcacgtcgaaaacggtaacgacgatttggatgctatcagtaaagctttggaacaagctaagctttctgatagaccaactttgatcaagttgaccaccactatcggtttcggttctctgaatgctggttctcactccgttcacggtgccccattgaaggctgatgatgtcaagcaattgaaggtcaaattcggtttcaacccagaagaatccttcgttgttccacaagaagtttacgatctttacaacaaatccaccatcgaaccaggtatcgaagccaacaagcaatgggatgctttattggacgcttacgttggccagttcccagaattaggtgctgaagtcaagagaagattagcaggtgaattcccagaaggttgggaatccaagttgccaacttacaccccagaagactctgccgtcgcctccagaaagttgtctgaaatcgttttggataacgttttcgacactttgccagaattgttgggtggttccgctgatttgaccccatccaacttgaccagatctaagggtgccgttgacttccaacctccaatcactggtctaggtgattactccggtagatacatcagatacggtgttcgtgaacatggtatgggtgctatcatgaacggtatctctgcctttggtgctaactacagaccatacggtggtaccttcttgaacttcgtttcttacgcttccggtgcagtcagattgtccgctttgtccggacacccagtcatctgggtcgccactcacgactctatcggtttgggtgaagatggtccaacccatcaacctatcgaaaccttggctcacttcagagctattccaaacctacaagtatggagaccagccgatggtaacgaagtcactgctgcttacaaggtcgctttgactaacaaacacactccagctatcattgctctctccagacaaaacttgccacaattgcaaggttcttccgttgaaaaggctgtcaagggtggttacattttgcaagatgttgaccaaccagaccttgccattgtttctactggttctgaagttggtattgccgttgaagctgctaaggtcttggctgaaaagaacattaaggcacgtatcgtctctctaccagacttccacagcttcggtcaacaatcaaaggaataccaattgtctgttttcccagatggtgttccaatcctatccgtcgaagtcttggctacttccggatggtctaaatacgctcaccaatctttcggtttggacagattcggtgcttctggtaagggtccagctgtttacgaaaagttcgaattcactcctcaaggtattgctaccagagctgaaaagactgttgaattctacaagggtaagcaagtcatttctccactgaacactgctttctaa

SEQ ID NO: 10309 - protein, 679 aa, Kluyveromyces lactis
MSQYTDIDRLAVSTIRLLAVDQVSAANSGHPGAPLGLAPAAHVIWKQMRLNPKNPEWINRDRFVLSNGHACALLYSLLHLFGYDMSIEDLKHFRHLGSKTPGHPEFELPGVEVTTGPLGQGISNAVGMAIAQANFAATYNKPDYELSDSYTYVFLGDGCLQEGVSSEASSLAGHLRLKNLIAFYDDNQITIDGNINVSFDEDVSKRYEAYGWEVLHVENGNDDLDAISKALEQAKLSDRPTLIKLTTTIGFGSLNAGSHSVHGAPLKADDVKQLKVKFGFNPEESFVVPQEVYDLYNKSTIEPGIEANKQWDALLDAYVGQFPELGAEVKRRLAGEFPEGWESKLPTYTPEDSAVASRKLSEIVLDNVFDTLPELLGGSADLTPSNLTRSKGAVDFQPPITGLGDYSGRYIRYGVREHGMGAIMNGISAFGANYRPYGGTFLNFVSYASGAVRLSALSGHPVIWVATHDSIGLGEDGPTHQPIETLAHFRAIPNLQVWRPADGNEVTAAYKVALTNKHTPAIIALSRQNLPQLQGSSVEKAVKGGYILQDVDQPDLAIVSTGSEVGIAVEAAKVLAEKNIKARIVSLPDFHSFGQQSKEYQLSVFPDGVPILSVEVLATSGWSKYAHQSFGLDRFGASGKGPAVYEKFEFTPQGIATRAEKTVEFYKGKQVISPLNTAF

SEQ ID NO: 10310 - DNA, 2007 bp, Pasteurella multocida
  CDS (1)..(2007): transl_table=11
atggcaacacgtagagaactggcaaatgccattcgttttttaagtatggatgcggtgcaaaaagcaaaatcagggcatccaggtgcaccgatggggatggcagatattgcagaagtcttatggcgtgactttttaaaacataacccaagcaatccacactgggccgatcgcgaccgtttcattttatccaatggtcatggttcaatgctgatttacagtttattacatttaagtggttatgacctttctattgaagatttaaaacaattccgtcaattacattccaaaacaccgggacacccagaatacggttatgcgccgggtgttgaaaccacaacaggaccattaggtcaagggattacgaacgcagtgggttttgcgattgcggagaaaacccttgcccatcaatttaaccgtccaggtcatgaaattgttgaccaccacacctatgtgttcttaggcgatggttgtttaatggaagggatttctcatgaagcctgttctttagcgggtactcttgggttaggtaaattaattgctttctatgacgacaacaatatctcaattgatggtcatgtggacggttggttcactgatgatacgcaaaaacggtttgaagcttatggttggcatgtcattccagcggtagatggtcataatccagaacaaattcttgaggcggtgaaacaagcccaagcggagacaaccaaaccaaccttaattatttgtaaaaccattatcggttatggttcaccgaataaagccaactcacacgattgtcatggtgctccattaggtgatgatgaaattgcggcagcacgtgaattcttaaaatgggagcatgccccgtttgaaattcctgcggagatttatgcacaatgggatgcgaaagaaaaaggtcaagttgctgaaaaagcgtgggaagaaaaattggcagcttatgccaaagcttacccagaattagcggcggaatttactcgtcgtgtgaatgcggagctaccggcaaactgggcggcagaatcgcaagcttttattgaacatttacaagcgaatccggcgaacattgccagccgtaaagcgtcacaaaatgcgattgaagcctatgctaaattattaccggagtttttaggtgggtcagcggatttagccagctcaaacttaaccctctggtcaggttccaaaccaatccgtgcggtagaaaatgccgatggtaactacatcaactacggtgtgcgtgagtttggtatgtcggcgattatgaacggtattgcgttacatggtggtttcattccttatggtgccactttcttgatgtttatggaatacgcacataatgcggtgcgtatggcggcgttaatgaaacaacgctcattgtttgtttatactcacgactctattgggcttggtgaagacggtccaactcaccaaccggttgaacaaacgtctgctttacgtttaattccaaatttggaaacatggcgcccatgtgaccaagtggaatcggcggtggcgtggaaagcggcagtggaacgtaaagagggacctagtgcgttaatttttactcgtcaaaatcttgcgcaaatggaccgcactgctgagcagttagccaatgtggcacgtggtggttatgtattacgtcattgctgtgaaaaccaaaactgtccagatttaattttgattgcgaccggttctgaggtggaattggcgatgaaagcggcggatgttttagatgcagaaggggtaaaagtacgtgttgtctctatgccgagcaccaatgtgtttgataaacaagatgcggcttaccgtgaaagtgtgttaccaagccacataacaaaacgtgttgcgattgaagcgggtattgcggacttctggtacaaatatgtgggctttgagggacgtgttgtgggaatgaacagttttggtgaatccgcaccagctgaccaattgttcaaactctttggttttacagtcgagaatatagtcgaaaaagcaaaagcgattttataa

SEQ ID NO: 10311 - protein, 668 aa, Pasteurella multocida
MATRRELANAIRFLSMDAVQKAKSGHPGAPMGMADIAEVLWRDFLKHNPSNPHWADRDRFILSNGHGSMLIYSLLHLSGYDLSIEDLKQFRQLHSKTPGHPEYGYAPGVETTTGPLGQGITNAVGFAIAEKTLAHQFNRPGHEIVDHHTYVFLGDGCLMEGISHEACSLAGTLGLGKLIAFYDDNNISIDGHVDGWFTDDTQKRFEAYGWHVIPAVDGHNPEQILEAVKQAQAETTKPTLIICKTIIGYGSPNKANSHDCHGAPLGDDEIAAAREFLKWEHAPFEIPAEIYAQWDAKEKGQVAEKAWEEKLAAYAKAYPELAAEFTRRVNAELPANWAAESQAFIEHLQANPANIASRKASQNAIEAYAKLLPEFLGGSADLASSNLTLWSGSKPIRAVENADGNYINYGVREFGMSAIMNGIALHGGFIPYGATFLMFMEYAHNAVRMAALMKQRSLFVYTHDSIGLGEDGPTHQPVEQTSALRLIPNLETWRPCDQVESAVAWKAAVERKEGPSALIFTRQNLAQMDRTAEQLANVARGGYVLRHCCENQNCPDLILIATGSEVELAMKAADVLDAEGVKVRVVSMPSTNVFDKQDAAYRESVLPSHITKRVAIEAGIADFWYKYVGFEGRVVGMNSFGESAPADQLFKLFGFTVENIVEKAKAIL

SEQ ID NO: 10312 - DNA, 2085 bp, Vibrio cholerae; identical to SEQ ID NO: 9610
  CDS (88)..(2085): transl_table=11

SEQ ID NO: 10313 - protein, 665 aa, Vibrio cholerae
MSSRKQLANAIRALSMDGVQKANSGHPGAPMGMADIAEVLWRSHLNHNPQNPNWADRDRFVLSNGHGSMLIYSLLHLSGYELSIDDLKNFRQLHSKTPGHPEYGYAPGIETTTGPLGQGITNAVGMAIAEKALAAQFNKPGHDIVDHFTYVFMGDGCLMEGISHEACSLAGTLGLGKLIAFWDDNGISIDGHVEGWFSDDTPKRFEAYGWHVIPAVDGHDADAINAAIEAAKAETSRPTLICTKTIIGFGSPNKAGSHDCHGAPLGNDEIKAAREFLGWEHAPFEIPADIYAAWDAKQAGASKEAAWNEKFAAYAKAYPAEAAEYKRRVAGELPANWEAATSEIIANLQANPANIASRKASQNALEAFGKLLPEFMGGSADLAPSNLTMWSGSKSLTAEDASGNYIHYGVREFGMTAIINGIALHGGFVPYGATFLMFMEYARNAMRMAALMKVQNIQVYTHDSIGLGEDGPTHQPVEQIASLRMTPNMSTWRPCDQVESAVAWKLAIERKDAPSALIFSRQNLAQQPRSAEQVANIAKGGYILKDCAGQPELILIATGSEVELAVAAYEQLSAEGKAVRVVSMPSTDAFDKQDAAYREAVLPAAVTKRIAIEAGIADFWYKYVGFGGRIIGMTSFGESAPAGELFKLFGFTTENVVKQAKELLA

SEQ ID NO: 10314 - DNA, 1995 bp, Vibrio parahaemolyticus
  CDS (1)..(1995): transl_table=11
atgtcgtctcgtaaacatcttgccaatgcaattcgtgctctaagcatggatggtgttcaacaagctaactctggccacccaggcgcacctatgggtatggctgatatcgctgaagttctttggcgctctcacctaaaccacaacccagctaacccagagtgggcagatcgcgaccgttttgtactttcaaacggccacggttctatgctgatctactctctactgcacttgagcggttacgagctatctatcgatgatctgaaaaacttccgtcagcttcactctaagactccaggtcacccagagtacggctacgcaccaggcatcgaaacgacaacaggtcctctaggtcaaggtatcacgaacgctgttggtatggctctagcagaaaaagcgctagcagcacaattcaacaaagaaggccacgacatcattgaccatttcacttacgtgttcatgggtgatggctgtctgatggaaggtatctcgcatgaggcatgttctcttgctggtactctaggcctaggtaaactgatcgcattttgggatgacaacggcatctctatcgatggtcacgttgaaggttggttctctgacgatacacctaagcgtttcgaagcttacggttggcatgtaatcccagcagtggatggccacgattctgacgcaatcaacgcagcgattgaagctgcaaaagcagaccctcgtcctacgctaatttgtacgaagactatcatcggttttggttctccaaacaaatcgggttctcacgactgtcacggtgcaccactaggcgctgaagaaatcgcagcagcacgtgaattcctaggttgggaacaccctgcatttgaaatccctgctgatgtatacgcagagtgggatgcaaaagcagctggcgctgaaaaagaagcggcgtggaacgcgaagttcgaagcatacgcagcggcttacccaacagaagcagcagagcttaagcgtcgtctaaacggcgaacttcctgcagagtgggaagagaaagcaaaccaaatcattgctgatcttcaagcaaacccagcaaacattgcgtcacgtaaagcatctcaaaatgctctagaagctttcggtcaaatgctaccagaattcatgggcggctctgctgacctagcgccttctaacctaaccatgtggtctggttctaagtctctagaagcgaacgacttctctggtaactacatccactacggtgtacgtgaatttggtatgactgctattatgaacggtatcgcactacacggcggtttcgttccttacggcgcaacattcctaatgttcatggaatacgctcgtaacgcaatgcgtatggctgctttgatgaaaattcagaacatccaagtgtacacacacgattctatcggtcttggcgaagatggcccaactcaccaaccagttgagcaaatggcgtctctacgtttgactccaaatatgaacacatggcgcccatgtgaccaagttgagtctgctgtagcatggaaactagcgattgaacgtaaagatgcaccaacagcacttatcttctctcgtcaaaacctagcgcaacaagagcgtactgcagagcaagttacagacatcgcgaaaggtggttacatcctgaaagacagcgatggcaaacctgagctaatcctaatcgcaacaggttctgaagttgagctagcagtgaaagccgctgagcaactaaccgcagaaggtaagaaagtacgcgttgtttcaatgccatcaacagatgcattcgacaaacaagacgcagcttaccgtgaagcagttctaccatcagacgtaacagctcgtatcgctattgaagcgggcatcgcagacttctggtacaagtacgttggtttcgacggtcgcatcatcggtatgacaacattcggtgaatctgcacctgctgaccagttgttcgaaatgtttggtttcactgtagaaaacgtagtgaacacagcaaaagaactactagcgtaa

SEQ ID NO: 10315 - protein, 664 aa, Vibrio parahaemolyticus
MSSRKHLANAIRALSMDGVQQANSGHPGAPMGMADIAEVLWRSHLNHNPANPEWADRDRFVLSNGHGSMLIYSLLHLSGYELSIDDLKNFRQLHSKTPGHPEYGYAPGIETTTGPLGQGITNAVGMALAEKALAAQFNKEGHDIIDHFTYVFMGDGCLMEGISHEACSLAGTLGLGKLIAFWDDNGISIDGHVEGWFSDDTPKRFEAYGWHVIPAVDGHDSDAINAAIEAAKADPRPTLICTKTIIGFGSPNKSGSHDCHGAPLGAEEIAAAREFLGWEHPAFEIPADVYAEWDAKAAGAEKEAAWNAKFEAYAAAYPTEAAELKRRLNGELPAEWEEKANQIIADLQANPANIASRKASQNALEAFGQMLPEFMGGSADLAPSNLTMWSGSKSLEANDFSGNYIHYGVREFGMTAIMNGIALHGGFVPYGATFLMFMEYARNAMRMAALMKIQNIQVYTHDSIGLGEDGPTHQPVEQMASLRLTPNMNTWRPCDQVESAVAWKLAIERKDAPTALIFSRQNLAQQERTAEQVTDIAKGGYILKDSDGKPELILIATGSEVELAVKAAEQLTAEGKKVRVVSMPSTDAFDKQDAAYREAVLPSDVTARIAIEAGIADFWYKYVGFDGRIIGMTTFGESAPADQLFEMFGFTVENVVNTAKELLA

SEQ ID NO: 10316 - DNA, 2013 bp, Vibrio vulnificus; identical to SEQ ID NO: 9738
  CDS (19)..(2013): transl_table=11

SEQ ID NO: 10317 - protein, 664 aa, Vibrio vulnificus
MPSRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKPGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAAAREFLGWEHPAFEIPADVYAEWDAKAAGAEKEAAWNAKFDAYAAAYPTEAAELKRRLNGELPAEWEEKANQIIADLQANPANIASRKASQNALEAFGKMLPEFMGGSADLAPSNLTMWSGSKSLEANDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDTFDKQDAAYREAVLPSDVTARIAIEAGIADFWYKYVGFDGRIIGMTTFGESAPADQLFEMFGFTVENVVNTAKELLA

SEQ ID NO: 10318 - DNA, 2031 bp, Vibrio vulnificus; identical to SEQ ID NO: 9812
  CDS (37)..(2031): transl_table=11

SEQ ID NO: 10319 - protein, 664 aa, Vibrio vulnificus
MPSRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAAAREFLGWEHPAFEIPADVYAEWDAKAAGAAKEAAWNAKFDAYAAAYPAEAAEFKRRVNGELPAQWEEKANQIIADLQANPANIASRKASQNALEAFGKMLPEFMGGSADLAPSNLTMWSGSKSLEASDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDAFDKQDAAYRESVLPSDVTARIAIEAGIADFWYKYVGFDGRIIGMTTFGESAPADQLFEMFGFTVENVVNTAKELLA

SEQ ID NO: 10320 - DNA, 2004 bp, Escherichia coli
  CDS (1)..(2004): transl_table=11
atgtcccgaaaagaccttgccaatgcgattcgcgcactcagtatggatgcggtacaaaaagccaactctggtcatcccggcgcgccgatgggcatggctgatattgccgaagtgctgtggaacgattttcttaaacataaccctaccgacccaacctggtatgatcgcgaccgctttattctttccaacggtcacgcgtcgatgctgctctacagtttgctacatctgaccggttacgacctgccgctggaagaactgaagaacttccgtcagttgcattcgaaaaccccaggccacccggagattggctatacgccaggcgttgaaaccaccaccggcccgcttggacaaggtttggcgaacgccgtcgggctggcgatagcagagcgtacactggcggcgcagtttaaccagccagaccatgagatcgtcgatcacttcacctatgtgtttatgggcgacggctgcctgatggaaggtatttcccacgaagtctgttcgctggcaggcacgctgggactgggcaagctgattggtttttacgatcacaacggtatttccatcgacggtgaaacagaaggctggtttaccgacgatacggcaaaacgttttgaagcctatcactggcatgtgatccatgaaatcgacggtcacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgacggatgagcggtggtttaccgaaggactgggagaaaacgactcagaaatatatcaatgagttacaggcaaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccagcgggcaactacattcactacggggtgcgtgaatttggcatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggcctgggcgaagatggtccgacgcaccaggctgttgagcaactggccagcctgcgcttaacgccaaatttcagcacctggcgaccgtgcgatcaggtggaagcggcggtgggctggaagctggcggttgagcgccacaacggaccgacggcactgatcctctcaaggcagaatctggcccaggtggaacgtacgccggatcaggttaaagagattgctcgtggtggctatgtgctgaaagacagcggcggtaagccagatattattctgattgccaccggttcagagatggaaattaccctgcaagcggcagagaaattagcaggagaaggtcgcaatgtacgcgtagtttccctgccctcgaccgatattttcgacgcccaggatgaggaatatcgggagtcggtgttgccttctaacgttgcggctcgcgtggcggtggaagcaggtattgccgattactggtacaagtatgttggtctgaaaggggcaattgtcgggatgacgggttacggggaatctgctccggcggataagctgttcccgttctttggctttaccgccgagaatattgtggcaaaagcgcataaggtgctgggagtgaaaggtgcctga

SEQ ID NO: 10321 - protein, 667 aa, Escherichia coli
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 10322 - DNA, 2007 bp, Pasteurella multocida
  CDS (1)..(2007): transl_table=11
atggcaacacgtagagaactggccaatgccattcgttttttaagtatggatgcagtgcaaaaagcaaaatcagggcatccaggtgcaccgatggggatggcagatattgcagaagtcttatggcgtgactttttaaaacataacccaagcaatccacactgggccgatcgcgaccgtttcattttatccaatggtcatggttcaatgctgatttacagtttattacatttaagtggttatgacctttctattgaagatttaaaacaattccgtcaattacattccaaaacaccgggacacccagaatacggttatgcgccgggtgttgaaaccacaacaggaccattaggtcaagggattacgaacgcagtgggttttgcgattgcggagaaaacccttgcccatcaatttaaccgtccaggtcatgaaattgttgaccaccacacctatgtgttcttaggcgatggttgtttaatggaagggatttctcatgaagcctgttctttagcgggtactcttgggttaggtaaattaattgctttctatgacgacaacaatatctcaattgatggtcatgtggacggttggttcactgatgatacgcaaaaacggtttgaagcttatggttggcatgtcattccagcggtagatggtcataatccagaacaaattcttgaggcggtgaaacaagcccaagcggagacaaccaaaccaaccttaattatttgtaaaaccattatcggttatggttcaccgaataaagccaactcacacgattgtcatggtgctccattaggtgatgatgaaattgcggcagcacgtgaattcttaaaatgggagcatgccccgtttgaaattcctgcggagatttatgcacaatgggatgcgaaagaaaaaggtcaagttgctgaaaaagcgtgggaagaaaaattggcagcttatgccaaagcttacccagaattagcggcggaatttactcgtcgtgtgaatgcggagctaccggcaaactgggcggcagaatcgcaagcttttattgaacatttacaagcgaatccggcgaacattgccagccgtaaagcgtcacaaaatgcgattgaagcctatgctaaattattaccggagtttttaggtgggtcagcggatttagccagctcaaacttaaccctctggtcaggttccaaaccaatccgtgcggtagaaaatgccgatggtaactacatcaactacggtgtgcgtgagtttggtatgtcggcgattatgaacggtattgcgttacatggtggtttcattccttatggtgccactttcttgatgtttatggaatacgcacataatgcggtgcgtatggcggcgttaatgaaacaacgctcattgtttgtttatactcacgactctattgggcttggtgaagacggtccaactcaccaaccggttgaacaaacgtctgctttacgtttaattccaaatttggaaacatggcgcccatgtgaccaagtggaatcggcggtggcgtggaaagcggcagtggaacgtaaagagggacctagtgcgttaatttttactcgtcaaaatcttgcgcaaatggaccgcactgctgagcagttagccaatgtggcacgtggtggttatgtattacgtcattgctgtgaaaaccaaaactgtccagatttaattttgattgcgaccggttctgaggtggaattggcgatgaaagcggcggatgttttagatgcagaaggggtaaaagtacgtgttgtctctatgccgagcaccaatgtgtttgataaacaagatgcggcttaccgtgaaagtgtgttaccaagccacataacaaaacgtgttgcgattgaagcgggtattgcggacttctggtacaaatatgtgggctttgagggacgtgttgtgggaatgaacagttttggtgaatccgcaccagctgaccaattgttcaaactctttggtttcaccgttgaaaacgtggtcgcgaaagccaaagaaattctctaa

SEQ ID NO: 10323 - protein, 668 aa, Pasteurella multocida
MATRRELANAIRFLSMDAVQKAKSGHPGAPMGMADIAEVLWRDFLKHNPSNPHWADRDRFILSNGHGSMLIYSLLHLSGYDLSIEDLKQFRQLHSKTPGHPEYGYAPGVETTTGPLGQGITNAVGFAIAEKTLAHQFNRPGHEIVDHHTYVFLGDGCLMEGISHEACSLAGTLGLGKLIAFYDDNNISIDGHVDGWFTDDTQKRFEAYGWHVIPAVDGHNPEQILEAVKQAQAETTKPTLIICKTIIGYGSPNKANSHDCHGAPLGDDEIAAAREFLKWEHAPFEIPAEIYAQWDAKEKGQVAEKAWEEKLAAYAKAYPELAAEFTRRVNAELPANWAAESQAFIEHLQANPANIASRKASQNAIEAYAKLLPEFLGGSADLASSNLTLWSGSKPIRAVENADGNYINYGVREFGMSAIMNGIALHGGFIPYGATFLMFMEYAHNAVRMAALMKQRSLFVYTHDSIGLGEDGPTHQPVEQTSALRLIPNLETWRPCDQVESAVAWKAAVERKEGPSALIFTRQNLAQMDRTAEQLANVARGGYVLRHCCENQNCPDLILIATGSEVELAMKAADVLDAEGVKVRVVSMPSTNVFDKQDAAYRESVLPSHITKRVAIEAGIADFWYKYVGFEGRVVGMNSFGESAPADQLFKLFGFTVENVVAKAKEIL

SEQ ID NO: 10324 - DNA, 2043 bp, Vibrio cholerae; identical to SEQ ID NO: 9612
  CDS (49)..(2043): transl_table=11

SEQ ID NO: 10325 - protein, 664 aa, Vibrio cholerae
MNRKQLANAIRALSMDGVQKANSGHPGAPMGMADIAEVLWRSHLNHNPQNPNWADRDRFVLSNGHGSMLIYSLLHLSGYELSIDDLKNFRQLHSKTPGHPEYGYAPGIETTTGPLGQGITNAVGMAIAEKALAAQFNKPGHDIVDHFTYVFMGDGCLMEGISHEACSLAGTLGLGKLIAFWDDNGISIDGHVEGWFSDDTPKRFEAYGWHVIPAVDGHDADAINAAIEAAKAETSRPTLICTKTIIGFGSPNKAGSHDCHGAPLGNDEIKAAREFLGWEYAPFEIPTDIYAAWDAKQAGASKEAAWDEKFAAYAKAYPAEAAEYKRRVAGELPANWEAATSEIIANLQANPANIASRKASQNALEAFGKLLPEFMGGSADLAPSNLTMWSGSKSLTAEDASGNYIHYGVREFGMTAIINGIALHGGFVPYGATFLMFMEYARNAMRMAALMKVQNIQVYTHDSIGLGEDGPTHQPVEQIASLRMTPNMSTWRPCDQVESAVAWKLAIERKDAPSALIFSRQNLAQQPRSAEQVANIAKGGYILKDCAGQPELILIATGSEVELAVAAYEQLSAEGKAVRVVSMPSTDAFDKQDAAYREAVLPAAVTKRIAIEAGIADFWYKYVGFGGRIIGMTSFGESAPAGELFKLFGFTTENVVKQAKELLA

SEQ ID NO: 10326 - DNA, 1992 bp, Vibrio parahaemolyticus
  CDS (1)..(1992): transl_table=11
atggatcgtaaatacctagcaaatgcaatccgtgcgctaagcatggacggtgttcaacaagctaactctggccacccaggcgcacctatgggtatggctgatatcgctgaagttctttggcgttctcacctaaaccacaacccatcaaaccctgaatgggcagaccgcgaccgtttcgtactgtctaacggccacggctcaatgctaatttactctctactgcacttgagcggttacgagctatctatcgatgatctgaaaaacttccgtcagcttcactctaagactccaggtcacccagagtacggctacgctcctggtatcgagacaacaacgggccctctaggccaaggcatcaccaacgctgttggtatggcaatggctgagaaagcgctagcagcgcaattcaacaaagaaggccacgacatcgttgaccacttcacttacgtgttcatgggcgacggctgtctaatggaaggtatctcgcacgaggcatgttctcttgctggtacgctaggcctaggcaaactgatcgcattctgggatgacaacggcatctctatcgacggtcacgttgaaggttggttctctgacgatacacctaagcgtttcgaagcttacggttggcacgtaatcccagcagtagacggtcacgatgctgacgcaatcaacgcagcgattgaagctgcaaaagcggatcctcgccctactctaatctgtactaagactatcatcggttttggttcaccaaacaaatctggttcacacgactgtcacggtgcaccactaggcgctgaagaaattgcagcgacacgtaaagaactaggttgggagcacggtccttttgaaattccgcaggaagtctacgcagaatggtcagcgaaagaaacaggcgcagctaaggaagcagcgtggaacgagaaatttgcagcttatgaagcagcgtaccctgagctggcagctgaatttaaacgccgcgtaaacggtgaacttccagctgagtgggaagagaaagcaagtcaaatcattgctgatcttcaagcaaacccagcaaacattgcgtcacgtaaagcatctcaaaacgctctagaggcatttggtgctctactacctgagttcatgggcggctctgctgacctagcgccttctaacctaaccatgtggtctggttctaagtctctagaagcgaacgacttctctggtaactacatccactacggtgtacgtgaatttggtatgactgctatcatgaacggtatcgcactacacggcggtttcgttccttacggcgcaacattcctaatgttcatggaatacgctcgcaacgcaatgcgtatggctgctctgatgaagattcagaacatccaagtgtacactcacgactctatcggtcttggcgaagatggcccaactcaccaaccagttgaacaaatcgcgtctctacgtttgactccaaacatgaacacatggcgtccatgtgaccaagttgagtctgctgtagcatggaaactagcgattgaacgtaaagatgcaccaacagcacttatcttctctcgtcaaaacctagcgcaacaaccacgtagcgctgagcaagttgcagacatcgcgaaaggtggttacatcctgaaagacagtgaaggtaagcctgagctaatcctaatcgcaacaggttctgaagttgagctagcagtgaaagccgctgagcaactaaccgcagaaggtaagaaagtacgcgttgtttcaatgccatcaacagatgcattcgacaaacaagacgcagattaccgtgaagcagttctaccatcagacgtaacagctcgtatcgctattgaagcgggcatcgcagacttctggtacaagtacgttggtttcgacggtcgcatcatcggtatgacaacattcggtgaatctgcacctgctgaccagttgttcgaaatgtttggtttcactgtagaaaacgtagtgaacacagcaaaagaactactagcgtaa

SEQ ID NO: 10327 - protein, 663 aa, Vibrio parahaemolyticus
MDRKYLANAIRALSMDGVQQANSGHPGAPMGMADIAEVLWRSHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHDADAINAAIEAAKADPRPTLICTKTIIGFGSPNKSGSHDCHGAPLGAEEIAATRKELGWEHGPFEIPQEVYAEWSAKETGAAKEAAWNEKFAAYEAAYPELAAEFKRRVNGELPAEWEEKASQIIADLQANPANIASRKASQNALEAFGALLPEFMGGSADLAPSNLTMWSGSKSLEANDFSGNYIHYGVREFGMTAIMNGIALHGGFVPYGATFLMFMEYARNAMRMAALMKIQNIQVYTHDSIGLGEDGPTHQPVEQIASLRLTPNMNTWRPCDQVESAVAWKLAIERKDAPTALIFSRQNLAQQPRSAEQVADIAKGGYILKDSEGKPELILIATGSEVELAVKAAEQLTAEGKKVRVVSMPSTDAFDKQDADYREAVLPSDVTARIAIEAGIADFWYKYVGFDGRIIGMTTFGESAPADQLFEMFGFTVENVVNTAKELLA

SEQ ID NO: 10328 - DNA, 1992 bp, Vibrio vulnificus
  CDS (1)..(1992): transl_table=11
atggatcgtaaacaactcgctaatgcaatccgcgcactcagcatggacggcgtacaaaaagcaaactcaggccacccaggcgcacctatgggtatggcggacatcgctgaagttctttggcgcggccacctaaaccacaacccatcaaaccctgaatgggctgaccgcgaccgtttcgtactgtctaacggtcacggctctatgctgatttactcgctactgcacttgagcggttacgagctatctatcgacgacctaaagaacttccgtcaattgcactctaagactccaggtcacccagagtacggctacgcaccgggcatcgaaacaacaactggcccgctaggccaaggcatcaccaacgcggttggtatggcaatggctgagaaagcgctcgcagcgcaattcaacaaagaaggccacgacatcgttgaccactttacttacgtgttcatgggcgacggctgtctgatggaaggtatctcgcatgaggcttgctctcttgctggtacactaggtctaggcaaactgatcgcattctgggatgacaacggcatctctatcgatggtcacgttgaaggttggttctctgacgacacacctaagcgtttcgaagcttacggctggcacgtcatcccagcagtggatggtcacaatgcggaagcgatcaacgcagcaattgaagccgctaaagcagatcctcgcccaactctaatctgtactaagactatcatcggttttggttcaccaaacaaatcgggttcacacgactgtcacggtgcaccactaggcgctgaagaaattgcagcgacacgtaaagaactaggttgggagcacggtccttttgaaattccgcaagaagtgtacgcagaatggtcagcgaaggaagcaggcgcagctaaggaagcagcgtggaacgagaaatttgcagcttatgaagcagcatatccagagcttgcagcagagttcaaacgccgcgtaaatggcgaactgccagcgcagtgggaagagaaagcaaaccaaatcattgccgatcttcaagcaaacccagcgaacatcgcatcacgtaaagcatcgcaaaacgcgctagaagcgtttggtaaaatgctaccagaattcatgggcggctctgctgacctagcgccttctaacctcaccatgtggtcgggttcaaagtcactagaagcaagcgacttctctggtaactacatccactacggtgtgcgtgaattcggtatgactgcgatcatgaacggtatcgcgctgcacggtggtttcgtaccttacggcgcaaccttcctaatgttcatggaatacgcacgtaacgcaatgcgtatggcggctctgatgaaagtgcaaaacatccaagtgtacacgcacgattctatcggtcttggcgaagatggcccaactcaccaacccgttgagcaaatcgcatcgctacgtctaacgccaaacatgagcacatggcgtccatgtgaccaagttgagtctgcggtagcttggaaactagcaattgaacgtaaagatggtccatcggcactgattttctctcgtcaaaacctagcacaacaaccacgcagcgctgagcaagtggcagacatcgccaaaggtggttacatcctgaaagacagcgatggtaagcctgagctcatcctaatcgcgacgggttcagaagttgagctagcggtgaaagcggctgagcaactaacagctgaaggtaagaaagtacgcgtggtttcaatgccagctactgatactttcgacaagcaagacgcggcttaccgtgaagcagtactgccatcagacgtaacggcacgtatcgctatcgaagcgggcattgcggacttctggtacaagtacgttggcttcgacggtcgcatcatcggcatgactaccttcggtgaatctgcaccagcagatcaactgttcgaaatgttcggttttacggtagaaaatgtggtgaacacagcgaaagaacttctcgcgtaa

SEQ ID NO: 10329 - protein, 663 aa, Vibrio vulnificus
MDRKQLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAATRKELGWEHGPFEIPQEVYAEWSAKEAGAAKEAAWNEKFAAYEAAYPELAAEFKRRVNGELPAQWEEKANQIIADLQANPANIASRKASQNALEAFGKMLPEFMGGSADLAPSNLTMWSGSKSLEASDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQPRSAEQVADIAKGGYILKDSDGKPELILIATGSEVELAVKAAEQLTAEGKKVRVVSMPATDTFDKQDAAYREAVLPSDVTARIAIEAGIADFWYKYVGFDGRIIGMTTFGESAPADQLFEMFGFTVENVVNTAKELLA

SEQ ID NO: 10330 - DNA, 1992 bp, Vibrio vulnificus
  CDS (1)..(1992): transl_table=11
atggatcgtaaacatttagccaatgcaatccgcgcactcagcatggacggcgtacaaaaagcaaactcaggccacccaggcgcacctatgggtatggcggacatcgctgaagttctttggcgcggccacctaaaccacaacccatcaaaccctgaatgggctgaccgcgaccgtttcgtactgtctaacggccacggctctatgctgatttactcgctactgcaccttagcggttacgagctatctatcgacgacctaaagaacttccgtcaattgcactctaagactccaggtcacccagagtacggctacgcaccgggcatcgaaacaacaactggcccgctaggccaaggcatcaccaacgcggttggtatggcaatggctgagaaagcgctcgcagcgcaattcaacaaagaaggccacgacatcgttgaccactttacttacgtgttcatgggtgatggctgtctgatggaaggtatctcgcatgaggcttgctctcttgctggtacactaggtctaggcaaactgatcgcattctgggatgacaacggcatctctatcgatggtcacgttgaaggttggttctctgacgacacacctaagcgtttcgaagcttacggctggcacgtaatcccagcagtggatggtcacaatgcggaagcgatcaacgcagcaattgaagccgctaaagcagatcctcgcccaactctaatctgtactaagactatcatcggttttggttcaccaaacaaatcgggttcacacgactgtcacggtgcaccactaggcgctgaagaaattgcagcgacacgtaaagaactaggttgggagcacggtccttttgaaattccgcaagaagtgtacgcagaatggtcagcgaaggaagcaggcgcagctaaggaagcagcgtggaacgagaaatttgcagcttatgaagcagcatatccagagcttgcagcagagttcaaacgccgcgtaaatggcgaactgccagcgcagtgggaagagaaagcaaaccaaatcattgcagatcttcaagcaaacccagcaaacatcgcatcacgtaaagcatcgcaaaacgcgctagaagcgtttggtaaaatgctgccagaattcatgggcggctcagctgacctagcgccttctaacctcaccatgtggtcgggttctaagtcgctagaagcaagcgacttctctggtaactacatccactacggtgtgcgtgaattcggtatgactgcgatcatgaacggtatcgcactacacggtggtttcgttccttacggcgcgacgttcctaatgttcatggaatacgcacgtaacgcaatgcgtatggctgctctgatgaaagttcagaacatccaagtttacacgcacgactctatcggtcttggcgaagatggtccaactcaccaacccgttgagcaaatcgcgtctctacgtctgactccaaacatgagcacatggcgtccatgtgaccaagttgagtctgcggtagcttggaaactagcaattgaacgtaaagatggtccatcagcacttatcttctctcgtcaaaacctagcacaacaagagcgtactgctgagcaagttgcagacatcgcaaaaggtggttacatcctaaaagacagcgatggtaagcctgagctcatcctaatcgcaacgggttcagaagttgagctagcagtgaaagcagcagaacaactaactgcagaaggtaagaaagtacgcgtggtttcaatgcctgctactgatgccttcgacaagcaagacgcggcttaccgtgaatcagtactgccatcagacgtaacggcacgtatcgctatcgaagcgggtattactgacttctggtacaagtacgttggtttcgacggtcgcatcatcggtatgacgactttcggtgaatcagcacctgctgaccaattgttcgaaatgttcggtttcacggtagaaaacgtggtgaacacagcgaaagagcttctcgcgtaa

SEQ ID NO: 10331 - protein, 663 aa, Vibrio vulnificus
MDRKHLANAIRALSMDGVQKANSGHPGAPMGMADIAEVLWRGHLNHNPSNPEWADRDRFVLSNGHGSMLIYSLLHLSGYELSIDDLKNFRQLHSKTPGHPEYGYAPGIETTTGPLGQGITNAVGMAMAEKALAAQFNKEGHDIVDHFTYVFMGDGCLMEGISHEACSLAGTLGLGKLIAFWDDNGISIDGHVEGWFSDDTPKRFEAYGWHVIPAVDGHNAEAINAAIEAAKADPRPTLICTKTIIGFGSPNKSGSHDCHGAPLGAEEIAATRKELGWEHGPFEIPQEVYAEWSAKEAGAAKEAAWNEKFAAYEAAYPELAAEFKRRVNGELPAQWEEKANQIIADLQANPANIASRKASQNALEAFGKMLPEFMGGSADLAPSNLTMWSGSKSLEASDFSGNYIHYGVREFGMTAIMNGIALHGGFVPYGATFLMFMEYARNAMRMAALMKVQNIQVYTHDSIGLGEDGPTHQPVEQIASLRLTPNMSTWRPCDQVESAVAWKLAIERKDGPSALIFSRQNLAQQERTAEQVADIAKGGYILKDSDGKPELILIATGSEVELAVKAAEQLTAEGKKVRVVSMPATDAFDKQDAAYRESVLPSDVTARIAIEAGITDFWYKYVGFDGRIIGMTTFGESAPADQLFEMFGFTVENVVNTAKELLA

SEQ ID NO: 10332 - DNA, 2046 bp, Saccharomyces cerevisiae
  CDS (1)..(2046)
atggcacagttctccgacattgataaacttgcggtttccactttaagattactttccgttgaccaggtggaaagcgcacaatctggccacccaggtgcaccactaggattggcaccagttgcccatgtaattttcaagcaactgcgctgtaaccctaacaatgaacattggatcaatagagacaggtttgttctgtcgaacggtcactcatgcgctcttctgtactcaatgctccatctattaggatacgattactctatcgaggacttgagacaatttagacaagtaaactcaaggacaccgggtcatccagaattccactcagcgggagtggaaatcacttccggtccgctaggccagggtatctcaaatgctgttggtatggcaatagcgcaggccaactttgccgccacttataacgaggatggctttcccatttccgactcatatacgtttgctattgtaggggatggttgcttacaagagggtgtttcttcggagacctcttccttagcgggacatctgcaattgggtaacttgattacgttttatgacagtaatagcatttccattgacggtaaaacctcgtactcgttcgacgaagatgttttgaagcgatacgaggcatatggttgggaagtcatggaagtcgataaaggagacgacgatatggaatccatttctagcgctttggaaaaggcaaaactatcgaaggacaagccaaccataatcaaggtaactactacaattggatttgggtccctacaacagggtactgctggtgttcatgggtccgctttgaaggcagatgatgttaaacagttgaagaagaggtgggggtttgacccaaataaatcatttgtagtacctcaagaggtgtacgattattataagaagactgttgtggaacccggtcaaaaacttaatgaggaatgggataggatgtttgaagaatacaaaaccaaatttcccgagaagggtaaagaattgcaaagaagattgaatggtgagttaccggaaggttgggaaaagcatttaccgaagtttactccggacgacgatgctctggcaacaagaaagacatcccagcaggtgctgacgaacatggtccaagttttgcctgaattgatcggtggttctgccgatttgacaccttcgaatctgacaaggtgggaaggcgcggtagatttccaacctcccattacccaactaggtaactatgcaggaaggtacattagatacggtgtgagggaacacggaatgggtgccattatgaacggtatctctgcctttggtgcaaactacaagccttacggtggtacctttttgaacttcgtctcttatgctgcaggagccgttaggttagccgccttgtctggtaatccagtcatttgggttgcaacacatgactctatcgggcttggtgaggatggtccaacgcaccaacctattgaaactctggctcacttgagggctattccaaacatgcatgtatggagacctgctgatggtaacgaaacttctgctgcgtattattctgctatcaaatctggtcgaacaccatctgttgtggctttatcacgacagaatcttcctcaattggagcattcctcttttgaaaaagccttgaagggtggctatgtgatccatgacgtggagaatcctgatattatcctggtgtcaacaggatcagaagtctccatttctatagatgcagccaaaaaattgtacgatactaaaaaaatcaaagcaagagttgtttccctgccagacttttatacttttgacaggcaaagtgaagaatacagattctctgttctaccagacggtgttccgatcatgtcctttgaagtattggctacttcaagctggggtaagtatgctcatcaatcgttcggactcgacgaatttggtcgttcaggcaaggggcctgaaatttacaaattgttcgatttcacagcggacggtgttgcgtcaagggctgaaaagacaatcaattactacaaaggaaagcagttgctttctcctatgggaagagctttctaa

SEQ ID NO: 10333 - protein, 681 aa, Saccharomyces cerevisiae
MAQFSDIDKLAVSTLRLLSVDQVESAQSGHPGAPLGLAPVAHVIFKQLRCNPNNEHWINRDRFVLSNGHSCALLYSMLHLLGYDYSIEDLRQFRQVNSRTPGHPEFHSAGVEITSGPLGQGISNAVGMAIAQANFAATYNEDGFPISDSYTFAIVGDGCLQEGVSSETSSLAGHLQLGNLITFYDSNSISIDGKTSYSFDEDVLKRYEAYGWEVMEVDKGDDDMESISSALEKAKLSKDKPTIIKVTTTIGFGSLQQGTAGVHGSALKADDVKQLKKRWGFDPNKSFVVPQEVYDYYKKTVVEPGQKLNEEWDRMFEEYKTKFPEKGKELQRRLNGELPEGWEKHLPKFTPDDDALATRKTSQQVLTNMVQVLPELIGGSADLTPSNLTRWEGAVDFQPPITQLGNYAGRYIRYGVREHGMGAIMNGISAFGANYKPYGGTFLNFVSYAAGAVRLAALSGNPVIWVATHDSIGLGEDGPTHQPIETLAHLRAIPNMHVWRPADGNETSAAYYSAIKSGRTPSVVALSRQNLPQLEHSSFEKALKGGYVIHDVENPDIILVSTGSEVSISIDAAKKLYDTKKIKARVVSLPDFYTFDRQSEEYRFSVLPDGVPIMSFEVLATSSWGKYAHQSFGLDEFGRSGKGPEIYKLFDFTADGVASRAEKTINYYKGKQLLSPMGRAF

SEQ ID NO: 10334 - DNA, 2031 bp, Craterostigma plantagineum
  CDS (1)..(2031)
atggcgcccaagacgaccttaatcgccgaacccgagctcgtgtccaagtcggtgaacacgataaggttcttagccatcgacgcggtggagaaggccaagtcgggtcacccgggaatgcccatgggttgcgccccgatgggccacgttctctacgatgagttcatgcggttcaatcccaagaacccatattggttcaatagggataggttcgtcctatcggccggccacggctgtatgctgcagtacgcactgcttcacttgtctggctacgattccgtcaaggaagaggatttgaagagtctgaggcaatggggaagcaggacgccggcgcacccagagaacttcgagacgccgggagttgaagtcaccactggcccgctcggccagggcattgcgagcgcggttggcttggcggtcgccgagaagcacttggccgctcggtacaacaagccgggttttgagatcgtcgaccattacacgtatgtgatactcggcgacggttgccaaatggaaggcgtttcgaacgaggcgtgctccctcgcggcgcactgggggctcgggaagttgatcgcgctgtacgacgataaccacataacgatcgacggcgacacggacgttgccttcaccgaggacgtcgacaagcgcttcgacgccctgggatggcacgtgatatgggtcaagaatgggaacgatgggtgcgatgagattcgggccgccatcgaagaggctaagtctgttaaggacaggcccactatgatcaaggttactacgacgatcggctatggtgcgccgagcaaggcgaacacttacggcgtgcacggaaatgcgttgggcccgaaagaagcggaagccacgaggaagaacctcggatggccttacgagccgttccacgtccccgacgacgttaagaaacattggagccgacacatagccgagggagcggctttggaatcggcttggaacgcaaagttcgccgaatttcagaagaaatttcccgaggaagccgccgatctcaaatcgatcatcaccggcgaactcccgaccaactgggaaagcatttttcccacgtacacgccagagaacccgggcctaccgacccgaaccctctcccaccaaatcctcaacgggctcggagacgtcctcccgggcttactcggcgggagcgccgacctaacactgtccaacatggccttcctcaaaaactccggcgacttccagaaaaaatcccccggggagcgcaatgtaaagttcggggcccgcgagcacgccatgggctcgatatgcaacgggctggccctacacagcccgggcctactcccctactgcgcgacctactttgtattcaccgactacatgcgggccgccatgagaatctcggccctctccaaggcccgagtcctctacataatgacccacgactccatcgggctgggcgaggacggcccgacccaccagcccgtggagcacctagccagctttcgggccatgcccaacattttgacccttcggcccgctgacgggaatgagaccgccggggcctaccgagccgcggttcaaaacggcgagcgcccgtcgatcctcgtgctcgcccgacagaagctgccccaactgcccgggacttcgatcgagggcgtgagcaagggcggttacgtaatttcggataattcgaggggcgggaatagtaagcccgacgtcatactgatcgggacgggctcggagcttgagatagcggctagggccggggacgagctcaggaaggagggcaaaaaggtccgagttgtctcgcttgtgtgttgggagttgttcgccgagcagtccgagaagtatagagagacggttttgccctcgggggttacggctagggttagcgtggaggcgggctcgactttcgggtgggagaggttcatcgggccgaagggtaaggcggttgggatcgataggtttggggcgagcgcgccggcggagaggctttttaaggagtttgggataaccgtcgaagcagtcgtcgcggcggcgaaggagatttgctga

SEQ ID NO: 10335 - protein, 676 aa, Craterostigma plantagineum
MAPKTTLIAEPELVSKSVNTIRFLAIDAVEKAKSGHPGMPMGCAPMGHVLYDEFMRFNPKNPYWFNRDRFVLSAGHGCMLQYALLHLSGYDSVKEEDLKSLRQWGSRTPAHPENFETPGVEVTTGPLGQGIASAVGLAVAEKHLAARYNKPGFEIVDHYTYVILGDGCQMEGVSNEACSLAAHWGLGKLIALYDDNHITIDGDTDVAFTEDVDKRFDALGWHVIWVKNGNDGCDEIRAAIEEAKSVKDRPTMIKVTTTIGYGAPSKANTYGVHGNALGPKEAEATRKNLGWPYEPFHVPDDVKKHWSRHIAEGAALESAWNAKFAEFQKKFPEEAADLKSIITGELPTNWESIFPTYTPENPGLPTRTLSHQILNGLGDVLPGLLGGSADLTLSNMAFLKNSGDFQKKSPGERNVKFGAREHAMGSICNGLALHSPGLLPYCATYFVFTDYMRAAMRISALSKARVLYIMTHDSIGLGEDGPTHQPVEHLASFRAMPNILTLRPADGNETAGAYRAAVQNGERPSILVLARQKLPQLPGTSIEGVSKGGYVISDNSRGGNSKPDVILIGTGSELEIAARAGDELRKEGKKVRVVSLVCWELFAEQSEKYRETVLPSGVTARVSVEAGSTFGWERFIGPKGKAVGIDRFGASAPAERLFKEFGITVEAVVAAAKEIC

SEQ ID NO: 10336 - DNA, 2040 bp, Craterostigma plantagineum
  CDS (1)..(2040)
atggccaagactacgccgtcgtccccctccgccgctgccgccgccgagctggtggtgaaatccgtcaacaccataaggttcttagccatcgacgccgtggagaatgtcaagtcgggtcacccgggaatgcccatgggttgtgccccgatgggtcacgttttgttcgacgaattcatgaagttcaacccaaagaatccgtattggttcaaccgtgataggttcgttttgtccgccggccacggcgctatgttgctgtacggcctccttcacttggccggatatgattccgtcaaggtggaggatttgaagggtttaagacaatggggaagcaagacgccggcccaccccgagaatttcgagactcccggcgttgaagtcacgaccgggccgctcgggcaaggcgtggggagcgcggtggggttggcgctcgcggagaagcacttgggcgcaagatacaacaagcccgatttcgagatggtcgaccattacacgtacatgattctgggcgacggttgtcagatggaaggcatttcgaacgaggcgagctcactcgcggcacactgggggctcgggaagttgatcgctctgtacgacgataatcacatcacgatcgacggtgacacagacttggccttcaccgaggacgtcgggaaacgtttcgaggccttgggttggcacgtgctaaccgtcgcgaacggcaacgacggttacgacgagattcgcgaggctattaaggtggctaagtcagttacggacaagcccaccttgatcaaggttgccacgacgataggctttggttcgccgaacaaggcgaacacttacggcgtgcacggaaatgcattggggccgaaagaagcagaagccacgaggcagaacctcggatggccttacgaaacgttccacgtccccgacgacgtgaagaagcattggagccgacacatatccgagggagcagaattggaatccgcgtggaacgcaaagttcgccgagtacgagaagaaatatcccaaagaagccgccgagcttaaatcgatcatcaccggcgaactgcccctcggttgggaaaaggcccttccgacgtacacgcccgagagcccgggaaatccaacccgaaccctatcccaccagaacctcaacgcagtcgcggcggtcctcccgggcctaatcggcgggagcgccgacctaaccgcctccaacatggctttcctaaagtcctccggcgacttccagaaagaaaccccgacgggccgaaacctaaaattcggggcccgcgagcacggaatgggggccatatgcaacggtgtagccctacacagccccgggctcgtccccttcagtgcgacctacttcgtattcaccgactacatgcgggccgccattcgcatcgctgccctctccaaggcccgagtcgtctacatcatgacccacgactccatcgggctgggcgaggacgggccgacccaccagcccgtggagcacctcgccagctttcgggccatgcccaacatcttggttctccgtcccgcggacgggaacgagacggcgggggcgtacaaggtcgcggtcgagaatgccgggcggccgtcgatactttccttgtcccgtcagaagctgccccagctgcccgggacgtcggtggagggcgtggggaggggcggttacgtaatttcggataattcgaaggatggggaaaagcccgaggtgatactgatggggacgggctcggagcttgagatagcggctagggccggggaggagcttaggaaggagggcaaaaaggtcagagtggtttcgctcgtttcttgggagttgttcggcgagcagtcgaaagagtacaaagagatggttttgccctcggaggttacggctagggttagcgtggaggcgggctcgacgttcgggtgggagaggttcgtcgggttgaagggtcgggccgtggggatcgatcggttcggggcgagcgcatcggcggagaggctttataaggagttcggtattactgttgaagccgttgttgctgccgctaaagagctgtgctag

SEQ ID NO: 10337 - protein, 679 aa, Craterostigma plantagineum
MAKTTPSSPSAAAAAELVVKSVNTIRFLAIDAVENVKSGHPGMPMGCAPMGHVLFDEFMKFNPKNPYWFNRDRFVLSAGHGAMLLYGLLHLAGYDSVKVEDLKGLRQWGSKTPAHPENFETPGVEVTTGPLGQGVGSAVGLALAEKHLGARYNKPDFEMVDHYTYMILGDGCQMEGISNEASSLAAHWGLGKLIALYDDNHITIDGDTDLAFTEDVGKRFEALGWHVLTVANGNDGYDEIREAIKVAKSVTDKPTLIKVATTIGFGSPNKANTYGVHGNALGPKEAEATRQNLGWPYETFHVPDDVKKHWSRHISEGAELESAWNAKFAEYEKKYPKEAAELKSIITGELPLGWEKALPTYTPESPGNPTRTLSHQNLNAVAAVLPGLIGGSADLTASNMAFLKSSGDFQKETPTGRNLKFGAREHGMGAICNGVALHSPGLVPFSATYFVFTDYMRAAIRIAALSKARVVYIMTHDSIGLGEDGPTHQPVEHLASFRAMPNILVLRPADGNETAGAYKVAVENAGRPSILSLSRQKLPQLPGTSVEGVGRGGYVISDNSKDGEKPEVILMGTGSELEIAARAGEELRKEGKKVRVVSLVSWELFGEQSKEYKEMVLPSEVTARVSVEAGSTFGWERFVGLKGRAVGIDRFGASASAERLYKEFGITVEAVVAAAKELC

SEQ ID NO: 10338 - DNA, 2226 bp, Solanum tuberosum
  CDS (1)..(2226)
atggcttcttcatcttctctcactctttctcaagttatcttctctccttctctccctcgccatggctcatcttcttcgtcttctccttctctctctttctccactttctctggccttaaatccacccctttcacttcctcccaccgtcgtattcttccttccactaccgtcactaaacaacagttctctgttcgtgcctccgcagctgtagagactttggagaaaactgatgcagccattgttgagaaatctgttaacactattcgatttttggctattgatgctgttgaaaaagctaattccggtcatccgggtttacccatgggatgtgctccaatgggtcatatattgtatgatgaagtaatgaaatataacccgaagaatccttactggtttaatcgtgaccgatttgttctatctgctggtcatggttgtatgctgcaatatgctcttcttcatcttgctggttatgactctgttcaggaagacgatttgaaaagtttccgtcaatggggaagcagaattcccggtcaccctgagaattttgagacacctggtgttgaagttaccactggtcctctggggcaaggtattgccaatgctgttggattggctgttgcagagaagcacttggctgctcggttcaacaagcctgacgctgagattgttgaccactatacatatgttattcttggtgatggttgtcagatggagggtatctcaaatgaagtttgttcccttgctggccattggggacttggaaagctgattgctttctatgacgataatcacatttccattgacggagacacggaaattgctttcactgaggatgtctctgctcgtttcgagtctttaggatggcatgtaatctgggtgaagaatggtaacacaggttatgatgagattcgtgcagctattaaggaagctaaagctgtcaaagacaaacctactatgatcaaggtaactacaacgattggttttggctctcctaacaaggcaaactcttacagtgtgcacggtagtggacttggagcaaaggaagtcgaggcaactagaaataacctgggatggccttatgagcctttccatgtgcctgaagatgtgaagagccattggagtcgtcatacaccggagggtgctgcccttgaaactgaatggaatgctaagtttgctgaatatgagaagaagtatgcagaggaagctgcagatttgaaatccatcattactggtgaactacctgctggctgggagaaagctcttcctacttacactcccgagagcccagctgatgccacgagaaacttgtcacaacaaaaccttaatgctcttgccaaggttctacctggtttccttggtggtagtgctgatcttgcatcatcaaacatgactcttttgaaaatgtttggtgacttccaaaagaacactccagaagagcgtaatttaaggtttggtgttcgtgaacatggtatgggagccatatgtaatggaattgctctacacagccttggcttgatcccctattgtgctactttctttgtgttcactgactacatgagaggagccatgaggatttcagccttgtctgaagctggagttatttatgttatgactcacgattcaattggtctaggagaagacggtccaacccatcaacccattgagcacttggcaagtttccgtgccatgcccaacattctgatgttccgtccagcagatggcaatgagacagcaggagcttacaaggtggctgtccttaagaggaaaacaccatcaatccttgccctctctcggcaaaagttgccacaacttgctggaacttctattgaaggagcagcaaagggtggctacattgtatcagacaattcatctggcaacaaacctgatgtcattttgatcggtactggctccgagttggaaattgctgtcaaggctgctgaggaactaaagaaagaaggaaagacagtgagggttgtttcctttgtttgttgggagctttatgatgaacaatcagctgaatacaaggaaagtgtccttccatcatctgttacagctagagttagcattgaagctggatcaacatttgggtggcaaaaatttgttggcgataaaggaaaagccattgggattgacgggtttggtgctagtgctcctgctgataagatatacaaagagtttggtattacagcagaagctgttgtagctgcagctaaacaagtttcttag

SEQ ID NO: 10339 - protein, 741 aa, Solanum tuberosum
MASSSSLTLSQVIFSPSLPRHGSSSSSSPSLSFSTFSGLKSTPFTSSHRRILPSTTVTKQQFSVRASAAVETLEKTDAAIVEKSVNTIRFLAIDAVEKANSGHPGLPMGCAPMGHILYDEVMKYNPKNPYWFNRDRFVLSAGHGCMLQYALLHLAGYDSVQEDDLKSFRQWGSRIPGHPENFETPGVEVTTGPLGQGIANAVGLAVAEKHLAARFNKPDAEIVDHYTYVILGDGCQMEGISNEVCSLAGHWGLGKLIAFYDDNHISIDGDTEIAFTEDVSARFESLGWHVIWVKNGNTGYDEIRAAIKEAKAVKDKPTMIKVTTTIGFGSPNKANSYSVHGSGLGAKEVEATRNNLGWPYEPFHVPEDVKSHWSRHTPEGAALETEWNAKFAEYEKKYAEEAADLKSIITGELPAGWEKALPTYTPESPADATRNLSQQNLNALAKVLPGFLGGSADLASSNMTLLKMFGDFQKNTPEERNLRFGVREHGMGAICNGIALHSLGLIPYCATFFVFTDYMRGAMRISALSEAGVIYVMTHDSIGLGEDGPTHQPIEHLASFRAMPNILMFRPADGNETAGAYKVAVLKRKTPSILALSRQKLPQLAGTSIEGAAKGGYIVSDNSSGNKPDVILIGTGSELEIAVKAAEELKKEGKTVRVVSFVCWELYDEQSAEYKESVLPSSVTARVSIEAGSTFGWQKFVGDKGKAIGIDGFGASAPADKIYKEFGITAEAVVAAAKQVS

SEQ ID NO: 10340 - DNA, 2226 bp, Spinacia oleracea
  CDS (1)..(2226): transl_table=11
atggcagcttcttcctctcttagtacactatctcatcatcaaacacttctctcacacccaaaaacccaccttccaaccacccctgcatcctcccttttagtccctacaacctcctctaaggtcaatggggtgcttcttaagtcaacctcctcctctaggaggctgcgcgtgggatcagcctccgccgtggtgagggctgcagctgttgaagccttggagagtactgatattgaccaacttgttgagaagtctgtgaacactattaggttcttggctattgatgctgttgagaaggctaattcgggtcaccccggtttgcctatgggttgtgcacccatgggtcatatattgtatgatgagatcatgcggtataacccgaagaacccgtattggtttaaccgtgaccggtttgttctctctgcgggtcatggttgtatgcttcagtatgctcttcttcaccttgctggttatgacagtgtcttggaagaagatttgaagactttccgccaatggggaagcagaattcccggtcacccagagaactttgagactcctggagtagaagttacaactgggccacttggtcagggaatagccaatgctgttggtttggcacttgctgagaagcatttagctgcacgattcaacaaacctgatgctgaaatcgttgatcattacacgtatgtcattcttggtgatggttgccagatggaagggattgctcaggaagcttgctcccttgctggtcattggggacttggaaaattgattgccttttatgatgataaccacatttctattgatggtgatactgccattgctttcactgagagtgttgatctgaggtttgaggcccttggctggcatgttatctgggttaagaatggtaacacaggctacgatgaaattcgtgctgctattaaggaagctaagacagtcacagacaaacccactttgatcaaggttaccaccaccatcggttttgggtctcctaacaagtcgaactcatacagtgtgcacggaagtgcattgggttcaaaggaagttgaggctacaaggcagaatcttggttggccttacgagccattccacgttccagaggaagttaagaagcactggagccgccatactcccgagggagcctccttggaagctgagtggaataccaagtttgccgagtatgagaagaaataccctgaagatgcaacagagttcaagtctatcactactggtgaatttcctgctggttgggagaaagctcttcctacctacactcctgaaaccccaggtgatgcaaccagaaacctgtcacaacaatgcttaaacgcccttgcaaaggttattccaggactccttggtggtagtgcagaccttgcatcatcaaacatgaccttactgaaaatgtttggagacttcagaaggacacaccggaagaaagaaacgttccgttttggtgtcagagaacacggaatgggagccatttgcaacggtatctgccttcacagcccgggttttgtcccttactgtgctaccttcttcgtgttcacagactacatgagaggagccatgaggatctcagccttgtcagaagccggagtcatctacgtcatgacccacgattctatcgggcttggagaagatggacccacccatcaacccatcgaggcacttagcaagtttccggccatgcccaacattcttatgctccgtccagctgatggaaacgagactgctggttcatacaaagttgctgttgaaaacagaaagacaccctccatccttgctctttctagaaaaaaactcccaaacttgcccggaacttccattgaaggagttgagaaaggagggtacacaatcacagacaactcttcaggtaacaaacctgatgttattcttattggaactggttcagaactggaaattgctgcaaaggctggtgatgagttaagaaaagaaggaaaagctgttagggttgtatcatttgtttcttgggaattgtttgagaaacaatctgatgaatacaaggagagtgttcttccttcagatgttactgcaagagtaagtattgaagcaggatcaacctttggatggcataagattgtggggtcaaaggggaaagccattggtattgacaagtttggagcaagtgcaccagcaggaaagatttaccaggagtatggaattacagttgaggcagttgttgaagctgcaaaatcagtttgttag

SEQ ID NO: 10341 - protein, 741 aa, Spinacia oleracea
MAASSSLSTLSHHQTLLSHPKTHLPTTPASSLLVPTTSSKVNGVLLKSTSSSRRLRVGSASAVVRAAAVEALESTDIDQLVEKSVNTIRFLAIDAVEKANSGHPGLPMGCAPMGHILYDEIMRYNPKNPYWFNRDRFVLSAGHGCMLQYALLHLAGYDSVLEEDLKTFRQWGSRIPGHPENFETPGVEVTTGPLGQGIANAVGLALAEKHLAARFNKPDAEIVDHYTYVILGDGCQMEGIAQEACSLAGHWGLGKLIAFYDDNHISIDGDTAIAFTESVDLRFEALGWHVIWVKNGNTGYDEIRAAIKEAKTVTDKPTLIKVTTTIGFGSPNKSNSYSVHGSALGSKEVEATRQNLGWPYEPFHVPEEVKKHWSRHTPEGASLEAEWNTKFAEYEKKYPEDATEFKSITTGEFPAGWEKALPTYTPETPGDATRNLSQQCLNALAKVIPGLLGGSADLASSNMTLLKMFGDFRRTHRKKETFRFGVREHGMGAICNGICLHSPGFVPYCATFFVFTDYMRGAMRISALSEAGVIYVMTHDSIGLGEDGPTHQPIEALSKFPAMPNILMLRPADGNETAGSYKVAVENRKTPSILALSRKKLPNLPGTSIEGVEKGGYTITDNSSGNKPDVILIGTGSELEIAAKAGDELRKEGKAVRVVSFVSWELFEKQSDEYKESVLPSDVTARVSIEAGSTFGWHKIVGSKGKAIGIDKFGASAPAGKIYQEYGITVEAVVEAAKSVC

SEQ ID NO: 10342 - DNA, 2070 bp, Aquifex aeolicus
  CDS (1)..(2070): transl_table=11
atggtagtccagcttgatcaaatacactttttcatttttcatgaagtccttaaaatatttaaaactatgcctcagctttttaaaacctctaaaaaaatcgacgagctggttataaacactattcgctttttgagcgttgatatggtcgaaagggcaaaatcaggacaccccggaatgcccctcggagcttcccacatagtttatctgctttacgacaggataatgaagtacaaccctaaaaatcccaattggtttaacagggataggtttatactctctgcgggccacggaagtgcaatgctctatgcagccttctacatgttcggatttgacctgactcttgaggatctaaaagccttcaggcaactaaacagcaaaactccgggacaccccgaatacggactcactcccggcgttgaggtgactaccggaaacctcggacagggattcgggaatgcggttgggatggcgatggctgagaaatttttgtcccactactttaacagggaaggataccccgttatagatcactacacctacgtccttgtatcggatggggacttaatggagggtgtttcttacgaggctgcatcccttgcgggacactttaagttaaacaagttaatagcaatatgggacaacaaccacataactatagacggagacactaagcttacgtggacggaagacgtcttaaaaaggtttgaagccctcggttgggaagtgtaccacctggaagacgggtacaacttggatcttctggaagaaacgattctaaaagcaaaagaaagcgacaagcccacctttatatccgtgaggacgcacataggttacggaacgccccttcaggatacaccggaagtccacgggaagcctatgggcaaagagatagtggaggaaaccaagaagaagttcggctggccacttgaggagttttacgtccccgaagaggcactcaattatacgagaaggaaagttgaagaggggaaagctctcgaagaagagtggaacaaactttacgccgaatacagggaaaaataccccgaccttgcccagacgcttgagaaggctcttaacaaggagtggagtttagactggcttgaaaaagtagaggaattcaaagaagacatgcctaccagaaaagcctcggggaaagtgctcaacgtaatggcggattacatacccaccatgattggcggttcggcggacctttcggaatccgtgaacacagtgttgaaaaagtacggagattttgaagccgacacacctacaggaaggaacgttcactacggtgtcagggaacacgccatgggaacgattctcaacggcatggcttaccacggaggaatactcccttacggcggtactttcctcatattctcggagtacatgagacccgctataagaacggcagcactcgcaaacctacaggtaatcttcgtttactctcatgactccataggtctgggagaggacggtcctacccaccaacccgttgaacaactttggagcctgaggagcatacccaacctctgggtagtaagacccgccgacgcaaacgaggtgaagtacgcgtgggagatagccctgaagaggaaaaacggccccacggccataatactcacgagacaaaaagtaaaaaccatagacagatccaagtacgcctctccggaaggcgtaaggaaaggggcttacgttatagctgatacagaaggaaaaccggatgttgtaatcatcgcaacaggttcggaagttcaggttgcactcggagcgaaagagatactggaacaaaaaggaataaaaacgagagtggttaatatggcttgctgtgaactcttcgaagaacagcccgaagagtacaaaagggaagttctgcctcccgaagttacgaagagggtagccgttgaagcgggaagggacacgggctggtataagtacgtaggaagcgacggactcgttattagcctgaacgagttcggtaagtccgctcccggaagcgttctctttgagtattacggctttacaccggaaaacgtggccaataaggtaattgaaaagtggttttcctga

SEQ ID NO: 10343 - protein, 689 aa, Aquifex aeolicus
MVVQLDQIHFFIFHEVLKIFKTMPQLFKTSKKIDELVINTIRFLSVDMVERAKSGHPGMPLGASHIVYLLYDRIMKYNPKNPNWFNRDRFILSAGHGSAMLYAAFYMFGFDLTLEDLKAFRQLNSKTPGHPEYGLTPGVEVTTGNLGQGFGNAVGMAMAEKFLSHYFNREGYPVIDHYTYVLVSDGDLMEGVSYEAASLAGHFKLNKLIAIWDNNHITIDGDTKLTWTEDVLKRFEALGWEVYHLEDGYNLDLLEETILKAKESDKPTFISVRTHIGYGTPLQDTPEVHGKPMGKEIVEETKKKFGWPLEEFYVPEEALNYTRRKVEEGKALEEEWNKLYAEYREKYPDLAQTLEKALNKEWSLDWLEKVEEFKEDMPTRKASGKVLNVMADYIPTMIGGSADLSESVNTVLKKYGDFEADTPTGRNVHYGVREHAMGTILNGMAYHGGILPYGGTFLIFSEYMRPAIRTAALANLQVIFVYSHDSIGLGEDGPTHQPVEQLWSLRSIPNLWVVRPADANEVKYAWEIALKRKNGPTAIILTRQKVKTIDRSKYASPEGVRKGAYVIADTEGKPDVVIIATGSEVQVALGAKEILEQKGIKTRVVNMACCELFEEQPEEYKREVLPPEVTKRVAVEAGRDTGWYKYVGSDGLVISLNEFGKSAPGSVLFEYYGFTPENVANKVIEKWFS

SEQ ID NO: 10344 - DNA, 2001 bp, Bacillus halodurans
  CDS (1)..(2001): transl_table=11
atgtcgaaacatgttgaacagttagcagtcaatacgattcgaacgctatccattgacagtgtggaaaaagccaattcaggacaccctggaatgccgatgggagcagcgccgatggcgttttgtttatggacgaaattcatgaaccataacccagctaatccagactgggtaaatcgcgatcgctttgttttatcggcagggcacggctcgatgcttttgtacagcctactacaccttacaggctacgacctctcgcttgaggagttacaaaacttccgacaatggggaagcaaaacacctgggcatccagagtatgggcatacacctggtgtagaagcgacgacaggtccacttggacaaggggttgcaatggccgtaggtatggcaatggcagaacgtcatttagctgctacatacaaccgcgatgggtataatatcgttgaccattacacctatacgatttgtggagatggcgatttaatggaaggtgtttcagcagaagcagcgtctcttgctggtcacttaaaactagggcgcatgatcttgttgtacgattccaacgatatttcccttgatggggacctacaccattcattctctgaaagcgtagaggaccgcttcaaagcttatggatggcacgtagttcgtgtcgaggatggaaacaatctagacgaaattgcgaaagcgattgaagaggcgaaggcggacgagcgcccatcgttaattgaagtaaagacaaccatcggattcggttcaccgaataagggaggaaaatccgtatctcatggagcgcctcttggagcggacgaagtgaagttaacaaaggaagcctatgaatggacatatgaaaatgaatttcatatcccagaagaagtggctgcttattatgagcaggtcaaacagcaaggagctgagaaggaagagagctggaatgagctgttcgcccaatataaaaaagcataccctgagctcgcgagccagttcgaactagctgttcacggcgatcttccagaggggtgggatgcagttgcgccatcttatgaggtcggcaaatcagttgccactcgttcttcatccggtgaagcattgaacgcttttgcgaaaactgtccctcaactctttggtggctcagctgacttggcttcttcaaacaaaacgctcattaagggggaagctaatttctcccgtgatgactacagcggtcgtaacgtttggtttggtgttcgggaatttgccatgggtgctgccatgaacggaatggctttacacggcggcttgaaagtgtttggcgccacatttttcgtcttctctgattacttgcgccctgcgattcgtttagctgctttaatgcaattgccggtcatctacgtatttactcatgacagcattgcagttggcgaagatggaccaacacatgagccggtagagcagcttgcctctttacgtgcgatgccagggttgtctgtgattcgtccagcagacggaaacgaatcggtagctgcgtggaaactcgcactcgaaagtaaagatcaaccgacggctctcgtcttatcaagacaaaatttaccgactcttgaaggcgcagtggaccgcgcatatgatggtgtctcaaaaggcgcctacgttttggcaccagctaatggttctgctgatcttttattactcgcttcagggtcagaggtatcccttgcagtgaatgccaaagaagcccttgagaaagagggtattcatgcggctgttgtcagtatgcctagctgggatcgttttgaagcgcaatcggcagaatacaaagaggaagtacttccgtccgatgtgaccgctcgacttgcaattgaaatgggatcttcacttggctgggcgaaatatgtagggaatcaaggggatgttgtagcgattgatcgctttggtgcatcagccccaggtgaacgaatcatggaagagtttggctttactgttcaacatgtagttgctcgtgcgaaggcactccttgaaaacaaataa

SEQ ID NO: 10345 - protein, 666 aa, Bacillus halodurans
MSKHVEQLAVNTIRTLSIDSVEKANSGHPGMPMGAAPMAFCLWTKFMNHNPANPDWVNRDRFVLSAGHGSMLLYSLLHLTGYDLSLEELQNFRQWGSKTPGHPEYGHTPGVEATTGPLGQGVAMAVGMAMAERHLAATYNRDGYNIVDHYTYTICGDGDLMEGVSAEAASLAGHLKLGRMILLYDSNDISLDGDLHHSFSESVEDRFKAYGWHVVRVEDGNNLDEIAKAIEEAKADERPSLIEVKTTIGFGSPNKGGKSVSHGAPLGADEVKLTKEAYEWTYENEFHIPEEVAAYYEQVKQQGAEKEESWNELFAQYKKAYPELASQFELAVHGDLPEGWDAVAPSYEVGKSVATRSSSGEALNAFAKTVPQLFGGSADLASSNKTLIKGEANFSRDDYSGRNVWFGVREFAMGAAMNGMALHGGLKVFGATFFVFSDYLRPAIRLAALMQLPVIYVFTHDSIAVGEDGPTHEPVEQLASLRAMPGLSVIRPADGNESVAAWKLALESKDQPTALVLSRQNLPTLEGAVDRAYDGVSKGAYVLAPANGSADLLLLASGSEVSLAVNAKEALEKEGIHAAVVSMPSWDRFEAQSAEYKEEVLPSDVTARLAIEMGSSLGWAKYVGNQGDVVAIDRFGASAPGERIMEEFGFTVQHVVARAKALLENK

SEQ ID NO: 10346 - DNA, 2004 bp, Bacillus subtilis
  CDS (1)..(2004): transl_table=11
atggatacaattgaaaagaaatcagttgctaccattcgcacactgtcaatagacgctattgaaaaagcaaattctggtcacccagggatgccgatgggagccgctccaatggcatacacgctgtggacaaaatttatgaacgtaagtccggcaaaccctggctggtttaaccgtgaccgttttgttttatctgctggacacgggtcagcactattatacagcatgcttcatttaagcgggtttgatcttagtattgaagatcttaagggattccgccagtggggcagcaaaacaccaggacatccggaattcggacatactgccggtgttgatgctacaacaggtccgcttggccaaggaattgccatggcagtcggtatggcaattgctgaacgccatttagcggaaacatacaaccgcgattcatttaacgtagtcgatcattatacatacagtatttgcggtgatggtgatttaatggaaggtatttcttctgaagccgcttcactcgcaggccatcttcagcttggccgtctgatcgtactatacgattctaatgacatctctcttgatggagacctcgaccgttcattctctgaaaacgtgaaacagcgttttgaagcaatgaattgggaagttctttatgttgaggatggaaacaatattgaagaattaacagcggctatcgaaaaagcacgccaaaatgaaaagaaacctacattaattgaagtgaaaacgacaatcggattcggttcacctaaccgtgccggtacatccggtgttcacggtgcgccgcttggtaaagaagaaagcaaattaacaaaagaagcttacgcgtggacatatgaagaagacttctacgttccgtcagaagtttatgagcatttcgctgtagctgttaaagaatcaggtgagaaaaaagaacaagaatggaatgctcaattcgctaaatataaagaagtttatcctgaacttgctgaacagcttgaactggcaatcaaaggagagcttccgaaggactgggatcaagaggttcctgtgtatgaaaaaggaagcagtttggcatcccgtgcatcttccggtgaagttctcaacggacttgcgaaaaaaattcctttctttgtcggaggttctgctgacctagcgggatcgaacaaaacgactattaaaaatgccggtgattttacagcggttgattactcaggcaaaaacttctggtttggtgtacgtgaatttgcgatgggtgcggccttaaacggtatggcgcttcatggcggtcttcgtgtattcggcggaactttctttgtcttctctgattacctgcgtcctgcgattcgccttgcagcgttaatgggccttcctgtgacatatgtcttcacacatgacagtattgcggttggtgaagacggtccgacgcacgagcctgttgaacagcttgcttcactccgtgcgatgcctaacctttctttgatccgtccagcagacggcaatgagacagcagcagcatggaagcttgcagtgcaaagcactgaccacccaacagcgctagtgcttacacgtcaaaaccttcctaccatcgatcaaacatctgaagaagcattggcaggagtagaaaaaggtgcatatgtcgtttctaaatctaaaaacgaaacacccgacgctcttctcatcgcttccggatcagaggtaggtcttgcaattgaagcgcaggctgaattggcaaaagaaaatatcgatgtttctgttgtcagcatgccttcaatggaccgttttgagaaacaatctgatgaatacaaaaacgaagtccttcctgcagatgtgaaaaaacgtcttgcaattgaaatgggctcatcatttggatggggcaaatacacggggcttgaaggtgacgttctcggcatagaccgattcggtgcatctgctcctggtgaaaccatcattaacgaatacggcttctcagttccgaacgtagtgaatcgagttaaggcattaatcaataagtaa

SEQ ID NO: 10347 - protein, 667 aa, Bacillus subtilis
MDTIEKKSVATIRTLSIDAIEKANSGHPGMPMGAAPMAYTLWTKFMNVSPANPGWFNRDRFVLSAGHGSALLYSMLHLSGFDLSIEDLKGFRQWGSKTPGHPEFGHTAGVDATTGPLGQGIAMAVGMAIAERHLAETYNRDSFNVVDHYTYSICGDGDLMEGISSEAASLAGHLQLGRLIVLYDSNDISLDGDLDRSFSENVKQRFEAMNWEVLYVEDGNNIEELTAAIEKARQNEKKPTLIEVKTTIGFGSPNRAGTSGVHGAPLGKEESKLTKEAYAWTYEEDFYVPSEVYEHFAVAVKESGEKKEQEWNAQFAKYKEVYPELAEQLELAIKGELPKDWDQEVPVYEKGSSLASRASSGEVLNGLAKKIPFFVGGSADLAGSNKTTIKNAGDFTAVDYSGKNFWFGVREFAMGAALNGMALHGGLRVFGGTFFVFSDYLRPAIRLAALMGLPVTYVFTHDSIAVGEDGPTHEPVEQLASLRAMPNLSLIRPADGNETAAAWKLAVQSTDHPTALVLTRQNLPTIDQTSEEALAGVEKGAYVVSKSKNETPDALLIASGSEVGLAIEAQAELAKENIDVSVVSMPSMDRFEKQSDEYKNEVLPADVKKRLAIEMGSSFGWGKYTGLEGDVLGIDRFGASAPGETIINEYGFSVPNVVNRVKALINK

SEQ ID NO: 10348 - DNA, 1998 bp, Buchnera aphidicola subsp
  CDS (1)..(1998): transl_table=11
atgtattcacgaaaagaattagctaatgcaattcgtatgttaagtatagatgctgtacaaaatgcacaatcaggacatcctggtatgccgatgggaatggcagatattgctgaagtgttatggagaagttttttaaaacataatccagcaaatcctaattggaatgatcgcgatcgttttatattatctaacggacatggttctatgttgctctatagtttgttgcatcttacaggctataatctaccgatcgaagaattaaaaaaatttagacaactgaattcaaaaactccaggacatcctgaaacaggtgaaacacctggtgtagaaacaactactggtccattgggacaagggttagcaaatgctgttggtatggctattgcagaaagaactttaagttcttattttaatcgaccaggatatgatataattaatcattatacttgggtttttgtaggcgacggttgcttaatggagggtatttctcacgaagtctgttctttagcaggaactttaaatcttggaaaattaatcgttttttatgataaaaatggtatttcgatagatgggaaaacagctcactggttcaccgatgatacagcaaaacgttttgaatcttataattggcatgtattagataatatagatggtcatgattcagaatctatagaaagaagtataaaacaagcaaaattaataacaaatcaaccttctattattatttgcaatactattattggttttggttctcctaataaatcaggaacagcagaatcacatggagctcctctaggtgaggttgaaatttctttaattcgagaacaattgaaatggaattatcctccttttcagatacctaaagaaatttataaaaaatggaattttatagaagaaggatctaaacttgaaaagaaatggaacgaaaaattttctttatatcaatccaaatatcctgatttatcgactgaatatttgcggcgaataaataaaaaattacctgttgagtgggatagagtaactaataattacatttcttttttacaaaaaaatagacaaagtattgctagtcgtaaagcttctcaaaatacattagaaaaatatgcgatgattttacctgagttaatcggtggttcagcagatttatcaccgagcaatctcactatgtggtctagatgtaattccattaaagataatttatctggaaactatattcattatggagtacgtgaatttggaatgaccgctattgcaaatggcatatctcatcatggaggttttataccttatactgctacatttttaatgtttgtcgaatatgcacgaaatgcagttcgtatggctgctttaatgtgtaccaaacatatttttgtgtatactcacgattctattggactgggtgaagatggtcctacacatcaaccagtagaacaattatctagtttgagaataactcctaatatagatgtatggagacctagtgaccaagtagaaacagctgttgcttggaaaaaagctattgaaaaaacatcaggacctacagcattaattttatcacgtcaaaatcttgatcaatttgagagaagttctgaacaattagaaaacatttcttatggagcatatatattatatgattcaaaaaaaagacttgatattatctttatatcaactggatcagaattaaatgttactttaattgctgcaaaaaaattggcttctttagggtattctgtacgtgttgtatctatgccctgtactagtgtttttgatagacaagatgcttcttataaagaatttgtattaccgacttatgttgctaaaagggttgctgttgaagctagtatagaagatttttggtataaatacgtagggataaatggtgtaattattggaatgaaaacatttggtgaatctgctccagcagaagatttatttaaaaaatttggttttactgtacaaaatatcttcaataaatcattaattttattaaaatcttaa

SEQ ID NO: 10349 - protein, 665 aa, Buchnera aphidicola subsp
MYSRKELANAIRMLSIDAVQNAQSGHPGMPMGMADIAEVLWRSFLKHNPANPNWNDRDRFILSNGHGSMLLYSLLHLTGYNLPIEELKKFRQLNSKTPGHPETGETPGVETTTGPLGQGLANAVGMAIAERTLSSYFNRPGYDIINHYTWVFVGDGCLMEGISHEVCSLAGTLNLGKLIVFYDKNGISIDGKTAHWFTDDTAKRFESYNWHVLDNIDGHDSESIERSIKQAKLITNQPSIIICNTIIGFGSPNKSGTAESHGAPLGEVEISLIREQLKWNYPPFQIPKEIYKKWNFIEEGSKLEKKWNEKFSLYQSKYPDLSTEYLRRINKKLPVEWDRVTNNYISFLQKNRQSIASRKASQNTLEKYAMILPELIGGSADLSPSNLTMWSRCNSIKDNLSGNYIHYGVREFGMTAIANGISHHGGFIPYTATFLMFVEYARNAVRMAALMCTKHIFVYTHDSIGLGEDGPTHQPVEQLSSLRITPNIDVWRPSDQVETAVAWKKAIEKTSGPTALILSRQNLDQFERSSEQLENISYGAYILYDSKKRLDIIFISTGSELNVTLIAAKKLASLGYSVRVVSMPCTSVFDRQDASYKEFVLPTYVAKRVAVEASIEDFWYKYVGINGVIIGMKTFGESAPAEDLFKKFGFTVQNIFNKSLILLKS

SEQ ID NO: 10350 - DNA, 1998 bp, Buchnera aphidicola subsp
  CDS (1)..(1998): transl_table=11
atgtgtgtaagaagagaattagcaaacgcaattcgtatgttgagtatagatgctgttcaaaatgcaaaatctggtcatccgggtatgcctatgggaatggctgatattgcagaagttttatggagaaaattttttaaacatagtccaacgaatcctaattggaacaatcgtgatcgttttattctttctaacggacatggttctatgttgttatacagtttattgcatcttactggatatgatttatcaatagacgaacttaaaaaatttagacagcttcattcaaaaacaccaggacatccagaaacaggtgaaacgccaggtgttgaaactactactggtcccttagggcaaggtttagctaatgcggttggaatggctattgcagaaagaacattaagtgcttattttaatcgaccagattacgatatagttgatcattatacttgggtttttgtaggagacggttgtttaatggagggtatttctcatgaagtctgttctttggctggaacattaaaattagggaaattaattgttttttacgataaaaatggtatttcaatagatggtaaaatttcgaattggtttacagatgatacagttatgcgatttaaatcgtataattggcatgttgtagataaagtcgatggtcatgatgctaattctattaaaaatagtattgaagaagcaaaatcagtaaaagatcaaccttcaattattatttgtaatacgattattggttttggttctccaaacaagtcaggtacagctgattctcatggtgctcctcttggagaagaggaaatttttttaacgcgaaaaaatttaaattggaagtattcaccgtttgaaatacctaataaaatttatgataagtggaactttgtaaaacaaggtttaaaattagaagaaaattggaataaacaatttcatttatataaatctgaatatcctgcacttgcagaagaatattcaagaagaatcaaaaaaaaattacctacacaatggtataaaaaaactaaagattatatttttaatttgcaaaaaaatcctcaaaatattgcaactagaaaagcttctcaaaatgctatagaagaatttgcggcactacttccagaattaataggtggatctgcagatttgtcaccaagtaatctaactatgtggtcgaagtctagttccataacagaaaatttatgtggaaattatattcattatggtgttcgtgaatttggaatgacagcgattgctaatggaatctctcatcatggaggatttattccatatacttcgacatttttaatgtttgttgagtatgctcgaaatgcagtccgtatggcagctttgatgaatactaaacatatttttgtatatacacatgattctattggattaggtgaggatggtcctacacatcaaccaatagaacaattagcaaatttaagaatgacgccaaatatagatgtttggaggcctagcgatcaagtagaaactgctgtagcatggaaatatgcgattgaagaaaaaaatggtccaacagcactgattttgtcacgtcaaaatttattccaattttctagaaataatgaacaaataaaaaatatttcttacggggcttacatattatatgattctaaaaaacctatcgatatcatttttatatcaacaggttctgaattacaaataactttaacttctgctaaaaaaattgctgctttaggttattctgtgcgtgttgtatctatgccttctaataatgtttttgatagacaaaatattgattataaagaatcaatattgccatcttatattactaaaagaattgtaatagaggctagtataaaagacttctggtataaatatgcagggtcagaaggattaattattggcatggaaacatttggagaatctgcttcagaagaggttttatttaaaaaatttggttttactgtagaaaatatagtaaataaatctaaaattttattgaaacattaa

SEQ ID NO: 10351 - protein, 665 aa, Buchnera aphidicola subsp
MCVRRELANAIRMLSIDAVQNAKSGHPGMPMGMADIAEVLWRKFFKHSPTNPNWNNRDRFILSNGHGSMLLYSLLHLTGYDLSIDELKKFRQLHSKTPGHPETGETPGVETTTGPLGQGLANAVGMAIAERTLSAYFNRPDYDIVDHYTWVFVGDGCLMEGISHEVCSLAGTLKLGKLIVFYDKNGISIDGKISNWFTDDTVMRFKSYNWHVVDKVDGHDANSIKNSIEEAKSVKDQPSIIICNTIIGFGSPNKSGTADSHGAPLGEEEIFLTRKNLNWKYSPFEIPNKIYDKWNFVKQGLKLEENWNKQFHLYKSEYPALAEEYSRRIKKKLPTQWYKKTKDYIFNLQKNPQNIATRKASQNAIEEFAALLPELIGGSADLSPSNLTMWSKSSSITENLCGNYIHYGVREFGMTAIANGISHHGGFIPYTSTFLMFVEYARNAVRMAALMNTKHIFVYTHDSIGLGEDGPTHQPIEQLANLRMTPNIDVWRPSDQVETAVAWKYAIEEKNGPTALILSRQNLFQFSRNNEQIKNISYGAYILYDSKKPIDIIFISTGSELQITLTSAKKIAALGYSVRVVSMPSNNVFDRQNIDYKESILPSYITKRIVIEASIKDFWYKYAGSEGLIIGMETFGESASEEVLFKKFGFTVENIVNKSKILLKH

SEQ ID NO: 10352 - DNA, 2001 bp, Buchnera aphidicola subsp
  CDS (1)..(2001): transl_table=11
atgtgcttgcgtaggaaattagcaaatgcaattagagcacttagtatagatgcagtacaagaagcgcagtctggtcatccaggtatgcctatgggtatggctgatattgcagaagtattatggagagaattttttaaacataatcctaaaaatccattatggaataatagagatcgctttattctttcaaatgggcatggatccatgttattatatagtatattgcatcttactggatacaaactgtctattgatgatttaaaaaaatttagacaattaggttctaatacacctgggcatcctgagataggaagtactcctggagttgaaatgacaacaggaccattaggtcaaggtttaggggctgctgtagggatggctattgctgaacgcacattagcgtcaacttttaataaacctaattatgacattgtagatcattatacttgggtatttgtaggtgatggatgtttaatggaagggatatcgcatgaagtatgttctttagctgggacatttggattaggtaagttaattgtattttatgacagtaatggaatatcaattgatggtaaagtagaagaatggtttactgatgatacggaaaatcgttttaaagcatataattggcatgttgtttctaatgtagatggtcatgattatcgttctatttctagcgcaattaaagatgctatattggtaaaaaataaaccatctcttattatttgcaagactattattggatatgggtcacctaataagtcaggattagaaacatctcatggagcgcccctaggagaaaacgaagtattgttaactaaacaaaaattaggatggacttaccctccctttgtaatacctcaagacgtttatgatcattggaattttaatcttcaaggagtaattttagagaatgaatggaataaaaaatttcagggctattataataagtaccccgatttagctaatgaatatttacgacgtataagtaagaatgttccagacaaatttgtagataattttaataaattcatcaaagaattatatttatgtcctaaaaatatagctactagggttgcgtcacaaaatgtgttagaatttttaggaaaatcgttacctgagttaattggtggatctgctgatcttgctccaagcaatttaactatgtggtcgaagtctaaatctataaaacaagatatatcaggtaattatgtgcattatggtgttcgcgagtttggtatgacagcaatttctaatgggatagcgcattatggagggtttattccttatgttgcaacgtttttagcgtttatggattatgcgagaagcgcggttcgtatgtctgcactaatgaaaactcaaaatatttttatatatagtcatgattcaattggattaggagaagatggtcctactcatcagcctatagaacagctttctgcattacgttttattcctaacgttaatgtatggcgaccatgtgatcaacttgaaacagctattgcttggaaaaatgctatagaaagaaaagatggacctacagcattaattttatcacgtcaaattttatgtcaaatagatcgcagtcaggaacagattaatgatatttaccgtggtggatatattgttaatacaacagtacgtagtcctaaggttatcattgttgctactggatcagaggttaaaattgcattagatgtttccaatattttatttaaaaagggtattttagttagagtagtgtctatgccatctactaatgtattcgatcagcaagataatgattataaagaattcatttttcctagatgtcttgtacatcgtgtagcgattgaagctggaatatctgatttttggtataagtacgttggattaacaggttgtattattggaatagatacgtttggagagtcaggatcttctgatcaattatttagtaaatttgggtttaattctgatataatttctgaaaaaataatttcttatttaaaatcgtcataa

SEQ ID NO: 10353 - protein, 666 aa, Buchnera aphidicola subsp
MCLRRKLANAIRALSIDAVQEAQSGHPGMPMGMADIAEVLWREFFKHNPKNPLWNNRDRFILSNGHGSMLLYSILHLTGYKLSIDDLKKFRQLGSNTPGHPEIGSTPGVEMTTGPLGQGLGAAVGMAIAERTLASTFNKPNYDIVDHYTWVFVGDGCLMEGISHEVCSLAGTFGLGKLIVFYDSNGISIDGKVEEWFTDDTENRFKAYNWHVVSNVDGHDYRSISSAIKDAILVKNKPSLIICKTIIGYGSPNKSGLETSHGAPLGENEVLLTKQKLGWTYPPFVIPQDVYDHWNFNLQGVILENEWNKKFQGYYNKYPDLANEYLRRISKNVPDKFVDNFNKFIKELYLCPKNIATRVASQNVLEFLGKSLPELIGGSADLAPSNLTMWSKSKSIKQDISGNYVHYGVREFGMTAISNGIAHYGGFIPYVATFLAFMDYARSAVRMSALMKTQNIFIYSHDSIGLGEDGPTHQPIEQLSALRFIPNVNVWRPCDQLETAIAWKNAIERKDGPTALILSRQILCQIDRSQEQINDIYRGGYIVNTTVRSPKVIIVATGSEVKIALDVSNILFKKGILVRVVSMPSTNVFDQQDNDYKEFIFPRCLVHRVAIEAGISDFWYKYVGLTGCIIGIDTFGESGSSDQLFSKFGFNSDIISEKIISYLKSS

SEQ ID NO: 10354 - DNA, 1998 bp, Haemophilus influenzae
  CDS (1)..(1998): transl_table=11
atggcaactcgtagacaattagccaatgcaattcgtgtcttagcaatggattctgtacaaaaagcgaaatctggtcaccctggtgcaccaatggggatggcggatattgctgaagtattatggcgcgactttttaaaacacaatccaaccaatcctaaatgggctgatcgagatcgttttgtactttctaacggccatggttctatgttgatttatagtcttttacatttaactggctatgatctttctatcgaagatttaaaacaattccgtcaattacattctaaaaccccaggtcacccagaatatggttatgcccctggtgttgaaaccacgactggcccgttaggtcaaggtatcactaatgcggtgggtatggcaattgctgagaaaaccttagctggacaatttaaccgtgaaggccatgaaattgtcgatcaccacacttatgtgttcttaggcgatggttgtttaatggaagggatttctcacgaggcttgctctttagcaggaaccttaggtctgggtaaattaatcgcattctacgatgacaacaatatttccattgatggtcatgttgatggctggttcagtgatgacactgccgagcgttttgaagcttatggctggcaagtaatccgtaatgtagatggtcacgatgcagagcaaattcgtgctgctaccattcttgctcaagcagaaaaaggaaaaccaacgttaattatttgtaaaaccatcatcggctttggttcaccaaataaatcaggttctcatgattcccatggcgcaccattaggcgatgaagaaatcgatttaacccgtaaagcacttggttgggaatatgcgccatttgaaattccagctgaatactatgctgaatggtcggcaaaagagaaaggtgctgcagcagaaaaatcttgggaagaaaaatttgccgcttatgcaaaagcctatcctgaattagcagcagaatttaaacgtcgtgtttctggcgaattaccaacaaactgggcggcagaatctaaagcgttcatcgaaaaattacaagcaaatccagcgagtattgcaagccgtaaagcatcacaaaatgctatcgaagcttatgcgcacgtattacctgaattcttaggtggctctgcagacttagcaagctctaacttaacgttatggagtggttctaaaccaattcgtgcccacgaaaacgtaggtggtaactacattaactacggcgttcgtgaatttggtatgtctgccattatgaacggtattgctttacacggcggtttcattccttacggcgcaaccttcttaatgttctacgaatatgctcacaatgcggtgcgtatggcagcattaatgaaacaacgcacattattcgtttatacccacgattccattggtttaggcgaagatgggcctacacaccaaccagtagaacaaacggcttcactacgcttaattccaaaccttgaaacatggcgtccatgtgaccaagttgaatcagccatcgcatggcaacaagcggttgaacgtcaagatggcccaagtgcgttgatctttacccgtcaaaacttagcccaaatggaccgcacttctgcacaattagatgcggttaaacgtggtgcttatgtgttaaaagactgtgatggcacacctgagttaatcttcattgcgacaggttctgaagtggaattagcagtgcaagcagccgaagcattaagtgctgaaggtaaaaaagtacgcgttgtttctatgccaagtactaaccgtttcgataaacaagatgcagcgtaccgtgaaagtgtattacctgcagcggtaaccaaacgtgttgcgattgaagcgggtattgctgacttctggtataaatacgttggattcaatggtcgtgttatcggtatgaatagctttggcgaatccgcaccagcagatcaattattcaaactctttggtttcactgttgaaaacgtggtagcaaaagcgaaagaaattctttaa

SEQ ID NO: 10355 - protein, 665 aa, Haemophilus influenzae
MATRRQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAERFEAYGWQVIRNVDGHDAEQIRAATILAQAEKGKPTLIICKTIIGFGSPNKSGSHDSHGAPLGDEEIDLTRKALGWEYAPFEIPAEYYAEWSAKEKGAAAEKSWEEKFAAYAKAYPELAAEFKRRVSGELPTNWAAESKAFIEKLQANPASIASRKASQNAIEAYAHVLPEFLGGSADLASSNLTLWSGSKPIRAHENVGGNYINYGVREFGMSAIMNGIALHGGFIPYGATFLMFYEYAHNAVRMAALMKQRTLFVYTHDSIGLGEDGPTHQPVEQTASLRLIPNLETWRPCDQVESAIAWQQAVERQDGPSALIFTRQNLAQMDRTSAQLDAVKRGAYVLKDCDGTPELIFIATGSEVELAVQAAEALSAEGKKVRVVSMPSTNRFDKQDAAYRESVLPAAVTKRVAIEAGIADFWYKYVGFNGRVIGMNSFGESAPADQLFKLFGFTVENVVAKAKEIL

SEQ ID NO: 10356 - DNA, 2103 bp, Mycobacterium bovis
  CDS (1)..(2103): transl_table=11
gtgaccacactcgaagagatctccgcgcttacccgaccgcgccatcccgacgactggaccgagatcgattcggctgccgtcgacaccatccgggtattggccgccgatgccgtccaaaaggtcggcaacggtcatcctggaacggcgatgagcctggctccgttggcctacacgctgtttcagcggacaatgcgtcacgatcccagcgacacacactggctgggccgcgatcggttcgttttgtcggccgggcacagcagcctgaccctctacatccagctctacctcggcggcttcggcctggaactgtccgacattgagtcgttgcgcacctggggatccaagacccccggacacccggagttccgccacacccccggcgttgagatcaccaccggcccgctggggcagggactggcgtcggcggtcgggatggcgatggcctcgcgctacgagcgcggcctgttcgacccggacgccgaaccgggcgccagccccttcgaccactacatctatgtcatcgcctccgacggtgacatcgaagaaggggtgacctcggaggcgtcgtcgctggccgcggtccagcaactgggcaacctcatcgtgttctacgaccgcaaccagatctcgatcgaggacgacaccaacatcgcgctgtgtgaggacaccgcggcccgctaccgcgcgtacggctggcacgtgcaagaggttgagggcggtgagaacgtcgtcggcatcgaggaggccatcgccaatgcgcaggcggtcaccgaccggccctcgttcatcgcgctgcgcaccgtcatcggctatccggcgccgaacctgatggacaccggcaaggcgcacggcgcggcgctgggcgacgacgaggtggccgcagtcaagaagatcgtcggcttcgatccggacaagacgttccaggtccgcgaggacgtcctcacccacacccgagggctggtggcccgcggcaaacaggcccacgaacgctggcagctcgaattcgatgcctgggcgcggcgtgaacccgagcgcaaggcgctgctggaccggctgctcgcgcagaagttgcccgacggctgggacgccgacttgccccactgggaaccggggtccaaggcgctggccacccgtgcggcctcgggtgcggtgctgtccgcgctcgggccgaaactgcccgagttgtggggcggttcggccgacctggcgggcagcaacaacacaacgataaagggcgccgactcctttggcccgccctcgatttccaccaaggagtacaccgcgcactggtatggtcgcaccttgcacttcggtgttcgcgagcacgcgatgggtgccatcctgtccggcatcgtgctgcacggacccacccgggcttacggcggcaccttcctgcagttctccgactacatgcgcccggcggtgcggctggcggcgttgatggacatcgacaccatctacgtctggacgcacgactcgatcggcctcggcgaagacgggcccacccatcaaccgatcgagcacctctcggcgctgcgcgcgatcccccggctgtcggtggtgcgcccggcagatgccaacgagacagcctacgcctggcgcacgatcctggcccgccgcaacggcagcgggccggtcgggttgatcctgacccgccagggtgtgccggtgctggacggcaccgacgccgagggggttgcccgcggcggttacgtgctgagtgacgccggtggtctgcaaccgggcgaggaacccgacgtcattctcatcgccaccggctcggaggtgcagctggcggtcgcggcgcagacgttgctggcggacaacgacatcctcgctcgggtggtgtcgatgccgtgcctggagtggttcgaggcccaaccctacgagtaccgcgacgcggtgctgcccccgacggtgtcggcgcgggtggccgtcgaagccggcgtcgcgcaatgctggcaccagctggttggcgacacgggcgagatcgtctcgatcgagcactacggcgaatccgcggaccacaagaccttgttccgcgagtacggcttcactgccgaggccgtggccgccgccgccgaacgagcgctggataactga

SEQ ID NO: 10357 - protein, 700 aa, Mycobacterium bovis
MTTLEEISALTRPRHPDDWTEIDSAAVDTIRVLAADAVQKVGNGHPGTAMSLAPLAYTLFQRTMRHDPSDTHWLGRDRFVLSAGHSSLTLYIQLYLGGFGLELSDIESLRTWGSKTPGHPEFRHTPGVEITTGPLGQGLASAVGMAMASRYERGLFDPDAEPGASPFDHYIYVIASDGDIEEGVTSEASSLAAVQQLGNLIVFYDRNQISIEDDTNIALCEDTAARYRAYGWHVQEVEGGENVVGIEEAIANAQAVTDRPSFIALRTVIGYPAPNLMDTGKAHGAALGDDEVAAVKKIVGFDPDKTFQVREDVLTHTRGLVARGKQAHERWQLEFDAWARREPERKALLDRLLAQKLPDGWDADLPHWEPGSKALATRAASGAVLSALGPKLPELWGGSADLAGSNNTTIKGADSFGPPSISTKEYTAHWYGRTLHFGVREHAMGAILSGIVLHGPTRAYGGTFLQFSDYMRPAVRLAALMDIDTIYVWTHDSIGLGEDGPTHQPIEHLSALRAIPRLSVVRPADANETAYAWRTILARRNGSGPVGLILTRQGVPVLDGTDAEGVARGGYVLSDAGGLQPGEEPDVILIATGSEVQLAVAAQTLLADNDILARVVSMPCLEWFEAQPYEYRDAVLPPTVSARVAVEAGVAQCWHQLVGDTGEIVSIEHYGESADHKTLFREYGFTAEAVAAAAERALDN

SEQ ID NO: 10358 - DNA, 1947 bp, Mycoplasma genitalium
  CDS (1)..(1947): transl_table=4
atgaaatacttatatgccactcaacaccttactttaaatgctattaagcatgctaagggaggacatgttggcatggccattggtgcaagtcctatcttatttagtttatttactaaacactttcactttgatcctgaccaaccaaagtggatcaacagagatcgctttgttttaagtgctggccatggtagcatggcattatattcaattttccattttgccggacttatttctaaacaagagatcttacagcataaacatggtcaaattaacacttcttcccatcctgaatatgctccaaataacttcatagatgcatcaacaggccctttaggtcaaggctttggcatggcagttggcatggtgttagcacaaaagttattagctaatgaatttaaagagctaagtgataaattgtttgaccattacacctatgtggttgttggggatggagatctacaggagggggttagttatgaagttagtcaaattgctgggttatataaattaaataaactaattgtgcttcatgattcaaatagagtgcaaatggatagtgaagtaaaaaaagttgctaatgaaaatctaaaggttaggtttgaaaacgttggttggaattacatccatactgatgatcaactagaaaatattgatcaagctattattaaagccaaacaatcagataagccaacttttattgaagtgagaacaactattgctaaaaacacccaccttgaagatcagtatggaggacattggtttattcccaatgaagtggactttcaactttttgagaaaagaacaaatactaactttaacttttttaattatccagatagtatttaccactgattcaaacaaactgttattgaaagacaaaaacaaattaaagaagattacaacaatttgctaatttctcttaaagacaaaccactttttaaaaaatttactaattggattgacagtgattttcaagccctttatcttaaccaactagatgaaaagaaagtagcaaaaaaagatagtgctactagaaactatttaaaagattttttaaaccaaattaataatcctaattccaacttgtattgcttaaatgctgatgtatcacgttcttgttttatcaagataggtgatgataatctccatgaaaatccttgttctagaaatatccaaataggaattagggagtttgcaatggcaacaataatgaatggtatggcacttcatggtggtattaaagtgatgggtggtacttttttagcatttgctgattattcaaagccagcaattcgcttaggtgcattaatgaacttaccagtattttatgtttatacccatgactcttatcaagtagggggtgatggtcctactcatcaaccctatgatcaactaccaatgttaagagcaattgaaaatgtttgtgtatttcgtccttgtgatgaaaaggaaacttgtgctggatttaactatggtcttttaagtcaagatcagacaactgttttggttttaacacgtcaacccttaaaatccattgataacactgatagtttaaaaacactgaagggtggttatatccttttggatagaaaacaacctgatttaattattgctgctagtggtagtgaagtgcaacttgcaatagagtttgaaaaagttttaactaaacaaaatgtaaaggtaagaattctgtcagttcccaatataactttacttttaaaacaagatgaaaaatatctaaagagtttatttgatgctaacagttcacttatcaccatagaagctagtagtagctatgagtggttttgctttaagaagtatgttaaaaaccatgctcatttaggagcttttagttttggtgaatctgatgatggagataaagtttatcagcaaaaagggtttaatctggaaaggttaatgaaaatatttacttccctaagaaattaa

SEQ ID NO: 10359 - protein, 648 aa, Mycoplasma genitalium
MKYLYATQHLTLNAIKHAKGGHVGMAIGASPILFSLFTKHFHFDPDQPKWINRDRFVLSAGHGSMALYSIFHFAGLISKQEILQHKHGQINTSSHPEYAPNNFIDASTGPLGQGFGMAVGMVLAQKLLANEFKELSDKLFDHYTYVVVGDGDLQEGVSYEVSQIAGLYKLNKLIVLHDSNRVQMDSEVKKVANENLKVRFENVGWNYIHTDDQLENIDQAIIKAKQSDKPTFIEVRTTIAKNTHLEDQYGGHWFIPNEVDFQLFEKRTNTNFNFFNYPDSIYHWFKQTVIERQKQIKEDYNNLLISLKDKPLFKKFTNWIDSDFQALYLNQLDEKKVAKKDSATRNYLKDFLNQINNPNSNLYCLNADVSRSCFIKIGDDNLHENPCSRNIQIGIREFAMATIMNGMALHGGIKVMGGTFLAFADYSKPAIRLGALMNLPVFYVYTHDSYQVGGDGPTHQPYDQLPMLRAIENVCVFRPCDEKETCAGFNYGLLSQDQTTVLVLTRQPLKSIDNTDSLKTLKGGYILLDRKQPDLIIAASGSEVQLAIEFEKVLTKQNVKVRILSVPNITLLLKQDEKYLKSLFDANSSLITIEASSSYEWFCFKKYVKNHAHLGAFSFGESDDGDKVYQQKGFNLERLMKIFTSLRN

SEQ ID NO: 10360 - DNA, 2100 bp, Mycobacterium leprae
  CDS (1)..(2100): transl_table=11
gtgaccacactcgaccagatctccacgctgacccaaccgcgccatcccgatgactggaccgagatcgattcggctgcagtcgacaccatcagggtgttggctaccgacgcggtccaaaaagctggcaacgggcacccggggacggcgatgagcttggccccgctggcctacactttgttccagcgcactctacgccacgaccccaatgacaccgcatggctgggtcgtgaccgattcgtgctgtcggccgggcatagcagcctgaccttatatatacaactctatctcggcggcttcggtctcgaactatctgacatcgaatcgctgcgcacctggggatccacaactcctgggcatccagagttccggcacactaagggtgttgagatcaccaccggcccactcggccagggtctagcatcagcagtcgggatggcgatggcatcacgttacgaacgtggcctgttcgaccccgacgctgaaccgggagccagccctttcgaccattacatttatgtgatcgcctccgacggggacatcgaagaaggggtgacatcggaagcgtcgtccctggccgcagtccagcaactcggcaacctcatcgtgttctacgaccacaaccagatctcgatcgaaggcgacaccaaaatcacgctgtgcgaggacaccgccgcacgctaccgcgcctacggctggcacgtacaagaggtggaaggtggcgagaacgtcgtcggcattgaggaagccatcgccaacgcgaaagccgccaccgaccggccgtcgttcatctcactgcgcaccatcatcggttatcccgcgccaaccttgataaacaccggcaaagcgcacggtgcggcccttggcgaagacgaggtagcggccactaagcgaatccttgggttcgatcccgacaagacctttgcagtccgcgaggacgtaatcacccacacccgcggcttgatagcccgcggcaaagaagcccacgaacgctggcaactagaattcgaagcgtgggcacagcgcgagcccgaacgcaaggcactgttggatcggttgctcgcccagcagcttcccgacggctgggatgctgacctgccgaactgggagccgaggtccaaggaattggccacccgcgccgcatctggtgcggtactatccgcgataggaccgaaactcccggagttgtggggcgggtcggccgatctagcgggcagcaacaacaccaccataaaagacgttgattcctttgggccgccgtcgatttcgaccgacgagtacaccgcacattggtatggtcgcaccttgcatttcggtgttcgcgaacacgcgatgggcgccattctgtccggcatcgtgctgcacggccccacccgcgcatatggtggtacatttctacaattctccgactacatgcgcccgtcggtgcgactggcgtcgttgatggatattgacacgatctacgtgtggacgcacgattcggtcggactcggcgaggacggcccaacccatcagcccatcgaacacctcgcagcgttgcgtgctatccctcgattgtcggtggtgcgtcccgccgatgccaacgaaacggcatatgcctggcgcacaatcctggctcgcggcgccaacagcggtccggtcgggctaatcctgacccggcagagtgtgccagtgttggaaggcaccaacaccgaaggcgtcgcccgaggcggctatgtgctaggcgatggtggcagctctgaagctaaggagcctgacgtcattttgatcgccaccggatccgaggtccaactcgctgtcgcagctcagaagttgttggcggataaagacatcattgtgcgggtggtgtcgatgccgtgtgtggaatggttcgagtcacagccgtacgagtatcgcgacagtgtgttgcccccgtcagtgtcggcacgggtggccgtcgaggccggcgtcgcgcaatgctggcataagctggtcggagacaccggcaagattgtgtccatcgagcactacggcgaatccgcagattaccagactttgttccgtgagtacggcttcacgccggaggccgtggttgccgcagcggaacaggtattggataactga

SEQ ID NO: 10361 - protein, 699 aa, Mycobacterium leprae
MTTLDQISTLTQPRHPDDWTEIDSAAVDTIRVLATDAVQKAGNGHPGTAMSLAPLAYTLFQRTLRHDPNDTAWLGRDRFVLSAGHSSLTLYIQLYLGGFGLELSDIESLRTWGSTTPGHPEFRHTKGVEITTGPLGQGLASAVGMAMASRYERGLFDPDAEPGASPFDHYIYVIASDGDIEEGVTSEASSLAAVQQLGNLIVFYDHNQISIEGDTKITLCEDTAARYRAYGWHVQEVEGGENVVGIEEAIANAKAATDRPSFISLRTIIGYPAPTLINTGKAHGAALGEDEVAATKRILGFDPDKTFAVREDVITHTRGLIARGKEAHERWQLEFEAWAQREPERKALLDRLLAQQLPDGWDADLPNWEPRSKELATRAASGAVLSAIGPKLPELWGGSADLAGSNNTTIKDVDSFGPPSISTDEYTAHWYGRTLHFGVREHAMGAILSGIVLHGPTRAYGGTFLQFSDYMRPSVRLASLMDIDTIYVWTHDSVGLGEDGPTHQPIEHLAALRAIPRLSVVRPADANETAYAWRTILARGANSGPVGLILTRQSVPVLEGTNTEGVARGGYVLGDGGSSEAKEPDVILIATGSEVQLAVAAQKLLADKDIIVRVVSMPCVEWFESQPYEYRDSVLPPSVSARVAVEAGVAQCWHKLVGDTGKIVSIEHYGESADYQTLFREYGFTPEAVVAAAEQVLDN

SEQ ID NO: 10362 - DNA, 1947 bp, Mycoplasma pneumoniae
  CDS (1)..(1947): transl_table=4
atgaaaaacctgtttgcttgccaacacttagcgttaagtgctattcaacacgctaagggtggtcatgtgggaatggccttaggtgctagtcctattttgtacaccttatggactaaacacatccagtttaaccctaactgtcccaaatggattaaccgggaccgtttagtgatgagtgcaggtcatggtagtatggccttatacccgatcttacactttgcggggttaattacgaagcaggaaatgctccatcacaaatacgggcaagtcaacacctcttcccatcccgagtatgcccctaataactttattgatgcgtccactggtcccttaggacaaggcctaggaatggctgtcgggatggccttgacacaacgggtactagcagctgaatttaaagcgttaagtcccaaactgtttgaccactttacctatgtggttgtgggtgatggtgatctccaggaaggggtgagttatgaggtagctcacttagcaggggtctaccagttaaataagctaatagtgctccatgattccaaccgggtgcagatggacagtgtcgtgcgtgatgtgtccttggaaaacctgcaaacccggtttaccaacatggggtgaaattaccttgaaactagtgatgcagttgcagacattgatgctgccattaaacaagcgaaaaagtccgataagccgaccttcattgaggtgcacacgacaattgctaaaaacaccaccttggaagaccaacccgctggtcactggtttattcctaccgacaaggactttgcgcgctttaacagcaacaccaagactaactttaccccgtttgaatatccccaaacggtgtatgacttctttcacaagcaggtcatagcacgccaagctaaaccagtgcaagcttacaaggaattactggaaaaactaaaggacaaaccgctgtatactaagtttattaattgaacggaaaacgattaccaggcgttgtacctcaaccagttagatgaacgcaaggtagcacaagccaatgcggcaacccgtaactacctcaaggactttttaggccaaattaacaacagtaattccaacttgtactgtctcaatgctgatgtagcacgttcgtgtaacattaagttaggtgatgataatttacataccaatccgcattcgcgcaacattcaggtgggtattcgggaatttggtatgtccaccattatgaacgggatggcactccatggtggggtcaaagtgatgggtggtaccttcctagcgtttgctgattattccaaacccgcaattcgcttaggggcgttaatgaacctccccaccttttatgtgtacacccatgactcttaccaagtcggtggtgatggaccaacccaccaaccgtacgatcaactcccgatgttaagggccattgaaaacgttcaggtttgacggccttgtgatgaaaaggaaacagcggctggggttaactatggtttgttaagccaagaccaaactaacgtattaattttgacccgtcaagctttgccttccctagaacaatctgatagtgtacagaccttgaaagggggctatattattagtaatagaaaacaacccgatgtcattgtggccgctagtggcagtgaagttcagctggcattgcaactagaacaagctctaaacgaacaacaattaaagacgcgggtggtgtcagtgcccaacattaacatgttgttaagtcaaccccaaagctacttgcaacaactgtttgatcctaacagtgttttactcaccttagaagcgagtgctagcatggagtggtatgcactagcaaaatacgtcaaaaagcacacccacttaggtgcttttagctttggtgagtccaatgacgggcaagtcgtgtatgaacacaagggctttaatgtgactaacttactcaagttgattaaaactctaaagagttaa

SEQ ID NO: 10363 - protein, 648 aa, Mycoplasma pneumoniae
MKNLFACQHLALSAIQHAKGGHVGMALGASPILYTLWTKHIQFNPNCPKWINRDRLVMSAGHGSMALYPILHFAGLITKQEMLHHKYGQVNTSSHPEYAPNNFIDASTGPLGQGLGMAVGMALTQRVLAAEFKALSPKLFDHFTYVVVGDGDLQEGVSYEVAHLAGVYQLNKLIVLHDSNRVQMDSVVRDVSLENLQTRFTNMGWNYLETSDAVADIDAAIKQAKKSDKPTFIEVHTTIAKNTTLEDQPAGHWFIPTDKDFARFNSNTKTNFTPFEYPQTVYDFFHKQVIARQAKPVQAYKELLEKLKDKPLYTKFINWTENDYQALYLNQLDERKVAQANAATRNYLKDFLGQINNSNSNLYCLNADVARSCNIKLGDDNLHTNPHSRNIQVGIREFGMSTIMNGMALHGGVKVMGGTFLAFADYSKPAIRLGALMNLPTFYVYTHDSYQVGGDGPTHQPYDQLPMLRAIENVQVWRPCDEKETAAGVNYGLLSQDQTNVLILTRQALPSLEQSDSVQTLKGGYIISNRKQPDVIVAASGSEVQLALQLEQALNEQQLKTRVVSVPNINMLLSQPQSYLQQLFDPNSVLLTLEASASMEWYALAKYVKKHTHLGAFSFGESNDGQVVYEHKGFNVTNLLKLIKTLKS

SEQ ID NO: 10364 - DNA, 2103 bp, Mycobacterium tuberculosis
  CDS (1)..(2103): transl_table=11
gtgaccacactcgaagagatctccgcgcttacccgaccgcgccatcccgactactggaccgagatcgattcggctgccgtcgacaccatccgggtattggccgccgatgccgtccaaaaggtcggcaacggtcatcctggaacggcgatgagcctggctccgttggcctacacgctgtttcagcggacaatgcgtcacgatcccagcgacacacactggctgggccgcgatcggttcgttttgtcggccgggcacagcagcctgaccctctacatccagctctacctcggcggcttcggcctggaactgtccgacattgagtcgttgcgcacctggggatccaagacccccggacacccggagttccgccacacccccggcgttgagatcaccaccggcccgctggggcagggactggcgtcggcggtcgggatggcgatggcctcgcgctacgagcgcggcctgttcgacccggacgccgaaccgggcgccagccccttcgaccactacatctatgtcatcgcctccgacggtgacatcgaagaaggggtgacctcggaggcgtcgtcgctggccgcggtccagcaactgggcaacctcatcgtgttctacgaccgcaaccagatctcgatcgaggacgacaccaacatcgcgctgtgtgaggacaccgcggcccgctaccgcgcgtacggctggcacgtgcaagaggttgagggcggtgagaacgtcgtcggcatcgaggaggccatcgccaatgcgcaggcggtcaccgaccggccctcgttcatcgcgctgcgcaccgtcatcggctatccggcgccgaacctgatggacaccggcaaggcgcacggcgcggcgctgggcgacgacgaggtggccgcagtcaagaagatcgtcggcttcgatccggacaagacgttccaggtccgcgaggacgtcctcacccacacccgagggctggtggcccgcggcaaacaggcccacgaacgctggcagctcgaattcgatgcctgggcgcggcgtgaacccgagcgcaaggcgctgctggaccggctgctcgcgcagaagttgcccgacggctgggacgccgacttgccccactgggaaccggggtccaaggcgctggccacccgtgcggcctcgggtgcggtgctgtccgcgctcgggccgaaactgcccgagttgtggggcggttcggccgacctggcgggcagcaacaacacaacgataaagggcgccgactcctttggcccgccctcgatttccaccaaggagtacaccgcgcactggtatggtcgcaccttgcacttcggtgttcgcgagcacgcgatgggtgccatcctgtccggcatcgtgctgcacggacccacccgggcttacggcggcaccttcctgcagttctccgactacatgcgcccggcggtgcggctggcggcgttgatggacatcgacaccatctacgtctggacgcacgactcgatcggcctcggcgaagacgggcccacccatcaaccgatcgagcacctctcggcgctgcgcgcgatcccccggctgtcggtggtgcgcccggcagatgccaacgagacagcctacgcctggcgcacgatcctggcccgccgcaacggcagcgggccggtcgggttgatcctgacccgccagggtgtgccggtgctggacggcaccgacgccgagggggttgcccgcggcggttacgtgctgagtgacgccggtggtctgcaaccgggcgaggaacccgacgtcattctcatcgccaccggctcggaggtgcagctggcggtcgcggcgcagacgttgctggcggacaacgacatcctcgctcgggtggtgtcgatgccgtgcctggagtggttcgaggcccaaccctacgagtaccgcgacgcggtgctgcccccgacggtgtcggcgcgggtggccgtcgaagccggcgtcgcgcaatgctggcaccagctggttggcgacacgggcgagatcgtctcgatcgagcactacggcgaatccgcggaccacaagaccttgttccgcgagtacggcttcactgccgaggccgtggccgccgccgccgaacgagcgctggataactga

SEQ ID NO: 10365 - protein, 700 aa, Mycobacterium tuberculosis
MTTLEEISALTRPRHPDYWTEIDSAAVDTIRVLAADAVQKVGNGHPGTAMSLAPLAYTLFQRTMRHDPSDTHWLGRDRFVLSAGHSSLTLYIQLYLGGFGLELSDIESLRTWGSKTPGHPEFRHTPGVEITTGPLGQGLASAVGMAMASRYERGLFDPDAEPGASPFDHYIYVIASDGDIEEGVTSEASSLAAVQQLGNLIVFYDRNQISIEDDTNIALCEDTAARYRAYGWHVQEVEGGENVVGIEEAIANAQAVTDRPSFIALRTVIGYPAPNLMDTGKAHGAALGDDEVAAVKKIVGFDPDKTFQVREDVLTHTRGLVARGKQAHERWQLEFDAWARREPERKALLDRLLAQKLPDGWDADLPHWEPGSKALATRAASGAVLSALGPKLPELWGGSADLAGSNNTTIKGADSFGPPSISTKEYTAHWYGRTLHFGVREHAMGAILSGIVLHGPTRAYGGTFLQFSDYMRPAVRLAALMDIDTIYVWTHDSIGLGEDGPTHQPIEHLSALRAIPRLSVVRPADANETAYAWRTILARRNGSGPVGLILTRQGVPVLDGTDAEGVARGGYVLSDAGGLQPGEEPDVILIATGSEVQLAVAAQTLLADNDILARVVSMPCLEWFEAQPYEYRDAVLPPTVSARVAVEAGVAQCWHQLVGDTGEIVSIEHYGESADHKTLFREYGFTAEAVAAAAERALDN

SEQ ID NO: 10366 - DNA, 2034 bp, Pichia stipitis
  CDS (1)..(2034)
atgtcgtccgtcgatcaaaaagctatcagcaccatccgtcttttggctgtggatgccgtcgctgctgccaactccggtcacccaggtgctccattgggtttggctccagctgcccacgccgtattcaagaagatgagattcaaccctaaggataccaagtggatcaacagagacagattcgtcttgtccaacggtcacgcctgtgccttgttgtactcgatgttggttctctacggctacgacttaaccgtcgaagacttgaagaagttcagacaattgggctccaagacccctggtcacccagaaaacaccgatgttccaggtgctgaagtcactaccggtccattaggtcaaggtatctgtaacggtgttggtattgcccttgcccaagctcaattcgctgccacctacaacaagccagacttccctatctccgactcgtacacctacgtcttcttgggtgacggttgtttgatggaaggtgtttcttcggaagcctcttctcttgctggtcacttgcaattgggtaatttgattgccttctgggacgacaacaagatctccattgacggttctactgaagttgcattcaccgaagacgttatcgccagatacaagtcgtacggatggcacattgttgaagtcagcgatgcagacaccgatatcactgccattgctgctgccatcgacgaagccaagaaggttaccaataagccaactttggttagattgactaccaccatcggtttcggttcgcttgctcaaggtactcatggtgtccacggtgctccattgaaggctgatgacatcaagcaattgaagactaagtggggcttcaacccagaagaatccttcgctgttccagctgaagttactgcttcctacaacgagcacgttgctgaaaaccagaagattcaacaacaatggaacgaattgttcgctgcctacaagcaaaagtacccagaattgggtgctgagctccaacgtcgtttggacggtaagttgccagaaaactgggacaaagccttgccagtctacaccccagccgacgctgccgttgctaccagaaagttgtctgaaatcgtcttgtccaagatcattccagaagtgccagaaatcattggtggttctgccgatttgactccttccaacttgaccaaggccaagggcactgttgacttccagcctgccgctactggcttgggtgattactctggtagatacatcagatacggtgttagagaacacgctatgggtgctatcatgaacggtatcgctgcctttggtgccaactacaagaactacggtggtactttcttgaactttgtctcctatgctgctggtgccgtcagattgtctgcattgtctgaattcccaatcacttgggtcgctacacacgactctatcggtttgggtgaagacggtccaacccatcaacctatcgaaacattggctcatttcagagctactccaaacatctctgtctggagaccagctgatggtaatgaaacctctgctgcttacaagagtgctatcgaatctacccacactccacacattcttgccttgaccagacaaaacttgccacaattggaaggatccagtattgaaaaggcttctaagggtggttacactttggtccaacaagacaaggctgacatcatcatcgttgctactggttccgaagtgtctcttgctgtcgatgccctcaaggtcttagaaggccaaggcatcaaggctggtgtcgtctccttgccagatcaattgaccttcgacaagcaatctgaagaatacaagttgtctgtcttgccagatggcgttccaatcttgtctgttgaagttatgtccaccttcggctggtctaagtactctcaccaacaattcggtttgaacagattcggtgcttccggtaaagctccagaaatcttcaagctcttcgaattcaccccagaaggtgttgctgaaagagctgccaagactgttgccttctacaagggcaaggatgttgtgtctccattgcgttctgccttctga

SEQ ID NO: 10367 - protein, 677 aa, Pichia stipitis
MSSVDQKAISTIRLLAVDAVAAANSGHPGAPLGLAPAAHAVFKKMRFNPKDTKWINRDRFVLSNGHACALLYSMLVLYGYDLTVEDLKKFRQLGSKTPGHPENTDVPGAEVTTGPLGQGICNGVGIALAQAQFAATYNKPDFPISDSYTYVFLGDGCLMEGVSSEASSLAGHLQLGNLIAFWDDNKISIDGSTEVAFTEDVIARYKSYGWHIVEVSDADTDITAIAAAIDEAKKVTNKPTLVRLTTTIGFGSLAQGTHGVHGAPLKADDIKQLKTKWGFNPEESFAVPAEVTASYNEHVAENQKIQQQWNELFAAYKQKYPELGAELQRRLDGKLPENWDKALPVYTPADAAVATRKLSEIVLSKIIPEVPEIIGGSADLTPSNLTKAKGTVDFQPAATGLGDYSGRYIRYGVREHAMGAIMNGIAAFGANYKNYGGTFLNFVSYAAGAVRLSALSEFPITWVATHDSIGLGEDGPTHQPIETLAHFRATPNISVWRPADGNETSAAYKSAIESTHTPHILALTRQNLPQLEGSSIEKASKGGYTLVQQDKADIIIVATGSEVSLAVDALKVLEGQGIKAGVVSLPDQLTFDKQSEEYKLSVLPDGVPILSVEVMSTFGWSKYSHQQFGLNRFGASGKAPEIFKLFEFTPEGVAERAAKTVAFYKGKDVVSPLRSAF

SEQ ID NO: 10368 - DNA, 2085 bp, Rhizobium meliloti
  CDS (1)..(2085): transl_table=11
atgaatgtttcgcagcagatcggaccgcgcgccgccgcctcggagcgcagcatggccgatgccatccggtttctttccatggatgccgtcgagaaggccaattccggtcaccccggcatgccgatgggcatggccgacgcggtgacggtcctcttcaaccgcttcatcaggatcgatccgtcacaccccgactggccggaccgcgaccgttttgtgctttcggccggccatggctcgatgctgctctattcgctccatcacctcatcggcttcgccgatatgccgatggccgagctttcatcctttcgccagcttggctcgaaaacggccggccaccccgaatatggccatgccctcggtatcgagaccaccaccggcccgctcggccaggggatctcgaccgctgtcggcatggcgatcgccgaacagatgatggccgcccgcttcggcagtgcgctctgcaaccacttcacttacgtggtagccggagacggctgcctgcaggaggggatcagccacgaggcgatcgaccttgccggacatttgaaattgcgcaagctcgtcgtgctgtgggacgacaaccggatatcgatcgacggctcgaccgatctctccacctcgatgaaccagcttgcgcgtttccgcgccgccggctgggacgcgcaagcagtcgacggccacgaccccgatgcggtggcaaaagcgatcgaacgggcgcgccggacccgaaagccgtcgctgatcgcctgccgcacccgtatcggcaagggtgccgccagcatggagggctcgcacaagacccacggcgcggcgctcggcgaaaaggagatcgctgccacacgcgaaaaactcggctggccgcatccgcccttcttcgttccgcccgagatcaaggccgcctgggaaaaggtggcgacgcggggccgcacggcccgcgaggcgtgggaaatccgccttgacgcttcgcgctcgaaaaagcgttacgagcagaccgtagagcggaagctcgacggcgaggtcggcgatctgcttgcaagattccggggcgcgcatcgcacaagggctacgaaggtcgcgacgcgtcaggcctcgcagatggctctggaggtcatcaacggcgccaccgctttgaccatcggcggctcggccgacctgaccggctcgaacctgacgctgacctcgcagacccagcccatctcgccgggtaatttcaagggccgctacctgcattacggcatccgcgagcacggcatggcggccgccatgaacggcatcgcgctccatggcggcttcatcccctatgggggcactttcctggtcttttccgactatgcccgcggtgccatgcgcctttcggccctgatgggcctgccggtcatctatgtgctgacccatgattccatcgggcttggcgaagacggaccgacgcaccagccggtcgagcatctggccatgctgcgcgccacgcccaacctcaacgtcttccggccggccgacatcatcgagacggcggaatgctgggagatcgcgattggcgagaagaacacgccgagcgtcttcgccctttcgcggcaggccctgccgatgctgcgccggacggacgggaacgagaacctatcggcgctcggggcctatgtcctgagggaggcgcgcggcgaccgggacatcacgcttctcgccacgggatccgaagtcgagatcgccgttgccgcagcggagcgcctgcaggccgaagaacgcatagcagcggcggtggtctccatgccgtgctgggagaagttcgaggctcaggacgcggcctatcataggcaggtcctcggagatgcaccgcgcatcgccatcgaggcggcgggccgcctcggctgggaccgttggatgggccccgacagtgctttcgtcgggatgacaggcttcggtgcctcggcaccggccggagacctctaccgccatttcggcattaccgccgaccatgtcgtcgcagaagccctggagcttctccgccgggcatgcccggaaacgccgcccataggtgcccggaccggcaaaccggtcgcccacatcgtcagatcatccgaggaggcatga

SEQ ID NO: 10369 - protein, 694 aa, Rhizobium meliloti
MNVSQQIGPRAAASERSMADAIRFLSMDAVEKANSGHPGMPMGMADAVTVLFNRFIRIDPSHPDWPDRDRFVLSAGHGSMLLYSLHHLIGFADMPMAELSSFRQLGSKTAGHPEYGHALGIETTTGPLGQGISTAVGMAIAEQMMAARFGSALCNHFTYVVAGDGCLQEGISHEAIDLAGHLKLRKLVVLWDDNRISIDGSTDLSTSMNQLARFRAAGWDAQAVDGHDPDAVAKAIERARRTRKPSLIACRTRIGKGAASMEGSHKTHGAALGEKEIAATREKLGWPHPPFFVPPEIKAAWEKVATRGRTAREAWEIRLDASRSKKRYEQTVERKLDGEVGDLLARFRGAHRTRATKVATRQASQMALEVINGATALTIGGSADLTGSNLTLTSQTQPISPGNFKGRYLHYGIREHGMAAAMNGIALHGGFIPYGGTFLVFSDYARGAMRLSALMGLPVIYVLTHDSIGLGEDGPTHQPVEHLAMLRATPNLNVFRPADIIETAECWEIAIGEKNTPSVFALSRQALPMLRRTDGNENLSALGAYVLREARGDRDITLLATGSEVEIAVAAAERLQAEERIAAAVVSMPCWEKFEAQDAAYHRQVLGDAPRIAIEAAGRLGWDRWMGPDSAFVGMTGFGASAPAGDLYRHFGITADHVVAEALELLRRACPETPPIGARTGKPVAHIVRSSEEA

SEQ ID NO: 10370 - DNA, 2019 bp, Rhodobacter capsulatus
  CDS (1)..(2019): transl_table=11
atggatctcgccgctctgcgggccaagacccccgatcactggaagcttgccaccgcgatccgcgtgctggcgatcgatgccgtgcaggcggccaattcgggccaccccggcatgccgatgggcatggccgatgtcgccacggttctgttccgcaaccacctgaaattcgacgcgaaagcgccgaactgggcggatcgtgaccggttcgtgctgtcggcgggccatggctcgatgctgctttatgcgctgttgcacctgaccggctatgaacaggcgacgctcgacgaggtgaagaacttccgccaatggggcgcgcggatggcggggcacccggaatatggccatctggagggggtcgagaccaccaccggcccgctgggtcaggggatctcgaccgccgtcggcatggcgattgcggaaaaatccatggcggcgcggttcggcaagaagctggtcgatcacaagatctgggtcatcgcgggcgacggctgtctgatggagggcatcagccaggaggccatcggtctggcgggcaagcaggagcttgataacctgatcgtgctttgggacaacaacaacatcaccatcgacggccgggtgacggtctccgacgtgaccgaccagaaggcgcgctttgccgcctcgggctgggatgtgctgtcctgcgacggccatgacgccgaagacatcgaccgcgcgctgacggcggcgaaaaaggccaagcgtccggtgctggtcgattgcaagacgctgatcggtttcggcagcccgaacaaggccgacagctatgcggtgcacggcgcgccgctgggcgatgccgaaatcaagctgacccgcgaggcttacggctgggagcatggtcccttcgtgatcccggccgagatcaaggcggaatgggaagcgatcggcgccaagggcgccgcggaacgcgccgaatgggaggcccgtctggccgccctgcccgcgggcaagcgcgccgaattcgaacgccagatggcccgcggtgtcgcgccgaaactggcgggcgccattcgcgccttcaagaaggcgcaatcggaagccgcgccgaaggttgccacccgcaaggccagcgaaatggtgctggccgcggtcaacccggtggtgcccgaaaccatcggcggctcggccgacctgaccggctcgaacctgacgaaaacctcggatatcgaggatttcatgcccggcaaccacaagggccgctacatgcgctacggcattcgcgaacatgcgatggcggcggcgatgaacggcatgtggctgcatggcggcgtgcggccctatggcggcaccttcttctgcttcaccgattatgcgcgcggcgcgatgcggctctcgtcgctgatgggcgtgcccaccgtttacgtcatgacccatgacagcatcggtctgggcgaggacggcccgacgcaccagccggtcgagcatctggcgatctgccgggcgacgccgaacacctggaccttccgccccgccgatgtgatcgagaccgccgaagcctgggaactggcgctgtcgtcggaacgcacgccctcggtgctggcgctgtcgcggcagaacctgcccacgctgcgcaccaagcacgaggcgaagaacctgaccgccaagggcgcctatgtcatcgccgaggccgagggcaagcgccaggcgatcctgatggcgaccggctccgaggtcgagatcgcgctgaaggcccgtgcgctgttgcaggccgaagcgatcggcacccgggtcgtctcgatgccctgcatggagcttttcgcggcccaggacgaggcttaccgcaagcgcatcctgcccgcgggcggcgtgcgcgtcgcggtcgaggcggcgatccggcagccctgggaccgctggcttctgggcgagcgcgggatggagcgcaaggcgggcttcgtcggcatggagggctttggcgcctcggccccggcggaacggctttacgccgaattcgggatcacccccgaggcgatcgccgccaaggtcaagagcctgctgtga

SEQ ID NO: 10371 - protein, 672 aa, Rhodobacter capsulatus
MDLAALRAKTPDHWKLATAIRVLAIDAVQAANSGHPGMPMGMADVATVLFRNHLKFDAKAPNWADRDRFVLSAGHGSMLLYALLHLTGYEQATLDEVKNFRQWGARMAGHPEYGHLEGVETTTGPLGQGISTAVGMAIAEKSMAARFGKKLVDHKIWVIAGDGCLMEGISQEAIGLAGKQELDNLIVLWDNNNITIDGRVTVSDVTDQKARFAASGWDVLSCDGHDAEDIDRALTAAKKAKRPVLVDCKTLIGFGSPNKADSYAVHGAPLGDAEIKLTREAYGWEHGPFVIPAEIKAEWEAIGAKGAAERAEWEARLAALPAGKRAEFERQMARGVAPKLAGAIRAFKKAQSEAAPKVATRKASEMVLAAVNPVVPETIGGSADLTGSNLTKTSDIEDFMPGNHKGRYMRYGIREHAMAAAMNGMWLHGGVRPYGGTFFCFTDYARGAMRLSSLMGVPTVYVMTHDSIGLGEDGPTHQPVEHLAICRATPNTWTFRPADVIETAEAWELALSSERTPSVLALSRQNLPTLRTKHEAKNLTAKGAYVIAEAEGKRQAILMATGSEVEIALKARALLQAEAIGTRVVSMPCMELFAAQDEAYRKRILPAGGVRVAVEAAIRQPWDRWLLGERGMERKAGFVGMEGFGASAPAERLYAEFGITPEAIAAKVKSLL

SEQ ID NO: 10372 - DNA, 1974 bp, Rhodobacter sphaeroides
  CDS (1)..(1974): transl_table=11
atgaaggacattggagccgcgcaggagacgcggatggcgaacgccatccgggccctcgcgatggatgcggtggagaaggccaagtcgggccatcccgggatgccgatggggatggcggacgtggcgaccgtcctcttcaaccgctttctcacggtcgatccttcggcgcccaaatggcccgaccgcgaccggttcgtgctgtcggcggggcatggctcgatgctgctctatgccatccatcatctgctgggctatgccgatatggacatggatcagatccggtccttccgccagctcggcgcgcggacggcgggccacccggaatacggccatgccgaggggatcgaggtcacgaccgggccgctcggtcaggggatcgcgaccgcggtgggcatggcgctggccgagcgcatgaagaacgcgcgctatggcgatgatctggtggaccatttcacctatgtcatcgcgggtgacggctgcctgatggagggcatctcgcacgaggccatcgacatgggcggtcatctgggcctcggccggctgatcgtgctgtgggacgacaaccgcatcaccatcgacggcgactcgggcatctcgacctcgaccgaccagaaggcgccgttcgccgcctcgggctggcatgtgctggcctgcgacggtcatgcgcccgaggagatcgccgccgccatcgaggccgcacggcgcgacccccggccctcgatgatcgcctgccgcacggtgatcggctacggcgcgccgaacaagcagggcggccacgatgtccatggcgcgccgctgggcgcggccgagatcgcggcggcgcgcgagcggctcggctgggaccatccgcccttcgagatccccgcggatctctacgaggcctggggccggatcgccgcccgcggcgccgacgcccgcgcggcctgggaaacacgccttcaggcgagccccctccgcgccgccttcgagacggcggaggcggccgacacctcggcgctgccgccggccatcgcggcctacaaggcgcggctctcggccgaggcgcccaaggtcgcgacccgcaaggcctcggaaatggcgctgggtgtggtcaacgaggcgctgcccttcgcggtcggcggctcggccgacctgacgggctcgaacctgacccgctcgaagggcatggtctcggtcgcgccgggcgccttcgcgggcagctatatccattacggcatccgcgagcacggcatggccgccgcgatgaacgggatcgcgctgcatggcggcctgcgcccctacggcggcaccttcatggccttcgccgactattgccggccctcgatccggctctcggcgctgatgggcgtgccggtgacctatgtcatgacgcacgattccatcgggctcggcgaggatgggcccacgcaccagccggtcgagcatctggcgagcctgcgggcgatcccgaaccttgcggtgatccggcctgcggatgcggtcgagaccgccgaggcctgggagatcgccatgacggcgacatccacgcccacgcttctggtgctgtcgcgccagaacctgcccacggtgcggaccgaacatcgggacgagaacctgaccgcgcgcggcgcctatctcctgcgggatccgggcgagcgacaggtgacgctgatcgcgaccggctcggagctggagctggcgctggccgcggcggatcttctggccgcggaaggcatcgccgccgccgtggtctcggcgccctgcttcgagctcttcgccgcgcagccggcggactaccgggcgacggttctgggacgggccccgcgtgtgggatgcgaggcggcgctgcggcaggggtgggatctcttcctcggaccgcaggacgggttcgtgggcatgacgggcttcggcgcttcggcgcccgcgcccgcactctatcaacatttcaacatcaccgctgaagccattgtcaaatcggcaaaagaacggatctga

SEQ ID NO: 10373 - protein, 657 aa, Rhodobacter sphaeroides
MKDIGAAQETRMANAIRALAMDAVEKAKSGHPGMPMGMADVATVLFNRFLTVDPSAPKWPDRDRFVLSAGHGSMLLYAIHHLLGYADMDMDQIRSFRQLGARTAGHPEYGHAEGIEVTTGPLGQGIATAVGMALAERMKNARYGDDLVDHFTYVIAGDGCLMEGISHEAIDMGGHLGLGRLIVLWDDNRITIDGDSGISTSTDQKAPFAASGWHVLACDGHAPEEIAAAIEAARRDPRPSMIACRTVIGYGAPNKQGGHDVHGAPLGAAEIAAARERLGWDHPPFEIPADLYEAWGRIAARGADARAAWETRLQASPLRAAFETAEAADTSALPPAIAAYKARLSAEAPKVATRKASEMALGVVNEALPFAVGGSADLTGSNLTRSKGMVSVAPGAFAGSYIHYGIREHGMAAAMNGIALHGGLRPYGGTFMAFADYCRPSIRLSALMGVPVTYVMTHDSIGLGEDGPTHQPVEHLASLRAIPNLAVIRPADAVETAEAWEIAMTATSTPTLLVLSRQNLPTVRTEHRDENLTARGAYLLRDPGERQVTLIATGSELELALAAADLLAAEGIAAAVVSAPCFELFAAQPADYRATVLGRAPRVGCEAALRQGWDLFLGPQDGFVGMTGFGASAPAPALYQHFNITAEAIVKSAKERI

SEQ ID NO: 10374 - DNA, 2058 bp, Schizosaccharomyces pombe
  CDS (1)..(2058)
atgacttcttcctcatatactgatatcgatacccttgctatcaacaccatccgtacgttggctgttgataccaccgcacatgccaagtctggtcatcccggtgcccccatgggtttggctcctgccgctcacgttcttttcagtcgtatcatgaagttcaaccctgctcaccccaagtggttgaaccgtgatcgcttcattctctctaatggtcacgcttgtgtcttacagtacatcatgtgccacttgcttggttacaaattgaccattgaagacttgaagcaattccgtcaagtcggcagtaagactcctggtcatcccgaaactcataaccctgacctcaacattgagactggtgctggtcctttgggtcaaggtattgctagtgctgttggtcttgccattggcaaagctcattctgctgctgtttacaacaagcctggttttgaccttttctccaactacaccttttgcttcttgggtgatggttgtcttcaagagggtgtctcttccgaggcctgttccttggctggtcacttgaagcttagcaacttgattgctgtttgggataacaacaagattaccattgacggtgctacctctatgtcctttgatgaagacgttgaaaagcgtttcgaggcctatggctggaacatcgttcgtgttgccaacggtgatactgatcttgatggtattgaaaagggtttccgtgaagccatgtcttgcactgacaagcctactttgattaacctcaagaccaccattggttacggttctgaacttcaaggtactcacagtgttcacggcagtcctcttaagcctgaagactgtgttcatgtcaagaaactctttggtttcgaccccaccaagactttccaagttcctcccgaggtttatgcctactacaaggagcgtgtcgccatcgcttcctctgctgaagaagagtacaaaaaaatgtatgcttcttacaagcaatcttaccctgatctttccaatcagcttgagcgtatcttgagccgtaaattccccgagggttgggagaagcatcttcctgtttacaagcccggtgacaaagctgtcgctactcgtaagctttcagaaattgttctcgatgctctttgccctgtcttgcctgaacttgttggtggttccgctgatttaactccttctaacttgactcgttgggaaggcgctgctgatttccaacctccttctagcaagctcggtacctatgccggtcgttacattcgttacggtattcgtgagcatggtatggctggtatcatgaacggtttggccgtctatggtcctatcatcccttacggtggtactttcttgaactttgtttcttatgctgccggtgccgttcgtatggctgccttgaacaacagccgtgtcatttatgttgctacccatgattctattggtttgggtgaggacggtcctacccatcaacctattgagacttttgctcatttccgtgctatgcccaacattaactgctggcgtcccgctgacggtaatgaaacttccgctgcttactacagtgctttgactagtgatagcactccttctattttggctttgactcgtcaaaaccttcctcaacttgagaactctactattgaaaatgctcttaagggtggttatgtcatgttggagaacaaggaggccgatattactcttgtcggtactggttctgaagtctctctttgcattgacactgtcaagacccttgagaccgagtacaacttgaaggctcgtgtcgtttcattgccttgctgggaagttttcgaacaacaaccagaaagctaccgtctttctgtcattcctgacggtattcctgctatgtccgtcgaggtttgggctaccaatggttggagacgttacgttcacgaggcctttggtatgcacacttttggtgactctggccctgctcccaaattatacgagaaattccatttcaccacctctggtgttgctcaacgtgccaaaaagactgttgatgcttacaaggatatcccttatattcgttcccctgtccgccgtgctttctaa

SEQ ID NO: 10375 - protein, 685 aa, Schizosaccharomyces pombe
MTSSSYTDIDTLAINTIRTLAVDTTAHAKSGHPGAPMGLAPAAHVLFSRIMKFNPAHPKWLNRDRFILSNGHACVLQYIMCHLLGYKLTIEDLKQFRQVGSKTPGHPETHNPDLNIETGAGPLGQGIASAVGLAIGKAHSAAVYNKPGFDLFSNYTFCFLGDGCLQEGVSSEACSLAGHLKLSNLIAVWDNNKITIDGATSMSFDEDVEKRFEAYGWNIVRVANGDTDLDGIEKGFREAMSCTDKPTLINLKTTIGYGSELQGTHSVHGSPLKPEDCVHVKKLFGFDPTKTFQVPPEVYAYYKERVAIASSAEEEYKKMYASYKQSYPDLSNQLERILSRKFPEGWEKHLPVYKPGDKAVATRKLSEIVLDALCPVLPELVGGSADLTPSNLTRWEGAADFQPPSSKLGTYAGRYIRYGIREHGMAGIMNGLAVYGPIIPYGGTFLNFVSYAAGAVRMAALNNSRVIYVATHDSIGLGEDGPTHQPIETFAHFRAMPNINCWRPADGNETSAAYYSALTSDSTPSILALTRQNLPQLENSTIENALKGGYVMLENKEADITLVGTGSEVSLCIDTVKTLETEYNLKARVVSLPCWEVFEQQPESYRLSVIPDGIPAMSVEVWATNGWRRYVHEAFGMHTFGDSGPAPKLYEKFHFTTSGVAQRAKKTVDAYKDIPYIRSPVRRAF

SEQ ID NO: 10376 - DNA, 1989 bp, Staphylococcus aureus
  CDS (1)..(1989): transl_table=11
atgtttaatgaaaaagatcaattagctgttgatacgctacgtgcactaagtatcgacacaatcgaaaaagcgaattctggtcatccaggattacctatgggagctgccccaatggcttacactttgtggacacgtcatctgaattttaatccacaatctaaagattacttcaatagagaccgtttcgtattatctgcagggcatggttcagcattattgtatagcttgttacatgtttctggtagtttagaattagaagaattaaagcaatttagacaatggggttctaaaacaccaggtcatcctgaatacagacatacagatggtgtagaagttactaccggaccacttggacaaggttttgctatgtcagtaggattagctttagcagaagatcacctagcagggaaatttaataaagaaggatataatgttgtagatcattacacatatgtattagcttctgacggtgatttaatggaaggtatatcgcatgaagcagcttcatttgctggacataataaattaagtaaattagttgttttatacgattcaaatgatatttcattagatggcgaattaaacaaagctttttctgaaaacacaaaagctcgttttgaagcatatggttggaattacttactagttaaagatggtaatgatttagaagaaattgataaagcgattactacagctaaatctcaagaaggaccaacgattattgaagttaaaacaacaatcggatttggttcaccgaataaagcaggaactaatggtgttcatggggcacctttaggtgaagttgaaagaaaattaacattcgaaaattacggtttagatcctgaaaaacgttttaatgtttcagaagaggtatacgaaattttccaaaatactatgttaaaacgtgctaatgaagatgaatctcaatggaattcattattagaaaaatatgcagaaacatatcctgaattagcagaagaatttaaattagcgattagtggtaaattgcctaaaaattataaggatgaattaccacgttttgaactgggtcataatggtgcatctcgtgctgattctggtactgttattcaagcaatcagtaaaactgtcccttcattctttggtggatcagcagaccttgctggttcaaacaaatccaatgtaaatgatgcaactgattatagttctgaaacacctgaaggtaaaaatgtgtggtttggtgtacgtgaatttgctatgggtgctgctgtaaatggtatggctgcacatggaggtttacatccatatggtgcaacattcttcgtatttagtgattatttaaaaccagcgttacgtttatcatcaattatgggattaaatgcaacgttcatcttcacacatgattcaattgcagtaggtgaagatggtcctactcatgaaccaattgagcaattagctggattaagagccattccaaatatgaatgttatccgtcctgctgatggtaatgaaacaagagtagcatgggaagttgccttagaatctgaatctacacctacttcattagtattgacacgtcaaaacttaccggtattagatgtaccagaagatgtagttgaagaaggcgttcgaaaaggtgcctatacagtttatggctctgaagagacaccagaattcctattattagcttcaggttcagaagttagtcttgcagttgaagctgctaaagatcttgaaaaacaaggtaaatcagtacgtgttgtttcaatgcctaactggaatgcatttgaacaacaatctgaagaatataaagaatcagttattccatcaagcgtaacaaaacgtgttgcgattgaaatggcttcaccgcttggatggcataaatatgtaggtactgcaggtaaagttattgctattgacggctttggcgcaagtgcacctggcgatttagtagttgaaaaatatggatttacaaaagaaaatatcttaaaccaagttatgagcttataa

SEQ ID NO: 10377 - protein, 662 aa, Staphylococcus aureus
MFNEKDQLAVDTLRALSIDTIEKANSGHPGLPMGAAPMAYTLWTRHLNFNPQSKDYFNRDRFVLSAGHGSALLYSLLHVSGSLELEELKQFRQWGSKTPGHPEYRHTDGVEVTTGPLGQGFAMSVGLALAEDHLAGKFNKEGYNVVDHYTYVLASDGDLMEGISHEAASFAGHNKLSKLVVLYDSNDISLDGELNKAFSENTKARFEAYGWNYLLVKDGNDLEEIDKAITTAKSQEGPTIIEVKTTIGFGSPNKAGTNGVHGAPLGEVERKLTFENYGLDPEKRFNVSEEVYEIFQNTMLKRANEDESQWNSLLEKYAETYPELAEEFKLAISGKLPKNYKDELPRFELGHNGASRADSGTVIQAISKTVPSFFGGSADLAGSNKSNVNDATDYSSETPEGKNVWFGVREFAMGAAVNGMAAHGGLHPYGATFFVFSDYLKPALRLSSIMGLNATFIFTHDSIAVGEDGPTHEPIEQLAGLRAIPNMNVIRPADGNETRVAWEVALESESTPTSLVLTRQNLPVLDVPEDVVEEGVRKGAYTVYGSEETPEFLLLASGSEVSLAVEAAKDLEKQGKSVRVVSMPNWNAFEQQSEEYKESVIPSSVTKRVAIEMASPLGWHKYVGTAGKVIAIDGFGASAPGDLVVEKYGFTKENILNQVMSL

SEQ ID NO: 10378 - DNA, 1989 bp, Staphylococcus aureus
  CDS (1)..(1989): transl_table=11
atgtttaatgaaaaagatcaattagctgttgatacgctacgtgcactaagtatcgacacaatcgaaaaagcgaattctggtcatccaggattacctatgggagctgccccaatggcttacactttgtggacacgtcatctgaattttaatccacaatctaaagattacttcaatagagaccgtttcgtattatctgcagggcatggttcagcactattgtatagcttgttacatgtttctggtagtttagaattagaagaattaaagcaatttagacaatggggttctaaaacaccaggtcatcctgaatacagacatacagatggtgtagaagttactactggaccacttggacaaggtttttctatgtcagttggattggctttagcagaagatcacctagcagggaaatttaataaagaaggatataatgttgtagatcattacacatatgtattagcttctgacggtgatttaatggaaggtatttcgcatgaagcagcttcatttgctggacataataaattaagtaaattagttgttttatacgattcaaatgatatttcattagatggcgaattaaacaaagctttttctgaaaacacaaaagctcgttttgaagcatatggttggaattacttactagttaaagatggtaatgatttagaagaaattgataaagcgattactacagctaaatctcaagaaggaccaacaattattgaagttaaaacaacaatcggatttggttcaccgaataaagcaggaactaatggtgttcatggggcacctttaggtgaagatgaaagaaaattaacattcgaaaattacggtttagatcctgaaaaacgttttaatgtttcagaagaagtatacgaaattttccaaaatactatgttaaaacgtgctaatgaagatgaatctcaatggaattcattattagaaaaatatgcagaaacatatcctgaattagcagaagaatttaaattagcgattagtggtaaattgcctaaaaattataaggatgaattaccacgttttgaatttggtcataatggtgcatctcgtgctgattctggtactgttattcaagcaatcagtaaaactgtcccttcattctttggtggatcagcagaccttgctggttcaaacaaatccaatgtaaatgatgcaacagattatagttctgaaacacctgaaggtaaaaatgtgtggtttggtgtacgtgaatttgctatgggtgctgctgtaaatggtatggctgcacatggaggtttacatccatatggtgcaacattcttcgtatttagtgattatttaaaaccagcgttacgtttatcatcaattatgggattaaatgcaacgttcatcttcacgcatgattcaattgcagtaggtgaagatggtcctactcatgaaccaattgaacaattagctggattaagagccattccaaatatgaatgttatccgtcctgctgatggtaatgaaacaagagtagcatgggaagttgccttagaatctgaatctacacctacttcattagtattgacacgtcaaaacttaccggttttagatgtaccagaagatgtagttgaagaaggcgttcgaaaaggtgcctatacagtttatggctctgaagagacaccagaatttctattattagcttcaggttcagaagttagtcttgcagttgaagctgctaaagatcttgaaaaacaaggtaaatcagtgcgtgttgtttcaatgcctaactggaatgcatttgaacaacaatctgaagaatataaagaatcagttattccatcaagcgtaacaaaacgtgttgcgattgaaatggcttcaccgcttggatggcataaatatgtaggtactgcaggtaaagttattgctattgacggctttggcgcaagtgcacctggcgatttagtagttgaaaaatatggctttacaaaagaaaatatcttaaaccaagttatgagcttataa

SEQ ID NO: 10379 - protein, 662 aa, Staphylococcus aureus
MFNEKDQLAVDTLRALSIDTIEKANSGHPGLPMGAAPMAYTLWTRHLNFNPQSKDYFNRDRFVLSAGHGSALLYSLLHVSGSLELEELKQFRQWGSKTPGHPEYRHTDGVEVTTGPLGQGFSMSVGLALAEDHLAGKFNKEGYNVVDHYTYVLASDGDLMEGISHEAASFAGHNKLSKLVVLYDSNDISLDGELNKAFSENTKARFEAYGWNYLLVKDGNDLEEIDKAITTAKSQEGPTIIEVKTTIGFGSPNKAGTNGVHGAPLGEDERKLTFENYGLDPEKRFNVSEEVYEIFQNTMLKRANEDESQWNSLLEKYAETYPELAEEFKLAISGKLPKNYKDELPRFEFGHNGASRADSGTVIQAISKTVPSFFGGSADLAGSNKSNVNDATDYSSETPEGKNVWFGVREFAMGAAVNGMAAHGGLHPYGATFFVFSDYLKPALRLSSIMGLNATFIFTHDSIAVGEDGPTHEPIEQLAGLRAIPNMNVIRPADGNETRVAWEVALESESTPTSLVLTRQNLPVLDVPEDVVEEGVRKGAYTVYGSEETPEFLLLASGSEVSLAVEAAKDLEKQGKSVRVVSMPNWNAFEQQSEEYKESVIPSSVTKRVAIEMASPLGWHKYVGTAGKVIAIDGFGASAPGDLVVEKYGFTKENILNQVMSL

SEQ ID NO: 10380 - DNA, 1989 bp, Staphylococcus epidermidis
  CDS (1)..(1989): transl_table=11
atgtttaatgaaaaagatcaattagctatagatacgatacgtgctttaagcattgatgcaatcgaaaaagcaaattcaggacaccctggattacctatgggagcagcacctatggcgtatactttatggacgcgccaccttaattttaaccctcaatctaaagatttttttaatagagatagatttattctatcagcaggtcatggttcggctttattgtatagcttattacatgtctctggtagtttagaacttgaagaacttaaacaatttagacaatggggttcgaagacgcctggacatccagaatatagacatactgatggcgtagaagttactactggtccattaggtcaaggttttgccatgtctgtagggatggcgttagcagaaagtcatttagcaggtaaatttaataaggaccaatttgatatagttaatcattacacttatgtattagcgtcagatggtgacttaatggaaggtatctcacatgaagctgcatcttttgcaggtcataatcagttagataaattaattgtcctttatgattcaaatgatatatctttagatggagatttagataaatcattttctgaagatacaaaacagcgtttcgaagcctatggttggaactatattctagttgaaaatggtaacgatttagatgagattgataatgcaatcactcaagctaaatcacaacaaggacctactattatcgaagttaaaactattatcggttttggttctcctaataaagctggttcaaatggagttcatggtgccccacttggtgaagaagaacgtgcacttacatttaaagaatatggattagatcctgaaaaacgttttaatgttcctgaagatgtatacgaaatatttaaatcaacaatgttaaaacgtgcaaatgaaaatgaagaggcttggaataatatgcttaaaaattatagtgaagcctatccggaattagctgaagaatttaaattagcaatgagtggtaagttaccaaataattacgctgatgccttaccagaatatgatttaaatcacagtggtgcttctagagctgattcaggagaaataattcaaaaattaagcgagtttgtaccttcattctttggtggatcagcagacttagcaggttcaaataaatctaacgttaaagaagctaaagattataataaagatactccagaaggtaaaaacgtatggtttggtgtacgtgaatttgcaatgggagcagcaataaacggcatggcagcacatggtggacttcatccatatgcagcaacattctttgtattcagtgattacctaaaaccagctttacgattatcatcaatcatgggactcaattcaacgttcatctttactcatgattcaattgctgtaggtgaagatggccctacacacgaacctattgaacaattagcaggtcttcgtgctattcctaacatgaatgttattcgtccagctgatggtaatgaaacacgtgtagcttgggaagttgcacttgaatcagaacaaacaccaacatcattagtgttaactcgtcaaaatttaccaactttggatgttgataaacaaacagttgaaaatggtgtgagaaaaggcgcatatattgtttttgaaacagaacaacaacttgaatatttattattggcatctggatcagaagttaatttagctgtagaagccgcaaaagaattagagcaacaaggtaaaggtgtacgagttatttctatgccaaactggtacgcatttgaacaacaatcttctgaatataaagaatcaattttaccttctgatgttactaaacgtatagctatcgaaatggcatcaccacttggttggcataaatatgttggaattgaaggtaaagtcattggtataaatagttttggcgctagtgctcctggagatttagtagttgaaaagtatggattcactaaagaaaatattttaaaacaagtccgttcattataa

SEQ ID NO: 10381 - protein, 662 aa, Staphylococcus epidermidis
MFNEKDQLAIDTIRALSIDAIEKANSGHPGLPMGAAPMAYTLWTRHLNFNPQSKDFFNRDRFILSAGHGSALLYSLLHVSGSLELEELKQFRQWGSKTPGHPEYRHTDGVEVTTGPLGQGFAMSVGMALAESHLAGKFNKDQFDIVNHYTYVLASDGDLMEGISHEAASFAGHNQLDKLIVLYDSNDISLDGDLDKSFSEDTKQRFEAYGWNYILVENGNDLDEIDNAITQAKSQQGPTIIEVKTIIGFGSPNKAGSNGVHGAPLGEEERALTFKEYGLDPEKRFNVPEDVYEIFKSTMLKRANENEEAWNNMLKNYSEAYPELAEEFKLAMSGKLPNNYADALPEYDLNHSGASRADSGEIIQKLSEFVPSFFGGSADLAGSNKSNVKEAKDYNKDTPEGKNVWFGVREFAMGAAINGMAAHGGLHPYAATFFVFSDYLKPALRLSSIMGLNSTFIFTHDSIAVGEDGPTHEPIEQLAGLRAIPNMNVIRPADGNETRVAWEVALESEQTPTSLVLTRQNLPTLDVDKQTVENGVRKGAYIVFETEQQLEYLLLASGSEVNLAVEAAKELEQQGKGVRVISMPNWYAFEQQSSEYKESILPSDVTKRIAIEMASPLGWHKYVGIEGKVIGINSFGASAPGDLVVEKYGFTKENILKQVRSL

SEQ ID NO: 10382 - DNA, 1989 bp, Staphylococcus epidermidis
  CDS (1)..(1989): transl_table=11
atgtttaatgaaaaagatcaattagctatagatacgatacgtgctttaagcattgatgcaatcgaaaaagcaaattcaggacaccctggattacctatgggagcagcacctatggcgtatactttatggacgcgccaccttaattttaaccctcaatctaaagatttttttaatagagatagatttattctatcagcaggtcatggttcggctttattgtatagcttattacatgtctctggtagtttagaacttgaagaacttaaacaatttagacaatggggttcgaagacgcctggacatccagaatatagacatactgatggcgtagaagttactactggtccattaggtcaaggttttgccatgtctgtagggatggcgttagcagaaagtcatttagcaggtaaatttaataaggaccaatttgatatagttaatcattacacttatgtattagcgtcagatggtgacttaatggaaggtatctcacatgaagctgcatcttttgcaggtcataatcagttagataaattaattgtcctttatgattcaaatgatatatctttagatggagatttagataaatcattttctgaagatacaaaacagcgtttcgaagcctatggttggaactatattctagttgaaaatggtaacgatttagatgagattgataatgcaatcactcaagctaaatcacaacaaggacctactattatcgaagttaaaactattatcggttttggttctcctaataaagctggttcaaatggagttcatggtgccccacttggtgaagaagaacgtgcacttacatttaaagaatatggattagatcctgaaaaacgttttaatgttcctgaagatgtatacgaaatatttaaatcaacaatgttaaaacgtgcaaatgaaaatgaagaggcttggaataatatgcttaaaaattatagtgaagcctatccggaattagctgaagaatttaaattagcaatgagtggtaagttaccaaataattacgctgatgccttaccagaatatgatttaaatcacagtggtgcttctagagctgattcaggagaaataattcaaaaattaagcgagtttgtaccttcattctttggtggatcagcagacttagcaggttcaaataaatctaacgttaaagaagctaaagattataataaagatactccagaaggtaaaaacgtatggtttggtgtacgtgaatttgcaatgggagcagcaataaacggcatggcagcacatggtggacttcatccatatgcagcaacattctttgtattcagtgattacctaaaaccagctttacgattatcatcaatcatgggactcaattcaacgttcatctttactcatgattcaattgctgtaggtgaagatggccctacacacgaacctattgaacaattagcaggtcttcgtgctattcctaacatgaatgttattcgtccagctgatggtaatgaaacacgtgtagcttgggaagttgcacttgaatcagaacacacaccaacatcattagtgttaactcgtcaaaatttaccaactttggatgttgataaacaaacagttgaaaatggtgtgagaaaaggcgcatatattgtttttgaaacagaacaacaacttgaatatttattattggcatctggatcagaagttaatttagctgtagaagccgcaaaagaattagagcaacaaggtaaaggtgtacgagttatttctatgccaaactggtacgcatttgaacaacaatcttctgaatataaagaatcaattttaccttctgatgttactaaacgtatagctatcgaaatggcatcaccacttggttggcataaatatgttggaattgaaggtaaagtcattggtataaatagttttggcgctagtgctcctggagatttagtagttgaaaagtatggattcactaaagaaaatattttaaaacaagtccgttcattataa

SEQ ID NO: 10383 - protein, 662 aa, Staphylococcus epidermidis
MFNEKDQLAIDTIRALSIDAIEKANSGHPGLPMGAAPMAYTLWTRHLNFNPQSKDFFNRDRFILSAGHGSALLYSLLHVSGSLELEELKQFRQWGSKTPGHPEYRHTDGVEVTTGPLGQGFAMSVGMALAESHLAGKFNKDQFDIVNHYTYVLASDGDLMEGISHEAASFAGHNQLDKLIVLYDSNDISLDGDLDKSFSEDTKQRFEAYGWNYILVENGNDLDEIDNAITQAKSQQGPTIIEVKTIIGFGSPNKAGSNGVHGAPLGEEERALTFKEYGLDPEKRFNVPEDVYEIFKSTMLKRANENEEAWNNMLKNYSEAYPELAEEFKLAMSGKLPNNYADALPEYDLNHSGASRADSGEIIQKLSEFVPSFFGGSADLAGSNKSNVKEAKDYNKDTPEGKNVWFGVREFAMGAAINGMAAHGGLHPYAATFFVFSDYLKPALRLSSIMGLNSTFIFTHDSIAVGEDGPTHEPIEQLAGLRAIPNMNVIRPADGNETRVAWEVALESEHTPTSLVLTRQNLPTLDVDKQTVENGVRKGAYIVFETEQQLEYLLLASGSEVNLAVEAAKELEQQGKGVRVISMPNWYAFEQQSSEYKESILPSDVTKRIAIEMASPLGWHKYVGIEGKVIGINSFGASAPGDLVVEKYGFTKENILKQVRSL

SEQ ID NO: 10384 - DNA, 1986 bp, Treponema pallidum
  CDS (1)..(1986): transl_table=11
  misc_feature (1900)..(1900): r is g or a
atgactgaagaagctatgcgcgcgatggcactttccatccgcagtttgacgatagacgccatcgaacgggcgaattctggtcaccctggtttgccgctgggcgcagcagagcttgctgcctgtttatatgggacgatcttaaagcataatccggcgaatcctagctggtttaatcgggatcgtttcgtcctgtctgcaggacacgggtctatgctcttgtatgctgcgctccacctttctgggtacgacgtttcgcttgaggatattaagaactttaggcaggtaggctcccggtgtcctggccatcctgaatacggttgtacccccggtgtggaagcaacaaccggtccattgggtcagggtatctctatggcggtgggttttgcgcttgcagaggcaatgcttgcggcacgttttaatactgatgagcatgccgttgtagatcaccacacctatgcgcttgtgggggaaggctgccttatggagggcgttgcctcagaggcttctagctttgccggcactatgcgtctgggcaagctcatcgttttttatgatgagaaccacatcagcatagacggatctaccgatctgacctttagcgaggatgtggctaagcgctacgaagcgtatggctggcaggtgctgcgcggttctatgtattcgtatacggatattatggatctcactgcgtgtgcaaagcgtgacgatcggccttctctcattatcctgcgttcgattattggaaagggtgcgcctaccgttgaagggagcgcgcgtgcccacggcgccccgcttggggaagcgggggtgagagaggcaaaaaaggcattgggacttgatcctgcgtgctctttttttgtagcgcctgagcttaccgctgttctccagaaacgaaagtgtgaatgtgcgcatgtcgaggactcgtggaatgagctctttgaagcatggagcacgcagtatcctgaaaaacgtgctgactgggacgctgcttttgttcccggaggggtaagtacttcgcagctagctcgtgttgtctgtccccattttgagaagggttcgtcacttgctactcggactgcttctggaaaggtgctcgacgcgctctgctctgtgctaccgaatctggtaggtggctctgcagatttacgcgggccgaatgcggtagcggtctcttcgttaagaccattttctgcagagcatcgtgcaggcggctactgttattttggtgtgcgcgagtttgccatggcagccattgtgaacggaatgcagttgcacggcggtttgcgtgcgtttggcgctacgtttatggttttttcagactactttcgccctgcgctccgtcttgcggcgctcatgcgcatcccttctgttttcgttttaacacatgactctatttttgtaggagaagatgggccgacgcaccaaccggtggagacgctcgctgcgctgcgtgcgattcccaacgtgcttgttctgcgccctgctgacgcagaagaaacgtttgaagcttggaaaatagcgttgctgcaccgcagtggtcctgtgtgtatcgttttgagtcggcagaacgtgccggtttttgagaaaagtgacagttcgtggcgctctacggtggaggagtcgggggcctatgtagtgcgcgaagggggtgctacgcctgagctgactgtcttggcaagtggctctgaggtggatttggcgttgcgtgccgcgcagctgagtaaaagacgtgtgcgtgtggtgtctgtactgtgcaaggagcgttttgaggcagcaggggacgaggtgcagcggcgcatacagggaggagcacgcgttgtagtggctgaggcaggggtgtatcaaggctggggagcgtgggcaaagcgggaaaaatgccttgtgctcgaccgtttcggaragtcaggccctggtacgcaggtggcacaggcgctggaatttaccgccgaagcgctggtggaaataatccttgattggttagcataa

SEQ ID NO: 10385 - protein, 661 aa, Treponema pallidum
  misc_feature (634)..(634): The Xaa at location 634 stands for Glu, or Lys.
MTEEAMRAMALSIRSLTIDAIERANSGHPGLPLGAAELAACLYGTILKHNPANPSWFNRDRFVLSAGHGSMLLYAALHLSGYDVSLEDIKNFRQVGSRCPGHPEYGCTPGVEATTGPLGQGISMAVGFALAEAMLAARFNTDEHAVVDHHTYALVGEGCLMEGVASEASSFAGTMRLGKLIVFYDENHISIDGSTDLTFSEDVAKRYEAYGWQVLRGSMYSYTDIMDLTACAKRDDRPSLIILRSIIGKGAPTVEGSARAHGAPLGEAGVREAKKALGLDPACSFFVAPELTAVLQKRKCECAHVEDSWNELFEAWSTQYPEKRADWDAAFVPGGVSTSQLARVVCPHFEKGSSLATRTASGKVLDALCSVLPNLVGGSADLRGPNAVAVSSLRPFSAEHRAGGYCYFGVREFAMAAIVNGMQLHGGLRAFGATFMVFSDYFRPALRLAALMRIPSVFVLTHDSIFVGEDGPTHQPVETLAALRAIPNVLVLRPADAEETFEAWKIALLHRSGPVCIVLSRQNVPVFEKSDSSWRSTVEESGAYVVREGGATPELTVLASGSEVDLALRAAQLSKRRVRVVSVLCKERFEAAGDEVQRRIQGGARVVVAEAGVYQGWGAWAKREKCLVLDRFGXSGPGTQVAQALEFTAEALVEIILDWLA

SEQ ID NO: 10386 - DNA, 2007 bp, Xanthobacter flavus
  CDS (1)..(2007): transl_table=11
atgtccagccgcaccagcgacagcgtcacgagtcacgatcgtctggccaatgccatccggttcctcgcgatcgatgccgtcgaggccgccaacagcggccatccgggcctgcccatgggcgcggcggacatcgccaccgtgctgttcacgaaggtgctgaagtacgatccctcgcgtccgttctggccggatcgcgaccgcttcgtgctctccgccggccacggctccatgctgctctattcggtgctgcacctcgccggctacgagaaggtgacgatcgacgagatcaagcgcttccggcagctcggttcgctgacgcccggtcaccccgagaatttcgtcaccgaaggcatcgagaccaccaccggcccgctggggcagggcatcgccaccgccgtgggcatggccatggccgagcgcctgctcgccgcccgcttcggttcggatgtggtggaccactacacctacgcgctcgcctccgacggcgacctgatggagggcatcagccaggaggcggcggacctcgccggccacctgaagctgtccaagctcatcgtcatgtgggacgacaacaagatctccatcgacggccccacctccatctccggctccaccaaccagctcgcgcgcttcgccgcctccggctgggcgacggcagccgtggacgggcatgaccccgaggccatcctcgccgcgcttgaggctgccaaggcctccgaccgtccgaccctgatcgcctgccgcaccaccatcggcttcggctctcccaagaaggccggctccgagaaggtccacggctcgccgctgggcgctgaggagatcgtcgccacccgcgctgccctcggctgggaagcgccggccttcgtggtgcccgaggatgcgctcaacggttggcgtgccgccggtgccgcaggccgtgccgcccgcgaggcgtgggaagcccgtttcgccgcccgcccggccgaggagcgtgcggaattcgagcgccgggtcgccggcacgctgcccgcggcgctggaaggcgccatcgtcgccgtcaaggaaaaggcggtgaaggatggtggcgcggtcgccacccgcaagtcgtccgagatggtgctggacttcatcaccccggcggtgcccgagatggtgggcggctcggccgacctcaccggctcgaacaacaccaaggccaagggcgcgaagtccgtgacgccggacgacttctccggctccttcatccattacggcgtgcgcgagcacggcatggccgctgccatgaacggcatggcgctgcacaaggggctcatccccttctccggcggcttcatggtgttctcggactattgccgcccggccatccgcctcgcggccctcatgggcgagcgggtgatccacgtgctcacccacgattccatcggcctcggcgaggatggccccacccaccagccggtggaacacctcgcggcgctgcgcgccattcccaacctcctcgtgatgcgcccctgcgacacggtggagacggcggaatgctggcagattgcgctacagtccaccgacaggccctcggcgctcatcctgtcgcgccagaacctgccgctcctgcgcaccgacgccacggccgtgaaccggtcggcggaaggtgcctacgaaatcctcgctgcgtccgggccggcgcaggcgagcctgttcgccaccggctcggaagtgtccttggcggttgaagccgccaagctgttggaggcgcagggtgttcccacccgcgtcgtctccatctcctcgttcgaactgttcctcgaaaggcccgccgcagagcgggcaaaggtgatcggggacgctccggccaaggttgcggtggaagccgcgatccgcatggggtgggacgccatcgtcggttcgaacgccgccttcgtgggaatgacatcgttcggcgccagcgcgcccgcaaaggagctttacgcccatttcggcattactgcccagcaggtcgcggcgcgcgcgctcgatcagctccggcaggcctga

SEQ ID NO: 10387 - protein, 668 aa, Xanthobacter flavus
MSSRTSDSVTSHDRLANAIRFLAIDAVEAANSGHPGLPMGAADIATVLFTKVLKYDPSRPFWPDRDRFVLSAGHGSMLLYSVLHLAGYEKVTIDEIKRFRQLGSLTPGHPENFVTEGIETTTGPLGQGIATAVGMAMAERLLAARFGSDVVDHYTYALASDGDLMEGISQEAADLAGHLKLSKLIVMWDDNKISIDGPTSISGSTNQLARFAASGWATAAVDGHDPEAILAALEAAKASDRPTLIACRTTIGFGSPKKAGSEKVHGSPLGAEEIVATRAALGWEAPAFVVPEDALNGWRAAGAAGRAAREAWEARFAARPAEERAEFERRVAGTLPAALEGAIVAVKEKAVKDGGAVATRKSSEMVLDFITPAVPEMVGGSADLTGSNNTKAKGAKSVTPDDFSGSFIHYGVREHGMAAAMNGMALHKGLIPFSGGFMVFSDYCRPAIRLAALMGERVIHVLTHDSIGLGEDGPTHQPVEHLAALRAIPNLLVMRPCDTVETAECWQIALQSTDRPSALILSRQNLPLLRTDATAVNRSAEGAYEILAASGPAQASLFATGSEVSLAVEAAKLLEAQGVPTRVVSISSFELFLERPAAERAKVIGDAPAKVAVEAAIRMGWDAIVGSNAAFVGMTSFGASAPAKELYAHFGITAQQVAARALDQLRQA

SEQ ID NO: 10388 - DNA, 2232 bp, Oryza sativa
  CDS (1)..(2232)
atggccgcgcactccgtcgccgccgcgcacgccaccatcgccgcgcgcgcgggtgccgccgcgccagcgcccgcgccgccggagcgcctcgggttccgcctcagcgcgctcgccggccgcggcctccgctccccgctcccgcctcgccgcggcgcgccatcggcgtccgcgtcgcgccgccgccacaacaaccgcgtgcgcgcggcggcggtcgagacgctcgaggggcaggcggcgacgggggcgctgctcgagaagtcggtgaacacgatccggttcctcgccatcgacgccgtcgagaaggccaactcggggcaccccggcctgcccatggggtgcgcgcccatggggcacatcctctacgacgaggtcatgcggtacaaccccaagaacccctactggttcaaccgcgaccgcttcatcctctccgccggccacggctgcatgctccagtacgccctgctccacctcgccggctacgacgccgtcttggaggaggacttgaagcaattcaggcaatggggaagcaagactccaggccatcccgagaacttcgagacgcccggagttgaagttaccactggacctcttggtcagggtattgcaaatgcagttgggctggcccttgctgagaagcacctggctgctcgtttcaacaagcccgacagcgagattgttgatcactacacctactgtattttgggagatgggtgccagatggagggtatctccaatgaagcttgctcgttggctggccattggggtcttggcaagctgattgcattctatgatgacaaccacatttccattgacggagacacagagattgcattcactgaggatgtgagtgctcgctttgaggctcttgggtggcatacaatctgggttaagaatggaaacgatggctatgatgagattcgtgccgccattaaggaagcaaaggcggtaactgacaagccaacactaatcaaggtgaccaccacaatcggttttggatcacccaacaaggccaactcatacagcgtccacggaagtgctttgggtaccaaagaggttgaagcaaccagagagaaccttggatggccctatgagccattctttgtgcctgaggatgtgaagagccactggagccgccatgtgcctcaaggtgctgcttttgaggctgactggaatgctaagttcgccgagtatgagaagaagtacccagaagatgcagcgaccttgaagagcattgtctcaggggagttgcctgctggctgggctgacgctcttcctaaatacactccagagagccctgcagatgccaccaggaatctgtcacagcagtgcttaaacgcacttgctaaagttgttcctggtcttcttggaggaagtgctgatcttgcatcctccaacatgacattgcttaagatgttcggtgacttccagaaggatacgcctgaggagcgcaatgtccgatttggagtcagggagcatggaatgggcgccatttgcaacggcattgctctgcacagcccaggactcattccatactgtgctactttctttgttttcactgattacatgagagctgccatgaggatctcagccttgtgtgaagccggagttatctatgttatgacccatgactctattggtcttggagaagatggtccaacccatcagcccattgagcacttggtgagcttccgtgcgatgcccaacattctgatgcttcgtcctgctgatggtaacgagactgctggggcatacaaaatcgcggtcctcaacaggaagaggccatccgtccttgctctctccaggcaaaagcttgctcagctgcctggtacctcgattgagggtgttgagaagggtgggtacatcgtctctgacaactcaactggcaacaagcctgacttcattgtgatgagcactggctctgaactagagattgtcgccaaggctgctgatgagttgaggaaggaggggaagactgtccgtgtcgtgtcatttgtttgctgggagcttttcgatgaacagtcggctgagtacaaggagagtgttctccctgaggctgttactgcaagagtcagccttgaagcagggtctactcttggatggcagaagtacgtcggaagcaaaggcaaggctattggcatcgacaaattcggtgcaagtgctcctgctggaaagatctaccaggagtatggcatcaccgcggagaacgtcatcgcaacagcaaagagcctgtaa

SEQ ID NO: 10389 - protein, 743 aa, Oryza sativa
MAAHSVAAAHATIAARAGAAAPAPAPPERLGFRLSALAGRGLRSPLPPRRGAPSASASRRRHNNRVRAAAVETLEGQAATGALLEKSVNTIRFLAIDAVEKANSGHPGLPMGCAPMGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 10390 - DNA, 2244 bp, Hordeum vulgare
  CDS (1)..(2244)
atggcagcgcactccgtcgccgccgcgcacgccaccatcgcggcccgcgcgggcgccgcgccgtcctccccggcggccgccccggccgagcgcctgggcttccgcctcagctcgctggccggccgcgccggggggggggcgctcccggcccgccgcggctcccccgccgccgccgcctcctcccgccggagcggcggcctgcaccgcgtgcgcgcctccgcggccgtcgagaccgtcgaggcggccgccacgggcgagctgctcgacaagtcggtcaacgcgatccggttcctggccatcgacgccgtcgagaaggccgtgtccggccacccggggctccccatgggctgcgcgcccatgggccacatcctctacgacgaggtcatgcgctacaaccccaagaacccctactggttcaaccgcgaccgcttcgtcctctccgccggccacggctgcatgctccagtacgccctcctccacctcgccggctacgacgccgtcaaggaagaggacctgaagcagttcagacagtggggaagctccaccccgggacaccccgagaacttcgagactcctggagttgaagtcaccactggtcctcttggtcagggtatcgcgaatgccgtcgggttggcgcttgctgagaagcacctggctgctcgtttcaacaagcccgacagtgaaatcgttgaccactacacgtactgtattgtcggagatgggtgcaacatggagggtatcttgactgaagcttgctcattggctgggcattggggtcttggcaagcttattgtcttctatgacgacaaccacatctccattgacggagacacagagattgcgtttacagaggatgtgagtggccgctttgaggctcttgggtggcacacactctgggttaagaatggcaacgatggttatgacgagatccgtaaagccatccaggaagcaaagtcagttaccgacaagcctacaatgatcaaggtgaccaccacaatcggttttggatctcccaacaaggccaactcatacgctgtgcacggagctgcattgggcaccagcgaggtcgaagcgaccagggcaaacctcggatggccatatgagccattctttgtgcctgaggatgtcaagagccactggagccgccatattccccagggtgccgcgcttgaggctgactgggatgctaagtttgcacagtatgagcagaagtacccagaagatgccgccaccttgaaaagtattatcacaggagagttgcccgctggctgggccgatgctcttcctcaatacactacagagagcccagcagatgccaccaggaatctctcccagcaatgcttgaatgcacttgctaaagttgtgcctggtcttattggaggcagtgctgatcttgcgtcctccaacatgacattgcttaagatgtttggcgacttccagaaggatacccctgaggagcgcaatgtccgctttggagtcagggagcacggcatgggcgccatctgcaacggcattgcactgcacacaccagggctcattccatactgtgcaactttctttgttttcactgactacatgagaggtgccatgaggatctcagccttgtctgaagctggagttatctatgtcatgacccatgactccattggtctgggtgaagatggtccgacccatcaacccattgagcacttggtgagcttccgcgcaatgcctaacatgctgatgttccgtcctgctgatggcaaggagactgctggggcatacaaggtggcggtcctcaacaggaagaggccatccattctggctctctcaaggcaaaagcttcctcatctgcctggtacctcaattgagggtgttgcgaagggtggatacaccatctccgacaactcgagcggaaacaagcctgactacatcataatgagcactggttctgaagtagagattgctgtgaaggctgccgaagagttgacgaaggaggggaagaccgtccgcgttgtgtcatttgtctgctgggagctttttgacgagcagtccgatgaatacaaggagagcgtgctccctgaggctgtcaccgcaaggatcagcattgaagctggctctaccctcggatggcaaaagtacgtcgggtccaagggcaagaccatcggcatcgacaagttcggcgccagcgctcctgcccccaagatctacaaggagtacggcatcactgcagagaacgtcatcgccgcagccaagagcctgtaa

SEQ ID NO: 10391 - protein, 747 aa, Hordeum vulgare
MAAHSVAAAHATIAARAGAAPSSPAAAPAERLGFRLSSLAGRAGGGALPARRGSPAAAASSRRSGGLHRVRASAAVETVEAAATGELLDKSVNAIRFLAIDAVEKAVSGHPGLPMGCAPMGHILYDEVMRYNPKNPYWFNRDRFVLSAGHGCMLQYALLHLAGYDAVKEEDLKQFRQWGSSTPGHPENFETPGVEVTTGPLGQGIANAVGLALAEKHLAARFNKPDSEIVDHYTYCIVGDGCNMEGILTEACSLAGHWGLGKLIVFYDDNHISIDGDTEIAFTEDVSGRFEALGWHTLWVKNGNDGYDEIRKAIQEAKSVTDKPTMIKVTTTIGFGSPNKANSYAVHGAALGTSEVEATRANLGWPYEPFFVPEDVKSHWSRHIPQGAALEADWDAKFAQYEQKYPEDAATLKSIITGELPAGWADALPQYTTESPADATRNLSQQCLNALAKVVPGLIGGSADLASSNMTLLKMFGDFQKDTPEERNVRFGVREHGMGAICNGIALHTPGLIPYCATFFVFTDYMRGAMRISALSEAGVIYVMTHDSIGLGEDGPTHQPIEHLVSFRAMPNMLMFRPADGKETAGAYKVAVLNRKRPSILALSRQKLPHLPGTSIEGVAKGGYTISDNSSGNKPDYIIMSTGSEVEIAVKAAEELTKEGKTVRVVSFVCWELFDEQSDEYKESVLPEAVTARISIEAGSTLGWQKYVGSKGKTIGIDKFGASAPAPKIYKEYGITAENVIAAAKSL

SEQ ID NO: 10392 - DNA, 2139 bp, Oryza sativa
  CDS (1)..(2139)
atggcgacgcaagctcccacctcgcccgccgccgcgtccgggagtggctccgtcctccccctcctccgtggccacccctccacccgcgtccgcctcgccgttggccggcgaccgcagaccgccctccgcgcgcagccgccgggggcggcggaggtggtggagcagtcggtgaacaccatccggttcctcgccgtggactccgtggagaaggccaagtccggccacccgggactccccatggggtgcgcgccgctgggccacgtcctattcgacgagttcctccggttcaaccccaagaacccctactggttcgaccgcgaccgcttcatcctctccgccggccatggatgcatgctccagtacgcactgcttcacctcgccggatacgacagcgtcacgatggatgatctgaaagctttccggcagtggggaagcagaactcctggtcacccagaaaacttcgaaacacctggtgttgaagtcactactggtcctctggggcagggttttgcaaatgctgttggcctagcgcttgctgagaaacatctagctgcccgtttcaataagcctgatttgaaaatcgtggatcatcacacgtatgttatacttggggatggctgccaaatggaaggtgtgtcaaatgaggcatcctcccttgctggtcactggggtctcgggaaactaattgccttctacgatgacaatcatatatcaattgatggtagcacaggcattgctttcactgaagatgcacttgcccgatatgaggcactaggttggcatactatctgggtgaaaaatggtaacacagggtatgatgacatccgtgctgcaattaaggaagcaaaggcagtcaaagacaagccaactcttatcaaggtgactactactattggttatggatccccaaacaaagcaaacacttatagtgttcatggtagcgctctaggtaccaaagaagtagaggcaaccaaaaacaatctttcttggcatcatgaacctttccatgttcctgatgaggtgaaaaggcactggagtcaccatattgatgagggtgcttctctggaagctgaatggaataaaaaaattgttgaatatgaaaagaaatatcgccaggaggctgctgagttaaagagcataatttcaggagaactgccttccgggtgggacaattctcttccaaaatatactcctgaaaatcctgctgatgctacaaggaacttatctcaacaatgcttgaatgctcttgctaaagcaatacctggatttcttggaggtagtgccgatctcgcaacatcaaatatgacattactaaaaatgtttggtgattttcaaaaagacacacctgaagaaagaaacatccgttttggtgtgagagagcatgcaatgggtgccatttccaacggcattgcattgcacagtcctggactaataccttactgtgcaacattctttgtgtttactgactatatgagagctgccattcgtctttcggccttatgtggatcaagggtgatctttgtaatgactcatgattcaattggccttggagaagatgggccaacacatcagcctgttgaacagttattcagcctccgcgccatgccaaacatactaatgcttcgacctgcagatggaaacgagacttctggagcttacaagattgcagttcttaataggcaaaggccctctgtccttgccctttctaggcagaagcttcaacagctgaaaggaacatcagcggaaggcgttgccaagggaggatacattatttctgataattcatcaggaaacaaaccagatatcattctcatcggcactggttctgaacttgagattgtagaaaaagccgcagatgagctgaggaaagatgggaagactgtacgagtagtttcactggtttgctgggaattgtttgaggagcagtcggagaaatacaaggagagtgtttttccaagtgaagtaacttctaggatcagcgtcgaggctggggtcacatttggatgggagaaatatatcggagaaaaaggtaaagctattggtgttgaccgttttggttctagtgcgcctgctgggaaaatatacaaggagcttggtttgacagtggaaaatgtcattgcaacggccaagtcactgtga

SEQ ID NO: 10393 - protein, 712 aa, Oryza sativa
MATQAPTSPAAASGSGSVLPLLRGHPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSRTPGHPENFETPGVEVTTGPLGQGFANAVGLALAEKHLAARFNKPDLKIVDHHTYVILGDGCQMEGVSNEASSLAGHWGLGKLIAFYDDNHISIDGSTGIAFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSAEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 10394 - DNA, 26 bp, Artificial sequence
  primer
atgactcaattcactgacattgataa

SEQ ID NO: 10395 - DNA, 27 bp, Artificial sequence
  primer
ttagaaagcttttttcaaaggagaaat

SEQ ID NO: 10396 - protein, 772 aa, Artificial sequence
  consensus sequence
  Variant (2)..(2): Xaa in position 2 is any amino acid
  Variant (3)..(3): Xaa in position 3 is any or no amino acid
  Variant (5)..(6): Xaa in position 5 to 6 is any amino acid
  Variant (8)..(10): Xaa in position 8 to 10 is any amino acid
  Variant (11)..(11): Xaa in position 11 is any or no amino acid
  Variant (13)..(13): Xaa in position 13 is any amino acid
  Variant (19)..(20): Xaa in position 19 to 20 is any amino acid
  Variant (21)..(22): Xaa in position 21 to 22 is any or no amino acid
  Variant (25)..(25): Xaa in position 25 is any amino acid
  Variant (27)..(30): Xaa in position 27 to 30 is any amino acid
  Variant (31)..(31): Xaa in position 31 is any or no amino acid
  Variant (33)..(36): Xaa in position 33 to 36 is any amino acid
  Variant (37)..(44): Xaa in position 37 to 44 is any or no amino acid
  Variant (46)..(47): Xaa in position 46 to 47 is any amino acid
  Variant (49)..(49): Xaa in position 49 is any amino acid
  Variant (50)..(50): Xaa in position 50 is any or no amino acid
  Variant (52)..(53): Xaa in position 52 to 53 is any amino acid
  Variant (56)..(56): Xaa in position 56 is any amino acid
  Variant (59)..(59): Xaa in position 59 is any amino acid
  Variant (62)..(62): Xaa in position 62 is any amino acid
  Variant (65)..(67): Xaa in position 65 to 67 is any amino acid
  Variant (69)..(69): Xaa in position 69 is any amino acid
  Variant (71)..(72): Xaa in position 71 to 72 is any amino acid
  Variant (74)..(74): Xaa in position 74 is any amino acid
  Variant (76)..(76): Xaa in position 76 is any amino acid
  Variant (78)..(84): Xaa in position 78 to 84 is any amino acid
  Variant (85)..(98): Xaa in position 85 to 98 is any or no amino acid
  Variant (100)..(100): Xaa in position 100 is any amino acid
  Variant (103)..(105): Xaa in position 103 to 105 is any amino acid
  Variant (106)..(108): Xaa in position 106 to 108 is any or no amino acid
  Variant (110)..(110): Xaa in position 110 is any amino acid
  Variant (117)..(119): Xaa in position 117 to 119 is any amino acid
  Variant (120)..(121): Xaa in position 120 to 121 is any or no amino acid
  Variant (123)..(123): Xaa in position 123 is any amino acid
  Variant (124)..(124): Xaa in position 124 is any or no amino acid
  Variant (126)..(126): Xaa in position 126 is any amino acid
  Variant (135)..(137): Xaa in position 135 to 137 is any amino acid
  Variant (141)..(141): Xaa in position 141 is any amino acid
  Variant (143)..(143): Xaa in position 143 is any amino acid
  Variant (145)..(147): Xaa in position 145 to 147 is any amino acid
  Variant (149)..(152): Xaa in position 149 to 152 is any amino acid
  Variant (153)..(164): Xaa in position 153 to 164 is any or no amino acid
  Variant (166)..(166): Xaa in position 166 is any amino acid
  Variant (169)..(171): Xaa in position 169 to 171 is any amino acid
  Variant (175)..(177): Xaa in position 175 to 177 is any amino acid
  Variant (180)..(182): Xaa in position 180 to 182 is any amino acid
  Variant (184)..(185): Xaa in position 184 to 185 is any amino acid
  Variant (190)..(192): Xaa in position 190 to 192 is any amino acid
  Variant (194)..(195): Xaa in position 194 to 195 is any amino acid
  Variant (197)..(200): Xaa in position 197 to 200 is any amino acid
  Variant (202)..(202): Xaa in position 202 is any amino acid
  Variant (204)..(204): Xaa in position 204 is any amino acid
  Variant (206)..(207): Xaa in position 206 to 207 is any amino acid
  Variant (210)..(219): Xaa in position 210 to 219 is any amino acid
  Variant (220)..(227): Xaa in position 220 to 227 is any or no amino acid
  Variant (229)..(230): Xaa in position 229 to 230 is any amino acid
  Variant (232)..(232): Xaa in position 232 is any amino acid
  Variant (235)..(246): Xaa in position 235 to 246 is any amino acid
  Variant (247)..(258): Xaa in position 247 to 258 is any or no amino acid
  Variant (260)..(261): Xaa in position 260 to 261 is any amino acid
  Variant (262)..(262): Xaa in position 262 is any or no amino acid
  Variant (264)..(266): Xaa in position 264 to 266 is any amino acid
  Variant (267)..(270): Xaa in position 267 to 270 is any or no amino acid
  Variant (272)..(273): Xaa in position 272 to 273 is any amino acid
  Variant (275)..(275): Xaa in position 275 is any amino acid
  Variant (276)..(277): Xaa in position 276 to 277 is any or no amino acid
  Variant (279)..(279): Xaa in position 279 is any amino acid
  Variant (282)..(282): Xaa in position 282 is any amino acid
  Variant (284)..(289): Xaa in position 284 to 289 is any amino acid
  Variant (290)..(298): Xaa in position 290 to 298 is any or no amino acid
  Variant (301)..(301): Xaa in position 301 is any amino acid
  Variant (302)..(302): Xaa in position 302 is any or no amino acid
  Variant (305)..(319): Xaa in position 305 to 319 is any amino acid
  Variant (320)..(324): Xaa in position 320 to 324 is any or no amino acid
  Variant (326)..(327): Xaa in position 326 to 327 is any amino acid
  Variant (329)..(330): Xaa in position 329 to 330 is any amino acid
  Variant (331)..(345): Xaa in position 331 to 345 is any or no amino acid
  Variant (347)..(349): Xaa in position 347 to 349 is any amino acid
  Variant (350)..(352): Xaa in position 350 to 352 is any or no amino acid
  Variant (354)..(376): Xaa in position 354 to 376 is any amino acid
  Variant (377)..(402): Xaa in position 377 to 402 is any or no amino acid
  Variant (404)..(404): Xaa in position 404 is any amino acid
  Variant (406)..(407): Xaa in position 406 to 407 is any amino acid
  Variant (409)..(413): Xaa in position 409 to 413 is any amino acid
  Variant (414)..(419): Xaa in position 414 to 419 is any or no amino acid
  Variant (421)..(423): Xaa in position 421 to 423 is any amino acid
  Variant (424)..(424): Xaa in position 424 is any or no amino acid
  Variant (428)..(428): Xaa in position 428 is any amino acid
  Variant (432)..(433): Xaa in position 432 to 433 is any amino acid
  Variant (436)..(436): Xaa in position 436 is any amino acid
  Variant (438)..(449): Xaa in position 438 to 449 is any amino acid
  Variant (450)..(472): Xaa in position 450 to 472 is any or no amino acid
  Variant (474)..(474): Xaa in position 474 is any amino acid
  Variant (477)..(478): Xaa in position 477 to 478 is any amino acid
  Variant (480)..(480): Xaa in position 480 is any amino acid
  Variant (482)..(483): Xaa in position 482 to 483 is any amino acid
  Variant (486)..(488): Xaa in position 486 to 488 is any amino acid
  Variant (490)..(496): Xaa in position 490 to 496 is any amino acid
  Variant (497)..(499): Xaa in position 497 to 499 is any or no amino acid
  Variant (502)..(503): Xaa in position 502 to 503 is any amino acid
  Variant (505)..(506): Xaa in position 505 to 506 is any amino acid
  Variant (508)..(510): Xaa in position 508 to 510 is any amino acid
  Variant (512)..(512): Xaa in position 512 is any amino acid
  Variant (514)..(515): Xaa in position 514 to 515 is any amino acid
  Variant (518)..(524): Xaa in position 518 to 524 is any amino acid
  Variant (526)..(526): Xaa in position 526 is any amino acid
  Variant (532)..(533): Xaa in position 532 to 533 is any amino acid
  Variant (543)..(543): Xaa in position 543 is any amino acid
  Variant (544)..(544): Xaa in position 544 is any or no amino acid
  Variant (546)..(550): Xaa in position 546 to 550 is any amino acid
  Variant (552)..(553): Xaa in position 552 to 553 is any amino acid
  Variant (555)..(559): Xaa in position 555 to 559 is any amino acid
  Variant (560)..(568): Xaa in position 560 to 568 is any or no amino acid
  Variant (571)..(571): Xaa in position 571 is any amino acid
  Variant (573)..(574): Xaa in position 573 to 574 is any amino acid
  Variant (576)..(578): Xaa in position 576 to 578 is any amino acid
  Variant (580)..(582): Xaa in position 580 to 582 is any amino acid
  Variant (584)..(588): Xaa in position 584 to 588 is any amino acid
  Variant (589)..(598): Xaa in position 589 to 598 is any or no amino acid
  Variant (600)..(600): Xaa in position 600 is any amino acid
  Variant (601)..(601): Xaa in position 601 is any or no amino acid
  Variant (603)..(605): Xaa in position 603 to 605 is any amino acid
  Variant (608)..(620): Xaa in position 608 to 620 is any amino acid
  Variant (621)..(632): Xaa in position 621 to 632 is any or no amino acid
  Variant (634)..(634): Xaa in position 634 is any amino acid
  Variant (636)..(649): Xaa in position 636 to 649 is any amino acid
  Variant (650)..(663): Xaa in position 650 to 663 is any or no amino acid
  Variant (667)..(672): Xaa in position 667 to 672 is any amino acid
  Variant (674)..(675): Xaa in position 674 to 675 is any amino acid
  Variant (676)..(676): Xaa in position 676 is any or no amino acid
  Variant (678)..(679): Xaa in position 678 to 679 is any amino acid
  Variant (680)..(685): Xaa in position 680 to 685 is any or no amino acid
  Variant (690)..(690): Xaa in position 690 is any amino acid
  Variant (692)..(695): Xaa in position 692 to 695 is any amino acid
  Variant (697)..(697): Xaa in position 697 is any amino acid
  Variant (698)..(698): Xaa in position 698 is any or no amino acid
  Variant (700)..(701): Xaa in position 700 to 701 is any amino acid
  Variant (702)..(702): Xaa in position 702 is any or no amino acid
  Variant (704)..(707): Xaa in position 704 to 707 is any amino acid
  Variant (709)..(709): Xaa in position 709 is any amino acid
  Variant (710)..(720): Xaa in position 710 to 720 is any or no amino acid
  Variant (722)..(727): Xaa in position 722 to 727 is any amino acid
  Variant (728)..(728): Xaa in position 728 is any or no amino acid
  Variant (730)..(733): Xaa in position 730 to 733 is any amino acid
  Variant (735)..(741): Xaa in position 735 to 741 is any amino acid
  Variant (742)..(755): Xaa in position 742 to 755 is any or no amino acid
  Variant (758)..(758): Xaa in position 758 is any amino acid
  Variant (760)..(766): Xaa in position 760 to 766 is any amino acid
  Variant (767)..(769): Xaa in position 767 to 769 is any or no amino acid
  Variant (771)..(771): Xaa in position 771 is any amino acid
RXXLXXDXXXXAXSGHPGXXXXMGXAXXXXXLXXXXXXXXXXXXPXXPXXWXXRDXRFXLSXGHXXXLXYXXLXLXGXXXXXXXXXXXXXXXXXXXXXKXFRXXXXXXSXTPGHPEXXXXXGXXEXTTGPLGQGXXXAVGXAXAXXXLXXXXXXXXXXXXXXXXHXTYXXXGDGXXXEGXXXEXXSLAGXXXLXXLXXXXDXNXIXXDGXXXXXXXXXXXXXXXXXXRXXAXGWXXXXXXXXXXXXXXXXXXXXXXXXAXXXAXXXXXXXPXXIXXXTXIGXGXXXXXXXXXXXXXXXHGXXLGXXXXXXXXXXXXXXXXXXXXFXXPXXXXXXXXXXXXXXXXXGXXXXXXWXXXXXXXXXXXXXXXXXXXXXXXXXXXXXXXXXXXXXXXXXXXXXXXXXAXRXXSXXXXXXXXXXXPXXXXGGSXADLXXSNXTXXXXXXXXXXXXXXXXXXXXXXXXXXXXXXXXXXXGXREXXMXAXXNGXXXHXXXXXXXXXXTFXXFXXYXXXAXRXXALXXXXXXXVXTHDSIXXGEDGPTHQPXXEXXXXXRXXPXXXXXXXXXXXXXXRPXDXXEXXXAXXXAXXXXXXXXXXXXXXXPXXLXXXRQXXXXXXXXXXXXXXXXXXXXXXXXXGXYXXXXXXXXXXXXXXXXXXXXXXXXXXXXGSEXXXXXXAXXXLXXXXXXXXRVVSXPXXXXFXXQXXXYXXXXLXXXXXXXXXXXXEXXXXXXXWXXXXGXXXXXXXXXXXXXXXXXXXXXFGXSXXXXXXXXXXGXT

SEQ ID NO: 10397 - protein, 30 aa, Artificial sequence
  protein pattern
  Variant (2)..(2): Xaa in position 2 is Ile, Leu or Met
  Variant (3)..(4): Xaa in position 3 to 4 is Ala or Ser
  Variant (5)..(5): Xaa in position 5 is Ile or Leu
  Variant (6)..(14): Xaa in position 6 to 14 is any amino acid
  Variant (15)..(15): Xaa in position 15 is Ser or Thr
  Variant (18)..(18): Xaa in position 18 is Ala, Ser or Thr
  Variant (19)..(19): Xaa in position 19 is Phe, Ile, Leu or Val
  Variant (20)..(21): Xaa in position 20 to 21 is any amino acid
  Variant (29)..(29): Xaa in position 29 is Glu or Gln
RXXXXXXXXXXXXXXHDXXXXGEDGPTHXP

SEQ ID NO: 10398 - protein, 38 aa, Artificial sequence
  protein pattern
  Variant (2)..(5): Xaa in position 2 to 5 is any amino acid
  Variant (6)..(7): Xaa in position 6 to 7 is any or no amino acid
  Variant (10)..(10): Xaa in position 10 is Cys or Asp
  Variant (11)..(12): Xaa in position 11 to 12 is any amino acid
  Variant (15)..(15): Xaa in position 15 is Ile, Leu or Val
  Variant (16)..(16): Xaa in position 16 is Ala, Cys, Gly, Asn, Ser, Thr or Val
  Variant (17)..(17): Xaa in position 17 is any amino acid
  Variant (19)..(19): Xaa in position 19 is Ala, Ser, Thr or Val
  Variant (20)..(22): Xaa in position 20 to 22 is any amino acid
  Variant (24)..(24): Xaa in position 24 is Ala or Gly
  Variant (25)..(27): Xaa in position 25 to 27 is any amino acid
  Variant (29)..(30): Xaa in position 29 to 30 is any amino acid
  Variant (32)..(34): Xaa in position 32 to 34 is any amino acid
  Variant (35)..(35): Xaa in position 35 is Phe, His, Trp or Tyr
  Variant (37)..(37): Xaa in position 37 is any amino acid
YXXXXXXDGXXXEGXXXEXXXXAXXXXLXXLXXXXDXN

SEQ ID NO: 10399 - protein, 15 aa, Artificial sequence
  protein pattern
  Variant (3)..(3): Xaa in position 3 is any or no amino acid
  Variant (10)..(10): Xaa in position 10 is Phe, Ile, Leu or Val
  Variant (11)..(12): Xaa in position 11 to 12 is any amino acid
  Variant (13)..(13): Xaa in position 13 is Ala, Gly or Ser
TTXGPLGQGXXXXVG

SEQ ID NO: 10400 - protein, 17 aa, Artificial sequence
  protein pattern
  Variant (2)..(3): Xaa in position 2 to 3 is any amino acid
  Variant (4)..(4): Xaa in position 4 is Ala, Cys, Gly or Ser
  Variant (5)..(8): Xaa in position 5 to 8 is any amino acid
  Variant (9)..(9): Xaa in position 9 is Ala, Asp, Glu, Asn, Gln, Ser or Thr
  Variant (10)..(10): Xaa in position 10 is any amino acid
  Variant (11)..(11): Xaa in position 11 is Ala, Cys, Ser or Val
  Variant (12)..(12): Xaa in position 12 is any amino acid
  Variant (17)..(17): Xaa in position 17 is Gly or Thr
RXXXXXXXXXXXSGHPX

SEQ ID NO: 10401 - protein, 25 aa, Artificial sequence
  protein pattern
  Variant (2)..(4): Xaa in position 2 to 4 is any amino acid
  Variant (5)..(7): Xaa in position 5 to 7 is any or no amino acid
  Variant (9)..(9): Xaa in position 9 is Gly or Asn
  Variant (10)..(13): Xaa in position 10 to 13 is any amino acid
  Variant (16)..(16): Xaa in position 16 is Ala, Cys or Gly
  Variant (18)..(19): Xaa in position 18 to 19 is any amino acid
  Variant (21)..(21): Xaa in position 21 is Ala, Ser, Thr or Val
  Variant (22)..(23): Xaa in position 22 to 23 is any amino acid
  Variant (24)..(24): Xaa in position 24 is Ala, Cys, Gly or Ser
  Variant (25)..(25): Xaa in position 25 is Trp or Tyr
LXXXXXXPXXXXXRPXDXXEXXXXX

SEQ ID NO: 10402 - protein, 7 aa, Artificial sequence
  protein pattern
  Variant (2)..(2): Xaa in position 2 is Ile or Val
  Variant (5)..(5): Xaa in position 5 is Phe or His
  Variant (6)..(6): Xaa in position 6 is Ala or Gly
GXREXXM

SEQ ID NO: 10403 - protein, 11 aa, Artificial sequence
  protein pattern
  Variant (6)..(6): Xaa in position 6 is Ala, Gly, Ser or Thr
  Variant (7)..(7): Xaa in position 7 is any amino acid
  Variant (10)..(10): Xaa in position 10 is any amino acid
  Variant (11)..(11): Xaa in position 11 is Ala, Asn, Ser, Thr or Val
GSADLXXSNXX

SEQ ID NO: 10404 - DNA, 591 bp, Escherichia coli
  CDS (1)..(591): transl_table=11
atgaacgaagccgttagcccaggtgcgcttagcaccctgttcaccgatgcccgcactcacaacggctggcgggagacacccgtcagcgatgagacgttacgggagatttatgccctgatgaaatgggggccgacatcagctaactgttctccggcacggatcgtgtttacccgcacggcagaaggaaaagaacgtctgcgcccggcactttccagcggcaatctgcaaaaaaccctgaccgcgcccgtcaccgctatcgtcgcctgggacagtgaattttatgaacggttaccactactgtttccccacggtgatgcccgcagttggtttacctccagcccacaacttgccgaagaaacagcgtttcgcaacagttccatgcaggcggcctatctgatcgtcgcctgccgggcgctgggactggataccggcccgatgtcgggctttgaccgtcaacacgtggacgacgccttttttacgggcagcacgctgaagagcaatctgctgattaatatcggctatggcgatagcagcaagctttatgcgcgcctgccacgtctgtcctttgaagaagcctgcgggctgttgtaa

SEQ ID NO: 10405 - protein, 196 aa, Escherichia coli
MNEAVSPGALSTLFTDARTHNGWRETPVSDETLREIYALMKWGPTSANCSPARIVFTRTAEGKERLRPALSSGNLQKTLTAPVTAIVAWDSEFYERLPLLFPHGDARSWFTSSPQLAEETAFRNSSMQAAYLIVACRALGLDTGPMSGFDRQHVDDAFFTGSTLKSNLLINIGYGDSSKLYARLPRLSFEEACGLL

SEQ ID NO: 10406 - DNA, 591 bp, Enterobacter cloacae
  CDS (1)..(591): transl_table=11
atgagcgaagccatcacgcccgccgcgctggaaacgctgtttaccggcgcacgtacccataacggctggctggatataccggtcagtgacgagacgctgcgcgagatttatgacctgatgaaatgggggccgacgtccgccaactgctccccggcgcgcattgtgtttgtgcgaagcccggaaggaaaagaaaagctgcgcccggcgctctccagcggcaaccttgagaaaacgctcactgccccggtcacggcgattgtcgcctgggacagcgagttttatgagcgcctgcctgaactgttcccgcacggcgatgccagaagctggtttaccgcaagccccgcgctggcggaagaaaccgcctttcgcaacagctcaatgcaggccgcgttcctgattttcgcctgccgcgcgctcgggctcgacaccgggccgatgtccggttttgaccgggaaaaagtggacgcggcctttttcacgggcacgctgcttaaaagcaatctgctgatcaacatcggctacggcgatacgaccgaactgtacggacgcctgccgcgtctgaccttcgaagacgcctgcgggctggcgtaa

SEQ ID NO: 10407 - protein, 196 aa, Enterobacter cloacae
MSEAITPAALETLFTGARTHNGWLDIPVSDETLREIYDLMKWGPTSANCSPARIVFVRSPEGKEKLRPALSSGNLEKTLTAPVTAIVAWDSEFYERLPELFPHGDARSWFTASPALAEETAFRNSSMQAAFLIFACRALGLDTGPMSGFDREKVDAAFFTGTLLKSNLLINIGYGDTTELYGRLPRLTFEDACGLA

SEQ ID NO: 10408 - DNA, 591 bp, Xanthomonas axonopodis pv. citri str. 306
  CDS (1)..(591): transl_table=11
atgtccgactcgctcaacgccgccgcactggatcagctgttccgcaccgcccgcacgcagaatgcgtttgccgacacgccggtcagccacgaggtgctgcgtgagctgtatgagctggtgaagtgggggcccaccgcggccaatagctgtccggcgcgctttgtgttcgtgaccagcgccgaaggcaaggccaagctcaagccggcgctgtcggagggcaatgccgccaagacgctggccgcaccggtgacggtgatcgtggcgcacgacgaagacttccacgagaagctgccgtatctgttcccacatgccgacgccaagagctggttcgacggcccgcgcgagggccgcaccgaatcggcgttccgcaatggctcgctgcagggcgcctacctgatcctggccgcgcgtgcgctgggactggatgccggcccgatgtccggcttcgataatgcgaaggtggatgcggcgttctttgccggcacgccgatcaagtccaacttcctggtcaatctcggctatggcgacccggccgggctgttcccgcgttcgccacgcctgagcttcgacgaagcggcacgtttcgagtaa

SEQ ID NO: 10409 - protein, 196 aa, Xanthomonas axonopodis pv. citri str. 306
MSDSLNAAALDQLFRTARTQNAFADTPVSHEVLRELYELVKWGPTAANSCPARFVFVTSAEGKAKLKPALSEGNAAKTLAAPVTVIVAHDEDFHEKLPYLFPHADAKSWFDGPREGRTESAFRNGSLQGAYLILAARALGLDAGPMSGFDNAKVDAAFFAGTPIKSNFLVNLGYGDPAGLFPRSPRLSFDEAARFE

SEQ ID NO: 10410 - DNA, 618 bp, Corynebacterium efficiens YS-314
  CDS (1)..(618): transl_table=11
atgactgaaacccagaatctcaaggacgccctcgtcatccacgaggaggcccagaacatcctcttccgcgaggcacgcaccgccaacgccttcaccgatgagccggtgaccgacgagcagatcaacgccatcttcgacctggtcaagtgggccccgacctccatgaacaaccagccactgcgcgtggtggtcatccgctccgaggaggccaaggcacgcctgctgccccacatggccgagggcaaccgcgagaagaccgccaaggcaccggccgtcgccctgctggcagccgacctcgacttccacgaggagatgccgcagctcttcccgcacttcgagggtgcccgcgacatgttcgcctccgacgaccagatgcgtgcagaggccgccaagctgaacaccggcctgcagatcgggtacgccatcatcggcatccgtgcagccggcctggccgcaggcccgatgaccggtttcgacgctgacgccatctccaaggagttcttccccgacggcaagcaccgcgtcatggtggccatcaacatgggtaagcctgccgagaacgcctggtacgaccgtcttccacgtctgaccttcgaagaggtcgtggagaccctctag

SEQ ID NO: 10411 - protein, 205 aa, Corynebacterium efficiens YS-314
MTETQNLKDALVIHEEAQNILFREARTANAFTDEPVTDEQINAIFDLVKWAPTSMNNQPLRVVVIRSEEAKARLLPHMAEGNREKTAKAPAVALLAADLDFHEEMPQLFPHFEGARDMFASDDQMRAEAAKLNTGLQIGYAIIGIRAAGLAAGPMTGFDADAISKEFFPDGKHRVMVAINMGKPAENAWYDRLPRLTFEEVVETL

SEQ ID NO: 10412 - DNA, 618 bp, Streptomyces avermitilis MA-4680
  CDS (1)..(618): transl_table=11
atgaccgaccgcgaaccgcaggccctcgatgtcctcgacgacgccggacgaaaggtgctgttcaccgaggcccgcaccgcgaacacctttgccgaggtggccgttgccgacgacgagctcgccatgatctgggaactcgcccgctggtcgccgagcgccgccaacggtcagcctctgcgtgtgctctttgtgcgcacccccgagggcaaggagcgactgggccggcatctcgacgagggcaacagggccaagacgctcagtgcgccggccgtggcgatcctggcgtacgacgtcgacttccacgagcagatgccgaccgtcttcccggctcgcggcgagatgctgcgagcggcgttcgccgaccagacggagaagcgcgagagcctcgcggcctacaactcggcactgcagaccggggtcttcctgctcgcggtgcgtgcggcggggctggcggccggtcccatggcgggcttcgacagggccggcgtggacgaggagttcttcgccggtaccagctggcgttcgcatctggtggtcaacatcggtcaccccggcgccgacccgtggttcccgcggctgccccgcgtgcccgtcgaggacgccgtcgcctatgcctga

SEQ ID NO: 10413 - protein, 205 aa, Streptomyces avermitilis MA-4680
MTDREPQALDVLDDAGRKVLFTEARTANTFAEVAVADDELAMIWELARWSPSAANGQPLRVLFVRTPEGKERLGRHLDEGNRAKTLSAPAVAILAYDVDFHEQMPTVFPARGEMLRAAFADQTEKRESLAAYNSALQTGVFLLAVRAAGLAAGPMAGFDRAGVDEEFFAGTSWRSHLVVNIGHPGADPWFPRLPRVPVEDAVAYA

SEQ ID NO: 10414 - DNA, 591 bp, Streptomyces avermitilis MA-4680
  CDS (1)..(591): transl_table=11
atgtctctcgtccttgaccccgccgcccaggacctgctcttccgcgaggcccgcaccgccaacacgttctccgacgagcccgtgaccgacgagcaggtgcaggcgatctacgacctggtcaagtacggcccgaccgccttcaaccagtcgccgctgcgcatcaccctggtccgctccgccgaggcccgcgagcgcctcgtgcagcacatggccgagggcaaccagcccaagaccgccaccgccccgctggtcgcgatcctctccgcggacaacgagttccacgaggagctgccggccctcttcccgcacttcccgcaggccaaggacgtcttcttcgcggagcgcccggcccgtgagggggccgccgcgctgaacgccgctctgcaggccgcgtacttcatcatcggcgtccgtgccgcgggcctcgccgccggcccgatgaccggtctcgacttcgcgggcgtccagaaggagttcctcgacgacgaccacaccccgctgatggtggtcaacatcggcaagccgggcgaggacgcctggttcccgcgctccccgcgcctggagttcgaccaggtcgtcaccacggtctga

SEQ ID NO: 10415 - protein, 196 aa, Streptomyces avermitilis MA-4680
MSLVLDPAAQDLLFREARTANTFSDEPVTDEQVQAIYDLVKYGPTAFNQSPLRITLVRSAEARERLVQHMAEGNQPKTATAPLVAILSADNEFHEELPALFPHFPQAKDVFFAERPAREGAAALNAALQAAYFIIGVRAAGLAAGPMTGLDFAGVQKEFLDDDHTPLMVVNIGKPGEDAWFPRSPRLEFDQVVTTV

SEQ ID NO: 10416 - DNA, 606 bp, Bordetella pertussis Tohama I
  CDS (1)..(606): transl_table=11
atgaatgccccgttgagccttgccgcccaggaacagatcttccaggccgcccgcaccttcaatcgctataccgaacaatcgatcagcgacgcgacgctgcacgagttgtacgagctgatgaaatgggggccgaccgcgatgaattcgcagcccggccggttcatcttcctgcgcagcgccgaggccaggcagcgcctggcgcccgccctgtctcccggcaacctggaaaagacactggccgcgcccgtgaccgtgatcgtcgcccaggacacccagttctatgagcacctgccgacgcagttcagcgcctacgacgcccgtccggtcttcgagaacaacgccgacgccgcgcgcgcgaccgccatgcgcaacagctccctgcaaggcgcctacctgatcgtggcggcccgcatgctgggactggacgccggcccgatgagcggcttcgacgcggccaaggtggacgccgaattcttcccggacggccgctgcagggccaacttcctcgtcaacctgggctacggcgacccggccggcaactacccgcgcggccccccgcctggccttcgacaccgcggcgcaaatcctctgatcgcccggccgtag

SEQ ID NO: 10417 - protein, 201 aa, Bordetella pertussis Tohama I
MNAPLSLAAQEQIFQAARTFNRYTEQSISDATLHELYELMKWGPTAMNSQPGRFIFLRSAEARQRLAPALSPGNLEKTLAAPVTVIVAQDTQFYEHLPTQFSAYDARPVFENNADAARATAMRNSSLQGAYLIVAARMLGLDAGPMSGFDAAKVDAEFFPDGRCRANFLVNLGYGDPAGNYPRGPPPGLRHRGANPLIARP

SEQ ID NO: 10418 - DNA, 579 bp, Bordetella parapertussis 12822
  CDS (1)..(579): transl_table=11
ttgagccttgccgcccaggaacagatcttccaggccgcccgcaccttcaatcgctataccgaacaatcgatcagcgacgcgaccctgcacgagttgtacgagttgatgaaatgggggccgaccgccatgaattcgcagcccggccggttcatcttcctgcgcagcgccgcggccaggcagcgcctggcgcccgccctgtctcccggcaacctggaaaagacactggccgcgcccgtgaccgtgatcgtcgcccaggacacccagttctatgagcacctgccgacgcagttcagcgcctacgacgcccgtccggtcttcgagaacaacgccgacgccgcgcgcgcgaccgccatgcgcaacagctccctgcaaggcgcctacctgatcgtggcggcccgcatgctggggctggacgccggcccgatgagcggcttcgacgcggccaaggtggacgccgaattcttcccggacggccgctgcaaggccaacttcctcgtcaacctgggctacggcgacccggccggcaactacccgcgcggcccccgcctggcgttcgacaccgcggcgcaaatcctctga

SEQ ID NO: 10419 - protein, 192 aa, Bordetella parapertussis 12822
MSLAAQEQIFQAARTFNRYTEQSISDATLHELYELMKWGPTAMNSQPGRFIFLRSAAARQRLAPALSPGNLEKTLAAPVTVIVAQDTQFYEHLPTQFSAYDARPVFENNADAARATAMRNSSLQGAYLIVAARMLGLDAGPMSGFDAAKVDAEFFPDGRCKANFLVNLGYGDPAGNYPRGPRLAFDTAAQIL

SEQ ID NO: 10420 - DNA, 591 bp, Bordetella bronchiseptica RB50
  CDS (1)..(591): transl_table=11
atgaatgccccgttgagccttgccgcccaggaacagatcttccaggccgcccgcaccttcaatcgctataccgaacaatcgatcagcgacgcgaccctgcacgagttgtacgagctgatgaaatgggggccgaccgccatgaattcgcagcccggccggttcatcttcctgcgcagcgccgcggccaggcagcgcctggcgcccgccctgtctcccggcaacctggaaaagacactggccgcgcccgtgaccgtgatcgtcgcccaggacacccagttctatgagcacctgccgacgcagttcagcgcctacgacgcccgtccggtcttcgagaacaacgccgacgccgcgcgcgcgaccgccatgcgcaacagctccctgcaaggcgcctacctgatcgtggcggcccgcatgctggggctggacgccggcccgatgagcggcttcgacgcggccaaggtggacgccgaattcttcccggacggccgctgcaaggccaacttcctcgtcaatctgggctacggcgacccggccggcaactacccgcgcggcccccgcctggcgttcgacaccgcggcgcaaatcctctga

SEQ ID NO: 10421 - protein, 196 aa, Bordetella bronchiseptica RB50
MNAPLSLAAQEQIFQAARTFNRYTEQSISDATLHELYELMKWGPTAMNSQPGRFIFLRSAAARQRLAPALSPGNLEKTLAAPVTVIVAQDTQFYEHLPTQFSAYDARPVFENNADAARATAMRNSSLQGAYLIVAARMLGLDAGPMSGFDAAKVDAEFFPDGRCKANFLVNLGYGDPAGNYPRGPRLAFDTAAQIL

SEQ ID NO: 10422 - DNA, 591 bp, Chromobacterium violaceum ATCC 12472
  CDS (1)..(591): transl_table=11
atgagcactcccctctcccacgccacgctggaacagctgttcctgaacgcccgcacccacagccactggcaaccgcgtccggtgagcgacgagctgctgcaccagctgcacgagctgctgaaacaggcgcccaccagcgccaactgctcgccggcccgcttcgtgttcgtcaagagcgaagcggccaaggccaagctgaaaccctgcctggccgccggcaacgtcgacaagaccatggccgcgccggtctgcgtgatcgtcgcccatgacacgcgcttctacgagcatctgccccagctgttcccgcacgcggacgccaagagctggttcgagggcaaccagccgctgatcgataccaccgccttccgcaacggcacgctgcaaggcgcctacctgatcctggccgcgcgctcgctgggcctggattgcggcccgatgtccggcttcgacaacgccgccgtggacgccgccttcttcccggacgggcgcgtcaagtccaacttcctgatcaacctgggctacggcgaagccgacaagctgttcccgcgctcgccccgcttcggcttcgacgaggcctgccagatcctgtaa

SEQ ID NO: 10423 - protein, 196 aa, Chromobacterium violaceum ATCC 12472
MSTPLSHATLEQLFLNARTHSHWQPRPVSDELLHQLHELLKQAPTSANCSPARFVFVKSEAAKAKLKPCLAAGNVDKTMAAPVCVIVAHDTRFYEHLPQLFPHADAKSWFEGNQPLIDTTAFRNGTLQGAYLILAARSLGLDCGPMSGFDNAAVDAAFFPDGRVKSNFLINLGYGEADKLFPRSPRFGFDEACQIL

SEQ ID NO: 10424 - DNA, 591 bp, Rhodopseudomonas palustris CGA009
  CDS (1)..(591): transl_table=11
atgagctcgacgctgcccgatccccacctcgaccagctgttcgtccaggcccgcacccacaatgcctggacctcaaagccggtgaccgatgacaccatccacgcgctgtacgaccttttgaaatgggcgccgaccgcggccaacagcaacccgggccgcttcgtgttcgtgcgcagcactgacgccaaggcgcggctgctgaacagcgtggcgccgggcaacgtcgacaaggtgaaggcggcgccgtgctgcgtgatcgtggcctacgacaccgaatttcacgacctgttgccgcaactgtttcccgcgcgcgacatgcgcagcggcttcgtcggcaagccggagctgatcaccgagacggcgaagcgcaactcggcgctgcagggcgcctacatgatcctcgccgcccgcgcgctggggctcgatgcgggcccgatgtccggcttcgaccacgccgcgctcgacgccgagttcttccccgacggccgctggaagtcgaacttcctgtgcaacatcggctacggcgatgccgagaagctgttcccgcgcaatccgcggctcgccttcgaggacgcctgccgcgtgctgtga

SEQ ID NO: 10425 - protein, 196 aa, Rhodopseudomonas palustris CGA009
MSSTLPDPHLDQLFVQARTHNAWTSKPVTDDTIHALYDLLKWAPTAANSNPGRFVFVRSTDAKARLLNSVAPGNVDKVKAAPCCVIVAYDTEFHDLLPQLFPARDMRSGFVGKPELITETAKRNSALQGAYMILAARALGLDAGPMSGFDHAALDAEFFPDGRWKSNFLCNIGYGDAEKLFPRNPRLAFEDACRVL

SEQ ID NO: 10426 - DNA, 618 bp, Herminiimonas arsenicoxydans
  CDS (1)..(618): transl_table=11
atgtcttttgaaaatctgaataagaaagtccccatgttgaaccaggaagcgcttgaaacactttttacccatgcccataccaataccgtctggctcgacaagccggtcaccaacggtcagttacgcgagatttatgaattgatgaaatgggggccgacttcgatgaactgcatgccggcgcgtattgccttcatcaagtcgccgcaagccaaggaaaagctggctgcctgcgtatctgccggcaatgtgcaaaaggtgctgactgcgcctattaccgccattatcggcatggacatggcgtttccgcgcaagctgccgcaattgtttccccacgcggatgggcaggcaatctttgccggcaacgataaattgatagcagagacggcgtttcgcaattcctcgctgcaaggcggttatttcatcatggcagcgcgtgccatcggtctggattgcggcccgatgtcgggctttgatgcagaaaaagtgaacgccgaattttttgtcggcacacaggtgaaagcgaatttcctctgcagtataggctatggcgatcacgaaaaaatcaagccgcgtttaccgcgtctgacgttcgaggcttcctgcgccatcgtcctgtaa

SEQ ID NO: 10427 - protein, 205 aa, Herminiimonas arsenicoxydans
MSFENLNKKVPMLNQEALETLFTHAHTNTVWLDKPVTNGQLREIYELMKWGPTSMNCMPARIAFIKSPQAKEKLAACVSAGNVQKVLTAPITAIIGMDMAFPRKLPQLFPHADGQAIFAGNDKLIAETAFRNSSLQGGYFIMAARAIGLDCGPMSGFDAEKVNAEFFVGTQVKANFLCSIGYGDHEKIKPRLPRLTFEASCAIVL

SEQ ID NO: 10428 - DNA, 612 bp, Kineococcus radiotolerans SRS30216
  CDS (1)..(612): transl_table=11
gtgaccacgctcgacgaacgccccgccggactcgacgagacggcccgcgccgccctcttcggcgacgcccgcaccgcgaacagcttcgcgagcacccccgtcaccgacgagcagctggcccaggtctgggaactggcccgctgggcccccaccgccgccaacctgcagccggcccgcgtcctctacgtccgcacccccgaggccaaggcccgcctggtgccgctgctgaacgacaccaaccgcgaccgcgccgcgagcgccccggtgaccgccgtcctcgccctcgacgagcgcttccacgacgccatccccaccgtggcgcccttcctggccggcctgcagccggtgctcgaggaggacaccgcgatgcggtcgggcatgggctcctacagcgccgccctccaggcggggtacttcatcctcgccgtccgcgccctgggcctggccgccggcccgatggccggtttcgaccgcgacgccgtcgacgcggagttcttcgccggcaccacctggcgctcccacctcgtcgtcaacatcggctacccgggcccggacgcgttccgcccccgcctgccccgcctggccccggaggacgtcgtccgctacgcctga

SEQ ID NO: 10429 - protein, 203 aa, Kineococcus radiotolerans SRS30216
MTTLDERPAGLDETARAALFGDARTANSFASTPVTDEQLAQVWELARWAPTAANLQPARVLYVRTPEAKARLVPLLNDTNRDRAASAPVTAVLALDERFHDAIPTVAPFLAGLQPVLEEDTAMRSGMGSYSAALQAGYFILAVRALGLAAGPMAGFDRDAVDAEFFAGTTWRSHLVVNIGYPGPDAFRPRLPRLAPEDVVRYA

SEQ ID NO: 10430 - DNA, 591 bp, Xanthobacter autotrophicus Py2
  CDS (1)..(591): transl_table=11
atgaccaccaagatcgaccaggccgccatcgaccgcctgttcctcgaagcccgctcgcagaacggctggaccgaccagccggtgagcgaggcggagatccgcgcgctctatgatctggtcaaatatggccccacctcggccaacacccagcctgcccgcttcgtcttcgtcaccagccccgaggccaaggagcgcctgcgcccggccctgtcgcccggcaatgtgaaggcgctggcggcgccggtgatcgtcctcatcggctacgccctcgattttcacgacaagattcccgaagtgttcccgcacaatccgggcttccgcgacatgttcgtgaacaatccggcggccatcgagccccacgccttccgcaattcgtcgctgcagggcgcctatctcatcctcgcggcgcgggcgctggggctggatgtgggtcccatgtccggcttcgacgcggccaaggtggatgctgaattcttccccggcggcacggtgaagaccaatttcatcgccgccatcggccacggcgatccctcgaaggtgatgccccgcctgccgcgcctcgccttcgccgacgccgcgcagatcgtctga

SEQ ID NO: 10431 - protein, 196 aa, Xanthobacter autotrophicus Py2
MTTKIDQAAIDRLFLEARSQNGWTDQPVSEAEIRALYDLVKYGPTSANTQPARFVFVTSPEAKERLRPALSPGNVKALAAPVIVLIGYALDFHDKIPEVFPHNPGFRDMFVNNPAAIEPHAFRNSSLQGAYLILAARALGLDVGPMSGFDAAKVDAEFFPGGTVKTNFIAAIGHGDPSKVMPRLPRLAFADAAQIV

SEQ ID NO: 10432 - DNA, 627 bp, Mycobacterium abscessus
  CDS (1)..(627): transl_table=11
gtgaccgactcaaatggccatatcgccgtcgcctctctgcccgtcctggatgaggcaggacgcgcaacacttttcacgcacgctcgcaccgccaatagcttcgccgacacccccatcgcgcgggaaaaactccttgaagcgtgggagctagcccgctgggcgccgacctcggtcaatacccaaccacttcgaattctcttcgtagacaagggcgaagcacgtgaccgcttgatcccacacatgttcgatcccaacaaggccaagacatctaccgctcccgccgttgcgatactggcaaccgacacccgattccacgaccagatacccaccgtgttccccctcatgccagagatggccgagcttttcgaagcgaacagcgaattacgttcttctactgggatattcaatgcagcgttgcaatcggcctacttcatcatggccatccgcgcggtcggtctggccgccgggccgatgggcgggttcgatgcggacggcgtggaccgcgagttcttcccggacaacgactggtcaactgttctggtggtgaacatcggccaccccggcgagaatccgtggtttggccggctaccgcggctcgaccctgccgatgtcgtccgctgggcatag

SEQ ID NO: 10433 - protein, 208 aa, Mycobacterium abscessus
MTDSNGHIAVASLPVLDEAGRATLFTHARTANSFADTPIAREKLLEAWELARWAPTSVNTQPLRILFVDKGEARDRLIPHMFDPNKAKTSTAPAVAILATDTRFHDQIPTVFPLMPEMAELFEANSELRSSTGIFNAALQSAYFIMAIRAVGLAAGPMGGFDADGVDREFFPDNDWSTVLVVNIGHPGENPWFGRLPRLDPADVVRWA

SEQ ID NO: 10434 - DNA, 612 bp, Corynebacterium glutamicum ATCC 13032
  CDS (1)..(612): transl_table=11
atgactacagttactcaagaccttctagcacttgacgaagacgcacagaacctccttttccgtgaggctcgcaccgcaaatgctttcactgatgaaccaatctctgacgagcagatcgaagcaatcttcgacctagttaagtgggcaccaaccgcaatgaactcccagcctctgcgcgtggtaattgttcgttccgaagaagccaaagctcgcctcgtgccattgatggcagaaggcaaccaggccaaggttgctgcagctcctgcggtcgcacttcttgcagccgacatcgacttccacgaagaaatgcccaagctcttcccacctttcccaggcgcacgcgacatgttcgaagccgatgaagcttcacgtgcttcctccgcagaactcaatgctggccttcagatcggatacgccatcatcggtatccgcgcagcaggtctcgccgctggcccaatgaccggcatggatgcagacgctatctccaaggagttcttcccagacggccgccaccgcgttctggttgccatcaacatgggtaagccagctgacaatgcttggtacgaccgcctgccacgccttgagcaggacgaagttgtcgaaaccctctag

SEQ ID NO: 10435 - protein, 203 aa, Corynebacterium glutamicum ATCC 13032
MTTVTQDLLALDEDAQNLLFREARTANAFTDEPISDEQIEAIFDLVKWAPTAMNSQPLRVVIVRSEEAKARLVPLMAEGNQAKVAAAPAVALLAADIDFHEEMPKLFPPFPGARDMFEADEASRASSAELNAGLQIGYAIIGIRAAGLAAGPMTGMDADAISKEFFPDGRHRVLVAINMGKPADNAWYDRLPRLEQDEVVETL

SEQ ID NO: 10436 - DNA, 777 bp, Thermobifida fusca YX
  CDS (1)..(777): transl_table=11
atgcgggaccgcagccgggggtgcgcgcctcatcggcgctgggtgagcggaaacacacgaaaccccggaatcctttcctgggaagataagttgtacgttgctgatccggcctgcaccgccggacagccccgtattcgacgtactttctttccaggagagaccttgtcccagatctccgaaccgctggaactcgccaaggacgcccaggacctcctgttccgggaggcgcggaccgcgaacaccttcagtggcgaacccgtctccgaagaacaggtccgcgcgatctacgacctggtgaagtacggtcccaccgcgatgaacacgcagccgctgcgcatcgtgctgctgcgttcccgcgaaagccgggagcgtctcgtccagcacatggccgaggggaaccaggccaagaccctgtcggctccgctcaccgccatcctcgcctacgacagcgagttccacgagaaggccgaccgcttcttccccgaccgtgcccagggcatccgggacatgttctccagcagcgctgaagcccgcgcgacgaccgcgaaactcaacgcgtccctgcagatcgggtacttccttatcggagtccgcgcggccgggctggcagcggggccgatgaccggtttcgacgccgccgcgatcgacgccgagttcttccctaacgggcggtaccgcacgctcgtcgtcatgaacatcggcaagcctggcgcggaccatccccagttcccgcggctgccccgcctcgactacgaggatgtggtgaccgaactctag

SEQ ID NO: 10437 - protein, 258 aa, Thermobifida fusca YX
MRDRSRGCAPHRRWVSGNTRNPGILSWEDKLYVADPACTAGQPRIRRTFFPGETLSQISEPLELAKDAQDLLFREARTANTFSGEPVSEEQVRAIYDLVKYGPTAMNTQPLRIVLLRSRESRERLVQHMAEGNQAKTLSAPLTAILAYDSEFHEKADRFFPDRAQGIRDMFSSSAEARATTAKLNASLQIGYFLIGVRAAGLAAGPMTGFDAAAIDAEFFPNGRYRTLVVMNIGKPGADHPQFPRLPRLDYEDVVTEL

SEQ ID NO: 10438 - DNA, 588 bp, Ralstonia eutropha JMP134
  CDS (1)..(588): transl_table=11
atgacccagatcgatcaggcagccctggcccagttgttcaccgaagcccgcacgcacaacgtgtggcaagatcgtcacgtggacgatgccgtgctgaaccaggtctatgaagccatgaagttcggcccgaccgctgccaacagctgcccggtacgtatcgtcttcgtcaagagcgccgccgagaaggcccgcctggtcgagtgcgtgtcggctggcaacaccgaaaagacgcgctcggcgcccgtcacggcgatcatcgcgttcgacaaggctttccacgaccagttgcccaagctgttcccgcatgccgatgcacgctcgtggtatgccggcaacgatgccaagatcgcgcgcgatgcgctgatgaacagctcgctgcaaggcggctacttcatcctggccgcacgtgccatgggcctggactgcggcccgatgggcggcttcgacgccgacaaggtcaatgccgcgttcttcccggacggcaagtgggaagtcaacttcctgtgcaacctcggctatggcgaaggcgacaagctgcatccgcgcctgccgcgcctgtcgttcgacgaggcttgccggatcgtctga

SEQ ID NO: 10439 - protein, 195 aa, Ralstonia eutropha JMP134
MTQIDQAALAQLFTEARTHNVWQDRHVDDAVLNQVYEAMKFGPTAANSCPVRIVFVKSAAEKARLVECVSAGNTEKTRSAPVTAIIAFDKAFHDQLPKLFPHADARSWYAGNDAKIARDALMNSSLQGGYFILAARAMGLDCGPMGGFDADKVNAAFFPDGKWEVNFLCNLGYGEGDKLHPRLPRLSFDEACRIV

SEQ ID NO: 10440 - DNA, 588 bp, Burkholderia sp. 383
  CDS (1)..(588): transl_table=11
atgacgacgctgtccgactccgctctcgaccaactgtttctctccgcgcgcacgcacaacgcgtggcaggacaaacctgtcgacgacgcactgctgcaccggctgatcgacctgacgaaattcggcccgacgtcggcgaacgcgagccccgcacgcttcgtgttcgtcaagtcgcccgaggcgaaggcgcgcctgaagcccgcgctgtccgaaggcaatctcgcgaagacgatggccgcgccggtcaccgtgatcgtcggcatggacatggcattccatgagcacctgccgcgcctgttcccgcacgccgacgcacgcagctggttcgccggcaacgatgcgctgatcgagaccaccgcgttccgcaattcgtcgctgcagggcgcatacctgatcctggccgcgcgcgcactcggcctcgacgcgggcccgatgtccggcttcgacggcgcgaaggtcgacgccgcgttcttcgcgggcaccgcgatcaggagcaacttcctcgtgaatctcggctacggcgatccggccggcctgttcccgcgcagcccgcgcttcgacttcgacgacatcgcccgcatcgagtga

SEQ ID NO: 10441 - protein, 195 aa, Burkholderia sp. 383
MTTLSDSALDQLFLSARTHNAWQDKPVDDALLHRLIDLTKFGPTSANASPARFVFVKSPEAKARLKPALSEGNLAKTMAAPVTVIVGMDMAFHEHLPRLFPHADARSWFAGNDALIETTAFRNSSLQGAYLILAARALGLDAGPMSGFDGAKVDAAFFAGTAIRSNFLVNLGYGDPAGLFPRSPRFDFDDIARIE

SEQ ID NO: 10442 - DNA, 609 bp, Burkholderia thailandensis E264
  CDS (1)..(609): transl_table=11
ttgcgcgctcatccggaccccgacatgactctttccgattccgctctcgatcagatttttcgcaccgcgcgcacgcacaacgcatggcagccgaagcccgtcgacgacgcgctgctccaccaactgatcgatctcgtcaagtgcggcccgacgtcggcgaactcgagccccgcgcgcttcgtattcgtgaagtcgccgcaggcgaaggccaagctcaagcccgcgctgtccgaaggcaatctcgcgaagacgatggccgcgcccgtcaccgtgatcgtcgggatggacatggcgttccacgaccatctgccgaagctcttcccgcatgcggacgcgcgcagctggttcgccggcaacgacgcgctgatcgaggcgaccgcgttccgcaattcgtcgctgcaaggtgcgtacctgatcatcgccgcgcgcgcgctcggcctcgatgccggcccgatgtccggcttcgaccaggcggccgtcgacgccgcgttcttcgccggcacgtcgatcaagtcgaacttcctcgtgaatctcggctacggcgacgccgccggcctgttcccgcgcagcccccgcttctcgttcgacgaaatcgcgcgcatcgaataa

SEQ ID NO: 10443 - protein, 202 aa, Burkholderia thailandensis E264
MRAHPDPDMTLSDSALDQIFRTARTHNAWQPKPVDDALLHQLIDLVKCGPTSANSSPARFVFVKSPQAKAKLKPALSEGNLAKTMAAPVTVIVGMDMAFHDHLPKLFPHADARSWFAGNDALIEATAFRNSSLQGAYLIIAARALGLDAGPMSGFDQAAVDAAFFAGTSIKSNFLVNLGYGDAAGLFPRSPRFSFDEIARIE

SEQ ID NO: 10444 - DNA, 585 bp, Burkholderia xenovorans LB400
  CDS (1)..(585): transl_table=11
atgattctctccgacgaggcgctcgcccagctttttcgcgaagcgcgcacgcataacggctggcagccgaaacccgtcgacgacgccgtgctgaggcaactcgtcgaactcgtcctgctcggcccgacctcggccaattcgagtccgggccgcttcgtcttcgtcaaaacgcaggagggcaaggagaagctgcgcccggcattgtcggcaggcaatctcgagaagacgatggcagcgccggtcacggcgatcgttggaatggacatggcgttttacgagcatctgccgaagctgtttccgcacgcggacgcgcgtagctggtttgccggcaacgacaaggcgattgccgacacggcatttcgcaattcgacgctgcaaggcggctatctgattctcgccgcccgcgcgctcggcctggatacgggtgcgatgtccggtttcgacgccgccaggatagacgaagctttctttgccggcacgaccgtgaagtcgaactttctgatcaatctgggctatggcgacccgtccaggctgtttccgcgcagcccgcgccttgctttcgacgaagccgcgcggatcgtctag

SEQ ID NO: 10445 - protein, 194 aa, Burkholderia xenovorans LB400
MILSDEALAQLFREARTHNGWQPKPVDDAVLRQLVELVLLGPTSANSSPGRFVFVKTQEGKEKLRPALSAGNLEKTMAAPVTAIVGMDMAFYEHLPKLFPHADARSWFAGNDKAIADTAFRNSTLQGGYLILAARALGLDTGAMSGFDAARIDEAFFAGTTVKSNFLINLGYGDPSRLFPRSPRLAFDEAARIV

SEQ ID NO: 10446 - DNA, 588 bp, Ralstonia metallidurans CH34
  CDS (1)..(588): transl_table=11
atgaaatccgtcgatcaggcagtccttgcacaattgttcactgaagcccgcacccacaacgtgtggcaagacaagcatgtggatgatgcgctgctgaagcagatctacgaagcgatgaaattcggtccgaccgccgcaaatggctcgccggcacgcatcgtgttcgtgaagtcggcggccgagaaggcccgtctggtcgagtgcgtatcggctggcaatgctgacaagactcgctcggcgccggtgaccgcgatcatcgcgtttgaccgcaacttccacgaccagctgccgaagctgttcccgcacgccgatgcgcgttcgtggtacgccggcaacgacgagaagattgcccgtgacgcgctgatgaacagctcgctgcaaggtggctacttcatcctggccgcccgcgcactgggtctggactgcggcccgatggcgggtttcgatgccgacaagctcaacgccacgttcttccccgacggcaagtgggcggtcaacttcctggtgaacctgggctatggcgaggccgacaagctgttcccgcgtggtccgcgcctgacgttcgacgaagcctgccgcatcgtctga

SEQ ID NO: 10447 - protein, 195 aa, Ralstonia metallidurans CH34
MKSVDQAVLAQLFTEARTHNVWQDKHVDDALLKQIYEAMKFGPTAANGSPARIVFVKSAAEKARLVECVSAGNADKTRSAPVTAIIAFDRNFHDQLPKLFPHADARSWYAGNDEKIARDALMNSSLQGGYFILAARALGLDCGPMAGFDADKLNATFFPDGKWAVNFLVNLGYGEADKLFPRGPRLTFDEACRIV

SEQ ID NO: 10448 - DNA, 594 bp, Ralstonia metallidurans CH34
  CDS (1)..(594): transl_table=11
atgagtgcgccagtcgcatccgatgtgctcgacaccctgttcctgacggcccgcagccacaacggctggctcgacggggacgtctccgacgccacattgacccggctctatgcactcgtcagccaggggccgaccagcgccaactgcagcccgatgcgcctggtcttcgtgcgctccgacgccgccagggcaaggctcctgcctaccctcgcgccagcgaatgtcgacaaggtcaggcacgccccagtcaccgccatcgtggcctacgacacggcgttccacgcgttcggcgaaaccttgttcccgcaccgtcccgccatgttcgacacgttcgcagcggaccccgcactggctgcggaaacggcgatgcgcaacggctcgatgcagggcggctacctgattctggcggcgcgcgcgctcggcctggactgcggcccgctctccggcttcaatgcggacgcggtgaaccgcgccttctttcccgacgggcgctggcgtgtcaacttcctgtgcaaccttggcaagggagacccggcgcgactgttcgcaaagctgccgcgattacccttcgatcaggcctgccgcatcgagtag

SEQ ID NO: 10449 - protein, 197 aa, Ralstonia metallidurans CH34
MSAPVASDVLDTLFLTARSHNGWLDGDVSDATLTRLYALVSQGPTSANCSPMRLVFVRSDAARARLLPTLAPANVDKVRHAPVTAIVAYDTAFHAFGETLFPHRPAMFDTFAADPALAAETAMRNGSMQGGYLILAARALGLDCGPLSGFNADAVNRAFFPDGRWRVNFLCNLGKGDPARLFAKLPRLPFDQACRIE

SEQ ID NO: 10450 - DNA, 603 bp, Myxococcus xanthus DK 1622
  CDS (1)..(603): transl_table=11
atggcaacgcagcaggcaggcctcgacgccaacgccctcaaccagctctttctcgacgcccgcacccacaacgcgtggctcgacaagccggtggcggacgacgtcctccagcagctctacgcgctcacccggatggcgcccacggcggccaactcgcagccggtgcgcatcgtcttcgtgaagagccgcgaggcgaaggagcggctcaagcccaccctgtcccctggcaacgtggacaagacgatgaacgcgccggtgacggccatcatcgcgtacgacaccgcgttctacgaaaagtttccccagctcttccccttgcgcgacatgaaggcgggcttcctcgccatgcccgcggaggcccgcgagaagacggcctacatgaacagctcgctgcaggggggctacttcatcctcgccgcgcgggcgctgggcctggactgcggccccatggcgggcttcgacaacgcgaaggtggacgcggcgttcttcccggaggggaagtggaagtccaacttcctcatcaacctcggctacggcgacgcggagaagctcttcccgcgcaacccgcgcctggacttcagcgaggcgtgccgcatcgagtag

SEQ ID NO: 10451 - protein, 200 aa, Myxococcus xanthus DK 1622
MATQQAGLDANALNQLFLDARTHNAWLDKPVADDVLQQLYALTRMAPTAANSQPVRIVFVKSREAKERLKPTLSPGNVDKTMNAPVTAIIAYDTAFYEKFPQLFPLRDMKAGFLAMPAEAREKTAYMNSSLQGGYFILAARALGLDCGPMAGFDNAKVDAAFFPEGKWKSNFLINLGYGDAEKLFPRNPRLDFSEACRIE

SEQ ID NO: 10452 - DNA, 612 bp, Rhodococcus sp. RHA1
  CDS (1)..(612): transl_table=11
atggtcggcagtaactcgacgatcgaacgcctcgatgacgcagccagagacctgctgttcgcggaagcacgaacagtcaacaacttcgcaccgaccccggtcagcgatgccgaactcgcgcagatctgggaaatggcccgctgggcgccgacggccgcgaactcccaaccgctgcgcgtgcaatacgtgcgcaccgacgacgcccgccgcagactgatcgagcacctggacgagggcaaccgtgagaagacgacatcagctcccgtcaccgtgattctcgcggtagacagcggatttcacgagcaccttccccatctgctgccgatccggccgcagatccgcgaggtcttcgccgccaacgacgcgctgcgcgagcgcaccggcaatttcaacgccgccctgcaggcggggtacttcatcctcgccatccgggccgccggtctggcggccgggccgatgaccggattcgaccccaaaggaatggacaccgagttcttctccggaacaacctggagatcgatcctggtcgtcaacatcggacaccccggtgagaatccgtggttcgagcgtctccccagactcgatcccgcagagaccgtgcactgggcatga

SEQ ID NO: 10453 - protein, 203 aa, Rhodococcus sp. RHA1
MVGSNSTIERLDDAARDLLFAEARTVNNFAPTPVSDAELAQIWEMARWAPTAANSQPLRVQYVRTDDARRRLIEHLDEGNREKTTSAPVTVILAVDSGFHEHLPHLLPIRPQIREVFAANDALRERTGNFNAALQAGYFILAIRAAGLAAGPMTGFDPKGMDTEFFSGTTWRSILVVNIGHPGENPWFERLPRLDPAETVHWA

SEQ ID NO: 10454 - DNA, 612 bp, Rhodococcus sp. RHA1
  CDS (1)..(612): transl_table=11
atgagccacgcaatctctacaggtagaggactcgacgaggcggcacgggcgctgctctacacggaggcgcgcaccgccaacagcttcgctccgacgccggtgagcgacgaggaactcgcgcagatctgggaactcgcgcgctgggcgcccacggcggccaacacgcagccgctccgggtcctgttcgtgcgcaccgacgagggccgcgctcgtctggtcgagcacatgaacgagggcaacagggcgaagaccgcctcggcgcccgccgtcgccgtcctcgcggtcgacccacgtttccacgaccacatcccggcactgttgccgttccgtcccgaactccgcgacgtgttcgaggcgaacgaaccgatgcgcaagcagaccggggacttcaacgccgccctccaggccggctacttcatcctcgccgtgcgctcgctgggtctggcggcaggcccgatggccggattcgacgccgacggtatcgacaaggaattcttccccgacggccagtggcattcgaccctcgtggtcaacatcggccacccgggcgagaacccctggttcgaccggctgcccaggctcgacccggaagaatccgtctcctgggcctga

SEQ ID NO: 10455 - protein, 203 aa, Rhodococcus sp. RHA1
MSHAISTGRGLDEAARALLYTEARTANSFAPTPVSDEELAQIWELARWAPTAANTQPLRVLFVRTDEGRARLVEHMNEGNRAKTASAPAVAVLAVDPRFHDHIPALLPFRPELRDVFEANEPMRKQTGDFNAALQAGYFILAVRSLGLAAGPMAGFDADGIDKEFFPDGQWHSTLVVNIGHPGENPWFDRLPRLDPEESVSWA

SEQ ID NO: 10456 - DNA, 600 bp, Hyphomonas neptunium ATCC 15444
  CDS (1)..(600): transl_table=11
atggcccacccggtcaacgatcacgcgctcgacatcatcttccgcgatgcccgcagccagaacggctatctcgaccggtcggtgcccgaagtgctcatccgcgcggtgtatgacctcgccaagatgggcccgaccagcgccaactgttcgccggcgcgtttcgtgttcgtcaccacgccggaagggaaggagcgcctcttgcccttcatgagcgccggcaaccgcgagaagaccgccgctgcgccctggactgtcatcatggcgttcgacatgcgctttgccgacaagatcccccagctgttcccgcacaatccggatgcaaagcactggtttgacaacaacaccgaagaaaccgccttccggaacagcacgctgcaagcggcctatctgatgctggcggcccgctcgctggggctcgattgcggcccgatgagcggctttgatgtggctggggtgaaccgcgaattcttcgagagccaggaaggcgaagagcagcattggaaggccaacttcatctgcaatctcggctatggcgataagaccaagatcatggcccgctccccgcgtctggaatttgacgagggctgccgcatcctctaa

SEQ ID NO: 10457 - protein, 199 aa, Hyphomonas neptunium ATCC 15444
MAHPVNDHALDIIFRDARSQNGYLDRSVPEVLIRAVYDLAKMGPTSANCSPARFVFVTTPEGKERLLPFMSAGNREKTAAAPWTVIMAFDMRFADKIPQLFPHNPDAKHWFDNNTEETAFRNSTLQAAYLMLAARSLGLDCGPMSGFDVAGVNREFFESQEGEEQHWKANFICNLGYGDKTKIMARSPRLEFDEGCRIL

SEQ ID NO: 10458 - DNA, 666 bp, Mycobacterium smegmatis str. MC2 155
  CDS (1)..(666): transl_table=11
atgatcggacactcgaccatgacccactcgaaaaccaaagatcatgccgcgcaggcggattccgacatcgcacaacgcctctcggccttgggcgacgatggacgagacctgctgttccgacgggcacgcacggccaacacgttctcggccgaacctgtcgccgacgcactactcgaagaagtttgggaccttgcacaatggccgccgacctcggccaacggcaatcctcttcgcatcgttttcattcggtcaccagaagccaaggcgcggttgcttccgtgtatagacgaaggcaatcggcccaaggtcgccgctgcccctgtcaccgccgtgctggccaccgatacggccttcttcgaatcgataccgaagctgcttccgttcaagcccgagatgcgtgacttgctggccggacgcagcgaccgcgaccacatcggcgaattcaatgcaacgctccagatcggctacttcatcatggcggtccgcgccgtcggtctggctgccggcccgatggcggggttcgaccgcgcaggcgtcgacgcggagttcctgacaggcaccacatggcgttctctgttgaccgtcaacatcggccacccaggcccggcggcgtggtacgaccgtcttccgcgacacgatcccagcgacatcgtcagattcgtctag

SEQ ID NO: 10459 - protein, 221 aa, Mycobacterium smegmatis str. MC2 155
MIGHSTMTHSKTKDHAAQADSDIAQRLSALGDDGRDLLFRRARTANTFSAEPVADALLEEVWDLAQWPPTSANGNPLRIVFIRSPEAKARLLPCIDEGNRPKVAAAPVTAVLATDTAFFESIPKLLPFKPEMRDLLAGRSDRDHIGEFNATLQIGYFIMAVRAVGLAAGPMAGFDRAGVDAEFLTGTTWRSLLTVNIGHPGPAAWYDRLPRHDPSDIVRFV

SEQ ID NO: 10460 - DNA, 591 bp, Magnetospirillum magnetotacticum MS-1
  CDS (1)..(591): transl_table=11
atgagcggtgatctcgatcaggcgaccatggacaggctgttcgccaaggcccgcacctactcgaaattcacgaaggctccggtctccgacgatctgctgcgccaagcctgggatctggcccgcatggggcccaccagcgtcaactgccagcccatgcgtgtcgtcttcgtgcgctcatccgcagccaaggaacggctgaagcccgccctggcgcccggcaatctggacaagaccatggccgctccggtcaccgccatcatcgcccatgacatggagttctacgagcaactccccaagctgttcccccatgcggatgcgcgggcgtggttcgtgggcaacgaggccatgatccagtccaccgccttccggaatggaacattgcagggcgcctatttcatcctggcgctgcgcgcaatcggcctggattgcggccccatgagcggcttcgacaacgccaagctggacgaagccttcttcaagggcaccacactgcgctccaacttcctggtcaatatcggccatggcgatgccgccggactgtatcccaggggcccgcgcctggatttcgacgaggcatgccgggtggagtga

SEQ ID NO: 10461 - protein, 196 aa, Magnetospirillum magnetotacticum MS-1
MSGDLDQATMDRLFAKARTYSKFTKAPVSDDLLRQAWDLARMGPTSVNCQPMRVVFVRSSAAKERLKPALAPGNLDKTMAAPVTAIIAHDMEFYEQLPKLFPHADARAWFVGNEAMIQSTAFRNGTLQGAYFILALRAIGLDCGPMSGFDNAKLDEAFFKGTTLRSNFLVNIGHGDAAGLYPRGPRLDFDEACRVE

SEQ ID NO: 10462 - DNA, 609 bp, Erythrobacter sp. NAP1
  CDS (1)..(609): transl_table=11
atgcctacccaatatcacgacaacgttctgtctgccgacgtgctcggccaactcttcaacgatgcgcgcacctataatggttggctcgacaagcccgtctcggacgcgcagctgaaggctatctgggacctgatgaagatggcgccgacctctgctaacatgcagccggttcgcatcatctgggtgaagagccaggaagaaaaggaccgcctcgccggtctcgcttcggaaggcaaccgcgacaagatcaaggccgcgcctgttaccgcgatcatcggctacgacatcgattttcacgaggaattgccctggctgttcccgcacaccgatgcaaagagctggtttgaaggggacgaggaaggccgcaaggaaggcgcgttccggaattcctcgatgcagggtgcgtacctcatacttgcagcacgcgctgttgggctcgattgcggccctatgtcgggcttcgatgccgacaaggtcaacgaggcttatttcggagacaatccgcgtcaccgtgtgaatttcctgtgctcgattggctatggcgatcccgaaagcattttcgaccgttcgccgcgccccgacttcgagaagttcaactcgatcgtctga

SEQ ID NO: 10463 - protein, 202 aa, Erythrobacter sp. NAP1
MPTQYHDNVLSADVLGQLFNDARTYNGWLDKPVSDAQLKAIWDLMKMAPTSANMQPVRIIWVKSQEEKDRLAGLASEGNRDKIKAAPVTAIIGYDIDFHEELPWLFPHTDAKSWFEGDEEGRKEGAFRNSSMQGAYLILAARAVGLDCGPMSGFDADKVNEAYFGDNPRHRVNFLCSIGYGDPESIFDRSPRPDFEKFNSIV

SEQ ID NO: 10464 - DNA, 609 bp, Erythrobacter sp. SD-21
  CDS (1)..(609): transl_table=11
atgaccaagcaattccacgacaaccacctgtcggccgacgcgcttgaccagatctttcgcgaagcgcgcagttacaacggctggcacgaaaaggacgtgagcgagaagcagatcgaggcgatctacgaattgctgaagatgggtccgacctcggccaatatgcagccgggtcgctttgtctggtgcaagagccagaaatcgcgcgacaagctggccgaattcgcgtcagagggtaacaaggaaaagatcaagaccgcgccggtcgtggtcgtgatcggttacgatatcgacttccacgaagagctgccgtggcttttcccgcacaccgacgccaagagctggttcgaaggcgacgaggagggccgcaaggaaggcgccgcgcgcaattccgccttgcagggcgcttacctgatgatcgcggcgcgcgcgctgggcctcgattgcggccctatgtcgggcgtcgatctcgacaaggtgaccgagcatttcttcgccgacagcccccgtcaccgcgcggattgggtctgcgccatcggctatggcgacaaggaaacgatcttcggtcgctcgccccgtcccgatttcgacaagttcaaccgcatcaactga

SEQ ID NO: 10465 - protein, 202 aa, Erythrobacter sp. SD-21
MTKQFHDNHLSADALDQIFREARSYNGWHEKDVSEKQIEAIYELLKMGPTSANMQPGRFVWCKSQKSRDKLAEFASEGNKEKIKTAPVVVVIGYDIDFHEELPWLFPHTDAKSWFEGDEEGRKEGAARNSALQGAYLMIAARALGLDCGPMSGVDLDKVTEHFFADSPRHRADWVCAIGYGDKETIFGRSPRPDFDKFNRIN

SEQ ID NO: 10466 - DNA, 579 bp, Magnetospirillum gryphiswaldense
  CDS (1)..(579): transl_table=11
atgaccaccccgcagctggaacaaatgttcaaccttggccgcactcattctcattggctggatcgtccggtggaccctggcctgttgcgtcaggcctgggatctggcggtgctggggccgacttccgccaattgtctgcccatgcgcgtggttttcgtcgtgggagccgcggccaaggccaggctgcgcccggccctggccgcgggcaatgtggacaagaccatggccgccccggtcaccgccatcattggccaggatctggattttcccgacaccttgccccggctttatccccatgccgatgcgcaatcgtggttcgctggcaacgacgccctgatccaatccaccgcctttcgcaattccagcctgcaagccggttatttcattctggcgctgcgtgcccagggtctggattgcggccccatgagcggttttgatgccgatcaagtcgatcaagcctttttcgccgataccaaggtgcgggccaacctgctcatcaatatcggttacggtgacgcaacaaagttgcatccgcgcaatccccgcctatccttcaccgagggctgccgcatcctataa

SEQ ID NO: 10467 - protein, 192 aa, Magnetospirillum gryphiswaldense
MTTPQLEQMFNLGRTHSHWLDRPVDPGLLRQAWDLAVLGPTSANCLPMRVVFVVGAAAKARLRPALAAGNVDKTMAAPVTAIIGQDLDFPDTLPRLYPHADAQSWFAGNDALIQSTAFRNSSLQAGYFILALRAQGLDCGPMSGFDADQVDQAFFADTKVRANLLINIGYGDATKLHPRNPRLSFTEGCRIL

SEQ ID NO: 10468 - DNA, 594 bp, Ralstonia eutropha
  CDS (1)..(594): transl_table=11
atgatgcaaaccaatgaactgcttgacaagatcttccgcggtgcacgcagccagaatggctggctgcccacgccggtgcctgacagcaagctgcgggaactgtatgacctgatgaaatttggcccgacctcggtcaactgctcgccagcccggctggtgttcgtgcgcacggaggagggcagggaaaagctgcgtccggcactggcccccggcaacgtcgaaaagaccatggcggcgccggtcgtcgcgatcgtcggctacgacacgcgcttctacgagcagctgccggatctgttcccgcacaaccccgcagtcaaggcatggttcgagggcgacgagaaggtggatttcgccaacaccaccgcgtttcgaaacggcacgctgcaaggcggctatcttatcgccgctgcgcgcgcgctgggtctcgattgcggccccatgtccggcttcaacaaccaggccatcgatcaggccttcttcgccggcaccagcatccgctcgaatttcatctgcggccttggtcacggcgacccggaaaaagtgttcgcccgcagtccacgcctgtcgttcgagcaggcctgccaacttgcctag

SEQ ID NO: 10469 - protein, 197 aa, Ralstonia eutropha
MMQTNELLDKIFRGARSQNGWLPTPVPDSKLRELYDLMKFGPTSVNCSPARLVFVRTEEGREKLRPALAPGNVEKTMAAPVVAIVGYDTRFYEQLPDLFPHNPAVKAWFEGDEKVDFANTTAFRNGTLQGGYLIAAARALGLDCGPMSGFNNQAIDQAFFAGTSIRSNFICGLGHGDPEKVFARSPRLSFEQACQLA

SEQ ID NO: 10470 - DNA, 591 bp, Burkholderia pickettii
  CDS (1)..(591): transl_table=11
atgactgccaccatttcccttgctaccctgttcggcgaggcacgcagccagaacggctggctcgaccgcgacgttcccgacgccaggctgcgcgagatctatgaccagatgaagttcggcccgacctcggtcaactgctcgcccgcgcgcatcgtcttcgtccgcagcatggaagccaagcaaaagctcgcgggcgccgtggcgccggccaacgtcgacaaggtgatgaacgcgccggtggtggccatcgtcggctatgacacccgcttctacgaccgcctgcctgagctgttcccgcacaaccctgcggtcaagtcctggttcgaaggcccggagaaggccgctttcgccgagaccacggcgttccgcaacggcacgctgcagggcgcctacctgatcatggccgcgcgcgcggtcgggctggattgcggaccgatgtcggggttcaacaatgccgcggtggacgcggctttctttgcgggaacgacgatccggtcgaactttatctgtggactgggccatggcgatcccggccgggtgtttccgcgcagcccgcgcctggcgttcgagcaggcctgcacgctggcgtag

SEQ ID NO: 10471 - protein, 196 aa, Burkholderia pickettii
MTATISLATLFGEARSQNGWLDRDVPDARLREIYDQMKFGPTSVNCSPARIVFVRSMEAKQKLAGAVAPANVDKVMNAPVVAIVGYDTRFYDRLPELFPHNPAVKSWFEGPEKAAFAETTAFRNGTLQGAYLIMAARAVGLDCGPMSGFNNAAVDAAFFAGTTIRSNFICGLGHGDPGRVFPRSPRLAFEQACTLA

SEQ ID NO: 10472 - DNA, 591 bp, Escherichia coli O157
  CDS (1)..(591): transl_table=11
atgaacgaagccgttagcccaggtgcgcttagcaccctgttcaccgatgcccgcactcacaacggctggcgggagacacccgtcagcgatgagacgttacgggagctttatgccctgatgaaatgggggccgacatcagctaactgttctccggcacgtatcgtgtttatccgcactgcagagggaaaagaacgtctgcgcccggcgctttccagcggcaatctgcaaaaaaccctgaccgcgcccgtcaccgctatcgtcgcatgggacagtgaattttatgaacggttaccgcaactgtttcctcacggcgatgcccgcagttggtttacctccagcccacaacttgccgaagaaacagcgtttcgcaacagttccatgcaggcggcttatctgatcatcgcctgccgtgcgctggggctggataccggcccgatgtcgggttttgatcgtcaacacgtagacgacgctttttttgcaggcagcacgctgaagagcaatctgctgattaatatcggctatggcgatagcagcaaactttttgcgcgcctgccacgtctgtcctttgaagaagcctgcgggctgttgtaa

SEQ ID NO: 10473 - protein, 196 aa, Escherichia coli O157
MNEAVSPGALSTLFTDARTHNGWRETPVSDETLRELYALMKWGPTSANCSPARIVFIRTAEGKERLRPALSSGNLQKTLTAPVTAIVAWDSEFYERLPQLFPHGDARSWFTSSPQLAEETAFRNSSMQAAYLIIACRALGLDTGPMSGFDRQHVDDAFFAGSTLKSNLLINIGYGDSSKLFARLPRLSFEEACGLL

SEQ ID NO: 10474 - DNA, 591 bp, Escherichia coli O6
  CDS (1)..(591): transl_table=11
atgaacgaagccgttagcccaggtgcgcttagcaccctgttcaccgatgcccgcactcacaacggctggcgggagacacccgtcagcgatgagacgttacgggagatttatgccctgatgaaatgggggccgacatctgctaactgttctccgacacggatcgtgtttatccgcactgcagaaggaaaagaacgtctgcgcccggcgctttccagcggcaatctgcaaaaaaccctgaccgcgcccgtcaccgctatcgtcgcctgggacagtgaattttatgaacggttaccacagctgtttcctcacggcgatgcccgcagttggtttacctccagtccacaacttgccgaagaaacagcgtttcgcaacagttccatgcaggcggcctatctgatcgtcgcctgccgtgcgctggggctggataccggcccgatgtcgggctttgaccgtcaatacgttgacgacgccttttttgcgggcagcacgctgaagagcaatctgctgattaatatcggctatggcgattccagcaaactttttgcgcgcctgccacgtctgtcctttgaagaagcctgcgggctgttgtaa

SEQ ID NO: 10475 - protein, 196 aa, Escherichia coli O6
MNEAVSPGALSTLFTDARTHNGWRETPVSDETLREIYALMKWGPTSANCSPTRIVFIRTAEGKERLRPALSSGNLQKTLTAPVTAIVAWDSEFYERLPQLFPHGDARSWFTSSPQLAEETAFRNSSMQAAYLIVACRALGLDTGPMSGFDRQYVDDAFFAGSTLKSNLLINIGYGDSSKLFARLPRLSFEEACGLL

SEQ ID NO: 10476 - DNA, 588 bp, Caulobacter crescentus
  CDS (1)..(588): transl_table=11
atggccaagctcgacgacgccacgcttgcgcaattgttcactgaggctcgcagccacaacggctggaaccccgagcccctgcccgaaagcgtcctgcgcgagctttatgcgctgaccaagtttggtccgacggcggccaacggcagccccgcccgcttctatttcgtgacctcggccgaggccaaggaacgcctggccaagctgtcgtccggttcgaacgggcccaagattatgcaggcgccttgcacggtcatcatcggctatgacctggatttcccgcaaaccttgcccaagctgttcccgcacgcgccgggcgccaaggactggttcaacgaccccgtcgccaaggagtggtgcgcgctgcgcaacagctcgttgcagggcggctatttcatgatcggcgcgcgggcgctgggcctggatgtcggtccaatgtcgggcttcgacaacgccgccgtcgacgccgagttcttcgcgggcacgaacatcaagagcaacttcatcgtctcgatcggacacggcacggacgagggcctgttcccgcgcaacccgcgcctggacttcgacgaggccgccaagatcctgtaa

SEQ ID NO: 10477 - protein, 195 aa, Caulobacter crescentus
MAKLDDATLAQLFTEARSHNGWNPEPLPESVLRELYALTKFGPTAANGSPARFYFVTSAEAKERLAKLSSGSNGPKIMQAPCTVIIGYDLDFPQTLPKLFPHAPGAKDWFNDPVAKEWCALRNSSLQGGYFMIGARALGLDVGPMSGFDNAAVDAEFFAGTNIKSNFIVSIGHGTDEGLFPRNPRLDFDEAAKIL

SEQ ID NO: 10478 - DNA, 588 bp, Ralstonia solanacearum
  CDS (1)..(588): transl_table=11
atgcccacgcttgaaccgtccgtgctcgaccaactgttccatgaagcccgcacccacaacgtgtggctggacaatccggtcgacgacgaactgctgcatacgctgtacgacaccgtcaagtacggcccgaccgccgccaacagcacgccggcccgcttcgtcttcgtcaagagcgctgctgccaaggaacaactggtcccgtgcatgtcggccggcaaccaggagaagacgcggcaggcgcccgtcaccgtgatcgtcgcgtacgacacccagtttcacgagcagctgcccaaactgttcccgcacgtcgacgcacgttcgtggtacgccggcgaccaggccaggatcaatgccgccgcgctgatgaacagctcgctgcagggcggctacctggtgatcgcggcgcgcgcgctgggactcgactgcgggccgatgggcggcttcgatgccgacaaggtgaacgccaccttcttccccgacggccagtggaaggtcaacttcatctgcaacctcggctatggcgataccagcaaggtgcatccgcgcaatccgcgcctgacgttcgaagaggcctgccgggtgctctga

SEQ ID NO: 10479 - protein, 195 aa, Ralstonia solanacearum
MPTLEPSVLDQLFHEARTHNVWLDNPVDDELLHTLYDTVKYGPTAANSTPARFVFVKSAAAKEQLVPCMSAGNQEKTRQAPVTVIVAYDTQFHEQLPKLFPHVDARSWYAGDQARINAAALMNSSLQGGYLVIAARALGLDCGPMGGFDADKVNATFFPDGQWKVNFICNLGYGDTSKVHPRNPRLTFEEACRVL

SEQ ID NO: 10480 - DNA, 591 bp, Klebsiella pneumoniae subsp
  CDS (1)..(591): transl_table=11
atgaacgacgcgataaaccacacggcctgcgagacgctgtttacccaggcccggacccacaacggctggctggataagccggtgagcgatgcgcagctgcaggccgtctgggacctgatgaaaatggggccgacttccgccaactgttcgccagcgcgcatcgtgttcgtgcgcagcgcggaaggcaaagagaaacttcgcccgacgctctccagcggcaatctgcagaaaaccatgcaggcgccggtgaccgccatcgtggcgtgggatagcgccttctacgaccggctgccgaccctgtttccccacggtgacgcccgcagctggtttacctccagcccgcagctggcggaagagaccgcgtttcgcaacagctccctgcaggcggcgtatctgatttttgcctgccgggcgcggggcctcgacaccgggccaatgtccggttttgaccgggaaaaagtcgacgcggcattttttgccgacaacggctggaaaagcaacttgctggtgaacatcggctatggcgaccccggcaagctgtacggccgcctgccgcgcctgtcctttgatgaagcctgcctgctggcataa

SEQ ID NO: 10481 - protein, 196 aa, Klebsiella pneumoniae subsp
MNDAINHTACETLFTQARTHNGWLDKPVSDAQLQAVWDLMKMGPTSANCSPARIVFVRSAEGKEKLRPTLSSGNLQKTMQAPVTAIVAWDSAFYDRLPTLFPHGDARSWFTSSPQLAEETAFRNSSLQAAYLIFACRARGLDTGPMSGFDREKVDAAFFADNGWKSNLLVNIGYGDPGKLYGRLPRLSFDEACLLA

SEQ ID NO: 10482 - DNA, 591 bp, Ralstonia eutropha
  CDS (1)..(591): transl_table=11
atgcaaaccaatgaactgcttgacaagatcttccgcggtgcacgcagccagaatggctggctgcccacgccggtgcctgacagcaagctgcgggaactgtatgacctgatgaaatttggcccgacctcggtcaactgctcgccagcccggctggtgttcgtgcgcacggaggagggcagggaaaagctgcgtccggcactggcccccggcaacgtcgaaaagaccatggcggcgccggtcgtcgcgatcgtcggctacgacacgcgcttctacgagcagctgccggatctgttcccgcacaaccccgcagtcaaggcatggttcgagggcgacgagaaggtggatttcgccaacaccaccgcgtttcgaaacggcacgctgcaaggcggctatcttatcgccgctgcgcgcgcgctgggtctcgattgcggccccatgtccggcttcaacaaccaggccatcgatcaggccttcttcgccggcaccagcatccgctcgaatttcatctgcggccttggtcacggcgacccggaaaaagtgttcgcccgcagtccacgcctgtcgttcgagcaggcctgccaacttgcctag

SEQ ID NO: 10483 - protein, 196 aa, Ralstonia eutropha
MQTNELLDKIFRGARSQNGWLPTPVPDSKLRELYDLMKFGPTSVNCSPARLVFVRTEEGREKLRPALAPGNVEKTMAAPVVAIVGYDTRFYEQLPDLFPHNPAVKAWFEGDEKVDFANTTAFRNGTLQGGYLIAAARALGLDCGPMSGFNNQAIDQAFFAGTSIRSNFICGLGHGDPEKVFARSPRLSFEQACQLA

SEQ ID NO: 10484 - DNA, 591 bp, Agrobacterium tumefaciens
  CDS (1)..(591): transl_table=11
atgacgaaatcacttgatgacgctgcactggcgacgcttttcaccgaagcacgcacccacaatggttggacggacaagccgatcggcgacgagacgctgatggccctttacgatctgacgaagatggggccgacctcagccaattgctcgccagcgcgtttcgtcttcgtgcgcagccaggaggcgaaggaaaagctgaagcctgcgctgtcttccggcaatctcgaaaagaccatggcggcaccggtgactgtcatcgccgccattgacagcgaattctacgagaaactgccggaactgtttccccacgccgatgcgcgttcgtggttcacttccagcccggcggtggccgaagaaacggcctttcgcaacgccacgcttcaggccggatatctgatccttgccgcccgcgcgctagggctggataccggcgccatgtcgggtttcgacaagggtaaggtggatgcggcgttttttgccgggacgacgtggaaatccaattttctgatcaatctcggttatggcgatccgtcgaagctgttcggccgcctgccgcgccttggatttgaagacgcctgtgtgctggcttga

SEQ ID NO: 10485 - protein, 196 aa, Agrobacterium tumefaciens
MTKSLDDAALATLFTEARTHNGWTDKPIGDETLMALYDLTKMGPTSANCSPARFVFVRSQEAKEKLKPALSSGNLEKTMAAPVTVIAAIDSEFYEKLPELFPHADARSWFTSSPAVAEETAFRNATLQAGYLILAARALGLDTGAMSGFDKGKVDAAFFAGTTWKSNFLINLGYGDPSKLFGRLPRLGFEDACVLA

SEQ ID NO: 10486 - DNA, 591 bp, Xanthomonas campestris pv
  CDS (1)..(591): transl_table=11
atgtccgacctgctcaacgctgccgcgctggatcagctgtttcgcaccgcccgcacgcaaaacgccttcctcgatacgccggtcagcgaagacctgttgcgcgagctctatgacctggtcaagtggggccccaccgcggccaacggctcgccggcgcggttcgtgttcgtgaccaccgccgagggcaaggaaaagctcaagccggcattgtccgaaggcaacgccgccaagaccctggccgcaccggtgacggcgatcattgggtttgacgaagacttccacgagaagctgccgtacctgttcccgcatgccgatgccaagagctggttcgacggcccgcgcacggcgcgcaccgagtcggcattccgcaacagctcgctgcagggcgcgtacctgatcctggccgcgcgtgcgctgggcctggatgccggcccgatgtccggcttcgacaatgccaaggtggatgctgcgttctttgccggcacgccgattaaatccaactttctggtcaatctcgggtacggtgacccggccgggctgttcccgcgcctgccgcgcctgagtttcgacgaagccgcacgcatcgcttaa

SEQ ID NO: 10487 - protein, 196 aa, Xanthomonas campestris pv
MSDLLNAAALDQLFRTARTQNAFLDTPVSEDLLRELYDLVKWGPTAANGSPARFVFVTTAEGKEKLKPALSEGNAAKTLAAPVTAIIGFDEDFHEKLPYLFPHADAKSWFDGPRTARTESAFRNSSLQGAYLILAARALGLDAGPMSGFDNAKVDAAFFAGTPIKSNFLVNLGYGDPAGLFPRLPRLSFDEAARIA

SEQ ID NO: 10488 - DNA, 597 bp, Xanthomonas oryzae pv
  CDS (1)..(597): transl_table=11
gtgctcatgtccgactcgctcaacgccgccgcactggatcagctgtttcgcaccgcccgcacgcagaacgcgttcgccgacacgccggtcagccaggaggtactgcgcgagctctatgagctggtgaagtggggccccaccgcggccaatagcggcccggcgcgctttgtgttcgtgaccagcgccgacggcaaggccaagctcaagccggcgctgtccgagggcaatgccgccaagaccctggccgcgccagtgacggtgatcgtggcgcacgatgaagacttccacgaaaagctgccgtacctgttcccgcatgccgacgccaagagttggttcgacggcccgcgcgaagggcgcgccgaatcggcgttccgcaacggctcgctgcaaggcgcctacctgatcctggccgcgcgtgcgctgggactggatgccggtccgatgtccggcttcgataacgccaaggtggatgcggcgttcttcgccggcacgccgatcaagtccaacttcctggtcaatctcggctacggcgacccggccgggctgttcccgcgttcgccacgcctgagcttcgacgaagccgcgcgcttcgaataa

SEQ ID NO: 10489 - protein, 198 aa, Xanthomonas oryzae pv
MLMSDSLNAAALDQLFRTARTQNAFADTPVSQEVLRELYELVKWGPTAANSGPARFVFVTSADGKAKLKPALSEGNAAKTLAAPVTVIVAHDEDFHEKLPYLFPHADAKSWFDGPREGRAESAFRNGSLQGAYLILAARALGLDAGPMSGFDNAKVDAAFFAGTPIKSNFLVNLGYGDPAGLFPRSPRLSFDEAARFE

SEQ ID NO: 10490 - DNA, 591 bp, Streptomyces coelicolor
  CDS (1)..(591): transl_table=11
atgtctctcgttcttgaccccgccgcccaggacctgctgttccgcgaggcccgcacggcgaacaccttcaccgacgagccggtgaccgacgagcaggtgcaggcgatctacgacctggtcaagtacggcccgaccgccttcaaccagtcgccgctgcgcatcacgctggtccgctcccccgaggcccgcgagcgcctggtcgcccacatggccgagggcaaccggcccaagaccgccgccgccccgctggtcgccatcctgtccgcggacaacgagttccacgaggagctgccggagctcttcccgcacttccccgccgcgaaggacgccttcttcagcgagcgtccggtccgcgagggcgcggccaccctgaacgccgccctccaggccgcgtacttcatcgtcggcgtccgcgccgcgggtctggccgccggaccgatgaccggcctcgacttcgagggcgtgcgcaaggagttcctggacgacgaccacaccccgctgatggtcgtgaacatcggccgtccgggcccggacgcctggttcccgcgctccccgcggctggcctacgaccaggtcgtcaccacggtctga

SEQ ID NO: 10491 - protein, 196 aa, Streptomyces coelicolor
MSLVLDPAAQDLLFREARTANTFTDEPVTDEQVQAIYDLVKYGPTAFNQSPLRITLVRSPEARERLVAHMAEGNRPKTAAAPLVAILSADNEFHEELPELFPHFPAAKDAFFSERPVREGAATLNAALQAAYFIVGVRAAGLAAGPMTGLDFEGVRKEFLDDDHTPLMVVNIGRPGPDAWFPRSPRLAYDQVVTTV

SEQ ID NO: 10492 - DNA, 597 bp, Xanthomonas axonopodis pv
  CDS (1)..(597): transl_table=11
gtgctcatgtccgactcgctcaacgccgccgcactggatcagctgttccgcaccgcccgcacgcagaatgcgtttgccgacacgccggtcagccacgaggtgctgcgtgagctgtatgagctggtgaagtgggggcccaccgcggccaatagctgtccggcgcgctttgtgttcgtgaccagcgccgaaggcaaggccaagctcaagccggcgctgtcggagggcaatgccgccaagacgctggccgcaccggtgacggtgatcgtggcgcacgacgaagacttccacgagaagctgccgtatctgttcccacatgccgacgccaagagctggttcgacggcccgcgcgagggccgcaccgaatcggcgttccgcaatggctcgctgcagggcgcctacctgatcctggccgcgcgtgcgctgggactggatgccggcccgatgtccggcttcgataatgcgaaggtggatgcggcgttctttgccggcacgccgatcaagtccaacttcctggtcaatctcggctatggcgacccggccgggctgttcccgcgttcgccacgcctgagcttcgacgaagcggcacgtttcgagtaa

SEQ ID NO: 10493 - protein, 198 aa, Xanthomonas axonopodis pv
MLMSDSLNAAALDQLFRTARTQNAFADTPVSHEVLRELYELVKWGPTAANSCPARFVFVTSAEGKAKLKPALSEGNAAKTLAAPVTVIVAHDEDFHEKLPYLFPHADAKSWFDGPREGRTESAFRNGSLQGAYLILAARALGLDAGPMSGFDNAKVDAAFFAGTPIKSNFLVNLGYGDPAGLFPRSPRLSFDEAARFE

SEQ ID NO: 10494 - DNA, 609 bp, Streptomyces coelicolor
  CDS (1)..(609): transl_table=11
atgtccgtttccggacctctcccccgcatccccgccgaggccggcgccgcgctcttcaccgacgcccgtaccgcgtactccttcgccgacactccggtcgacgacgcgacgctcaccggcatctgggagctcgcccgctgggcaccgaccgccgcgaacacccagccgatgcgcgtcctgtacgtccgtacggccgagggcaaggagcgcctgctgccgcacctcgacgagggaaaccggccgaagtcggcctcggccccggtcgtcgcggtcctcgccgtggaccaccgcttccacgagcacctcccgcacgtcctgcccgtccgcccggagatgaaggagtacttcgagggcgagcccgcccagcgcgaggccatcacctcgttcaacggaccgcttcaggccggatacttcatcctcgccgtccgcgccctcggcctggccgcgggtccgatggccggcttcgacccggccgggatcgacaaggagttcttcgccgacagcgactggcactccatcctcgtggtcaacatcgggcacccggccggacccccggcgttcgaccgcatgccgcgcctggcccacgagcacgccctcgactgggcctga

SEQ ID NO: 10495 - protein, 202 aa, Streptomyces coelicolor
MSVSGPLPRIPAEAGAALFTDARTAYSFADTPVDDATLTGIWELARWAPTAANTQPMRVLYVRTAEGKERLLPHLDEGNRPKSASAPVVAVLAVDHRFHEHLPHVLPVRPEMKEYFEGEPAQREAITSFNGPLQAGYFILAVRALGLAAGPMAGFDPAGIDKEFFADSDWHSILVVNIGHPAGPPAFDRMPRLAHEHALDWA

SEQ ID NO: 10496 - DNA, 22 bp, Artificial sequence
  primer
atgaacgaagccgttagcccag

SEQ ID NO: 10497 - DNA, 22 bp, Artificial sequence
  primer
ttacaacagcccgcaggcttct

SEQ ID NO: 10498 - protein, 187 aa, Artificial sequence
  consensus sequence
  Variant (3)..(4): Xaa in position 3 to 4 is any amino acid
  Variant (8)..(8): Xaa in position 8 is any amino acid
  Variant (10)..(15): Xaa in position 10 to 15 is any amino acid
  Variant (17)..(20): Xaa in position 17 to 20 is any amino acid
  Variant (22)..(26): Xaa in position 22 to 26 is any amino acid
  Variant (28)..(31): Xaa in position 28 to 31 is any amino acid
  Variant (34)..(35): Xaa in position 34 to 35 is any amino acid
  Variant (37)..(38): Xaa in position 37 to 38 is any amino acid
  Variant (40)..(40): Xaa in position 40 is any amino acid
  Variant (42)..(53): Xaa in position 42 to 53 is any amino acid
  Variant (55)..(60): Xaa in position 55 to 60 is any amino acid
  Variant (63)..(63): Xaa in position 63 is any amino acid
  Variant (64)..(64): Xaa in position 64 is any or no amino acid
  Variant (66)..(68): Xaa in position 66 to 68 is any amino acid
  Variant (71)..(73): Xaa in position 71 to 73 is any amino acid
  Variant (75)..(77): Xaa in position 75 to 77 is any amino acid
  Variant (79)..(80): Xaa in position 79 to 80 is any amino acid
  Variant (82)..(85): Xaa in position 82 to 85 is any amino acid
  Variant (87)..(87): Xaa in position 87 is any amino acid
  Variant (91)..(97): Xaa in position 91 to 97 is any amino acid
  Variant (98)..(99): Xaa in position 98 to 99 is any or no amino acid
  Variant (101)..(107): Xaa in position 101 to 107 is any amino acid
  Variant (108)..(112): Xaa in position 108 to 112 is any or no amino acid
  Variant (114)..(115): Xaa in position 114 to 115 is any amino acid
  Variant (117)..(118): Xaa in position 117 to 118 is any amino acid
  Variant (121)..(122): Xaa in position 121 to 122 is any amino acid
  Variant (124)..(124): Xaa in position 124 is any amino acid
  Variant (126)..(126): Xaa in position 126 is any amino acid
  Variant (128)..(128): Xaa in position 128 is any amino acid
  Variant (131)..(131): Xaa in position 131 is any amino acid
  Variant (134)..(135): Xaa in position 134 to 135 is any amino acid
  Variant (139)..(139): Xaa in position 139 is any amino acid
  Variant (143)..(149): Xaa in position 143 to 149 is any amino acid
  Variant (152)..(161): Xaa in position 152 to 161 is any amino acid
  Variant (162)..(167): Xaa in position 162 to 167 is any or no amino acid
  Variant (169)..(169): Xaa in position 169 is any amino acid
  Variant (171)..(179): Xaa in position 171 to 179 is any amino acid
  Variant (180)..(180): Xaa in position 180 is any or no amino acid
  Variant (182)..(182): Xaa in position 182 is any amino acid
  Variant (184)..(185): Xaa in position 184 to 185 is any amino acid
LFXXARTXNXXXXXXVXXXXLXXXXXLXXXXPTXXNXXPXRXXXXXXXXXXXXLXXXXXXGNXXKXXXAPXXXIXXXDXXFXXXXPXLFPXXXXXXXXXFXXXXXXXXXXXXAXXNXXLQXXYXIXAXRAXGLXXGPMXGFDXXXXXXXFFXXXXXXXXXXXXXXXXNXGXXXXXXXXXXRXPXXRL

SEQ ID NO: 10499 - protein, 44 aa, Artificial sequence
  protein pattern
  Variant (2)..(3): Xaa in position 2 to 3 is any amino acid
  Variant (4)..(4): Xaa in position 4 is any or no amino acid
  Variant (6)..(7): Xaa in position 6 to 7 is Ala, Gly, Ser or Thr
  Variant (8)..(8): Xaa in position 8 is Leu or Met
  Variant (10)..(10): Xaa in position 10 is Ala, Gly or Ile
  Variant (11)..(11): Xaa in position 11 is Ala or Gly
  Variant (13)..(13): Xaa in position 13 is any amino acid
  Variant (14)..(14): Xaa in position 14 is any or no amino acid
  Variant (16)..(17): Xaa in position 16 to 17 is any amino acid
  Variant (18)..(18): Xaa in position 18 is any or no amino acid
  Variant (20)..(21): Xaa in position 20 to 21 is any amino acid
  Variant (24)..(24): Xaa in position 24 is Ala or Asp
  Variant (25)..(25): Xaa in position 25 is Ala, Cys, Thr or Val
  Variant (27)..(27): Xaa in position 27 is Ala or Pro
  Variant (28)..(28): Xaa in position 28 is Leu or Met
  Variant (29)..(29): Xaa in position 29 is Ala, Gly, Ser or Thr
  Variant (31)..(31): Xaa in position 31 is Phe, Leu, Met or Val
  Variant (32)..(32): Xaa in position 32 is Asp or Asn
  Variant (33)..(33): Xaa in position 33 is any amino acid
  Variant (34)..(34): Xaa in position 34 is Ala, Asp, Glu, Gly or Gln
  Variant (35)..(35): Xaa in position 35 is any amino acid
  Variant (36)..(36): Xaa in position 36 is Ile, Leu or Val
  Variant (37)..(39): Xaa in position 37 to 39 is any amino acid
  Variant (40)..(40): Xaa in position 40 is Phe or Tyr
  Variant (41)..(41): Xaa in position 41 is Phe or Leu
  Variant (42)..(42): Xaa in position 42 is any amino acid
  Variant (43)..(43): Xaa in position 43 is Asp, Glu, Gly or Asn
  Variant (44)..(44): Xaa in position 44 is Asp, Gly, Asn, Ser or Thr
AXXXNXXXQXXYXXIXXXRXXGLXXGXXXGXXXXXXXXXXXXXX

SEQ ID NO: 10500 - protein, 37 aa, Artificial sequence
  protein pattern
  Variant (2)..(5): Xaa in position 2 to 5 is any amino acid
  Variant (8)..(8): Xaa in position 8 is Ala or Ser
  Variant (9)..(9): Xaa in position 9 is any amino acid
  Variant (11)..(12): Xaa in position 11 to 12 is any amino acid
  Variant (14)..(14): Xaa in position 14 is any amino acid
  Variant (16)..(16): Xaa in position 16 is Phe, Ile, Leu or Val
  Variant (17)..(20): Xaa in position 17 to 20 is any amino acid
  Variant (21)..(21): Xaa in position 21 is Gly, Ser or Thr
  Variant (22)..(23): Xaa in position 22 to 23 is any amino acid
  Variant (24)..(24): Xaa in position 24 is Ala, Glu, Gly or Ser
  Variant (25)..(25): Xaa in position 25 is Lys or Arg
  Variant (26)..(26): Xaa in position 26 is Ala, Asp, Glu or Gln
  Variant (27)..(27): Xaa in position 27 is Lys or Arg
  Variant (29)..(33): Xaa in position 29 to 33 is any amino acid
  Variant (34)..(34): Xaa in position 34 is any or no amino acid
  Variant (36)..(36): Xaa in position 36 is any or no amino acid
LXXXXPTXXNXXPXRXXXXXXXXXXXXLXXXXXXGXN

SEQ ID NO: 10501 - protein, 22 aa, Artificial sequence
  protein pattern
  Variant (3)..(3): Xaa in position 3 is Ala, Leu or Val
  Variant (4)..(4): Xaa in position 4 is Cys, Thr or Val
  Variant (5)..(5): Xaa in position 5 is Ala or Val
  Variant (6)..(6): Xaa in position 6 is Ile, Leu or Val
  Variant (7)..(7): Xaa in position 7 is Ala, Ile, Leu or Val
  Variant (8)..(8): Xaa in position 8 is Ala, Gly or Ser
  Variant (9)..(9): Xaa in position 9 is any amino acid
  Variant (11)..(12): Xaa in position 11 to 12 is any amino acid
  Variant (14)..(16): Xaa in position 14 to 16 is any amino acid
  Variant (17)..(19): Xaa in position 17 to 19 is any or no amino acid
  Variant (21)..(21): Xaa in position 21 is any or no amino acid
APXXXXXXXDXXFXXXXXXLXP

SEQ ID NO: 10502 - protein, 27 aa, Artificial sequence
  protein pattern
  Variant (2)..(4): Xaa in position 2 to 4 is any or no amino acid
  Variant (6)..(7): Xaa in position 6 to 7 is any amino acid
  Variant (10)..(10): Xaa in position 10 is Ser or Thr
  Variant (11)..(11): Xaa in position 11 is any amino acid
  Variant (13)..(13): Xaa in position 13 is Ala, Gly, Asn, Ser, Thr or Val
  Variant (14)..(14): Xaa in position 14 is Phe, Trp or Tyr
  Variant (15)..(18): Xaa in position 15 to 18 is any amino acid
  Variant (19)..(19): Xaa in position 19 is Ile, Leu or Val
  Variant (20)..(20): Xaa in position 20 is Ala, Asp, Gly, Pro, Ser or Thr
  Variant (21)..(23): Xaa in position 21 to 23 is any amino acid
  Variant (24)..(24): Xaa in position 24 is Ile, Leu or Val
  Variant (25)..(26): Xaa in position 25 to 26 is any amino acid
  Variant (27)..(27): Xaa in position 27 is Ala, Ile, Leu or Val
LXXXFXXARXXNXXXXXXXXXXXXXXX

SEQ ID NO: 10503 - DNA, 666 bp, Escherichia coli
  CDS (1)..(666): transl_table=11
atgttagatttgtttaaagcaattggcctggggctggtggtgttgctgccgttagctaacccattaacaactgtcgcgttatttcttggcctggcaggcaacatgaacagtgccgaacgtaatcgtcagtcgttgatggcctcggtgtacgtatttgccatcatgatggtggcgtattacgccgggcaactggtgatggatacatttggcatttcgattcccggtctgcgaattgcaggcggcttaatcgtcgcgtttatcggttttcggatgctctttccgcaacagaaagcgattgattcaccggaggcgaaaagcaagtcggaagagctggaagatgaacccagtgccaatattgcctttgtgccgctggcaatgccaagtactgccggtccgggaaccatagcgatgattattagctcggcgtccacagtgcgtcagagttcaaccttcgctgattgggtactgatggttgcgccgccgctgatctttttcctggtggcggttattttgtggggaagcctacgcagctccggcgcaattatgcggctggtgggcaagggtggcattgaagcgatctcccgtctgatgggattcctgctggtatgtatgggtgtgcagtttattattaacggcatcctggaaatcattaaaacgtaccattaa

SEQ ID NO: 10504 - protein, 221 aa, Escherichia coli
MLDLFKAIGLGLVVLLPLANPLTTVALFLGLAGNMNSAERNRQSLMASVYVFAIMMVAYYAGQLVMDTFGISIPGLRIAGGLIVAFIGFRMLFPQQKAIDSPEAKSKSEELEDEPSANIAFVPLAMPSTAGPGTIAMIISSASTVRQSSTFADWVLMVAPPLIFFLVAVILWGSLRSSGAIMRLVGKGGIEAISRLMGFLLVCMGVQFIINGILEIIKTYH

SEQ ID NO: 10505 - DNA, 684 bp, Yersinia pestis
  CDS (1)..(684): transl_table=11
atgctaagtattttcgaattatttaaagccgttggcttaggattagtattgctgctgccattggcaaatccactgacgacggtggccttattgctagggttatccggtaatatgacccgcgaggagcgtaataatcagtcgttaatggcggcaatttatgtcttctttatcatgactatcgcgttttatgccggtcagatcgtcatgagtacatttggtatctctattcccggtctgcgtatagctggtggcttaattgtcgcgtttattggttttcgtatgctctttccgcaacaatcggctgaagatactcaactggaggcaaaatcccaggatttaaaaaaacgtaaatccatcaatattgcctttgtaccgctggcaatgccgagtactgcggggccaggtacgattgcaatgatcatcagttccgctgcaacaatgaaagaccagacaatgtttgcaccatgggtattggccatcgcccccgtaatcacattcttatgcgtttcgttgattttgtggggatctttactcagctcaggagcgattatgcgctgggttggtaaaagcggtattgaagcaatttcacgtttgatgggattcttgctggtatgtatgggtgtgcaatttattattaatggcgtcttagagttgatctcaacttatcaacctgtcatggcttaa

SEQ ID NO: 10506 - protein, 227 aa, Yersinia pestis
MLSIFELFKAVGLGLVLLLPLANPLTTVALLLGLSGNMTREERNNQSLMAAIYVFFIMTIAFYAGQIVMSTFGISIPGLRIAGGLIVAFIGFRMLFPQQSAEDTQLEAKSQDLKKRKSINIAFVPLAMPSTAGPGTIAMIISSAATMKDQTMFAPWVLAIAPVITFLCVSLILWGSLLSSGAIMRWVGKSGIEAISRLMGFLLVCMGVQFIINGVLELISTYQPVMA

SEQ ID NO: 10507 - DNA, 630 bp, Mesorhizobium loti MAFF303099
  CDS (1)..(630): transl_table=11
atgccgagtttcgacagcctgttcaatgccttcgtcaccattctcgtgaccatcgatccgcccggcctggcgccgctgttcctcgccgtgacccgcggcatgaaccgcgaggagcgccagcaggtgtcggtccgcgcctcggtcatcggcttcctggtgatggcgttgttcgcggttgccggcgcctcgatcctgtcggtgttcggcatcacgctgccggcattccgggttgccggcggtttcctgctgttcttcatcgccttcgaaatggtcttcgagcggcgccaggaccgcaaggagaagatcggagacgtcgccattaccaaggacatgatccacaacatcgccgccttcccgctggcgatcccgctgatcgccggccccggtgcgatttcagcgaccgtgctgctttccggctcgtttcagggctttgccgcgcaggcagcccttgtcggcatcatcttcgtctgcctcgccatcacctacctggtgttcgtgctgtcggaacgcatcgatcgcatcctcggccagaccggccgctcgatcctgacccgcctgctcggcgtcatcttggcggcgctggccgtgcagttcgtggccgacggcatcaaggcgctgatggcggggtga

SEQ ID NO: 10508 - protein, 209 aa, Mesorhizobium loti MAFF303099
MPSFDSLFNAFVTILVTIDPPGLAPLFLAVTRGMNREERQQVSVRASVIGFLVMALFAVAGASILSVFGITLPAFRVAGGFLLFFIAFEMVFERRQDRKEKIGDVAITKDMIHNIAAFPLAIPLIAGPGAISATVLLSGSFQGFAAQAALVGIIFVCLAITYLVFVLSERIDRILGQTGRSILTRLLGVILAALAVQFVADGIKALMAG

SEQ ID NO: 10509 - DNA, 702 bp, Pseudomonas aeruginosa PAO1
  CDS (1)..(702): transl_table=11
atgagcgaatacttccatcacgtcctgatcggactgctcgccgtgcttccggtggccaacccgctgaccagcgtctcgctactgctcggcctcggcggcagcctgccgccggcggagcgcaaccggcagatattcaaggccagcctctacgtggcgctgatcatgctggtcagcttctacggcggcagcctggtgatgcaggtgttcggcatctccattcccggcctgcgcatcgccggcgggctgatcgtcgcctatatcggtttcaccatgctgttccccgccaccacgccggacgagaccgaagtccagcacgacctgctgtcggacgaggaaaagatcaccccgcacttccgcgacctgtccttcgttccgctggccctgccgggtaccgcggggccggggaccatcgccctggtggtcagctcggcgtcgacgctgcaatccacctacggaagcattccgctgttcatccacctcgcggcgatcaccgtcaccctgctcaccgcgctgatcttctggatcgccctgcaaagctccgggcgcatcatgaagttcctcggcgaatccgggatcgacgccatctcgcgagtggtcggcttcctgctggtggcgatgggcgtgcagttcgtcatcaacggcggcttcgagctggtcgccggccacgccgcgcttcagtcggcggcgggcgtcaggcagtaa

SEQ ID NO: 10510 - protein, 233 aa, Pseudomonas aeruginosa PAO1
MSEYFHHVLIGLLAVLPVANPLTSVSLLLGLGGSLPPAERNRQIFKASLYVALIMLVSFYGGSLVMQVFGISIPGLRIAGGLIVAYIGFTMLFPATTPDETEVQHDLLSDEEKITPHFRDLSFVPLALPGTAGPGTIALVVSSASTLQSTYGSIPLFIHLAAITVTLLTALIFWIALQSSGRIMKFLGESGIDAISRVVGFLLVAMGVQFVINGGFELVAGHAALQSAAGVRQ

SEQ ID NO: 10511 - DNA, 654 bp, Neisseria meningitidis MC58
  CDS (1)..(654): transl_table=11
atgggattgggcatggaaatcggcaagctgattgtggcttttttggtgctgattaatccgtttagcgcgttgtcgctttaccttgacctgaccaacgggcacagcacgaaggagcgcaggaaggtcgcgcggacggccgccgttgccgtgtttgccgtgattgcggtatttgcgctgatcggcggtacgctgctgaaggttttgggcatcagcgtcggttcgtttcaggtcggcggcgggattttggtgctgctgatcgccatttcgatgatgaacggcaacgacaatcccgccaagcagaatctcggcgcgcagccggaaacggggcaggcgcgccccgcccgcaatgccggagcgattgccgtcgtgcccatcgccataccgatcaccatcggcccgggcggtatttcgaccgtgattatttacgcttcggcggctaaaacatacggcgacatcgcgttgattatcgcggccggtttggtggtcagtgcgatttgttatgccattttaatcgttgccgggaaggtcagccgcctgctgggcgcgacggggctgacgattttaaaccgcattatgggtatgatgctggcggcggtatcggtggagattattgtgtcgggactgaaaacgatattcccgcaactggcaggttga

SEQ ID NO: 10512 - protein, 217 aa, Neisseria meningitidis MC58
MGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQARPARNAGAIAVVPIAIPITIGPGGISTVIIYASAAKTYGDIALIIAAGLVVSAICYAILIVAGKVSRLLGATGLTILNRIMGMMLAAVSVEIIVSGLKTIFPQLAG

SEQ ID NO: 10513 - DNA, 714 bp, Neisseria meningitidis Z2491
  CDS (1)..(714): transl_table=11
ttgcggcggcaatttgcagcatcggatgcctgccgcacgggtttgaaggagggggaaataatgggattgggcatggaaatcggcaagctgattgtggcttttttggtgctgattaatccgtttagcgcgttgtcgctttaccttgacctgaccaacgggcacagcacgaaggagcgcaggaaggtcgcgcggacggccgccgttgccgtgtttgccgtgattgcggtatttgcgctgatcggcggtacgctgctgaaggttttgggcatcagcgtcggttcgtttcaggtcggcggcggaattttggtgttgctgattgccatttcgatgatgaacggcaacgacaatcccgccaagcagaatctcggcgcgcagccggaaacggggcaggtgcgccccgcccgcaatgccggagcgattgccgtcgtgcccatcgccataccgatcaccatcggcccgggcggtatttcgaccgtgattatttacgcttcggcggctaaaacatacggcgacatcgcgttgattatcgcggccggtttggtggtcagtgcgatttgttatgccattttaatcgttgccgggaaggtcagccgcctgctgggtgcgacggggctgacgattttaaaccgtatcatgggtatgatgctggcggcggtatcggtggagattattgtgtcgggactgaaaatgatattcccgcaactggcaggttga

SEQ ID NO: 10514 - protein, 237 aa, Neisseria meningitidis Z2491
MRRQFAASDACRTGLKEGEIMGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQVRPARNAGAIAVVPIAIPITIGPGGISTVIIYASAAKTYGDIALIIAAGLVVSAICYAILIVAGKVSRLLGATGLTILNRIMGMMLAAVSVEIIVSGLKMIFPQLAG

SEQ ID NO: 10515 - DNA, 666 bp, Escherichia coli O157:H7 EDL933
  CDS (1)..(666): transl_table=11
  misc_feature (288)..(288): k is g or t
atgttagatttgtttaaagcaattggcctggggctggtggtgttactgccgttagctaacccattaacaactgtcgcgttatttcttggcctggcaggcaacatgaacggtgccgaacgtaatcgtcagtcgttgatggcctcggtgtacgtctttgccatcatgatggtggcgtattacgccgggcaactggtgatggatacatttggcatttcgattcccggtctgcgaattgcaggcggcttaatcgtcgcgtttatcggttttcggatgctttttccgcaacakaaagcgattgattcaccggaggcgaaaagcaagtcggaagagctggaagatgaacccagcgccaatattgcttttgtaccactggcaatgccaagtaccgccggtccgggaaccattgcgatgattattagctcggcgtccacagtgcgtcagagttcaaccttcgctgattgggtactgatggttgcgccgccgctgatctttttcctggtggcggttattttgtggggaagtctacgcagctctggcgcaattatgcggctggtgggcaagggtggcattgaagcgatctcccgcttgatggggttcctgctggtatgtatgggtgtacagtttattattaacggcatcctggaaatcattaaaacgaatcattaa

SEQ ID NO: 10516 - protein, 221 aa, Escherichia coli O157:H7 EDL933
  misc_feature (96)..(96): The Xaa at location 96 stands for Gln, or His.
MLDLFKAIGLGLVVLLPLANPLTTVALFLGLAGNMNGAERNRQSLMASVYVFAIMMVAYYAGQLVMDTFGISIPGLRIAGGLIVAFIGFRMLFPQXKAIDSPEAKSKSEELEDEPSANIAFVPLAMPSTAGPGTIAMIISSASTVRQSSTFADWVLMVAPPLIFFLVAVILWGSLRSSGAIMRLVGKGGIEAISRLMGFLLVCMGVQFIINGILEIIKTNH

SEQ ID NO: 10517 - DNA, 687 bp, Caulobacter crescentus CB15
  CDS (1)..(687): transl_table=11
atggacttcagccccctgcccacctccagcctgatcggcgcctttctgttggcgttcccggcgctgttctcgatcgtcaatccggtcggggcggcgctgatcttcgaccaggccatgggcggtcgctcgcgtcccgaacgcctgaagctggcgcgcgccatcggcttctatgccttcctggtgctactggggtctttgctgctgggcggctatatcctgaacttcttcggcgtcagcatcggcgccttgcgggtggcgggcggcctcgtcgtggcgatccgggcctggggcctcctgatggaccccgagcaaaacgaggaccgcaaggtcaaccagaccgagtcggctcagagtcatcacgacgtagccttcttcccgctgaccatgcccttcaccaccggtcccggctcgatctcggtggccatcgctctgtcatctcagcgaccgacagaaggcgacgcggtggcgccgttcttcatcggcgccagcctcgcagccgccctggtcgctgtgctggtctggctttgctacagcgcctcgggacaggtcatgcgcctgctgggcccgtcgggcgcgcgggtgctgtcgagactggtggccttcctgctgctgtgcatcggcgtgcagatcatcgcgtcgggcgtggagaacctggtggcgaagttcctgctcgcgcacccgggttaa

SEQ ID NO: 10518 - protein, 228 aa, Caulobacter crescentus CB15
MDFSPLPTSSLIGAFLLAFPALFSIVNPVGAALIFDQAMGGRSRPERLKLARAIGFYAFLVLLGSLLLGGYILNFFGVSIGALRVAGGLVVAIRAWGLLMDPEQNEDRKVNQTESAQSHHDVAFFPLTMPFTTGPGSISVAIALSSQRPTEGDAVAPFFIGASLAAALVAVLVWLCYSASGQVMRLLGPSGARVLSRLVAFLLLCIGVQIIASGVENLVAKFLLAHPG

SEQ ID NO: 10519 - DNA, 714 bp, Yersinia pestis KIM
  CDS (1)..(714): transl_table=11
ttgattgatgttatttgcggagtaggatccatgctaagtattttcgaattatttaaagccgttggcttaggattagtattgctgctgccattggcaaatccactgacgacggtggccttattgctagggttatccggtaatatgacccgcgaggagcgtaataatcagtcgttaatggcggcaatttatgtcttctttatcatgactatcgcgttttatgccggtcagatcgtcatgagtacatttggtatctctattcccggtctgcgtatagctggtggcttaattgtcgcgtttattggttttcgtatgctctttccgcaacaatcggctgaagatactcaactggaggcaaaatcccaggatttaaaaaaacgtaaatccatcaatattgcctttgtaccgctggcaatgccgagtactgcggggccaggtacgattgcaatgatcatcagttccgctgcaacaatgaaagaccagacaatgtttgcaccatgggtattggccatcgcccccgtaatcacattcttatgcgtttcgttgattttgtggggatctttactcagctcaggagcgattatgcgctgggttggtaaaagcggtattgaagcaatttcacgtttgatgggattcttgctggtatgtatgggtgtgcaatttattattaatggcgtcttagagttgatctcaacttatcaacctgtcatggcttaa

SEQ ID NO: 10520 - protein, 237 aa, Yersinia pestis KIM
MIDVICGVGSMLSIFELFKAVGLGLVLLLPLANPLTTVALLLGLSGNMTREERNNQSLMAAIYVFFIMTIAFYAGQIVMSTFGISIPGLRIAGGLIVAFIGFRMLFPQQSAEDTQLEAKSQDLKKRKSINIAFVPLAMPSTAGPGTIAMIISSAATMKDQTMFAPWVLAIAPVITFLCVSLILWGSLLSSGAIMRWVGKSGIEAISRLMGFLLVCMGVQFIINGVLELISTYQPVMA

SEQ ID NO: 10521 - DNA, 633 bp, Shewanella oneidensis MR-1
  CDS (1)..(633): transl_table=11
ttggagttaactctttacgttaaattttttcttggcctcgttgccattatcaaccccattggtctgctgccagtgtttgtgagcttaactagccatcaaaccgaagctgagcgcaaccacacaggtaaagtggcgaactttgcggtggtggtgatcctgctggtgacaatcgtggcgggacaacatattttgaatatgtttagtatttcactctcggcctttagaattgcggggggcacgctgatcgcgattattgcgatgtcgatgttgcagggtaaattgggtgaagtaaaacgcaaccaagaggaagatcgtgaatcctcagccatggagtcggtggccgtggtgccgttggcactgccattaatggcaggccctggggctatcagctctgtgatcgtgtttgctgctgagcataattcgttatccaattttattgcgatgtttattaccgtgattatttttggattggtgagttttggcctgtttagaatggcgtccattatctataaaattttgggtaaaacagggattaacgttattactcgtctaatggggctattaatgctctcgattggtatcgaagtcattgccgctggtatcaaagggctattcccacaactttttagctaa

SEQ ID NO: 10522 - protein, 210 aa, Shewanella oneidensis MR-1
MELTLYVKFFLGLVAIINPIGLLPVFVSLTSHQTEAERNHTGKVANFAVVVILLVTIVAGQHILNMFSISLSAFRIAGGTLIAIIAMSMLQGKLGEVKRNQEEDRESSAMESVAVVPLALPLMAGPGAISSVIVFAAEHNSLSNFIAMFITVIIFGLVSFGLFRMASIIYKILGKTGINVITRLMGLLMLSIGIEVIAAGIKGLFPQLFS

SEQ ID NO: 10523 - DNA, 639 bp, Vibrio vulnificus CMCP6
  CDS (1)..(639): transl_table=11
atgcaaacgttcgaagtcgctatctttttgcagtttttcttaggcttagtggccgcagtaaaccctgtgggcatcatgccagtatttgtgtcgcttacaggccacatgacaccggaagaaaaatacaaaaccgcacttaccgccaatgtggcggtggcgattattctgaccgtttcattgctagccggtcagatgctactcgacatgtttagtatttctctcgactccttccgcgttgccggtggtttactactacttagcatcgccttttcgatgatgagcggtaagttgggtgaagataaacaaaacaaacaagagcagtcggaatacgtgagtcgcgaacaaattggtgttgtgcctttggcaatgcctttaatggcaggccctggtgcgattagctcgaccatcgtttatggctctcgctacccaagtatgttcgataccatgggtattgtgatcactatagttgcctttagcttttgctcatggctgctatttcgctcagcgccaattatcgttcgctttttagggcaaacaggcatcaacgtgatcacccgtattatgggtcttatcttgggtgcactcggcatcgagttcatcgccaatggcctgcgtaatctcttccccggattagcctga

SEQ ID NO: 10524 - protein, 212 aa, Vibrio vulnificus CMCP6
MQTFEVAIFLQFFLGLVAAVNPVGIMPVFVSLTGHMTPEEKYKTALTANVAVAIILTVSLLAGQMLLDMFSISLDSFRVAGGLLLLSIAFSMMSGKLGEDKQNKQEQSEYVSREQIGVVPLAMPLMAGPGAISSTIVYGSRYPSMFDTMGIVITIVAFSFCSWLLFRSAPIIVRFLGQTGINVITRIMGLILGALGIEFIANGLRNLFPGLA

SEQ ID NO: 10525 - DNA, 639 bp, Vibrio parahaemolyticus RIMD 2210633
  CDS (1)..(639): transl_table=11
atgcagactttagagctagccattttcctgcagtttttcttggggttggttgccgccgttaaccctgtaggcatcatgcctgttttcgtgtctttaagcggacatatgacaccagaagaaaagatcaaaaccgcgacaacagccaatgtggcagtggccgtgatcctgatcatttccctgcttgcaggtcagttactgttggatatgttcagtatttcactggattcattccgagtggcaggtggcttgctgctgttaagcatcgccttttcgatgatgagcggtaagctcggtgaggataagcagaacaaacaagaaaaatctgaatacgttagccgcgaacagatcggcgttgtaccactagcgatgccactaatggctggtcctggtgcaatcagctcaacaatcgtttatggcgcgcgttacccaagtatgttcgataccgtgggcatcgttatcacgattggtctgttttgcctttgttcttggttgctatttcgttcggcacctttgatcgttcgtttcttgggtcaaacaggcatcaacgtgatcacacgtatcatgggtttgattcttggtgcgctaggcatcgagtttattgcaaacggcttacgtaacttgttccctggattagcctga

SEQ ID NO: 10526 - protein, 212 aa, Vibrio parahaemolyticus RIMD 2210633
MQTLELAIFLQFFLGLVAAVNPVGIMPVFVSLSGHMTPEEKIKTATTANVAVAVILIISLLAGQLLLDMFSISLDSFRVAGGLLLLSIAFSMMSGKLGEDKQNKQEKSEYVSREQIGVVPLAMPLMAGPGAISSTIVYGARYPSMFDTVGIVITIGLFCLCSWLLFRSAPLIVRFLGQTGINVITRIMGLILGALGIEFIANGLRNLFPGLA

SEQ ID NO: 10527 - DNA, 675 bp, Wigglesworthia glossinidia endosymbiont of Glossina brevipalpis
  CDS (1)..(675): transl_table=11
gtgtttatgtttgaattatttaaagcggttggtttaggtttaatggtgcttctgccgttagtaaatccattgacaacagtagctttgtttttaagcttaagcaaaaatatgacatcagatgaaagaaaccaacaagcaagaatggcatcaatatatgttttttctattatgatggttactttttacgctggaacagttgtgatgagtactttcggaatttctataccaggcttaagaattgctggcggtttaattgtatcctttataggatttagaatgttattttctatatcttcagaagaagagcctaattttaaaaagggacaaattataaaaaattttaaaaataaaacagcaaatattgcttttattccattagcaatgccaagtacagctggccctggaacaattgctatgatcataagttgggtttctactgtaaatgaagatgtttatttttcttcttggattacagacctagccccgattttagtatttttaaccattagcataatagtttggattgctttgcgtagttcaagtgctattatgcatgtaataggttctagcggaattgaagctatttctagacttatgggtttcttgttggtttgcatgggagttcaatttgttattaatggagtgatagaagtaatttcagattatggtgtttaa

SEQ ID NO: 10528 - protein, 224 aa, Wigglesworthia glossinidia endosymbiont of Glossina brevipalpis
MFMFELFKAVGLGLMVLLPLVNPLTTVALFLSLSKNMTSDERNQQARMASIYVFSIMMVTFYAGTVVMSTFGISIPGLRIAGGLIVSFIGFRMLFSISSEEEPNFKKGQIIKNFKNKTANIAFIPLAMPSTAGPGTIAMIISWVSTVNEDVYFSSWITDLAPILVFLTISIIVWIALRSSSAIMHVIGSSGIEAISRLMGFLLVCMGVQFVINGVIEVISDYGV

SEQ ID NO: 10529 - DNA, 702 bp, Bordetella parapertussis 12822
  CDS (1)..(702): transl_table=11
gtgatcatcgaatacctgcaactggtcggcctcggcctggtcaccatgctgcccgtggccaacccgctgaccagcaccacgctgctgctggcgctgggcagcggcttcacgcgcgacgagcgcaaccgccagatcggccgcgccaccgtatatgtggccgccatcatcctggcctcgttctatgccggcaacgccatcatcagcagcttcggcatttccattcccggcctgcgcatcgccggcggactgatcgtcgcctacatcggcttcaccatgctgttcccggccacctcgcagaacgaggcgcaggcgcaagtcgagatggcgccggacgacccgcacatccaggtcccgggcgccgcgcacaccggcccgcgcccgcgcgacatctcgttcgtgccgctggcgctgccgggcaccgccggccccggcacgatcgccctgatcatcagctccgcctcgaccctgcacagccatggcggcatcaccctcatccaccatttcgccgtcatcaccgtcacgctcctgctggcgctgctgttctgggcctgcctgcgcagcgccgagcgggtcatgcgcatgctgggccagtccggcatcgacgccatctcgcgcgtcatgggctttctgctcatctgcatgggcgtgcaattcatcatcgacggcgtgttcgagctgatccgccatccgcccggcgcctga

SEQ ID NO: 10530 - protein, 233 aa, Bordetella parapertussis 12822
MIIEYLQLVGLGLVTMLPVANPLTSTTLLLALGSGFTRDERNRQIGRATVYVAAIILASFYAGNAIISSFGISIPGLRIAGGLIVAYIGFTMLFPATSQNEAQAQVEMAPDDPHIQVPGAAHTGPRPRDISFVPLALPGTAGPGTIALIISSASTLHSHGGITLIHHFAVITVTLLLALLFWACLRSAERVMRMLGQSGIDAISRVMGFLLICMGVQFIIDGVFELIRHPPGA

SEQ ID NO: 10531 - DNA, 648 bp, Chromobacterium violaceum ATCC 12472
  CDS (1)..(648): transl_table=11
atgttcaaaaccctgtcgctgcaattcctgttcggcggtctgctcagcctgatcaccatcaccaatccgctgtccaagattccgctgttcatcacgctgacccgcgaaatgagcgactcgcaccgcgactcacaagcccgccgcgcctgcgtgttcgcagccgccatcatggcggtgagcctgctggccggcaacctgatcatggccgccttcggcatttcctacggcgcgctgcgcatcgccggcggcttcgtggtggcggtgctgggctaccgcatgctgttcctgtcgcaggatccgggccaggcgcccagacagtcgggcgaacgcgaggactacgccttcttcccgctggcgatgcccggcatcagcggtccgggcaccatcgcggtggtgatcggcatctccaccgagatcgcggagctctccacgctgccggccaaggcgctggccttcgcgatgaccttcgccgccatcggcctgacctgcgtcggcatgtggctgacgctgaagtcgtcgctgctgatctcggagcggctgggccgcggcggccgcgaggtgatgacccggctgatgggcttcttgctgatctgcatcggcgtgcagttcgtcggctccggcatccgcaccttcatggccggctcttga

SEQ ID NO: 10532 - protein, 215 aa, Chromobacterium violaceum ATCC 12472
MFKTLSLQFLFGGLLSLITITNPLSKIPLFITLTREMSDSHRDSQARRACVFAAAIMAVSLLAGNLIMAAFGISYGALRIAGGFVVAVLGYRMLFLSQDPGQAPRQSGEREDYAFFPLAMPGISGPGTIAVVIGISTEIAELSTLPAKALAFAMTFAAIGLTCVGMWLTLKSSLLISERLGRGGREVMTRLMGFLLICIGVQFVGSGIRTFMAGS

SEQ ID NO: 10533 - DNA, 708 bp, Vibrio vulnificus YJ016
  CDS (1)..(708): transl_table=11
gtgaagtcgcgcaatatcgactatatttcgccaacaatctgttctcctatctttcgtgtggtttctctaatgcaaacgttcgaagtcgctatctttttgcagtttttcttaggcttagtggccgcagtaaaccctgtgggcatcatgccggtatttgtgtcgcttacaggccacatgacaccggaagaaaaatacaaaaccgcacttaccgccaatgtggcggtggcgattattctgaccgtttcattgctagctggtcagatgctactcgacatgtttagtatttctctcgactccttccgcgttgccggtggtttactactacttagcatcgccttttcgatgatgagcggtaagttgggtgaagataaacaaaacaaacaagagcagtcggaatacgtgagtcgcgaacaaattggtgttgtgcctttggcaatgcctttgatggcgggtcctggtgcgattagttcgaccatcgtttatggttctcgctacccaagcatgttcgataccatgggtattgtgatcaccattgttgcctttagcttttgctcatggctgctattccgctcagcgccaattatcgttcgctttttaggacaaaccggcatcaacgtgatcacccgtattatgggtctgatcttgggcgcactcggcatcgaatttatcgccaatggtctacgtaatctcttccccggattagcctga

SEQ ID NO: 10534 - protein, 235 aa, Vibrio vulnificus YJ016
MKSRNIDYISPTICSPIFRVVSLMQTFEVAIFLQFFLGLVAAVNPVGIMPVFVSLTGHMTPEEKYKTALTANVAVAIILTVSLLAGQMLLDMFSISLDSFRVAGGLLLLSIAFSMMSGKLGEDKQNKQEQSEYVSREQIGVVPLAMPLMAGPGAISSTIVYGSRYPSMFDTMGIVITIVAFSFCSWLLFRSAPIIVRFLGQTGINVITRIMGLILGALGIEFIANGLRNLFPGLA

SEQ ID NO: 10535 - DNA, 675 bp, Burkholderia vietnamiensis G4
  CDS (1)..(675): transl_table=11
atgatcgtcaaccgtcttgtttccgagatcctgttcggcttcaccggcctgatcggcatcatcaatccgatcggcatcgccttcctgttcctcgagcgtaccgaggcgctgaccgaacacgagcgcaacctgctcgcgcagaaggtggcgttcaacgcgttcatcgtgctgctggtcgcgttcttcgccggcacgccggtgctgcatttcttcgggatctcgatggaagcgctgcgcatcgggggcggcttcgcggtcgccgtcgccggctggcagatgctcaacgagccggacggcccggccggcggcggcgacacgccgatcaagccgatcgatgcgagcgcaatcatgacgcgcgcattcttcccgctcaccgtgccgctgaccgtcggtcccggttcgatcgccaccgcgatcgcgctgaacgcgaaccgcacgcacaagctgtctgaattcatgctgtcgagcatcgtgtcgatcacggtgtccgtgctggttgcggtcgtgatctggctgacctacagccgcgccgcgctgctcgcgcgctatctcggcaccgaaggcaccaaggtcgcgaagcgcgtgtcggcgtttctgctgctgtgcatcggcgtgcagatcatgctgaccggcttctccgagttcctccagccgctcgccgaccagatcaagtaa

SEQ ID NO: 10536 - protein, 224 aa, Burkholderia vietnamiensis G4
MIVNRLVSEILFGFTGLIGIINPIGIAFLFLERTEALTEHERNLLAQKVAFNAFIVLLVAFFAGTPVLHFFGISMEALRIGGGFAVAVAGWQMLNEPDGPAGGGDTPIKPIDASAIMTRAFFPLTVPLTVGPGSIATAIALNANRTHKLSEFMLSSIVSITVSVLVAVVIWLTYSRAALLARYLGTEGTKVAKRVSAFLLLCIGVQIMLTGFSEFLQPLADQIK

SEQ ID NO: 10537 - DNA, 621 bp, Burkholderia vietnamiensis G4
  CDS (1)..(621): transl_table=11
atggatctgctcaaatcgttcatttcgctgcttgcgctgatcaatccggtcggcgcggtgccgttcttcctgagcctgaccgcgcagcagacggagcacgagcggcgccgcacgatccggatcgcgtcggtgtcggtgttctgcgtgatgacgatcacgacgctgctcggccagcagatcatcgatttcttcggcatttcggtcggctcgctcgaagtggggggcgggatcatcatgctgctgatggcgatcaacatgctgaacgcgcagatcggcaatacgcgatcgacgcccgaggaacgcgacgaggccgagctgaaggacaacatcgcggtcgtgccgctggcgattccgctgctgacgggccccggctcgatcagcacggcgatcatctatgcggcgaactcgcatcactggtatgaacgggcggggctcgtcgcgatcggcgcggtcctcgctctgctgtgtttcctcgcgatgcggcttgccgagccgatcgcgaactggatcggccgcaccggcatcaacatcgccacgcggctgatgggtctgatgctgtcggcgctggcggtggaattcatcgtcaatggactgagggcactactgcctgcactgagatga

SEQ ID NO: 10538 - protein, 206 aa, Burkholderia vietnamiensis G4
MDLLKSFISLLALINPVGAVPFFLSLTAQQTEHERRRTIRIASVSVFCVMTITTLLGQQIIDFFGISVGSLEVGGGIIMLLMAINMLNAQIGNTRSTPEERDEAELKDNIAVVPLAIPLLTGPGSISTAIIYAANSHHWYERAGLVAIGAVLALLCFLAMRLAEPIANWIGRTGINIATRLMGLMLSALAVEFIVNGLRALLPALR

SEQ ID NO: 10539 - DNA, 669 bp, Klebsiella pneumoniae subsp. pneumoniae MGH 78578
  CDS (1)..(669): transl_table=11
atgttcgatttgtttaaagcaatagggctcggcctggcggtgcttttaccgctggcgaatccactcacaaccgtggcgctgttccttggcctggccggtaatatgaacaacgccgagcgtaataaacaggcgttaatggcatcggtgtatgtcttcgccatcctgatggtgtcgtggtatgccggtcaggtggtgatgaatacattcggcatatcaatacctgggctgcgtatcgccggcggattgattgtggcctttatcggtttccgcatgctgtttccccagcaaaaagcccacgattcgatggaagcgaagatcaaatcggaagaactgcaggatgaaccgaccgccaatatcgcctttgtgccgctggcgatgccaagcaccgccggtccgggcaccatcgcgatgattattagctccgcctcgaccgttaagcacggcgtggacttcccggagtgggtggtgctggcggcgccgccgatcatctttttgctgttaggggtgattctgtgggcttgtctgcgcagttccggcgcgattatgcgtctggttggcaaaggcggcatcgaggccatctcgcgactgatgggctttctgctggtctgcatgggcgtgcagtttattattaacggcgtgctggagatcatttcgacctggcatccctga

SEQ ID NO: 10540 - protein, 222 aa, Klebsiella pneumoniae subsp. pneumoniae MGH 78578
MFDLFKAIGLGLAVLLPLANPLTTVALFLGLAGNMNNAERNKQALMASVYVFAILMVSWYAGQVVMNTFGISIPGLRIAGGLIVAFIGFRMLFPQQKAHDSMEAKIKSEELQDEPTANIAFVPLAMPSTAGPGTIAMIISSASTVKHGVDFPEWVVLAAPPIIFLLLGVILWACLRSSGAIMRLVGKGGIEAISRLMGFLLVCMGVQFIINGVLEIISTWHP

SEQ ID NO: 10541 - DNA, 648 bp, Klebsiella pneumoniae subsp. pneumoniae MGH 78578
  CDS (1)..(648): transl_table=11
gtgactcaatcactgttcgatttttctgcatatttcaagtttttcatcggcttatttgccctggttaacccggttggcattattccggtattcatcagtatgaccagctatcagccggctgcggtgcgtaataagaccaacctcaccgccaacctgtcggtggcgatcatcctcctgacgtcgctgttcctcggcgatggcattctgcagattttcggtatctccattgactccttccgtatcgccggcggcatcctggtggtgaccatcgcgatgtcgatgatcagcggtaagctcggcgaagataagcagaacaagcaggaaaagtcggagacggcggtccgggagagcatcggcgtcgttcctctcgcgctaccattaatggccgggccaggggcaatcagttcaactatcgtctgggggacccggtaccactcctgggtgcatctggtcgggttctcactggcgatagcggtatttgccctctgctgctgggggattttccgtatggcgccgtggctggtccgtttgctggggcagacgggaatcaacgtcatcacccgtattatgggcctgttgctgatggctctcggcattgagtttattgtgaccgggattaaagcgcttttcccagggctgctgagttag

SEQ ID NO: 10542 - protein, 215 aa, Klebsiella pneumoniae subsp. pneumoniae MGH 78578
MTQSLFDFSAYFKFFIGLFALVNPVGIIPVFISMTSYQPAAVRNKTNLTANLSVAIILLTSLFLGDGILQIFGISIDSFRIAGGILVVTIAMSMISGKLGEDKQNKQEKSETAVRESIGVVPLALPLMAGPGAISSTIVWGTRYHSWVHLVGFSLAIAVFALCCWGIFRMAPWLVRLLGQTGINVITRIMGLLLMALGIEFIVTGIKALFPGLLS

SEQ ID NO: 10543 - DNA, 684 bp, Xanthobacter autotrophicus Py2
  CDS (1)..(684): transl_table=11
atgcgcgtgggctatttcagcaattccatcaatatcttcctcgccgtcttcgctgccctctttcccatcgtgaacccgcttggcggggcaccgatcttcctcaatttcgtgcgcggctgctccgcgtcgacccgggaactgctggcccgctccgtcgccgtctacggcttcctgatgcttctgggctcgctgatcatcggcgcgcaggtgctcctgttcttcggcatcaccttgccggtgctgcgggtggccggcggcgtggtggtgacctccgtgggctggaacctgctgcaccagggcgacgagccggccaagcgcgccgacggcacgccgctggatgatgcccacgccaaggaccaggccttctatcccctgaccctgccgctcacggtggggcccggctccatcgccaccaccatcgcgctggccgccagccacaggtccaccttcgacaccgatctggccatgtccgtgtcgtccctcatcggggcggtggcgggactgatcggggtggcgctcaccgtctatttcgccttccgggaggcgcccaccatcgagcgcgtgctgggcaagaacggcaccaacgtgctggtgcggctgttcgccttcatcctgttcgccatcggcgtgcagatcatctggctcggtgcccgtgacctgctgggcgagattccggggcgctga

SEQ ID NO: 10544 - protein, 227 aa, Xanthobacter autotrophicus Py2
MRVGYFSNSINIFLAVFAALFPIVNPLGGAPIFLNFVRGCSASTRELLARSVAVYGFLMLLGSLIIGAQVLLFFGITLPVLRVAGGVVVTSVGWNLLHQGDEPAKRADGTPLDDAHAKDQAFYPLTLPLTVGPGSIATTIALAASHRSTFDTDLAMSVSSLIGAVAGLIGVALTVYFAFREAPTIERVLGKNGTNVLVRLFAFILFAIGVQIIWLGARDLLGEIPGR

SEQ ID NO: 10545 - DNA, 666 bp, Salmonella enterica subsp. arizonae serovar 62:z4,z23:--
  CDS (1)..(666): transl_table=11
atgatggatttgtttaaagcgattggattggggctggttgtactgctccctttagccaatccgctaaccaccgtggcgctgtttcttggccttgcgggcaacatgaatagcacggaacgtaaccggcagtcatatatggcttcggtctatgtcttcgccattatgatggtggcgtactacgccgggcagttagtcatgaacaccttcggtatttccattccagggctacggatcgccgggggattaatcgtggcgtttatcggctgcagaatgcttttcccgcagcagaaagcgcatgagtcgccggaagcgaaaagcaaatcggaggagctggcggacgaaccgacggccaatattgcgtttgttccgctggcaatgccaagcaccgcgggaccggggaccatcgcaatgattatcagttctgcctccacggtgcgtcatggcggcgagtttcccgactgggtcattacggtcgcgccgccgattattttccttgccgtggcggtgatcctttgggggtgcttacgcagttccggtgctatcatgcggctggtgggaaaaggggggattgaagcaatttcccgcttaatgggattcctgctggtgtgtatgggcgtacaatttattatcaacggcgtgttggaaattattaaaacgtaccactaa

SEQ ID NO: 10546 - protein, 221 aa, Salmonella enterica subsp. arizonae serovar 62:z4,z23:--
MMDLFKAIGLGLVVLLPLANPLTTVALFLGLAGNMNSTERNRQSYMASVYVFAIMMVAYYAGQLVMNTFGISIPGLRIAGGLIVAFIGCRMLFPQQKAHESPEAKSKSEELADEPTANIAFVPLAMPSTAGPGTIAMIISSASTVRHGGEFPDWVITVAPPIIFLAVAVILWGCLRSSGAIMRLVGKGGIEAISRLMGFLLVCMGVQFIINGVLEIIKTYH

SEQ ID NO: 10547 - DNA, 675 bp, Pectobacterium atrosepticum SCRI1043
  CDS (1)..(675): transl_table=11
atgctggaattgattcaaaccattggccttggtctggtgttaatcctgccactcgcgaatccactgacaacggtagcggtattcttggcgatgtcaggcaacatgagtcaaggggagcgaaatcgccagatctttcaggcctcgatctatgtcttcatcatcatgaccgtcgcgtactacgcgggccaaatcgttatgaatactttcgggatttctattcccggattgcgtattgccggtgggctcattgtggcattcatcggttttcgcatgcttttcccccagcaaaagccagaacacgcacctgaagtcaaaagtaaaaaagaagaaattgacgacagtttctccgccaatgaagtcaatattgccttcgttccactggcgatgcccagcaccgcggggccaggaaccattgccctcatcatcagttctgcatcacaaatcaagagcggcgtcgacatcacgccatgggttgttaccgttgcccccgtactcacttttatgttaatcagcctgatagtctggctcagtctgaaaagttctggcctgattatgcgtctgatcggaaaaagcggtattgaagccatttcacggctgatgggttttttgctggtttgcatgggtgtgcagttcatcattaacggcacactggagatcgtgcattctctccattaa

SEQ ID NO: 10548 - protein, 224 aa, Pectobacterium atrosepticum SCRI1043
MLELIQTIGLGLVLILPLANPLTTVAVFLAMSGNMSQGERNRQIFQASIYVFIIMTVAYYAGQIVMNTFGISIPGLRIAGGLIVAFIGFRMLFPQQKPEHAPEVKSKKEEIDDSFSANEVNIAFVPLAMPSTAGPGTIALIISSASQIKSGVDITPWVVTVAPVLTFMLISLIVWLSLKSSGLIMRLIGKSGIEAISRLMGFLLVCMGVQFIINGTLEIVHSLH

SEQ ID NO: 10549 - DNA, 654 bp, Neisseria gonorrhoeae FA 1090
  CDS (1)..(654): transl_table=11
atgggattgggtatggaaatcggcaagctgattgtggcttttttggtgctgatcaatccgtttagcgcgttgtcgctttaccttgacctgaccaacggacacagcacgaaggagcgcaggaaggtcgcgcggacggccgccgtcgccgtgtttgccgtgattgcggtatttgcgctgatcggcggtgcgctattgaaggttttgggcatcagcgtcggttcgtttcaggtcggcggcgggattttggtgctgctgatcgccatttcgatgatgaacggcaacgacaatcccgccaagcagaatctcggcgcgcagccggaaacggggcaagcgcgccccgcccgcaatgcaggggcgattgccgtcgtgcccatcgccataccgatcaccatcggtccgggcggtatttcgactgtgattatttatgcttcggcagccaaaacgtacagcgatatcgcgctgattatcgcggccggtttggtggtcagtgcgatttgttatgccattttaatcgttgccgggaaggtcagccgcctgctgggcgcgacggggctgacgattttaaaccgcattatgggtatgatgctggcggcggtatcggtggagattattgtgtcgggactgaaaacgatattcccgcaactggcaggttga

SEQ ID NO: 10550 - protein, 217 aa, Neisseria gonorrhoeae FA 1090
MGLGMEIGKLIVAFLVLINPFSALSLYLDLTNGHSTKERRKVARTAAVAVFAVIAVFALIGGALLKVLGISVGSFQVGGGILVLLIAISMMNGNDNPAKQNLGAQPETGQARPARNAGAIAVVPIAIPITIGPGGISTVIIYASAAKTYSDIALIIAAGLVVSAICYAILIVAGKVSRLLGATGLTILNRIMGMMLAAVSVEIIVSGLKTIFPQLAG

SEQ ID NO: 10551 - DNA, 621 bp, Burkholderia sp. 383
  CDS (1)..(621): transl_table=11
atggatctgctcaaatcgttcatttcgctgctggcgctgatcaacccggtcggtgcggtgccgttcttcctgagcctgacggcgcagcagacggatgccgagcggcggcgcacgatccggatcgcgtcggtgtcggtgttctgcgtgatcacggtgacgacgctgctcgggcagcagatcatcaacttcttcggcatttcggtcgggtcgctcgaagtgggcggcgggatcatcatgctgctgatggcgatcaacatgctgaacgcacagatcggcaacacgcgatcgacgccggaggagcgccacgaggccgagctgaaggacaacatcgcggtcgtgccgctggcgattccgctgctcacgggccccggctcgatcagcacggtgatcatctatgcggcgaactcgcatcactggtatgagcgggccgggctggtcgcgatcggcgcggtcctggcttttctgtgtttcgtcgcgatgcggctcgccgagccgatcgcgaactggatcggccgcacgggcatcaacatcgccacgcggctgatgggtctgatgctgtcggcgctggcggtggaattcatcgtcaatggactgagggcgctactgcctgcactgagatga

SEQ ID NO: 10552 - protein, 206 aa, Burkholderia sp. 383
MDLLKSFISLLALINPVGAVPFFLSLTAQQTDAERRRTIRIASVSVFCVITVTTLLGQQIINFFGISVGSLEVGGGIIMLLMAINMLNAQIGNTRSTPEERHEAELKDNIAVVPLAIPLLTGPGSISTVIIYAANSHHWYERAGLVAIGAVLAFLCFVAMRLAEPIANWIGRTGINIATRLMGLMLSALAVEFIVNGLRALLPALR

SEQ ID NO: 10553 - DNA, 672 bp, Burkholderia sp. 383
  CDS (1)..(672): transl_table=11
atgatcgtcaaccgccttatctccgagatcctgttcggcttcaccggcctgatcggcatcatcaacccgatcggcatcgcgttcctgtttctcgaacggaccgaggcgctgaccgagcaagaacgcgatctgctcgcgaggaaggtcgcgttcaacgcgttcatcgtgctgatggtcgcgttcttcgccggcacgccggtgctgcacttcttcgggatttcgatggaagcgctgcggatcggcggcggcttcgcggtcgccgtcgcgggctggcagatgctgaacgaacccgacggcccgggcggcggcgacacgccggtcaagccgatcgacgcgaacgcgatcatgacgcgcgcgttcttcccgttgaccatgccgctgacggtcggcccgggctcgatcgcgaccgcgatcgcgctgaacgcgaaccgcacgcacaagctgtcggaattcatgctgtcgagcatcgtgtcgatcgccgtctccgtgctggtggcgatcgtgatctggcaggtctacagccgctccgcgctgctgtcgcgctacctcggcagcgaaggcaccaaggtcgcgaagcgcgtgtcggcattcctgctgctgtgcatcggcgtgcagatcatgctgaccggcttttccgcgttcctgcagccgatcgccgaccaggccaagtaa

SEQ ID NO: 10554 - protein, 223 aa, Burkholderia sp. 383
MIVNRLISEILFGFTGLIGIINPIGIAFLFLERTEALTEQERDLLARKVAFNAFIVLMVAFFAGTPVLHFFGISMEALRIGGGFAVAVAGWQMLNEPDGPGGGDTPVKPIDANAIMTRAFFPLTMPLTVGPGSIATAIALNANRTHKLSEFMLSSIVSIAVSVLVAIVIWQVYSRSALLSRYLGSEGTKVAKRVSAFLLLCIGVQIMLTGFSAFLQPIADQAK

SEQ ID NO: 10555 - DNA, 654 bp, Rhodospirillum rubrum ATCC 11170
  CDS (1)..(654): transl_table=11
atggattatttcggccttgccgcgaaatacattcccttcgtcacgctcggattgctgccgatcatgaatccgctaagcaccgtgccgctgtttctggaattgaccaagcgcatgtcgcccgagcgcaagcaccagcaggcgcgccgggcctgtctttacgccctgtcgattctcgccgtgttcttgttcatcggcaacggcatcatcacgctgtttggcatctcgctggccggcatccgggtggccggcgggctgatcattctggtgctggccttccgcatgctgttctcgggcgaaggcgaagaagcctcgatcgaaacggaagccaccgagatcaagcgcgccaacctcgatttctcgttctctccgttggccatgcccagcctcgccggcccgggatcgatcgccgtggtcatgagctacggctcgcagatccccgatgacgccctggtctttggccatttcatcgtcatctgcggcatctcgatcaccgtgctcatcgcctatatcgcccttgccggctcggcctggatcgccaaattcctcggcgagcacggcattcaggcggtcaccaagatcatgggctttctgctgacctgcatcgccgtccagttcatcgcctcgggcatccgcgatttctcgcaaaccctgtag

SEQ ID NO: 10556 - protein, 217 aa, Rhodospirillum rubrum ATCC 11170
MDYFGLAAKYIPFVTLGLLPIMNPLSTVPLFLELTKRMSPERKHQQARRACLYALSILAVFLFIGNGIITLFGISLAGIRVAGGLIILVLAFRMLFSGEGEEASIETEATEIKRANLDFSFSPLAMPSLAGPGSIAVVMSYGSQIPDDALVFGHFIVICGISITVLIAYIALAGSAWIAKFLGEHGIQAVTKIMGFLLTCIAVQFIASGIRDFSQTL

SEQ ID NO: 10557 - DNA, 660 bp, Methylobacillus flagellatus KT
  CDS (1)..(660): transl_table=11
atgagcatactggaagccctcaaatacatttccatcgtcgtgatcggcctcctgcccatcatgaaccccttgaccacgatcccgctctacatggcgctgacgcaacgcatgacgccggaaacgcgcaagctgcaggcacgcaaggcctgcatctatgcgttcttcatactcacgaccttcctgctgctgggcaatggcatcattgcgctgttcggcatctcgatggccggcatccgggtggcgggcggcctcatcatcctcatcctggcattgcgcatgatcttctccgggctggattcatcctccagcgtggactccgaacccgaggaaatcaagagtgccaacctggattactcattctcgccgctggcgatgcccagcctggccgggccaggctcgatcgccgtcgtcatgagtttcggctcgcagattccggaaggctcccacctcatcggtgaccccatcgtcatcgccgggatcgccatcaccatcggcatcgcctacttggcgctgtcatcggccacccatatcgagaaaatgctcggcgagcacggcatgcaggcagtgaccaaaatcatggggttcctgctcacctgcgtggcagtgcagttcctggcttccggcatccgcgatttctatatcgagttttccaccatataa

SEQ ID NO: 10558 - protein, 219 aa, Methylobacillus flagellatus KT
MSILEALKYISIVVIGLLPIMNPLTTIPLYMALTQRMTPETRKLQARKACIYAFFILTTFLLLGNGIIALFGISMAGIRVAGGLIILILALRMIFSGLDSSSSVDSEPEEIKSANLDYSFSPLAMPSLAGPGSIAVVMSFGSQIPEGSHLIGDPIVIAGIAITIGIAYLALSSATHIEKMLGEHGMQAVTKIMGFLLTCVAVQFLASGIRDFYIEFSTI

SEQ ID NO: 10559 - DNA, 621 bp, Burkholderia xenovorans LB400
  CDS (1)..(621): transl_table=11
atggacattctgaagtcgtttatttcgctgctggcgttgatcaacccggtcggcgccatcccgttcttcatgagcctgacagcgcatcagagcgacgccgagcggcgtagaaccatccggatcgcggccatttcggtgttctgcgtgattgcggtgaccacgctgctcgggcagcagatcatcgccttcttcggcatttcggtcggctcgctcgaagtgggcggcgggatcatcatgctgctgatggcgatcaacatgctgaacgcgcagatcggcaacagccgttccacgccggaagagcgccacgaagcggagcagaaggacaacatcgcggtcgtgccgctggcgattccgttgttgaccggtccgggcgcgatcagtactacgatcatctatgcggccggctcggcgcattggtacgaccggatcagcctcgtcgcgatcggcgcggtattggcggcgatctgctttttttcgctgcgccttgccgaaccgattgcccgctgggtgggtcgcacgggtatcaacatcggcacgcggctcatgggtttgatgttatcggcgctggcggtggaattcatcgtcgatggattgaaggcattgctgcctaatttgaaatga

SEQ ID NO: 10560 - protein, 206 aa, Burkholderia xenovorans LB400
MDILKSFISLLALINPVGAIPFFMSLTAHQSDAERRRTIRIAAISVFCVIAVTTLLGQQIIAFFGISVGSLEVGGGIIMLLMAINMLNAQIGNSRSTPEERHEAEQKDNIAVVPLAIPLLTGPGAISTTIIYAAGSAHWYDRISLVAIGAVLAAICFFSLRLAEPIARWVGRTGINIGTRLMGLMLSALAVEFIVDGLKALLPNLK

SEQ ID NO: 10561 - DNA, 657 bp, Cytophaga hutchinsonii ATCC 33406
  CDS (1)..(657): transl_table=11
atggacttaatttttgcaacggttgcagcacttttacccattatcaatcctttcagcacggcacctatgtttttatcgctcacacagggtgacaccaaatcgtatcgaaacgcacaggctacgcagggtgtaatctacatgctggcaattttgctggtctcgctggtgggtggctcgtttattatgaatttctttggtttgtctatgccgggcatgcgtattgccggcggcatactggtagcaggtgttggtatgaaaatgctcaaaccaaatgatgaaattgaaacaacagaggcagaaacaaaagaagctgaaaataaaaaagatatttcgtttacccctttggccatgcccagtttaagcggaccgggttctatctcggttgttatcggtatgagttcactggctaaaaatatttccgattattgttatatcgcgctgggtattatatttgttgcctgcgtggtgctgcttgtattacgttcgtctgttggacttgtaaaagtacttggcgtgaatggtctgcacgcaatgacaaagattatgggttttcttattttgtgcgttggtattcagtttatcatacacggtaccatggatattctgacaggaaatgaaatgcttgagtttttaaagaaggtgcatcagaatgtatag

SEQ ID NO: 10562 - protein, 218 aa, Cytophaga hutchinsonii ATCC 33406
MDLIFATVAALLPIINPFSTAPMFLSLTQGDTKSYRNAQATQGVIYMLAILLVSLVGGSFIMNFFGLSMPGMRIAGGILVAGVGMKMLKPNDEIETTEAETKEAENKKDISFTPLAMPSLSGPGSISVVIGMSSLAKNISDYCYIALGIIFVACVVLLVLRSSVGLVKVLGVNGLHAMTKIMGFLILCVGIQFIIHGTMDILTGNEMLEFLKKVHQNV

SEQ ID NO: 10563 - DNA, 633 bp, Shewanella sp. MR-7
  CDS (1)..(633): transl_table=11
ttggagttaacactttacgttaaattttttctcggcctcgttgccattatcaaccccattggtttgctgccagtgtttgtgagcttaaccagtcatcaaaccgaagccgagcgtaaccatacgggtaaagtggcgaactttgcggtggtggtgatcctgctagtgaccatagtggcgggacaacatattttgaatatgtttagcatttcgctctcggcctttaggatcgcaggcggcaccttgatcgcgattattgcgatgtcgatgctgcaggggaaattgggggaagtgaaacgcaaccaagaagaagatcgcgaatcttcggccatggagtccgtggctgtggtgccgttagccttgccgttaatggctggccccggcgcgattagctcggtcatcgtgtttgccgctgagcataataccttctccaattttgtggcgatgtttattaccgtgattatttttggtttggtgagttttgccttgtttagaatggcatcaatcatttataaaattctcggtaaaacaggtattaacgttattacccgtctgatggggctattaatgctgtcgatcgggatcgaggtgattgccgctggaattaaagggctgttcccacaactctttagctaa

SEQ ID NO: 10564 - protein, 210 aa, Shewanella sp. MR-7
MELTLYVKFFLGLVAIINPIGLLPVFVSLTSHQTEAERNHTGKVANFAVVVILLVTIVAGQHILNMFSISLSAFRIAGGTLIAIIAMSMLQGKLGEVKRNQEEDRESSAMESVAVVPLALPLMAGPGAISSVIVFAAEHNTFSNFVAMFITVIIFGLVSFALFRMASIIYKILGKTGINVITRLMGLLMLSIGIEVIAAGIKGLFPQLFS

SEQ ID NO: 10565 - DNA, 702 bp, Pseudomonas aeruginosa UCBPP-PA14
  CDS (1)..(702): transl_table=11
atgagcgaatacttccatcacgtcctggtcggcctgctcgccgtgctcccggtagccaacccgctgaccagcgtctcgctgctgcttggcctcggcggcagcctaccgccggcggagcgcaaccggcagatattcaaggccagcctctacgtggcgctgatcatgctggtcagcttctacggcggcagcctggtgatgcaggtgttcggcatctccattcccggcctgcgcatcgccggcgggctgatcgtcgcctatatcggcttcaccatgctgttccccgccaccacgccggacgagaccgaagtccagcacgacctgctgtcggacgaggaaaagatcaccccgcacttccgcgacctgtccttcgttccgctggccctgccgggtaccgcggggccggggaccatcgccctggtggtcagctcggcgtcgacgctgcaatccacctacggaagcattccgctgttcatccacctcgcggcgatcaccgtcaccctgctcaccgcgctgatcttctggatcgccctgcaaagctccgggcgcatcatgaagttcctcggcgaatccgggatcgacgccatctcgcgagtggtcggcttcctgctggtggcgatgggcgtgcagttcgtcatcaacggcggcttcgagctggtcgccggccacgccgcgcttcagtcggcggcgggcgtcaggcagtaa

SEQ ID NO: 10566 - protein, 233 aa, Pseudomonas aeruginosa UCBPP-PA14
MSEYFHHVLVGLLAVLPVANPLTSVSLLLGLGGSLPPAERNRQIFKASLYVALIMLVSFYGGSLVMQVFGISIPGLRIAGGLIVAYIGFTMLFPATTPDETEVQHDLLSDEEKITPHFRDLSFVPLALPGTAGPGTIALVVSSASTLQSTYGSIPLFIHLAAITVTLLTALIFWIALQSSGRIMKFLGESGIDAISRVVGFLLVAMGVQFVINGGFELVAGHAALQSAAGVRQ

SEQ ID NO: 10567 - DNA, 633 bp, Shewanella sp. ANA-3
  CDS (1)..(633): transl_table=11
ttggagttaacactttacgttaaattttttcttggcctggttgccattatcaaccccattggtttgttgccagtgtttgtgagcttaaccagccatcaaaccgaagccgagcgcaaccatacgggtaaagtggctaactttgctgtggtggtgatcctgctggtgaccatagtggcgggacaacatattttgaatatgtttagcatttcactttcggcctttaggatcgctggcggcacgctgatcgcgattattgcgatgtcgatgttgcagggtaaattgggcgaggtgaaacgcaaccaagaggaagaccgcgaatcttcggccatggagtcagtggctgtggtgccgttagccttgccgttaatggctggccctggtgcgatcagctcggttattgtatttgccgcagagcataattccttctccaattttgtggcgatgttcattaccgtaatcatttttggtttggtgagtttcgccctgttcagaatggcgtcaatcatctacaaaattcttggtaaaacagggattaacgttattacccgtttgatggggcttttaatgctgtcgatcgggattgaggtaattgccgctgggattaaagggctgttcccacaactttttagctaa

SEQ ID NO: 10568 - protein, 210 aa, Shewanella sp. ANA-3
MELTLYVKFFLGLVAIINPIGLLPVFVSLTSHQTEAERNHTGKVANFAVVVILLVTIVAGQHILNMFSISLSAFRIAGGTLIAIIAMSMLQGKLGEVKRNQEEDRESSAMESVAVVPLALPLMAGPGAISSVIVFAAEHNSFSNFVAMFITVIIFGLVSFALFRMASIIYKILGKTGINVITRLMGLLMLSIGIEVIAAGIKGLFPQLFS

SEQ ID NO: 10569 - DNA, 714 bp, Neisseria meningitidis FAM18
  CDS (1)..(714): transl_table=11
ttgcggcggcaatttgcagcatcggatgcctgccgcacgggtttgaaggagggggaaataatgggattgggcatggaaatcggcaagctgattgtggcttttttggtgctgattaatccgtttagcgcgttgtcgctttaccttgacctgaccaacgggcacagcacgaaggagcgcaggaaggtcgcgcggacggccgccgttgccgtgtttgccgtgattgcggtatttgcgctgatcggcggtacgctgctgaaggttttgggcatcagcgtcggttcgtttcaggtcggcggcgggattttggtgctgctgatcgccatttcgatgatgaacggcaacgacaatcccgccaagcagaatctcggcgcgcagccggaaacggggcaggcgcgccccgcccgcaatgccggagcgattgccgtcgtgcccatcgccataccgatcaccatcggcccgggcggtatttcgaccgtgattatttacgcttcggcagccaaaacgtacagcgacatcgcgctgattatcgtggccggtttggtggtcagtgcgatttgttatgccattttaattgttgcagggaaggtcagccgcctgctgggcgcgacggggctgacgattttaaaccgtatcatgggtatgatgctggcggcggtatcggtggagattattgtgtcgggactgaaaacgatattcccgcaactggcaggttga

SEQ ID NO: 10570 - protein, 237 aa, Neisseria meningitidis FAM18
MRRQFAASDACRTGLKEGEIMGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQARPARNAGAIAVVPIAIPITIGPGGISTVIIYASAAKTYSDIALIIVAGLVVSAICYAILIVAGKVSRLLGATGLTILNRIMGMMLAAVSVEIIVSGLKTIFPQLAG

SEQ ID NO: 10571 - DNA, 639 bp, Photobacterium sp. SKA34
  CDS (1)..(639): transl_table=11
atgcaagccattgaatttggaatatttttacacttttttgtcgggctttttgctacggtaaaccctgttggcattatgcctgtcttcgtgtcattaacaggttcaatgacccctgaagagcgaaataaaactgcgttaacaaccaataccgctgttgttattatattggtagtggctctcgttgcaggccaacacttattggatctctttagtatctctattaattcgttccgagtcgctggcggcttgctattactgagtatcgctttttcaatgatgagcggtaagattggtgaggtgaaacagaataaggaagagaaatcagagtcagccattcgtgaacaagtaggtgtggttccacttgcaatgcctttaatggcagggccaggtgctatcagttcaaccattgtttatggttctaagtatccaacaatgacatcaacgattggcattgccattaccatcgttgtttttgcttttggctgttggttactgtttcgctctgcaccattaattgtacgcttcctaggtcaaacaggtattaacgtcattactcgtatcatgggtttgattctggccgcacttggtattgaatttattattaatgggttaaaagtgatgctaccaggcctagtttaa

SEQ ID NO: 10572 - protein, 212 aa, Photobacterium sp. SKA34
MQAIEFGIFLHFFVGLFATVNPVGIMPVFVSLTGSMTPEERNKTALTTNTAVVIILVVALVAGQHLLDLFSISINSFRVAGGLLLLSIAFSMMSGKIGEVKQNKEEKSESAIREQVGVVPLAMPLMAGPGAISSTIVYGSKYPTMTSTIGIAITIVVFAFGCWLLFRSAPLIVRFLGQTGINVITRIMGLILAALGIEFIINGLKVMLPGLV

SEQ ID NO: 10573 - DNA, 639 bp, Vibrio sp. Ex25
  CDS (1)..(639): transl_table=11
atgcaaacttttgaacttgctatcttcttgcagttttttcttggtttggtcgccgcagtaaaccctgttggtatcatgcctgtgtttgtgtcactaaccggacatatgacaccagacgaaaagcgcaatacggcaaccacagcgaacgtggctgttgcgatcatcctgatcatttcgctctttgctggccagttactattagatatgttcagcatttctctggattcgtttcgtgttgcaggtgggctactgctgcttagcatcgcgttctcgatgatgagcggtaaactgggggaagataaacaaaacaaacaggaaaaatcagaatacgtgagtcgcgagcagatcggtgttgttcctcttgcgatgccgctaatggcaggaccaggcgcaatcagttcgactattgtttacggtgcacgctacccaagcatgtttgatacggtaggcatcagcattacaattggcttgttctgtctatgctcgtggctgttgttccgctctgccccactgatcgtgcgatttttgggccaaactggtatcaacgtcattacccgtatcatgggtttgatattaggcgcattgggtattgagtttatcgccaatggtttacgcaacttatttccaggattagcctga

SEQ ID NO: 10574 - protein, 212 aa, Vibrio sp. Ex25
MQTFELAIFLQFFLGLVAAVNPVGIMPVFVSLTGHMTPDEKRNTATTANVAVAIILIISLFAGQLLLDMFSISLDSFRVAGGLLLLSIAFSMMSGKLGEDKQNKQEKSEYVSREQIGVVPLAMPLMAGPGAISSTIVYGARYPSMFDTVGISITIGLFCLCSWLLFRSAPLIVRFLGQTGINVITRIMGLILGALGIEFIANGLRNLFPGLA

SEQ ID NO: 10575 - DNA, 759 bp, Opitutaceae bacterium TAV2
  CDS (1)..(759): transl_table=11
atgcttgcatccggcgggcttgggcattcgagtgcgggcggaaatcaaaacatgagtctgatcttcgcctccatcgcggcacttttgccgatcatcaacccattcagcaccgcgccattgtttctcgccatcacggaaggagacaccgacgccgagcgcaacgagcaggcccggcgcggcgtgctctacatggttgccatcctcaccacctttttggtctgcggcagttttatcatgaacttcttcggcctttcgctgcccggcttgcgaatcgcgggcggcattatcgtggctggcgtcggcatgcgcatgttgtatccaaaagacgaccacgaccagactccgcaggaaaaagccgagtcgcgcaaaaaagcggacgtctccttcaccccgctcgccatgccgagcctgagcggcccgggtgcgatctcggttaccatcggcctggcctcaatgtcgtcaggctggcttgattacgtgagcgttttcatcggcatcctcgtcgtggcctgcattacctacggcgtgctccggctggcaacgcgactcgtgcatcatctcggcgtcaacggcctccacgccatgaccaagatcatgggatttctgatcctgtgcgtcggagtccagttcgtggtcaacggcgtgcgcggcatcgccagcgactcggaactactccgcgacatccgcgccggactcgaggcatcggcggagacgaatactggaaccagcgccacggcgaaggcggacgccaacaagtga

SEQ ID NO: 10576 - protein, 252 aa, Opitutaceae bacterium TAV2
MLASGGLGHSSAGGNQNMSLIFASIAALLPIINPFSTAPLFLAITEGDTDAERNEQARRGVLYMVAILTTFLVCGSFIMNFFGLSLPGLRIAGGIIVAGVGMRMLYPKDDHDQTPQEKAESRKKADVSFTPLAMPSLSGPGAISVTIGLASMSSGWLDYVSVFIGILVVACITYGVLRLATRLVHHLGVNGLHAMTKIMGFLILCVGVQFVVNGVRGIASDSELLRDIRAGLEASAETNTGTSATAKADANK

SEQ ID NO: 10577 - DNA, 621 bp, Burkholderia multivorans
  CDS (1)..(621): transl_table=11
atggatctgctcaaatcgttcatttcgctgctcgcgctgatcaatccggtcggcgcggtgccgttcttcctgagcctgactgcgcagcagaacgaagcggaacggcgccgcacgatccggatcgcgtcggtatcggtgttctgcgtgatgacggtgacggtgctgctcgggcagcagatcatccgcttcttcgggatttcggtcggctcgcttgaagtcggcggcgggatcatcatgttgctgatggcgatcagcatgctgaacgcgcagatcggcaacacgcgctcgacgccggaggaacgcgacgaggccgaactgaaggacaacatcgcggtggtgccgctcgcgatcccgctgctcacgggccccggctcgatcagcacggcgatcgtgtatgcggcgaatgcgcatcactggtatgagcgggccgggctcgtcgcgatcggcgcgattctggccctgctgtgtttcgttgcgatgcggctcgcggagccgatcgcgaactggatcggccgcaccggcatcaacgtcgccacgcggctgatgggtctgatgctgtcggcgctggcggtggaattcatcgtcaacggactgagggcgctattgcctgcactgagatga

SEQ ID NO: 10578 - protein, 206 aa, Burkholderia multivorans
MDLLKSFISLLALINPVGAVPFFLSLTAQQNEAERRRTIRIASVSVFCVMTVTVLLGQQIIRFFGISVGSLEVGGGIIMLLMAISMLNAQIGNTRSTPEERDEAELKDNIAVVPLAIPLLTGPGSISTAIVYAANAHHWYERAGLVAIGAILALLCFVAMRLAEPIANWIGRTGINVATRLMGLMLSALAVEFIVNGLRALLPALR

SEQ ID NO: 10579 - DNA, 666 bp, Escherichia coli
  CDS (1)..(666): transl_table=11
atgttagatttgtttaaagcaattggcctggggctggtggtgttactgccgttagctaacccattaacaactgtcgcgttatttcttggcctggcaggcaacatgaacggtgccgaacgtaatcgtcagtcgttgatggcctcggtgtacgtctttgccatcatgatggtggcgtattacgccgggcaactggtgatggatacatttggcatttcgattcccggtctgcgaattgcaggcggcttaatcgtcgcgtttatcggttttcggatgctttttccgcaacagaaagcgattgattcaccggaggcgaaaagcaagtcggaagagctggaagatgaacccagcgccaatattgcttttgtaccactggcaatgccaagtaccgccggtccgggaaccattgcgatgattattagctcggcgtccacagtgcgtcagagttcaaccttcgctgattgggtactgatggttgcgccgccgctgatctttttcctggtggcggttattttgtggggaagtctacgcagctctggcgcaattatgcggctggtgggcaagggtggcattgaagcgatctcccgcttgatggggttcctgctggtatgtatgggtgtacagtttattattaacggcatcctggaaatcattaaaacgtatcattaa

SEQ ID NO: 10580 - protein, 221 aa, Escherichia coli
MLDLFKAIGLGLVVLLPLANPLTTVALFLGLAGNMNGAERNRQSLMASVYVFAIMMVAYYAGQLVMDTFGISIPGLRIAGGLIVAFIGFRMLFPQQKAIDSPEAKSKSEELEDEPSANIAFVPLAMPSTAGPGTIAMIISSASTVRQSSTFADWVLMVAPPLIFFLVAVILWGSLRSSGAIMRLVGKGGIEAISRLMGFLLVCMGVQFIINGILEIIKTYH

SEQ ID NO: 10581 - DNA, 666 bp, Salmonella typhi
  CDS (1)..(666): transl_table=11
atgatggatttgtttaaagcgattggattggggctggtcgtactgctcccgttagccaatccgctaaccaccgtggcgctgtttcttggccttgcgggcaatatgaatagtgcggaacgcaaccggcagtcctatatggcttcggtttatgtcttcgctattatgatggtggcgtactatgccgggcagttagttatgaacaccttcggtatttcgattccagggctacggatcgccggggggttaatcgtggcgtttatcggcttcagaatgcttttcccgcagcagaaggcgcatgagtcgccggaagcgaaaagcaaatcggaggagctggcagacgaaccgacggccaatattgcgtttgttccactggctatgccaagcaccgcaggaccggggaccatcgcaatgatcatcagttccgcttccacggtgcgtcatggcggcgagtttcccgactgggtcattatggtcgcgccgccgattatttttcttgccgtggcggtgatcctgtggggatgcttacgcagttctggcgctattatgcggctggtgggtaaaggggggattgaagcgatctcccgcttaatgggattcctgctggtgtgtatgggcgtgcaatttattatcaacggcgtgttggaaattattaaaacgtaccactaa

SEQ ID NO: 10582 - protein, 221 aa, Salmonella typhi
MMDLFKAIGLGLVVLLPLANPLTTVALFLGLAGNMNSAERNRQSYMASVYVFAIMMVAYYAGQLVMNTFGISIPGLRIAGGLIVAFIGFRMLFPQQKAHESPEAKSKSEELADEPTANIAFVPLAMPSTAGPGTIAMIISSASTVRHGGEFPDWVIMVAPPIIFLAVAVILWGCLRSSGAIMRLVGKGGIEAISRLMGFLLVCMGVQFIINGVLEIIKTYH

SEQ ID NO: 10583 - DNA, 648 bp, Buchnera aphidicola subsp
  CDS (1)..(648): transl_table=11
atgaatatttcaatttttgatttatctatatatataaaattttttataggtttatgtgctttagttaatccaattggaatgattcctatctttacaactatgacaaataatcaatcttttttagaaagaaagaagactaatatagtagctaatttttcagtatcattaattttattaatatcattattttttggtagtaatattttaaatatttttggtatatctattaattcttttcgtattgctggtggaattctaattattagcatagctttttctatgattagcggtcaattcattaaaacaataaaaactaaaaaagaaacaaaagaagaaaataaaatagataatattagtgttgttcccttggcaatgcctttaattgctggtccaggggcaattagttctactattgtttggagtacttattattcaagttgggctaatttatttttatgtagtttagtaattttcttattttcttttgtttgttggttatgttttgaagctgctccatatgttgtgcaaattctaggaaacacaggaattaatatcattactcgtattatgggtttattattaatgtctcttggaatagagtttattagtactggtataggtgctattttcccaggattattacattga

SEQ ID NO: 10584 - protein, 215 aa, Buchnera aphidicola subsp
MNISIFDLSIYIKFFIGLCALVNPIGMIPIFTTMTNNQSFLERKKTNIVANFSVSLILLISLFFGSNILNIFGISINSFRIAGGILIISIAFSMISGQFIKTIKTKKETKEENKIDNISVVPLAMPLIAGPGAISSTIVWSTYYSSWANLFLCSLVIFLFSFVCWLCFEAAPYVVQILGNTGINIITRIMGLLLMSLGIEFISTGIGAIFPGLLH

SEQ ID NO: 10585 - DNA, 27 bp, Artificial sequence
  primer
atgttagatttgtttaaagcaattggc

SEQ ID NO: 10586 - DNA, 27 bp, Artificial sequence
  primer
ttaatggtacgttttaatgatttccag

SEQ ID NO: 10587 - protein, 206 aa, Artificial sequence
  consensus sequence
  Variant (3)..(19): Xaa in position 3 to 19 is any amino acid
  Variant (22)..(27): Xaa in position 22 to 27 is any amino acid
  Variant (29)..(42): Xaa in position 29 to 42 is any amino acid
  Variant (44)..(49): Xaa in position 44 to 49 is any amino acid
  Variant (54)..(57): Xaa in position 54 to 57 is any amino acid
  Variant (59)..(60): Xaa in position 59 to 60 is any amino acid
  Variant (63)..(71): Xaa in position 63 to 71 is any amino acid
  Variant (73)..(95): Xaa in position 73 to 95 is any amino acid
  Variant (96)..(113): Xaa in position 96 to 113 is any or no amino acid
  Variant (117)..(117): Xaa in position 117 is any amino acid
  Variant (119)..(121): Xaa in position 119 to 121 is any amino acid
  Variant (125)..(125): Xaa in position 125 is any amino acid
  Variant (127)..(129): Xaa in position 127 to 129 is any amino acid
  Variant (131)..(170): Xaa in position 131 to 170 is any amino acid
  Variant (171)..(179): Xaa in position 171 to 179 is any or no amino acid
  Variant (181)..(182): Xaa in position 181 to 182 is any amino acid
  Variant (184)..(188): Xaa in position 184 to 188 is any amino acid
  Variant (190)..(190): Xaa in position 190 is any amino acid
  Variant (193)..(194): Xaa in position 193 to 194 is any amino acid
  Variant (196)..(205): Xaa in position 196 to 205 is any amino acid
NPXXXXXXXXXXXXXXXXXERXXXXXXAXXXXXXXXXXXXXXGXXXXXXFGISXXXXRXXGGXXXXXXXXXMXXXXXXXXXXXXXXXXXXXXXXXXXXXXXXXXXXXXXXXXXPLAXPXXXGPGXIXXXIXXXXXXXXXXXXXXXXXXXXXXXXXXXXXXXXXXXXXXXXXXXXXXXXXGXXGXXXXXRXMGXXLXXXXXXXXXXG

SEQ ID NO: 10588 - protein, 28 aa, Artificial sequence
  protein pattern
  Variant (2)..(2): Xaa in position 2 is any amino acid
  Variant (3)..(3): Xaa in position 3 is any or no amino acid
  Variant (5)..(9): Xaa in position 5 to 9 is any amino acid
  Variant (10)..(10): Xaa in position 10 is any or no amino acid
  Variant (12)..(12): Xaa in position 12 is Ile, Leu or Val
  Variant (13)..(13): Xaa in position 13 is Leu, Met or Val
  Variant (15)..(15): Xaa in position 15 is Phe, Leu, Met or Val
  Variant (16)..(16): Xaa in position 16 is Ile, Leu or Met
  Variant (17)..(17): Xaa in position 17 is Leu or Met
  Variant (18)..(18): Xaa in position 18 is any amino acid
  Variant (19)..(19): Xaa in position 19 is Ala, Cys or Ser
  Variant (20)..(20): Xaa in position 20 is Ile, Leu, Met or Val
  Variant (21)..(21): Xaa in position 21 is Ala, Gly or Ser
  Variant (22)..(22): Xaa in position 22 is Ile or Val
  Variant (23)..(23): Xaa in position 23 is Glu or Gln
  Variant (24)..(24): Xaa in position 24 is Phe, Ile or Val
  Variant (25)..(25): Xaa in position 25 is Ile or Val
  Variant (26)..(26): Xaa in position 26 is any amino acid
  Variant (27)..(27): Xaa in position 27 is Ala, Asp, Asn, Ser or Thr
GXXGXXXXXXRXXGXXXXXXXXXXXXXG

SEQ ID NO: 10589 - protein, 31 aa, Artificial sequence
  protein pattern
  Variant (2)..(7): Xaa in position 2 to 7 is any amino acid
  Variant (9)..(9): Xaa in position 9 is Gly or Ser
  Variant (11)..(11): Xaa in position 11 is Ser or Thr
  Variant (12)..(13): Xaa in position 12 to 13 is any amino acid
  Variant (14)..(14): Xaa in position 14 is Ala, Gly or Ser
  Variant (15)..(15): Xaa in position 15 is Phe, Ile or Leu
  Variant (16)..(16): Xaa in position 16 is Glu or Arg
  Variant (17)..(17): Xaa in position 17 is Ile or Val
  Variant (18)..(18): Xaa in position 18 is Ala or Gly
  Variant (21)..(21): Xaa in position 21 is any amino acid
  Variant (22)..(22): Xaa in position 22 is Ala, Ile, Leu or Val
  Variant (23)..(23): Xaa in position 23 is Ile, Leu, Met or Val
  Variant (24)..(26): Xaa in position 24 to 26 is any amino acid
  Variant (27)..(27): Xaa in position 27 is Ala or Gly
  Variant (28)..(29): Xaa in position 28 to 29 is any amino acid
  Variant (31)..(31): Xaa in position 31 is Ile, Leu, Met or Val
GXXXXXXFXIXXXXXXXXGGXXXXXXXXXMX

SEQ ID NO: 10590 - protein, 20 aa, Artificial sequence
  protein pattern
  Variant (4)..(4): Xaa in position 4 is Ile, Leu or Met
  Variant (6)..(7): Xaa in position 6 to 7 is any amino acid
  Variant (8)..(8): Xaa in position 8 is Ala, Ser or Thr
  Variant (12)..(12): Xaa in position 12 is Ala, Ser or Thr
  Variant (14)..(19): Xaa in position 14 to 19 is any or no amino acid
PLAXPXXXGPGXIXXXXXXS

SEQ ID NO: 10591 - DNA, 813 bp, Escherichia coli
  CDS (1)..(813): transl_table=11
atgaaatcactgtttaaagtaacgctgctggcgaccacaatggccgttgccctgcatgcaccaatcacttttgctgctgaagctgcaaaacctgctacagctgctgacagcaaagcagcgttcaaaaatgacgatcagaaatcagcttatgcactgggtgcctcgctgggtcgttacatggaaaactctctaaaagaacaagaaaaactgggcatcaaactggataaagatcagctgatcgctggtgttcaggatgcatttgctgataagagcaaactctccgaccaagagatcgaacagactctacaagcattcgaagctcgcgtgaagtcttctgctcaggcgaagatggaaaaagacgcggctgataacgaagcaaaaggtaaagagtaccgcgagaaatttgccaaagagaaaggtgtgaaaacctcttcaactggtctggtttatcaggtagtagaagccggtaaaggcgaagcaccgaaagacagcgatactgttgtagtgaactacaaaggtacgctgatcgacggtaaagagttcgacaactcttacacccgtggtgaaccgctttctttccgtctggacggtgttatcccgggttggacagaaggtctgaagaacatcaagaaaggcggtaagatcaaactggttattccaccagaactggcttacggcaaagcgggtgttccggggatcccaccgaattctaccctggtgtttgacgtagagctgctggatgtgaaaccagcgccgaaggctgatgcaaagccggaagctgatgcgaaagccgcagattctgctaaaaaataa

SEQ ID NO: 10592 - protein, 270 aa, Escherichia coli
MKSLFKVTLLATTMAVALHAPITFAAEAAKPATAADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 10593 - DNA, 633 bp, Haemophilus somnus 2336
  CDS (1)..(633): transl_table=11
atgacaaaacaattttttgcacaggttgccttagatgatgtttcagctcaaggtagttatggtatcggtttacaaatcggtcaacaattagtcgatagcaaattagcggttaaagctgaagccgttgcaaaagggatttatgacgcattgaatcaaaatccgcccgctttagaattaaacgaagttgctaaagcgttacaggaattacagcaacaagccagcgaaattgcacaagcacaatttaagcaaattgaagaagaaggtaaaaaataccttgaagaaaatgcgaaaaaagacagtgtaaaagtaacagactctggtttgcaatatgaagtgttggtagaaggcagtggggcaattccaactcgtcaagatcaagttcgtgtccattatacagggactttaattgatggcactgtatttgatagttcagtcaaacgtgggcaaccagccgaatttccagtaagtggcgtaattgcaggttggattgaagcattatctatgatgccgctaggttcaaaatggaaattaactattccacatcatttggcttatggtgaacgtggtgccggtgcatcaattccaccgttcagcacgttggtatttgaagtggaattattggatattttgtaa

SEQ ID NO: 10594 - protein, 210 aa, Haemophilus somnus 2336
MTKQFFAQVALDDVSAQGSYGIGLQIGQQLVDSKLAVKAEAVAKGIYDALNQNPPALELNEVAKALQELQQQASEIAQAQFKQIEEEGKKYLEENAKKDSVKVTDSGLQYEVLVEGSGAIPTRQDQVRVHYTGTLIDGTVFDSSVKRGQPAEFPVSGVIAGWIEALSMMPLGSKWKLTIPHHLAYGERGAGASIPPFSTLVFEVELLDIL

SEQ ID NO: 10595 - DNA, 687 bp, Haemophilus somnus 2336
  CDS (1)..(687): transl_table=11
atgttaaaaattaaaaaacgttctgcaatagcgttaatagcaagtgcggtcgtttctcaatctgtttttgctgataagcagttcaatgatgatgtttcttatgctttgggctattttatgggaaaatatttaacggtgatgggtgaagaacacaaagatgttgccagttacaattatgagaaaattgttgctggcattaaagatgttgtagaaaataaaagcactttaactgatgaaaaagcacaagaaacgttgcaagagttagaaaacaaagcacgtcatgcaaaaatggctaaaatcaaagctgaaaatgagaaatttacagcagaatttgctaaaaaatcgaatgtgaaaaaaacggaaagcggtttactttatcgtattgaaaaaatgggagaaggtaagagcattaaaccgacagatcgtgttaaagtacattacacgggcaaattagccaatggcaaagtattcgatagttccagagagcgtggacaacctgctgaatttaaattaaatcaagtgattttaggttggacagagggtttacaattcattaaaaaaggcggaaaaattgagttggttattcctgccgacttagcttatggcgaaagaggtgcaggtctaattccaccgagttcaacgctatattttgatattgaaatcttagatgtaacttctgaaaaataa

SEQ ID NO: 10596 - protein, 228 aa, Haemophilus somnus 2336
MLKIKKRSAIALIASAVVSQSVFADKQFNDDVSYALGYFMGKYLTVMGEEHKDVASYNYEKIVAGIKDVVENKSTLTDEKAQETLQELENKARHAKMAKIKAENEKFTAEFAKKSNVKKTESGLLYRIEKMGEGKSIKPTDRVKVHYTGKLANGKVFDSSRERGQPAEFKLNQVILGWTEGLQFIKKGGKIELVIPADLAYGERGAGLIPPSSTLYFDIEILDVTSEK

SEQ ID NO: 10597 - DNA, 795 bp, Treponema pallidum subsp. pallidum str. Nichols
  CDS (1)..(795): transl_table=11
gtgattttgaaaaaagaagctgcaggggtgtgttctttcgcgcttctgctccttgcgggtatgagtattttttcctgtcggaagggtgctgagggggtgtcctctgccggggaggctgcggataagaaggcgctgactgctgatcagctcgatccgcgaaaggtgcaggagcaggagcggcagaagacgccgctttcaaagaagagtgtggggtatgcctttggggttctcatgggggtgacgctgcaggattcgaagttagacgttgacctgggtcaggtgtggaagggtctaaagaagacagtcagtgcagacaaggataagcaggcacttgcggatgcgcaggacgtgctacagcgtgcgttcgaggcatatcggcaaaaagaggtagagaagaattcgcaggaggcaaaggcctttcttgaagagaatgcgaagaagccaggtgtgcaggtaacttcctctgggttgcagtacgaggtggtaaaggctgcagatggtccaaagccgcagggcggtcagagggtgcgcactcagtacaaggggacgctgcttgatggaacggtgtttgatgcctctcgagataagcctgcggagtttccggtggatggtatggtgcctggggtatctgagggcttaaagctgatgccggtgggttctacctatcggttttatgtgccttcttccttggggtatggggagcgtggtatcgagggggttatccctccaggtgcgctcctagtttttgagatagagttacaggaaatactcccagattcagcttcgaaaaagtga

SEQ ID NO: 10598 - protein, 264 aa, Treponema pallidum subsp. pallidum str. Nichols
MILKKEAAGVCSFALLLLAGMSIFSCRKGAEGVSSAGEAADKKALTADQLDPRKVQEQERQKTPLSKKSVGYAFGVLMGVTLQDSKLDVDLGQVWKGLKKTVSADKDKQALADAQDVLQRAFEAYRQKEVEKNSQEAKAFLEENAKKPGVQVTSSGLQYEVVKAADGPKPQGGQRVRTQYKGTLLDGTVFDASRDKPAEFPVDGMVPGVSEGLKLMPVGSTYRFYVPSSLGYGERGIEGVIPPGALLVFEIELQEILPDSASKK

SEQ ID NO: 10599 - DNA, 630 bp, Vibrio cholerae O1 biovar eltor str. N16961
  CDS (1)..(630): transl_table=11
gtgacttttatgtctgaagtaaaatttgaaaccgtagaacagaaagcaagctacggcattggcctacaaatgggtcaacagttggcaggtagtggccttgaaggcttaaacgtagcggcaattgctgcgggtatcgccaccgctcttgttggcgagcagccagcgatttctattgatgagatcaaccaagctctacatgcgattcatatgcgtgctgaagaagcccgccaagaagccgctaaagtggccgcttctgaaggtgaagctttcctgaaagataatgctctacgtccagaagtgacggttcttgagtcaggcctgcagtacgaagtactggttgaaggtaatggcgcaatcccaacatccgataagtcagttcgcgtacactaccacggccaactggttgatggcactgtgtttgatagctcagtatcacgcggccaacctgctgaattcccggtgactggcgtgatccgcggttgggttgaagctctgcaactgatgcctgttggttctaagtggaaactctacattccacacaaccttgcttatggcgagcgtggcgcaggcgcagcgattcctccgtttgcagcgttagtatttgaagtcgaactgctggatatcctgtaa

SEQ ID NO: 10600 - protein, 209 aa, Vibrio cholerae O1 biovar eltor str. N16961
MTFMSEVKFETVEQKASYGIGLQMGQQLAGSGLEGLNVAAIAAGIATALVGEQPAISIDEINQALHAIHMRAEEARQEAAKVAASEGEAFLKDNALRPEVTVLESGLQYEVLVEGNGAIPTSDKSVRVHYHGQLVDGTVFDSSVSRGQPAEFPVTGVIRGWVEALQLMPVGSKWKLYIPHNLAYGERGAGAAIPPFAALVFEVELLDIL

SEQ ID NO: 10601 - DNA, 717 bp, Pasteurella multocida subsp. multocida str. Pm70
  CDS (1)..(717): transl_table=11
atgtttaaaattcaaaagctttctcttattacccttgtggtgagtgcggttatttctggcaatgcgttagcgaatacggatgctaaatttaacgatgaagcatcttacgcagtaggggtgttattaggatcaaatgttaaacaaattgtagaatcgcaaaaaggcattattgaatatgacaatacgcgtttattggcaggggtgcaagatgtattaaatggtaaggtagatcttgattcaaatgaacaaattgcacaaacattacaacgcgtacaagagaaaatgcaacaagcgcaagctcagttactcgccgatattgcaaaacaagcaaaacaagatggcgaccaatatcgccaaacatttgagaaaaaagcgggagcgaagaaaacccaatctggtctgttatatcgcattgaacaagcagggacaggaaatacgattaagccaactgacactgttaccgttaattataccggcaaactccctaatggcgaggtatttgacagttcgcgtggtaaaccggtgtcctttaaattgaaccaagtggtaccgggttggacagaaggtttacaacttgttaaaaaaggtggaaaaatcgaactcgttctcccaccagaattggcgtatggggagcaaggggctggacagattccaccaaatgcgactttacactttgatgttgaagtcatcgatgtgaaagcggatacacaaaaataa

SEQ ID NO: 10602 - protein, 238 aa, Pasteurella multocida subsp. multocida str. Pm70
MFKIQKLSLITLVVSAVISGNALANTDAKFNDEASYAVGVLLGSNVKQIVESQKGIIEYDNTRLLAGVQDVLNGKVDLDSNEQIAQTLQRVQEKMQQAQAQLLADIAKQAKQDGDQYRQTFEKKAGAKKTQSGLLYRIEQAGTGNTIKPTDTVTVNYTGKLPNGEVFDSSRGKPVSFKLNQVVPGWTEGLQLVKKGGKIELVLPPELAYGEQGAGQIPPNATLHFDVEVIDVKADTQK

SEQ ID NO: 10603 - DNA, 633 bp, Pasteurella multocida subsp. multocida str. Pm70
  CDS (1)..(633): transl_table=11
atgagtcaacaatttttcgaccaagtatcattagaaagcctttcagcgaaaggaagctacggtatcggtttacaaatcggtcaacaattattagaaagccaacttgaagtgagcgccgaagccgtcgcgaaagggatctttgatgtgttaaatcaaaatccaccagcacttgagttaaatgaagtgagtcatgccctacagactttgcaacaacaagccactgaagcacaacaagcgaaattcaaagaaattgaagccgttggtgcacaattcttagctgaaaacgcgcaaaaagcgggggtaaatactacggaatctggtttacagtatgaagtgttagtggctggcgaagggcaaattccggcacgcgaagacaaagtgcgtgtgcattacactgggacattaatcgacggtaccgtctttgacagctcagtaaaacgtggtcaacctgcagaattcccagtgaatggtgtgatcgctggttggattgaagccttgtccatgatgccagtgggttcaaaatggcgtttaaccattcctcacaacctcgcttatggcgaacgtggtgccggtgcatccattccgccattcagtaccttagtgtttgaagtcgaattattagccattctttaa

SEQ ID NO: 10604 - protein, 210 aa, Pasteurella multocida subsp. multocida str. Pm70
MSQQFFDQVSLESLSAKGSYGIGLQIGQQLLESQLEVSAEAVAKGIFDVLNQNPPALELNEVSHALQTLQQQATEAQQAKFKEIEAVGAQFLAENAQKAGVNTTESGLQYEVLVAGEGQIPAREDKVRVHYTGTLIDGTVFDSSVKRGQPAEFPVNGVIAGWIEALSMMPVGSKWRLTIPHNLAYGERGAGASIPPFSTLVFEVELLAIL

SEQ ID NO: 10605 - DNA, 813 bp, Escherichia coli O157:H7 EDL933
  CDS (1)..(813): transl_table=11
  misc_feature (715)..(715): m is a or c
atgaaatcactgtttaaagtaacgctgctggcgaccacaatggccgttgccttgcatgcaccaatcacttttgctgctgaagctgcaaaacctgctacaactgctgacagcaaagcagcgttcaaaaatgacgatcagaaatcagcttatgcactgggtgcctcgctgggtcgttacatggaaaactctctaaaagaacaagaaaaactgggcatcaaactggataaagatcagctgatcgctggtgttcaggatgcatttgctgataagagcaaactctccgaccaagagatcgaacagactctgcaagcattcgaagctcgcgtgaagtcttctgctcaggcgaagatggaaaaagacgcggctgataacgaagcaaaaggtaaagagtaccgcgagaaatttgccaaagagaaaggtgtgaaaacctcttccactggtctggtttatcaggtagtagaagccggtaaaggcgaagcaccgaaagacagcgatactgttgtcgtgaactacaaaggtacgctgatcgacggtaaagagttcgacaactcttacacccgtggtgaaccgctctctttccgtctggacggtgttatcccgggttggacagaaggtctgaagaacatcaagaaaggcggtaagatcaaactggttattccaccagaactggcttacggcaaagcgggtgttccggggatcccaccgaattctaccmtggtgtttgacgtagagctgctggatgtgaaaccagcgccgaaggctgatgcaaagccggaagctgatgcgaaagccgcagattctgctaaaaaataa

SEQ ID NO: 10606 - protein, 270 aa, Escherichia coli O157:H7 EDL933
  misc_feature (239)..(239): The Xaa at location 239 stands for Leu, or Met.
MKSLFKVTLLATTMAVALHAPITFAAEAAKPATTADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTXVFDVELLDVKPAPKADAKPEADAKAADSAKK

SEQ ID NO: 10607 - DNA, 780 bp, Escherichia coli O157:H7 EDL933
  CDS (160)..(780): transl_table=11
  misc_feature (731)..(731): y is t or c
atgatgtccgtggtaaacccgcctttattatattcatacgggatattgctattgtttctttttccctgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggtattgccgatgcgctggaaggcaaacatccggctgttccggttgatgtggtgcatcgcgcgctgcgtgaaatccacgagcgcgccgatgccgttcgtcgtcagcgtttccaggcgatggctgctgaaggtgtgaaatacctggaagaaaacgccaaaaaagaaggtgtgaatagcaccgaatctggcctgcaattccgcgtgatcaaccagggtgaaggcgcaattccggcacgtaccgaccgcgttcgtgttcattacaccggtaaactgatcgacggcaccgtgtttgacagctccgttgctcgtggtgaacccgctgaatttccggttaatggcgtgatccctggctggattgaagcactgactctgatgccggtaggttctaaatgggaactgactatcccgcaggaactggcatatggcgagcgcggcgcaggcgcatccatccytccgttcagcaccctggtgtttgaagtcgaactgctggaaatcctctaa

SEQ ID NO: 10608 - protein, 206 aa, Escherichia coli O157:H7 EDL933
  misc_feature (191)..(191): The Xaa at location 191 stands for Leu, or Pro.
MTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIXPFSTLVFEVELLEIL

SEQ ID NO: 10609 - DNA, 888 bp, Xylella fastidiosa 9a5c
  CDS (1)..(888): transl_table=11
atgtccaaacaatcggtttccgttgtgaataatgaagagaaaacggtgttgagcaccgaaaaagagaaagtcagttatgccattggtttggacattgcgcgatcgcatgtgttcgagctgattgctcaagacattgatgttgctgcactacagcgtgcgatcgaaaatgtcttcaagggtgggccgcctttgatctctgaggaggttgctcagacaaccgataccgcgctgcgtgccatgttggcagcccgttccgggcaacaggaagcttcggggactgcgccgcctgctgtatccaaagagaacattggtctcatgcttgggagctatatggtcggcccgtcgctgctggcgatcaaggatgatattgatcttccggtgcttctacaggcactgcgtaccagcttcgcaaagcgcacaccgttgatggatgaacaagaaatgaccacaaggatgcaagcatttgtggcctctaaaaatgctgcggttgcaggaaaaaatcgtgatgagggcagtgcttttctctctaagaacaagaacgagaagggcgtgatcaccaccgcttcaggtcttcagtacatggtgttgcggcagggaagcggctcacgtccgaccccaagtaataatgtgcgtgtcaactacgagggcaagctgctcagcggtcaagtatttgatagctcttaccagcgtggtcagccggccgagttcggtcttggtcaggtgattaaagggtggtctgaggggctgtcgttgatgcctgtcggttctaagtaccgtttttggattcctgctgatcttgcttacgggcagcaggggactccgggtggtccgattggccctgatgcaacgttgacctttgacgtggagctgctcagtatcctcccttaa

SEQ ID NO: 10610 - protein, 295 aa, Xylella fastidiosa 9a5c
MSKQSVSVVNNEEKTVLSTEKEKVSYAIGLDIARSHVFELIAQDIDVAALQRAIENVFKGGPPLISEEVAQTTDTALRAMLAARSGQQEASGTAPPAVSKENIGLMLGSYMVGPSLLAIKDDIDLPVLLQALRTSFAKRTPLMDEQEMTTRMQAFVASKNAAVAGKNRDEGSAFLSKNKNEKGVITTASGLQYMVLRQGSGSRPTPSNNVRVNYEGKLLSGQVFDSSYQRGQPAEFGLGQVIKGWSEGLSLMPVGSKYRFWIPADLAYGQQGTPGGPIGPDATLTFDVELLSILP

SEQ ID NO: 10611 - DNA, 819 bp, Salmonella enterica subsp. enterica serovar Typhi str. CT18
  CDS (1)..(819): transl_table=11
atgaaatcactgtttaaagccacgctgctggcaacgacgatggccgttgctatgcacgtaccgatcacttttgctgctgatgcggcgaaaccggcagctaccgctgatagcaaagcagcatttaaaaacgacgatcaaaaagcggcttatgcgctgggcgcctcgctgggtcgttacatggaaaattcgcttaaagagcaggaaaagttgggcatcaaactggataaagatcagttgattgccggcgttcaggatgcctttgccgataagagcaaactgtccgatcaggaaattgagcaaacgctgcagacgtttgaagcacgtgtgaagagcgctgctcaggcgaagatggaaaaagacgctgccgataacgaagcaaaaggtaaaacgttccgtgacgcttttgctaaagagaaaggcgtgaaaacctcctctaccggtctgctttacaaagtagagaaagaaggcacaggcgaggcgccgaaagatagcgataccgttgtggtgaactacaaaggtacgctgatcgacggtaaagagtttgataactcttacacgcgcggcgaaccgctctccttccgtctggacggcgttatccctggctggactgaaggcctgaaaaatattaagaaaagcggcaagatcaagctggttatcccaccggcgctggcctacggtaaaacgggcgttccgggtatccctgcgaactccaccctggtattcgacgtagagctgctggatatcaaaccagcgccgaaagcggatgctaaacctgccgatgcggctgacgctaaagccgcagatgctgctaaaaaataa

SEQ ID NO: 10612 - protein, 272 aa, Salmonella enterica subsp. enterica serovar Typhi str. CT18
MKSLFKATLLATTMAVAMHVPITFAADAAKPAATADSKAAFKNDDQKAAYALGASLGRYMENSLKEQEKLGIKLDKDQLIAGVQDAFADKSKLSDQEIEQTLQTFEARVKSAAQAKMEKDAADNEAKGKTFRDAFAKEKGVKTSSTGLLYKVEKEGTGEAPKDSDTVVVNYKGTLIDGKEFDNSYTRGEPLSFRLDGVIPGWTEGLKNIKKSGKIKLVIPPALAYGKTGVPGIPANSTLVFDVELLDIKPAPKADAKPADAADAKAADAAKK

SEQ ID NO: 10613 - DNA, 819 bp, Salmonella typhimurium LT2
  CDS (1)..(819): transl_table=11
atgaaatcactgtttaaagccacgctgctggcaactacgatggccgttgctatgcacgcaccgatcacttttgctgctgatgcggcgaaaccggcagctaccgctgatagcaaagcagcatttaaaaacgacgatcaaaaagcggcttatgcgctgggcgcctcgctgggtcgttacatggaaaattcgcttaaagagcaggaaaagttaggcatcaaactggataaagatcagttgattgccggcgttcaggatgcctttgccgataagagcaaactgtccgatcaggaaattgagcaaacgctgcagacgtttgaagcacgcgtgaagagcgctgctcaggcgaagatggaaaaagacgctgccgataacgaagcaaaaggtaaaacgttccgcgacgcttttgctaaagagaaaggtgtgaaaacctcctctaccggcctgctttacaaagtagagaaagaaggcacaggcgaggcgccgaaagatagcgataccgttgtggtgaactacaaaggtactctgatcgacggtaaagagtttgataactcttacacgcgcggcgaaccgctctccttccgtctggacggcgttatccctggctggactgaaggtctgaaaaatattaagaaaggcggcaagatcaagctggttatcccacctgagctggcctacggtaaaacgggcgttccggggatcccggcaaactcaaccctggtattcgacgtagagctgctggatatcaaaccagcgccgaaagcggatgctaaacctgccgatgcggctgacgctaaagccgcagatgctgctaaaaaataa

SEQ ID NO: 10614 - protein, 272 aa, Salmonella typhimurium LT2
MKSLFKATLLATTMAVAMHAPITFAADAAKPAATADSKAAFKNDDQKAAYALGASLGRYMENSLKEQEKLGIKLDKDQLIAGVQDAFADKSKLSDQEIEQTLQTFEARVKSAAQAKMEKDAADNEAKGKTFRDAFAKEKGVKTSSTGLLYKVEKEGTGEAPKDSDTVVVNYKGTLIDGKEFDNSYTRGEPLSFRLDGVIPGWTEGLKNIKKGGKIKLVIPPELAYGKTGVPGIPANSTLVFDVELLDIKPAPKADAKPADAADAKAADAAKK

SEQ ID NO: 10615 - DNA, 621 bp, Salmonella typhimurium LT2
  CDS (1)..(621): transl_table=11
atggccaccccgacttttgacactattgaagcgcaagcgagctacggcattggtttgcaggtagggcagcagctcagcgaatccggtcttgaagggctgttgcctgaagcgctggttgcaggcattgctgatgcgctggaaggtaaacacccggcggttcctgttgatgtggtgcatcgtgcgctgcgtgaaattcatgagcgtgcggacgcggtgcgtcgtgagcgtttcaaagcgatggcggccgaaggcgtgaaatacctggaagaaaaccgcgaaaaagacggtgtgaacagtactgagtctggtttacagttccgcgttctgacgcagggcgaaggcgcgattccggcgcgtaccgaccgcgtacgcgtgcattacaccggtaagcttattgatggcaccgtatttgacagctccgtcgcgcgcggcgaaccggctgaattcccggtaaatggcgtgatcgccggctggattgaagcgctgactctgatgccggtaggttccaaatgggaactgactatcccacaggagctggcctatggcgagcgtggggccggggcatctattccgccattcagcaccctggtgtttgaagtggaactgctggaaattctgtaa

SEQ ID NO: 10616 - protein, 206 aa, Salmonella typhimurium LT2
MATPTFDTIEAQASYGIGLQVGQQLSESGLEGLLPEALVAGIADALEGKHPAVPVDVVHRALREIHERADAVRRERFKAMAAEGVKYLEENREKDGVNSTESGLQFRVLTQGEGAIPARTDRVRVHYTGKLIDGTVFDSSVARGEPAEFPVNGVIAGWIEALTLMPVGSKWELTIPQELAYGERGAGASIPPFSTLVFEVELLEIL

SEQ ID NO: 10617 - DNA, 903 bp, Xanthomonas axonopodis pv. citri str. 306
  CDS (1)..(903): transl_table=11
atgtcgcagcaaccggccgcagcggccaccaaggagaagccagctttgaatgcatcgtctgataagagcacgcgcgacaacgtcagctacgccatcggtatggacgtggcacgttcgttcgagccgatcgctcaggacatcgatgtgaacgcgatgcaacgcgccatcgaaaatgcattcaagggcggcaagccgctgttgtcggatgagcagacccaggccaccgatactgcattgcgtaccgcgctcgctgcccgcaacggccagcaggtgccaggcatggcgccgggcgccgcgccggctgcaccgtccaaggaaaatgtcggcctgatgctcggcgatcgcgcggttggtccgtcgctggccggtatcaaggacgagatcgatctgtcgatcctgatggaagcggtgcgtaccgtgttcgccaagggcaccacgcgtctgacccagcaggaggccgcagccaccatgcaggcattcgcctctgccaagcagggcgctgccgctgccaacaatcgccagcagggcaatgaattccttgccaagaacaagaccgagacgggcgtgatcaccaccgcgtccggcctgcagtacatggtgttgcgccagggtagcggcgagcgcccgatgcggaccagcaaggtgcgtgtgaactacgaaggcaagctgctcaacgggcaggtcttcgacagttcctaccagcgcggccagccggcggagttcggtctggatcaagtcattcccggttggaccgagggcgtggcgttgatgccggtcggttcgaaataccgtttctggattccatccaacttggcctatggcccgaacggcacgcaaggagggccgatcggacctgacgcaacgttgacgttcgatgtcgaactgatgggtatccttccctga

SEQ ID NO: 10618 - protein, 300 aa, Xanthomonas axonopodis pv. citri str. 306
MSQQPAAAATKEKPALNASSDKSTRDNVSYAIGMDVARSFEPIAQDIDVNAMQRAIENAFKGGKPLLSDEQTQATDTALRTALAARNGQQVPGMAPGAAPAAPSKENVGLMLGDRAVGPSLAGIKDEIDLSILMEAVRTVFAKGTTRLTQQEAAATMQAFASAKQGAAAANNRQQGNEFLAKNKTETGVITTASGLQYMVLRQGSGERPMRTSKVRVNYEGKLLNGQVFDSSYQRGQPAEFGLDQVIPGWTEGVALMPVGSKYRFWIPSNLAYGPNGTQGGPIGPDATLTFDVELMGILP

SEQ ID NO: 10619 - DNA, 780 bp, Shewanella oneidensis MR-1
  CDS (1)..(780): transl_table=11
atgaaaaaatctatgccaacttcttttatcccaaaaaccatcacagtggcgacctgcgccgcattgtttgtgtcaatggcgagctttgccgccccaagccttaaaaccgatgcagataaagcgtcatacagtatcggtgcatctgtcggtaactacatttctggccaggtttataaccaagtggaattgggcgcggaagtgaatgtggatttagtcgttcaaggttttgtggacgcgctgaaaaagcaacagcaattaaccgatgaagaagtggtgacgtatctcaatcaacgcgccgaagaattaaatcaagtgagaaaagctaacgctgaaaaattagccgctgaaaatatcaaagcgggtgaagcctttcttgctgaaaacaaaaagaaagctggcgtgactgtgaccgaatcaggcctgcaatatgaagtgttaaccaaaggcacaggtaacaagcctaatcctgaggatgtggtgaccgttgaatacgtcggcaagcttatcgatggcactgagtttgaaaatactgttggtcgtaaagagccgacacgtttcgccttaatgacagtgatccctggttgggaagaaggcttaaagctgatgccgatgggctcaaaataccgttttgtcattcccgcaaacttagcttatggcaatgaatttgtgggtgaaattccaccgcaatctaccttgatatttgaaattgagctgaaaaatatcgaaaagccaagtgagaagaaagaagcccgcatgatgggcatgatgcccgctcactaa

SEQ ID NO: 10620 - protein, 259 aa, Shewanella oneidensis MR-1
MKKSMPTSFIPKTITVATCAALFVSMASFAAPSLKTDADKASYSIGASVGNYISGQVYNQVELGAEVNVDLVVQGFVDALKKQQQLTDEEVVTYLNQRAEELNQVRKANAEKLAAENIKAGEAFLAENKKKAGVTVTESGLQYEVLTKGTGNKPNPEDVVTVEYVGKLIDGTEFENTVGRKEPTRFALMTVIPGWEEGLKLMPMGSKYRFVIPANLAYGNEFVGEIPPQSTLIFEIELKNIEKPSEKKEARMMGMMPAH

SEQ ID NO: 10621 - DNA, 768 bp, Shewanella oneidensis MR-1
  CDS (1)..(768): transl_table=11
atgaaatcgatttataaattatcgttagttgcattggctgttattggcctatctgcttgtaatcaagaagaaaaagcaacaaatgcaagcacaaatgttgaattaacgactgaagcacagaaagaagcctacagtgttggcgcttcaatcggtcgttatatgtctggccatattaaagagcaagaagaattaggcctgccagttgaccgcactttgatcgtgactggtttcactagcggtttaaatgatcaactgaaattaactgaagaagaaatgcaaaccattcttcaaagtttagataaaaagttaaacgacaaacgtcaagaacaagctaaagccattgcggtgaaaaatctcgaggatggcaaaaagttccttgatgaaaacaaagctaagtctggcgtcgtcaccactgaatctggcctgcaatacgaagtattaactccaggttcaggtgagaagccagctgctgaagacacagttgaagtggattacgtgggcacactgattgacggtaaagagtttgatagctcgtacaaacgtggtgagtcgcttaagttcccgttgaatcgtgttattcctggttggaccgaaggcgtacaattgatgccagttggcgctaagtacaagtttgttattcctgcaaacttagcttacggtgatcgcgataatggtactattccacctaactcaacgctgatttttgaagttgaactgaaatcaattgagaaagcagctgctcctgcagcagagcctgctaagaagtaa

SEQ ID NO: 10622 - protein, 255 aa, Shewanella oneidensis MR-1
MKSIYKLSLVALAVIGLSACNQEEKATNASTNVELTTEAQKEAYSVGASIGRYMSGHIKEQEELGLPVDRTLIVTGFTSGLNDQLKLTEEEMQTILQSLDKKLNDKRQEQAKAIAVKNLEDGKKFLDENKAKSGVVTTESGLQYEVLTPGSGEKPAAEDTVEVDYVGTLIDGKEFDSSYKRGESLKFPLNRVIPGWTEGVQLMPVGAKYKFVIPANLAYGDRDNGTIPPNSTLIFEVELKSIEKAAAPAAEPAKK

SEQ ID NO: 10623 - DNA, 618 bp, Shewanella oneidensis MR-1
  CDS (1)..(618): transl_table=11
atgtctgataaattcagtactgttgaacagcaagcaagctatggtgtaggccgtcaaatgggtgagcaactggcagcaaattcttttgaaggcgtcgatatccctgccgttcaagctggcttagccgatgcatttgccggtcttgaaagtgctgtgtctatgcaggaactgcaagtggcattcactgagatcagccgtcgcattcaagctgctcaagaacaagctgctgctgaggcttctgctgaaggcgaagcgtttttagttgaaaacgctaatcgtgaaggcgtaattgtgactgagtcaggtctgcaatacgaagtgttagttcaaggtaacggtgctaaaccaacctacgaagacactgtacgtactcactaccatggttcattcatcaatggtgatgtgttcgacagctctgttgttcgtggtcaacctgctgagttcccagtatcaggcgttatcgctggctggactgaagcactgcaactgatgccagtaggtacgaagttaaaattatatgtgccacatcacttagcttacggtgagcgtggcgcgggcgcttctattcctccgtattcaaccttagtgtttgaagtcgagttattagacatcgtctaa

SEQ ID NO: 10624 - protein, 205 aa, Shewanella oneidensis MR-1
MSDKFSTVEQQASYGVGRQMGEQLAANSFEGVDIPAVQAGLADAFAGLESAVSMQELQVAFTEISRRIQAAQEQAAAEASAEGEAFLVENANREGVIVTESGLQYEVLVQGNGAKPTYEDTVRTHYHGSFINGDVFDSSVVRGQPAEFPVSGVIAGWTEALQLMPVGTKLKLYVPHHLAYGERGAGASIPPYSTLVFEVELLDIV

SEQ ID NO: 10625 - DNA, 663 bp, Pseudomonas putida KT2440
  CDS (1)..(663): transl_table=11
ttgctggtatttgggagtcaggcgttgcctcgatatcttgttttgggtttatgcctgatggcacccctcgccttggccgacaacgacgaccacgatttggcctacagcctgggtgccagcctgggtgaacgcctgcgccaggagatgccaggcttgcagctggatgcactggtcgaaggcctgaagcagtcctatcaggggcaacccctgaaactcgacaaggcacgcatgcaggcagtgctgcagcagcatgaagcccaggaaggtgacgccgctgcgcaaaagctgcaggccgccgaaacgcgtttcatggctaatgaacgtgggcgttatggggtgcacgaactaacggaaggtgtgctgtacagcgaattgcaggcaggcacgggtgcacagccaaaagcgggcggcaaagtgcaagtgcgctatgtgggcagattgccggacggctcaatattcgaccagaaccagaccccccaatggttcaacctggattcggttatcgaaggctggcaggtcgccttgccgaaaatgcacaccggcgccaaatggcgcctggtaattccttcagcgcaagcctatggcgccgagggggcgggagacctgattgcaccctacacccccttggtattcgagatcgaactgctggcggttggcgactga

SEQ ID NO: 10626 - protein, 220 aa, Pseudomonas putida KT2440
MLVFGSQALPRYLVLGLCLMAPLALADNDDHDLAYSLGASLGERLRQEMPGLQLDALVEGLKQSYQGQPLKLDKARMQAVLQQHEAQEGDAAAQKLQAAETRFMANERGRYGVHELTEGVLYSELQAGTGAQPKAGGKVQVRYVGRLPDGSIFDQNQTPQWFNLDSVIEGWQVALPKMHTGAKWRLVIPSAQAYGAEGAGDLIAPYTPLVFEIELLAVGD

SEQ ID NO: 10627 - DNA, 753 bp, Pseudomonas putida KT2440
  CDS (1)..(753): transl_table=11
atgaaacagcatcgtttggcggctgcggttgccctggtaggcctggtactggctggctgcgatcaacaagccagcagccccgagctgaagactccggcgcagaaagcctcctacggtatcggcctgaacatgggcaagagcctggctcaggaaggcatggaagaccttgattcgaaagcagtcgccctcggcatcgaagacgccgttagcaagaaagaacaacgcatcaaggatgaagagctggtagaggccttcaccgcattgcagaaacgcgccgaggagcgcctggccaaggccagcgaagaagccgcctccgccggcaagaaattcctcgaagaaaacgccaagaagccaggcgtggttaccactgcctcgggcctgcagtacgaagtggtcaagaaggccgacggcccgcagcccaaaccgactgacgtggtcactgtccactacgaaggcaagctgatcgatggcaaggtcttcgacagctccgtcgagcgtggcagcccgatcgacctgccggtcagcggtgtgatcccaggttgggtcgaaggtttgcaactgatgcacgtcggcgagaagtacaagttgttcatcccggctgaactggcctatggcgcacaaagcccaagcccgctgatcccggccaactcggtactggtgttcgatctggaactgatcgccatcaaggacccggcccagttgcaaggtgccgagccgcaggccgaagcccctgaagaagcacctgccaagtaa

SEQ ID NO: 10628 - protein, 250 aa, Pseudomonas putida KT2440
MKQHRLAAAVALVGLVLAGCDQQASSPELKTPAQKASYGIGLNMGKSLAQEGMEDLDSKAVALGIEDAVSKKEQRIKDEELVEAFTALQKRAEERLAKASEEAASAGKKFLEENAKKPGVVTTASGLQYEVVKKADGPQPKPTDVVTVHYEGKLIDGKVFDSSVERGSPIDLPVSGVIPGWVEGLQLMHVGEKYKLFIPAELAYGAQSPSPLIPANSVLVFDLELIAIKDPAQLQGAEPQAEAPEEAPAK

SEQ ID NO: 10629 - DNA, 621 bp, Escherichia coli CFT073
  CDS (1)..(621): transl_table=11
atgaccaccccaacttttgacaccatcgaagcgcaagcaagctacggcattggtttgcaggtagggcaacaactgagtgaatctggcctggaagggctgctgccagaagcactggttgcaggcattgccgatgcgctggaaggcaaacatccggctgttccggttgatgtggtgcaccgcgcgctgcgtgaaatccacgaacgcgccgatgccgttcgtcgtcagcgtttccagacgatggctgctgaaggtgtgaaatacctggaagaaaacgccaaaaaagaaggtgtaaatagcaccgaatctggcctgcaattccgcgtgatcaaccagggcgaaggcgcaattccggcacgtaccgaccgcgttcgtgttcattacaccggaaaactgatcgacggcaccgtgtttgacagctccgttgctcgcggcgagccagctgaattcccggttaacggcgtgatccctggctggattgaagcactgactctgatgccagtaggttctaaatgggaactgactatcccgcaggaactggcatatggcgagcgtggcgcaggcgcgtccatccctccgttcagcaccctggtgtttgaagtcgaactgctggaaatcctctaa

SEQ ID NO: 10630 - protein, 206 aa, Escherichia coli CFT073
MTTPTFDTIEAQASYGIGLQVGQQLSESGLEGLLPEALVAGIADALEGKHPAVPVDVVHRALREIHERADAVRRQRFQTMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 10631 - DNA, 783 bp, Vibrio vulnificus CMCP6
  CDS (1)..(783): transl_table=11
atgaaatcagttttaaaagtgtcactgcttgcagctactgtaatgctggcagtcggctgtcagaaagaagaagcaaaaccagcagccgcaccacaagcagagcaggtacaggcagaaaccggtaaagcggttcactttaaatcagaagatgacaaagcggcttacgcgattggcgtgtcgtttgctaactacctaagtgcaagcctagacaagccaagtgaaattggtatcaacctaaataaagatttggtgcttaaaggtatcgagcatgtttttgctggtaaccctgagctgaatgaagaagaaacacgcgcggcactagaagcgctagataagcgcgtagctgaaaccatgcagaagaaagcggcagaaaaagcagaagctgcaaagaaagccggtgatgaattccgcgctgagtttgaaaaacaagaaggtgtggtgaagacggacactggtcttctataccaagtgatcacgcctgctgaaggtgagaaaccaaaagacaccgacacagttcaagttcactacaaaggtacattaacagatggtactcagttcgatagctcttacgatcgtggtgagccagcaactttcccactgaaccgagttatcccaggttggacggaaggtgttcaattgatgccagtaggttctaagttcaagttcgttattccacctgagctagcgtacggcgcgcaagacacgccaagcattccagcgaactcaacattggtgttcgaagtcgaactattgaagattgaaaacggcgacaacgcgcagtaa

SEQ ID NO: 10632 - protein, 260 aa, Vibrio vulnificus CMCP6
MKSVLKVSLLAATVMLAVGCQKEEAKPAAAPQAEQVQAETGKAVHFKSEDDKAAYAIGVSFANYLSASLDKPSEIGINLNKDLVLKGIEHVFAGNPELNEEETRAALEALDKRVAETMQKKAAEKAEAAKKAGDEFRAEFEKQEGVVKTDTGLLYQVITPAEGEKPKDTDTVQVHYKGTLTDGTQFDSSYDRGEPATFPLNRVIPGWTEGVQLMPVGSKFKFVIPPELAYGAQDTPSIPANSTLVFEVELLKIENGDNAQ

SEQ ID NO: 10633 - DNA, 699 bp, Xylella fastidiosa Temecula1
  CDS (1)..(699): transl_table=11
ttgatctctgaggaagttgctcagacaaccgatactgcgctgcgtgccatgttggcagctcgttccgggcaacaggaagcttcggggactgcgccgcctgctgtatccaaagagaacattggtctcatgcttgggagctatatggtcggcccgtcgctgctggcgatcaaggatgatattgatcttcctgtgcttctacaggcactgcgtaccagattcgcaaagcgcacaccgttgatggatgaacaagaaatgaccacaaggatgcaagcatttgtggcctctaaaaatgctgtggttgcaggaaaaaatcgtgatgagggcagtgcttttctctctaagaacaagaacgagaagggcgtggtcaccaccgcttcaggtcttcagtacatggtgttgcggcagggaagcggctcacgtccgaccccaagtaataatgtgcgtgtcaactacgagggcaagctgctcagcggtcaagtgtttgatagctcttatcagcgtggtcagccggccgagtttggtcttggtcaggtgattaaagggtggtctgaggggctgtcgttgatgcctgtcggttctaagtaccgtttttggattcctgctgatcttgcttacgggcagcaggggactccgggtggtccgattggtcctgatgcaacgttgacctttgacgtggagctgctcagtatcctcccttaa

SEQ ID NO: 10634 - protein, 232 aa, Xylella fastidiosa Temecula1
MISEEVAQTTDTALRAMLAARSGQQEASGTAPPAVSKENIGLMLGSYMVGPSLLAIKDDIDLPVLLQALRTRFAKRTPLMDEQEMTTRMQAFVASKNAVVAGKNRDEGSAFLSKNKNEKGVVTTASGLQYMVLRQGSGSRPTPSNNVRVNYEGKLLSGQVFDSSYQRGQPAEFGLGQVIKGWSEGLSLMPVGSKYRFWIPADLAYGQQGTPGGPIGPDATLTFDVELLSILP

SEQ ID NO: 10635 - DNA, 675 bp, Pseudomonas syringae pv. tomato str. DC3000
  CDS (1)..(675): transl_table=11
atgtcgcgctacttgttaacgtcgttgttcctcttgctacccttggctcaagccgccgaagcaccaccggacaatgatgctcatgaccttgcatacagtctgggcgccagtcttggcgagcgcctgcatcaggaagtcccggaccttgatctgaaggcgttggtcgatggtttgaaacaggcttatcagggcaagccgcttgcgctcaaacaggagcgtattgaccagatcctgcgtgagcatgatgcagcgatcgcgcaagccgagaccgcaggtaccgatgcgcctaccgaagccgccctcaaggccgagcgcacgttcatggccggcgagaaggccaagccaggcgtcaaggaactggccgatggcattctcatgaccgagctgacaccgggcaccggccccaagcctgatgccaatggcagagtcgaagtgcgttatgtcggtcgtttgccggacggcaagatcttcgatcagagcacccagcctcagtggttcaggctcgacagcgtgatcagtggctggaccagcgcgttgcagaacatgccgaccggcgcgaagtggcgcctggtgatcccttcggatcaagcctacggcgccgaaggtgctggcgacctgatcgatccgttcacaccgctggtgttcgagatcgagctgatcgcggtttcacagtaa

SEQ ID NO: 10636 - protein, 224 aa, Pseudomonas syringae pv. tomato str. DC3000
MSRYLLTSLFLLLPLAQAAEAPPDNDAHDLAYSLGASLGERLHQEVPDLDLKALVDGLKQAYQGKPLALKQERIDQILREHDAAIAQAETAGTDAPTEAALKAERTFMAGEKAKPGVKELADGILMTELTPGTGPKPDANGRVEVRYVGRLPDGKIFDQSTQPQWFRLDSVISGWTSALQNMPTGAKWRLVIPSDQAYGAEGAGDLIDPFTPLVFEIELIAVSQ

SEQ ID NO: 10637 - DNA, 774 bp, Pseudomonas syringae pv. tomato str. DC3000
  CDS (1)..(774): transl_table=11
atgaaacagcatcggttggcagcggcgattgccctggtcggtctggtactcgcaggttgtgataagcaggccagcaccgtagagctgaaaactccagcacaaaaagcgtcttatggcatcggtctgaacatgggcaaaagcctggctcaggaaggcatggatgatctcgactccaaggctgtagccctgggtatcgaagacgccgtcggcaagaaagatcagaaactcaaggatgaagagctggttgaagccttctctgcgctgcagaagcgttccgaagagcgtctggcgaagatgagtgaagaagcatcggcagccggcaagaagttcctcgaagagaacggcaagaaggatggcgtggttaccaccgcttccggcttgcagtatcagatcatcaagaaagctgatggcgctcagccaaagccgactgatgttgtgactgttcactacgaaggcaagctgattgacggcaaggtgtttgacagctccgttgaacgcggcagccccattgatctgccggttggcggcgttatcccgggttgggtcgaaggtctgcaactgatgcacgtaggcgagaaggtcaaacttttcatccctagtgatctggcttacggtgcccagagcccgagcccggcgatcccggccaattcggttctggtctttgacctcgaattgctcggcatcaaagacccggcggctgctccggctgttggcgctgacgccgacgaagaagaagacgcagcacctgctgcatcggctccagccaagaagtaa

SEQ ID NO: 10638 - protein, 257 aa, Pseudomonas syringae pv. tomato str. DC3000
MKQHRLAAAIALVGLVLAGCDKQASTVELKTPAQKASYGIGLNMGKSLAQEGMDDLDSKAVALGIEDAVGKKDQKLKDEELVEAFSALQKRSEERLAKMSEEASAAGKKFLEENGKKDGVVTTASGLQYQIIKKADGAQPKPTDVVTVHYEGKLIDGKVFDSSVERGSPIDLPVGGVIPGWVEGLQLMHVGEKVKLFIPSDLAYGAQSPSPAIPANSVLVFDLELLGIKDPAAAPAVGADADEEEDAAPAASAPAKK

SEQ ID NO: 10639 - DNA, 675 bp, Pseudomonas syringae pv. tomato str. DC3000
  CDS (1)..(675): transl_table=11
atgaccgttcaggttttacgcaattatcgactgcgtgcccctcagcggagcagtgtcatgtccgaagtcaatctgtccaccgacgaaacccgcgtcagctacggcatcggccgtcagttgggcgaccagttgcgcgacaacccgccaccgggcgtcaatctggaggccatcgtggcaggcctgcgcgatgcgtttggcggtcagccaagccgtgtcggtcaggaagaaatgtccgccagcttcaaggtcatccgtgaaatcatgcaggccgaagcggccgccaaggccgaacaggctgcaggtgccggcaaggcttacctggctgaaaatgccaagcgcgaaggcgtgaccacactggcttccggtcttcaatttgaagcgctgacttccggtgatggcgccaagccaacccgtgaagaccaggtgcgcgtgcactatcacggcacgctgatcgacggcactgtcttcgacagctcttacgatcgtggcgaacctgccgagtttccggtcagcggcgtgatcgcgggctggaccgaagcactgcaattgatgaacgccggcagcaaatggcgtctgcacgtgccgagcgaactggcttacggcgctcagggcgtcggcagcatcgcaccgcacagcgtgctggtgttcgacgtggaactgctggacgttctgtaa

SEQ ID NO: 10640 - protein, 224 aa, Pseudomonas syringae pv. tomato str. DC3000
MTVQVLRNYRLRAPQRSSVMSEVNLSTDETRVSYGIGRQLGDQLRDNPPPGVNLEAIVAGLRDAFGGQPSRVGQEEMSASFKVIREIMQAEAAAKAEQAAGAGKAYLAENAKREGVTTLASGLQFEALTSGDGAKPTREDQVRVHYHGTLIDGTVFDSSYDRGEPAEFPVSGVIAGWTEALQLMNAGSKWRLHVPSELAYGAQGVGSIAPHSVLVFDVELLDVL

SEQ ID NO: 10641 - DNA, 621 bp, Vibrio parahaemolyticus RIMD 2210633
  CDS (1)..(621): transl_table=11
atgtctgaaattaaatttgaaactgcagaacaaaaagcaagctacggcattggtctgcaaatgggtcagcaactagctggctctggtcttgaaggccttagcgttgacgctatcgctgcgggtatcgcaacagcattgactggcgaaatgccatcaatcgaaattgacgaaatcaacaatgcactgcaagagctacactctcgcgcagaagcagctcgtcaagaagcagctaaagcagcagcagctgatggtgaagcgttcctaaaagacaacgctctacgtccagaagttaatgttcttgaatctggcctacagtacgaaatcatcaatgaaggtactggcgaaatcccaacagctgataaatctgtacgtgttcactaccacggtgaactaacagacggcacagtattcgacagctctgtatctcgcggccaaccagctgagttcccagtaactggcgtaattaaaggttgggttgaagctctacaactaatgcctgtaggttctaagtggaaactatacatcccacaagaccttgcgtacggtgaacgtggcgcaggcgctgcaatccctccattcgcagcactagtattcgaagttgagctactagacattctataa

SEQ ID NO: 10642 - protein, 206 aa, Vibrio parahaemolyticus RIMD 2210633
MSEIKFETAEQKASYGIGLQMGQQLAGSGLEGLSVDAIAAGIATALTGEMPSIEIDEINNALQELHSRAEAARQEAAKAAAADGEAFLKDNALRPEVNVLESGLQYEIINEGTGEIPTADKSVRVHYHGELTDGTVFDSSVSRGQPAEFPVTGVIKGWVEALQLMPVGSKWKLYIPQDLAYGERGAGAAIPPFAALVFEVELLDIL

SEQ ID NO: 10643 - DNA, 783 bp, Vibrio parahaemolyticus RIMD 2210633
  CDS (1)..(783): transl_table=11
atgaaatcagttttaaaagtgtcgctacttgctgcaacagtaatgctagcggtaggttgtcagaaagaagaaacaaaaccagaagcagcacctcaagcagaacaagttcaagcagaaacaggtaaagcggttcactttaaaaccgacgacgacaaagcggcatacgcaatcggtgtttcatttgctaactacctaagcactagcatcgaaaaaccaagcgaaatcggtatcaacctaaacaaagaccttgttcttaaaggtatcgaagatgtctttaaaggcaacgcagagctaaacgaagaagaaacacgtgctgctctagagtctctagacaagcgtgttgctgagaagatgcaagcacaagcagcagaaaaagcagcggcagcgaaaaaagctggcgatgatttccgtgcggaattcgaaaagcaagaaggcgtagtgaaaacagacacaggtcttctataccaagtaatcacacctgctgaaggcgagaagccaaaagacactgacactgtacaagtacactacaaaggtacgttgattgacggtactcagttcgacagctcttacgatcgtggtgagccagcaacgttccctctaaaccgtgttatcccaggttggacagaaggtgttcagctaatgccagtgggttctaaattcaaatttgttatcccgccagagcttgcatacggtgaccaagacacgccaagcattccagcaaactcaacacttgtatttgaagttgagctactaaaagttgagaatgacaaagctgagcaataa

SEQ ID NO: 10644 - protein, 260 aa, Vibrio parahaemolyticus RIMD 2210633
MKSVLKVSLLAATVMLAVGCQKEETKPEAAPQAEQVQAETGKAVHFKTDDDKAAYAIGVSFANYLSTSIEKPSEIGINLNKDLVLKGIEDVFKGNAELNEEETRAALESLDKRVAEKMQAQAAEKAAAAKKAGDDFRAEFEKQEGVVKTDTGLLYQVITPAEGEKPKDTDTVQVHYKGTLIDGTQFDSSYDRGEPATFPLNRVIPGWTEGVQLMPVGSKFKFVIPPELAYGDQDTPSIPANSTLVFEVELLKVENDKAEQ

SEQ ID NO: 10645 - DNA, 876 bp, Bacteroides thetaiotaomicron VPI-5482
  CDS (1)..(876): transl_table=11
atgaaaaaagttagtatttttatggcaatcgccgctgctgcaagtcttgcttcttgtacagctcaagctcctaaagcaaatctgaaaacagacatcgactcactgtcttactctatcggtatggctcagactcaaggtctgaaaggctatctgacaggccgtctggacgttgatactgcttacatggcagaattcatcaaaggtttgaacgaaggtgcaaacaagactagcaagaaagacatcgcttatatggcaggtcttcagatcggtcagcagatcagcaaccagatgatgaagggtatcaaccaagaactgttcgctggtgactctaccaaaacgatcagcaaagacaacttcatggctggtttcatcgcaggtacactggaaaaaggtggcgtgatgactatggaagctgctcaggaatatactcgcacagctatggaaactatcaaagcgaaagctatggaagaaaaatacgctgacaataaagctgccggtgaaaaattccttgctgaaaacaaaactaaagaaggtgtgaaaactactgaaagcggattgcagtacaaagtaatcactgaaggtaaaggtgaaatccctgccgacacttgcaaagtgaaagtgaactataaaggtactttgatcgacggtacagaattcgacagctcttacaaacgtaacgagcctgctactttccgtgccaaccaagtaatcaaaggctggacagaagctctgactatgatgcctgtaggttctaaatgggaactttacatcccgcaagaactcgcttacggttcaagagaatcaggacagatcaaaccgttctctactctgattttcgaagttgagttggtaggtatcgaaaaagataagaaataa

SEQ ID NO: 10646 - protein, 291 aa, Bacteroides thetaiotaomicron VPI-5482
MKKVSIFMAIAAAASLASCTAQAPKANLKTDIDSLSYSIGMAQTQGLKGYLTGRLDVDTAYMAEFIKGLNEGANKTSKKDIAYMAGLQIGQQISNQMMKGINQELFAGDSTKTISKDNFMAGFIAGTLEKGGVMTMEAAQEYTRTAMETIKAKAMEEKYADNKAAGEKFLAENKTKEGVKTTESGLQYKVITEGKGEIPADTCKVKVNYKGTLIDGTEFDSSYKRNEPATFRANQVIKGWTEALTMMPVGSKWELYIPQELAYGSRESGQIKPFSTLIFEVELVGIEKDKK

SEQ ID NO: 10647 - DNA, 1005 bp, Streptomyces avermitilis MA-4680
  CDS (1)..(1005): transl_table=11
gtgcgccgacgctcagttcttctcgccgtgccggccggactggtcacgctcgccggatgcggtgacgaaaagtccgacacggccaagaccaagcccagcaccagcccgtctccgtcggcctccgcatcgtcggccccgccccccaagatcgtcgacggcccgctgccggccatcaccgccggtaccaagttcgacgagaagccgaccgtggccaagggcagcggcgacccctcgaaggacgtggcggtcaagacggtcatcgcgggcagcggcaagacggtcgcggagaacgactacatccaggcgaactacctgggccaggtctgggacacggcgaaggtcttcgacaactcctacgaccgcaagacgccgctggtcatccagctcgcccagggaagcatcatcgacggctggcgctatgcgctggcgggcaagaaggccggcagccgggtcctgatgtccgtgccgcccacctggggctacggcaagcagggcaactcgcaggcgggcatcaagggcaccgacaccctggtgttcgtggtcgacatccagaacacgttcaacgcgaagagctccgcccagggcaaggacgtcgcacagggcgacgccaagctgccgaaggtcggcaccaacaccgacggcaaggccccctccatcgacgtaccgaagacggccgccccgacgaagctcgtggcgaactacgtcatcgagggcgacggcgacgtggtcaaggcggacagcagcgtcctcgtgcagtacaagggcgtgctctgggacaccggcaaggagttcgactccacgtacagccgctcggcgctgacgtccttctcgctgcagcaggtcgtcaagggctggtcccagggtctgaccggcaagaaggtgggcagccgcgtactcatcgtggtgccgccgaagctgggttacggcgacagcccgccgagcgggagcggcatcgagaaggactccaccctggtcttctccgtcgacatcctggcgaagatgtaa

SEQ ID NO: 10648 - protein, 334 aa, Streptomyces avermitilis MA-4680
MRRRSVLLAVPAGLVTLAGCGDEKSDTAKTKPSTSPSPSASASSAPPPKIVDGPLPAITAGTKFDEKPTVAKGSGDPSKDVAVKTVIAGSGKTVAENDYIQANYLGQVWDTAKVFDNSYDRKTPLVIQLAQGSIIDGWRYALAGKKAGSRVLMSVPPTWGYGKQGNSQAGIKGTDTLVFVVDIQNTFNAKSSAQGKDVAQGDAKLPKVGTNTDGKAPSIDVPKTAAPTKLVANYVIEGDGDVVKADSSVLVQYKGVLWDTGKEFDSTYSRSALTSFSLQQVVKGWSQGLTGKKVGSRVLIVVPPKLGYGDSPPSGSGIEKDSTLVFSVDILAKM

SEQ ID NO: 10649 - DNA, 768 bp, Chlamydophila caviae GPIC
  CDS (1)..(768): transl_table=11
atgaaaaaacgatggcatttaatgataataacaatggttgtgtccttttccattgcttcctgtgattcaagttctcaaagagggaaccaaatagcacaagttgaggagaaaagcgctgccaacgattcgcaactttctgtaaatcaacagatatcgcgtactttcggtcatttgctcgcaagacagttacgcaaatcagaagatatcatgatggatatcgctgaggttgctaaaggattgcaaggtgagctagaatgcaaaagcgcacctttaactgaatcagaatatgaggaaaaaatggcagaaatacagaaattagttttcgagaaaaaagcgaaggaaaatctctccttggcagaaagattcctacaagaaaataagaaaaattcaggtgttgtcgaagtacaagctgataaactgcaataccgcattgtcaaagaaggtacagggagagctatttcaggtaagccttcagcgcttcttcactacaaggggacttttatcgatggtcaggtatttagtagctcagaagctaataaagagcctattcttcttcctctagcacaaacaatacctggatttgctttaggtatgcagggaatgaaagaaggtgaaactcgtatcctttacatccatcctgatcttgcttatggaacttctggccaactgcctccgaactctttattgatttttgaaatcaatttaatcgaaactacagatgattctgtagcagcacaaaacacagagaatgaaaacactgcctcatga

SEQ ID NO: 10650 - protein, 255 aa, Chlamydophila caviae GPIC
MKKRWHLMIITMVVSFSIASCDSSSQRGNQIAQVEEKSAANDSQLSVNQQISRTFGHLLARQLRKSEDIMMDIAEVAKGLQGELECKSAPLTESEYEEKMAEIQKLVFEKKAKENLSLAERFLQENKKNSGVVEVQADKLQYRIVKEGTGRAISGKPSALLHYKGTFIDGQVFSSSEANKEPILLPLAQTIPGFALGMQGMKEGETRILYIHPDLAYGTSGQLPPNSLLIFEINLIETTDDSVAAQNTENENTAS

SEQ ID NO: 10651 - DNA, 717 bp, Rhodopirellula baltica SH 1
  CDS (1)..(717): transl_table=11
atgccccgtctctcccgcctaattcccaccctctgtttggccacgttcgtcatgacctcccccggcaacgcccaagatgattctgcggccaaggtcgatgatcaactcggctacttcctcggattcaccgtcggcaactctttcgttcaacaaggtttcgaaccaaccgacttcaccgtcgaaggtatgaaccaaggtctgaaagacgcgttgtcagaaaaggacccagcgttgtccgacgaacaactgcaagaaatccaaggcaagattcaagccatgatgcagaagcgtcaggcggagcggatggccgagcttaaaaagcaaggcgtgatgaacaaagagaagagcgacttgtggctgaaacaaaacgccaaggcgaagggcatcaaagaactcgagggtggactgcaatataaagtggtcaaggaaggcgaaggagcatccccgaccgctgaagacaccgtcgcggttcactacaccggcaaactgaccaatggcgaagtcttcgacagttcggtcgagcgtggtcaacctgccaagttccctgtcggtcgagtgatccaaggatggcagatggctcttcagaagatgaaggttggttcgaaatggatgctctacattccaccagaattggcatacggcgagaacggttcgccaccaaagatcggacccaacgaagtgttggttttcgaagtcgagttgcttgagattttgtag

SEQ ID NO: 10652 - protein, 238 aa, Rhodopirellula baltica SH 1
MPRLSRLIPTLCLATFVMTSPGNAQDDSAAKVDDQLGYFLGFTVGNSFVQQGFEPTDFTVEGMNQGLKDALSEKDPALSDEQLQEIQGKIQAMMQKRQAERMAELKKQGVMNKEKSDLWLKQNAKAKGIKELEGGLQYKVVKEGEGASPTAEDTVAVHYTGKLTNGEVFDSSVERGQPAKFPVGRVIQGWQMALQKMKVGSKWMLYIPPELAYGENGSPPKIGPNEVLVFEVELLEIL

SEQ ID NO: 10653 - DNA, 735 bp, Haemophilus ducreyi 35000HP
  CDS (1)..(735): transl_table=11
atgttaaaaaataaactctcaactcttgcattagtagtaggtacattatttgcctctcaagcaacatttgcagaaaaagcagatcaagcatttgtgaatgattcatcttatgcggtaggtgtcttaatgggtaaaaatatccaaggcgtcatcgaatcccaaaaagaggttttttcttataatcaagagaaaatcttagtgggcgtacaagataccttaaaaaaaaccggtaaacttactgacgaagaactacaaaaacaattaaaagcactagatacttaccttgctaaacaagaaagcaaaatagctgctgaaaaaagtaaagcaactaaagaagcgggcgacaaattccgcgcagaatatgagaaaaaagcaggcgtgaaaaaaaccgcttcaggcttactctacaaaattgaaaaagcaggtacaggcgcatcaccaaaagctgaagatatcgtaatagcacactacaaaggcacattaccagatggcacagtatttgatagttcatatgaacgcaatgaaccaatcgaactacaattaaaacaattaattccagcgtggattgaagcgattccaatgctgaaaaaaggtggaaaaatggaaattgttgcaccacctaaattagcttatggcgaccgcccatcgggcaaagtaccggcaaatgcaacattgaaatttgaaattgaattattagatttcaaaccaactgccgcgcaaccaaagaaaaaataa

SEQ ID NO: 10654 - protein, 244 aa, Haemophilus ducreyi 35000HP
MLKNKLSTLALVVGTLFASQATFAEKADQAFVNDSSYAVGVLMGKNIQGVIESQKEVFSYNQEKILVGVQDTLKKTGKLTDEELQKQLKALDTYLAKQESKIAAEKSKATKEAGDKFRAEYEKKAGVKKTASGLLYKIEKAGTGASPKAEDIVIAHYKGTLPDGTVFDSSYERNEPIELQLKQLIPAWIEAIPMLKKGGKMEIVAPPKLAYGDRPSGKVPANATLKFEIELLDFKPTAAQPKKK

SEQ ID NO: 10655 - DNA, 831 bp, Porphyromonas gingivalis W83
  CDS (1)..(831): transl_table=11
atgaaaaaaacaattgcaattatcgcctcagccctcttggctttaggagccgtcggctgtaagaaaaatgctgacactaccgctgtcagtgaaaaggatagcatagccttgtccatgggtattttgtacggacaggattttgccaatcagttcgaaatgtcccgcttgcaaggccagccgattgattcggtagctttcttggacggtttcaaatatggtatcgatacgacgcgcttctcgtacaatctgggagccatctatgcttccaatatagctcgtcagctggctcatgattccatcgatatcgacaagttctatgcagccatgcgtgcggctcttcttaaagacaccgtatctatcgccatgaagcctgcagatgcacaggctttcatgcaacgaatccaagccaaaaagcagcgagaaaacaatatgaagcagtttggccagaacatcgaaaagggtaatgaatacatcgatacctttaaaaaagaagatggtgtaactgttacgacaagtggtctggcatacaagactcttcaggaaggtacgggagctactccctctttggccgatactgtacgtgtcaagtatgtgggtactctggtcgatggtaaagagttcgacaaaaacgaagaaggaatcgaatttgccgttaccggtgtgattaaaggctggacggagatgctccaactcatgaaggtcggtcagaaagttcgcgtggtaatcccacaggagctggcttatggggagaccggcaactataccatcgaaccgttctctaccctgacgttcgagatggaacttatcgggatcaagcccgggaaaaagtaa

SEQ ID NO: 10656 - protein, 276 aa, Porphyromonas gingivalis W83
MKKTIAIIASALLALGAVGCKKNADTTAVSEKDSIALSMGILYGQDFANQFEMSRLQGQPIDSVAFLDGFKYGIDTTRFSYNLGAIYASNIARQLAHDSIDIDKFYAAMRAALLKDTVSIAMKPADAQAFMQRIQAKKQRENNMKQFGQNIEKGNEYIDTFKKEDGVTVTTSGLAYKTLQEGTGATPSLADTVRVKYVGTLVDGKEFDKNEEGIEFAVTGVIKGWTEMLQLMKVGQKVRVVIPQELAYGETGNYTIEPFSTLTFEMELIGIKPGKK

SEQ ID NO: 10657 - DNA, 762 bp, Porphyromonas gingivalis W83
  CDS (1)..(762): transl_table=11
atgatcattgccggcttagcctttttagtggccggattatctgcctttgcaaaaaaaccgcccaaaaaggatgaggtgcaaaccgtgaagcctatcgtgacttctgctgactctgtggcatacgctttcggtataagcggagcaataaatttcaatgactataccggacggatgccgggcgattctctggatcgtgccctgattctccgagcattcgaagaagtactcatgggaaagagcactgctatctcttcccaaaatgcggacgaaatgatcaagaaatacttcaaggaagtacaggacagactcaaagccgaaaacttggcagcaggcaaagcttatcaggaagaatatcgcaagcagccgggcgttaaggctaccgaaagcggtttgttgtatcgtgtcttgaaggaaggggaaggacctcgcccgacggttcaggatacggtcgttgttcattatgtgggcaagaacattgaagggaaagaattcgacagctcttattctcgcaacgagccggcaaagttcagcctcctgcaagtgattccgggatggactgagggtgtttgtctgatgcaaaagggtgccaagtacgaatttgttatcccgaccgaactgggatatggcgaacgtagcatgggcgaacttctcaagccgaactctacgcttttcttcgaagtagaactactcgaaatcaagcctttcgtagagaagccggcaaagcctatcccggcaaaacctactccaaataagaaaaactaa

SEQ ID NO: 10658 - protein, 253 aa, Porphyromonas gingivalis W83
MIIAGLAFLVAGLSAFAKKPPKKDEVQTVKPIVTSADSVAYAFGISGAINFNDYTGRMPGDSLDRALILRAFEEVLMGKSTAISSQNADEMIKKYFKEVQDRLKAENLAAGKAYQEEYRKQPGVKATESGLLYRVLKEGEGPRPTVQDTVVVHYVGKNIEGKEFDSSYSRNEPAKFSLLQVIPGWTEGVCLMQKGAKYEFVIPTELGYGERSMGELLKPNSTLFFEVELLEIKPFVEKPAKPIPAKPTPNKKN

SEQ ID NO: 10659 - DNA, 588 bp, Porphyromonas gingivalis W83
  CDS (1)..(588): transl_table=11
atggataaagtgagctatgctctgggattgagcatcggtaataatttcaagtcttcgggcatcgacagcgtcgttatggatgatttcatgcaaggtctgtctgatgtactggaagaaaaagcccctcagctctcgtatgacgaggccaagcgcgaaatagaggcgtatttcatggatttgcagcagaaggctgtcaaactgaacaaagaggccggagaagaattcctcaagataaatgcacacaaggaaggtgtgacgaccttaccgagcggcttgcaatacgaagtcattaagatgggagagggcccgaaacccaccctttcggacacggtaacctgtcattatcacggtacgctcatcaacggtatcgttttcgatagctctatggacaggggagaaccggccagtttccctctaagaggagttatagccggctggacggagattcttcaattaatgcctgtaggatccaagtggaaagtaactataccgagcgatctggcgtatggagatcgtggtgccggcgaacatatcaaaccgggtagtacgctcatttttataatcgaattattgagtatcaacaaataa

SEQ ID NO: 10660 - protein, 195 aa, Porphyromonas gingivalis W83
MDKVSYALGLSIGNNFKSSGIDSVVMDDFMQGLSDVLEEKAPQLSYDEAKREIEAYFMDLQQKAVKLNKEAGEEFLKINAHKEGVTTLPSGLQYEVIKMGEGPKPTLSDTVTCHYHGTLINGIVFDSSMDRGEPASFPLRGVIAGWTEILQLMPVGSKWKVTIPSDLAYGDRGAGEHIKPGSTLIFIIELLSINK

SEQ ID NO: 10661 - DNA, 792 bp, Wolinella succinogenes DSM 1740
  CDS (1)..(792): transl_table=11
atgagcgttaaaaaaatctctgttgggttgtttctgttggcctgtttggtttctcaaggaatcgcaagtgatctgaaaacagatgtgcaaaaagaatcgtatagcattggagcgtccatgggcgcttatgtctccaatcaactttttgagcaatctcagctcggcgctaaggcggatgtccaagcgttgattgatgggtttgtggatgctttgaaaaaacagcaaaaactctctgatgatgagatcatcacgcatcttaacaatcgagccgagggtttgaacaaaatcagccaagagagatttaaacaacagcttgatcagaggctcaaagagggcaaaaagtatctcgccaacaacgccaaaaacaaaaaagttctcaccaccaagacaggccttcaatatgaagaattggtcgctggtaaaggggagagacccaagaaagagagcattgtcatgattcactacaaagggactcttgtggatgggacaccctttgatagcacctatgagcgtcaaacccctgcccatctctccatggtcaatgtgattgatggtttgcaagaggggctcatgcttatgaaggagggcgagaaggctagattggtgattcctagtgatctggcgtatggcaatgcggatgtccaagcgattcctgcgggctcaacagtggtttttgaggtggagcttttgaaggtgctcaagcctggcgagctagctgatagtgccaaaccgcttagcgatgaggtcaaaaaagaggttgaagaaatggggaaaaagcccatcaaaggctag

SEQ ID NO: 10662 - protein, 263 aa, Wolinella succinogenes DSM 1740
MSVKKISVGLFLLACLVSQGIASDLKTDVQKESYSIGASMGAYVSNQLFEQSQLGAKADVQALIDGFVDALKKQQKLSDDEIITHLNNRAEGLNKISQERFKQQLDQRLKEGKKYLANNAKNKKVLTTKTGLQYEELVAGKGERPKKESIVMIHYKGTLVDGTPFDSTYERQTPAHLSMVNVIDGLQEGLMLMKEGEKARLVIPSDLAYGNADVQAIPAGSTVVFEVELLKVLKPGELADSAKPLSDEVKKEVEEMGKKPIKG

SEQ ID NO: 10663 - DNA, 765 bp, Photorhabdus luminescens subsp. laumondii TTO1
  CDS (1)..(765): transl_table=11
atgaaatcattgtttaaagttaccctgcttgctaccacattagcgatggctttcagcgcccctcaggtgttggcggctaaagcagatagccagagtagtacagaattgaacagcgcatttaaaacagaagatcagcaaaatgcttatgctctgggcgcatctttagggcgttatatgcaaaacaccctgaaagaacagaaatctctgggtatcccattggataaagatcaattgttatcgggtgtgcaggatgctttcaataataagagcaaactgactgacagcgaaattgaaaatacgctgcgtgcgtttgaaggtaaagtgaagtctgctgctgaagctaagatggaaaaagaagccagcgagaatgaagctaaaggcgttaaatatcgtgaagaatttgctaaggaaaagggtgtcgttaagagtaaaaccggccttttgtataaaatagagaaggaaggcagtggtaagaagcctgtggcaagcgacacggtagttgtgaactaccgggggacattgattgacggtaaagagttcgatagttcctataagcgtaatgaacccctttctattcgcctggatagcgttatcccaggttggacagaaggtttacagaatgtgaaaaaaggcggaaaaattaaactggttattccaccagagctggcctatggtaaagcggatctgccgggtattcctgcaaattcgacactagtatttgatattgagctgctggatgttaaagcggagaccaaagctaagtaa

SEQ ID NO: 10664 - protein, 254 aa, Photorhabdus luminescens subsp. laumondii TTO1
MKSLFKVTLLATTLAMAFSAPQVLAAKADSQSSTELNSAFKTEDQQNAYALGASLGRYMQNTLKEQKSLGIPLDKDQLLSGVQDAFNNKSKLTDSEIENTLRAFEGKVKSAAEAKMEKEASENEAKGVKYREEFAKEKGVVKSKTGLLYKIEKEGSGKKPVASDTVVVNYRGTLIDGKEFDSSYKRNEPLSIRLDSVIPGWTEGLQNVKKGGKIKLVIPPELAYGKADLPGIPANSTLVFDIELLDVKAETKAK

SEQ ID NO: 10665 - DNA, 621 bp, Photorhabdus luminescens subsp. laumondii TTO1
  CDS (1)..(621): transl_table=11
atggcaaaactttcttttgactctatcgaagcacaagcaagttatggggttggcttgcaagttggtcagcaattactggagtctggcctgcaaggtctggaacctgaagcgttgttagcggggttatgcgatgcgctggaaaatcattctccagcggtgccggtcgatatattgcatcgtgccttacgtgaaatgcatgaacgtgcagatggtgtgcgtcgtgaacgtcagcaagttatggcagaagagggacagaaatttctggcagaaaatgctcagcgtgacggtataagcacgacagaatctggtttacagttctctgtactaaagcagggtgatggtgcaattcctgcccatactgaccacgtgcgtgtccattacacggggcgtctgattgatggcaccgtgtttgacagctcagtacagcgtggtgaacctgctgaatttcctgtgaatggggtgattgctggatggattgaagcattgacgttgatgcctgtcggttctaaatgggaactttatatcccttataatttggcttatggcgagcgtggtgccggtgcatcgattcccccatatagcactctgattttcgaggtggaattgttggatattctgtaa

SEQ ID NO: 10666 - protein, 206 aa, Photorhabdus luminescens subsp. laumondii TTO1
MAKLSFDSIEAQASYGVGLQVGQQLLESGLQGLEPEALLAGLCDALENHSPAVPVDILHRALREMHERADGVRRERQQVMAEEGQKFLAENAQRDGISTTESGLQFSVLKQGDGAIPAHTDHVRVHYTGRLIDGTVFDSSVQRGEPAEFPVNGVIAGWIEALTLMPVGSKWELYIPYNLAYGERGAGASIPPYSTLIFEVELLDIL

SEQ ID NO: 10667 - DNA, 630 bp, Vibrio vulnificus YJ016
  CDS (1)..(630): transl_table=11
gtgacttttatgtctgacattaaatttgaaaccgtagaagagaaagcaagctacggtatcggcctacaaatgggccagcagctagcaggttcaggtcttgatggcctaaacgttgcagccatcgcagcgggtatcgccacatctctaacaggcgacatgccagcggtagaagtagacgaaatcaacaaagcgctacacgagctatacactcgcgcagaatctgcgcgtgcagaagcggcaaaagccgcagcggctgacggcgaggtattcctaaaagacaacgcgcttcgtccagaagtaacggttcttgagtctggcctgcaatacgaaatcatcaccgaaggtaatggcgaaatcccaacgtcagacaaaaccgtacgtgttcactaccatggcgaactggttgacggcaccgttttcgatagctcagtatcacgtggccaaccagcgcaattcccagtaacgggtgtgattaaaggttgggttgaagcactacaactgatgcctgtaggctctaaatggaaactgtacatcccacacgatcttgcttacggcgagcgtggtgcgggcgcatccattcctccatttgcagcacttgtatttgaagtagaactgctagacatcgtttaa

SEQ ID NO: 10668 - protein, 209 aa, Vibrio vulnificus YJ016
MTFMSDIKFETVEEKASYGIGLQMGQQLAGSGLDGLNVAAIAAGIATSLTGDMPAVEVDEINKALHELYTRAESARAEAAKAAAADGEVFLKDNALRPEVTVLESGLQYEIITEGNGEIPTSDKTVRVHYHGELVDGTVFDSSVSRGQPAQFPVTGVIKGWVEALQLMPVGSKWKLYIPHDLAYGERGAGASIPPFAALVFEVELLDIV

SEQ ID NO: 10669 - DNA, 795 bp, Vibrio vulnificus YJ016
  CDS (1)..(795): transl_table=11
ttggagagtttaatgaaatcagttttaaaagtgtcactgcttgcagctactgtaatgctggcagtcggctgtcagaaagaagaagcaaaaccagcagccgcaccacaagcagagcaggtacaggcagaaaccggtaaagcggttcactttaaatcagaagatgacaaagcggcttacgcgattggcgtgtcgtttgctaactacctaagtgcaagcctagacaagccaagtgaaattggtatcaacctaaataaagatttggtgcttaaaggtatcgagcatgtttttgctggtaaccctgagctgaatgaagaagaaacacgcgcggcactagaagcgctagataagcgcgtagctgaaaccatgcagaagaaagcggcagaaaaagcagaagctgcaaagaaagctggtgatgaattccgcgctgagtttgaaaaacaagaaggtgtggtgaagacggacactggtcttctataccaagtgatcacgcctgctgaaggtgagaaaccaaaagacaccgacacagttcaagttcactacaaaggtacattaacagatggtactcagttcgatagctcttacgatcgtggtgagccagcaactttcccactgaaccgagttatcccaggttggacggaaggtgttcaattgatgccagtaggttctaagttcaagttcgttattccacctgagctagcgtacggcgcgcaagacacgccaagcattccagcgaactcaacattggtgttcgaagtcgaactattgaagattgaaaacggcgacaacgcgcagtaa

SEQ ID NO: 10670 - protein, 264 aa, Vibrio vulnificus YJ016
MESLMKSVLKVSLLAATVMLAVGCQKEEAKPAAAPQAEQVQAETGKAVHFKSEDDKAAYAIGVSFANYLSASLDKPSEIGINLNKDLVLKGIEHVFAGNPELNEEETRAALEALDKRVAETMQKKAAEKAEAAKKAGDEFRAEFEKQEGVVKTDTGLLYQVITPAEGEKPKDTDTVQVHYKGTLTDGTQFDSSYDRGEPATFPLNRVIPGWTEGVQLMPVGSKFKFVIPPELAYGAQDTPSIPANSTLVFEVELLKIENGDNAQ

SEQ ID NO: 10671 - DNA, 696 bp, Bdellovibrio bacteriovorus HD100
  CDS (1)..(696): transl_table=11
atgaataaattggttctgggtggtctggttgttgcggcgatggccttcacaacagcttgccaaaagaaagttaagctcgacactgatatgaaaaaagcgagctatgctatcggtcaacaaatcggtggtaacttgaaacaacaaaacatcgacttcgatgcagatgcattggcgatggctttgaaagacgcagcagcgggtaaaaacgaaatgtctaaagaagacatgcaagctgctatgatgaaacttcaagaaatggcgatgaaaaaacaacaggaacaagctgaaggcaatgctaaagctggtaaagacttcctggagaaaaacaaatctgcagcgggcgtgaagacaactgcttccggtttgcagtacatcgttgaaaaagaaggcactggcgcttctcctaaaaaagaagacgtagtaaaagttcactacaaagggactttgactaacggtgaacagttcgactcttcctacgatcgtggtcaaccggctgaattcccagttggtggcgtgatcccaggttggacagaagctcttcagttgatgaaagttggcggcaaagccaagcttttcatcccacctgagctggcttacggtccatccggtcgtcctggcattccgccaaactctgtgcttgtgttcgaagttgagttgatcgacatcgttaaacaagacactaaaaagaaaaagtaa

SEQ ID NO: 10672 - protein, 231 aa, Bdellovibrio bacteriovorus HD100
MNKLVLGGLVVAAMAFTTACQKKVKLDTDMKKASYAIGQQIGGNLKQQNIDFDADALAMALKDAAAGKNEMSKEDMQAAMMKLQEMAMKKQQEQAEGNAKAGKDFLEKNKSAAGVKTTASGLQYIVEKEGTGASPKKEDVVKVHYKGTLTNGEQFDSSYDRGQPAEFPVGGVIPGWTEALQLMKVGGKAKLFIPPELAYGPSGRPGIPPNSVLVFEVELIDIVKQDTKKKK

SEQ ID NO: 10673 - DNA, 750 bp, Treponema denticola ATCC 35405
  CDS (1)..(750): transl_table=11
atgaaatttattaaaaattttactcttattttatgttgtgcctgcttgttttttgcgtttacatcctgtaaggacaaaaaagcggaaacggaagttccttccgaaaacaatgcagccgatgaaaaggaaaaaatttcggtaaccgaggaagaggtaggctatgccttcggcgttatcatcgcacaaagtgcaaagcaagacggtataaaactcaaccccaagcacattttaaagggctataatgaagcaatggctaaggattttaaagaaacaggacttcaggatgctcagacggttttaaataaggcctttaaaatggctcagatagaaaaggctgcaaaggctcttgaagaagctaatgcctttttggaaaaaaacaaggctaaagagggtgttgtagttaccgaatccggtttgcagtatgaggtgctttcaaaggggaaggaagatttctatcctacagcaaatgatgaagttgaagtcaactatatcggaaaacttatagacgaaagtgtttttgacgattcatataaaagcggttcaagcgtaaaaatccagttatcaagggtgatccccggctggaaagaaggcttacagttgatgagccaggatgcaaaattcagactttatgttccgccggcattggcttacggagaacagggtattactcagggcaatacggttataattccccccaatgctgttttgatttttgacattgagttggtaaatatcttaccccaaaagtag

SEQ ID NO: 10674 - protein, 249 aa, Treponema denticola ATCC 35405
MKFIKNFTLILCCACLFFAFTSCKDKKAETEVPSENNAADEKEKISVTEEEVGYAFGVIIAQSAKQDGIKLNPKHILKGYNEAMAKDFKETGLQDAQTVLNKAFKMAQIEKAAKALEEANAFLEKNKAKEGVVVTESGLQYEVLSKGKEDFYPTANDEVEVNYIGKLIDESVFDDSYKSGSSVKIQLSRVIPGWKEGLQLMSQDAKFRLYVPPALAYGEQGITQGNTVIIPPNAVLIFDIELVNILPQK

SEQ ID NO: 10675 - DNA, 840 bp, Yersinia pestis biovar Microtus str. 91001
  CDS (1)..(840): transl_table=11
ttgcttggggttagagtccttaagccaatggagaaatggatgaaatcactgtttaaagtaacgttgctggctacggccatgacgctaaccctgaatacctcaactgttttcgctgctgacgcaacctcaccagtagtaaccaatagcgcatttaaaaataatgatcagcaatctgcttatgcattaggtgcgtctttgggccgctatatggataattccctgaaagaacaagaaaaattggggattaagttggataaagaccagttgatcgctggtgtgcaagatgcttttgctaacaaaagcaaactgactgacgaagagatcgaaaaaaccctgcaaaattttgaagctcgggtaaaagcgtctgctcaagccaaaatggagcaagatgccaaagaaaacgcggataaaggcgctaagtaccgcgatacctttgctaaagaaaaaggtgtgaagaaaaccgcatctggcctgctgtacaaggtagagaacgccggtacgggtgatgcaccaaaagacagcgatactgttgtcgttaactacaaaggcactttggctgacggaactgagtttgataactcatacaaacgtggcgagccattgtctttccgtctggatggcgttatcccaggctggactgaaggcctgaagcaaatcaaaaaaggtggcaaaatcaccttggttatcccgccagaactggcttacggcaaagcaggcgtccctggtattcctgccaactctactctgatattcgatgtagaactgctggatgtgaaagccgcagctaaagccgatgctcaagagcaacagcctgcggttgatacaaaagctaagaagtaa

SEQ ID NO: 10676 - protein, 279 aa, Yersinia pestis biovar Microtus str. 91001
MLGVRVLKPMEKWMKSLFKVTLLATAMTLTLNTSTVFAADATSPVVTNSAFKNNDQQSAYALGASLGRYMDNSLKEQEKLGIKLDKDQLIAGVQDAFANKSKLTDEEIEKTLQNFEARVKASAQAKMEQDAKENADKGAKYRDTFAKEKGVKKTASGLLYKVENAGTGDAPKDSDTVVVNYKGTLADGTEFDNSYKRGEPLSFRLDGVIPGWTEGLKQIKKGGKITLVIPPELAYGKAGVPGIPANSTLIFDVELLDVKAAAKADAQEQQPAVDTKAKK

SEQ ID NO: 10677 - DNA, 990 bp, Dichelobacter nodosus VCS1703A
  CDS (1)..(990): transl_table=11
atgatgaaaaaaacttctttactattatcagccgcgattgccttgagtttgacgcaggtttatgccggcgttgtgttaaaaaatgaagggcaaaaagtgggttatgccatcggggtggatatgggaagttccattgcgcaattaggtatttctgatggggaagaattggattttaatgccgtgattttgggattgcgcgatgcttatcaaaagaaagatttgcttttaactcaagatgaaatgacgaaaacgctgcaagatttttctgaaaaacgtttgcaagccatgaaaaaagaaatggaaaaaatcgccgctgaagaagcagaaaaaggcaaagcgtttttagaagaaaatgcgaaaaaagacggcgtaattacaacggaatctggtttgcaatataaagttgttaaaaaaggaaccggcgcaaaacccaatagcgacgaccgcgttaccgttgattacaccggcactttgattgacggcaccgaatttgacagctcaaaaggacgcgaacctattacgattaacgtacaagatgttattgctggttgggttgaaggtttgcaactgatgaccgaaggcgctaattatattttctatattccgtctgatttagcttatggctctcgcggcgccggtaacgctattccgcctaatgctactttgatttttgatgtgaatttactcaaaattgaaaaaaatgaagcggaagccgaagctgataaaaaagaatcgattgcaaaatccatcaataaatctttagaagaagccacggaaatcgtaaaagcagaagtggaagctgacaaaaaagaatcgattgcaaaatccattaataaatctttggaagaagccacagaaaccgtaaaagcggaagccgaagctgataaaaaagaagccattgccaattctattaataaatctttagaagaagcggcggaagcggtaaaagaagtgatcgaagcgaaacctgatgaagcggctaaaaaatag

SEQ ID NO: 10678 - protein, 329 aa, Dichelobacter nodosus VCS1703A
MMKKTSLLLSAAIALSLTQVYAGVVLKNEGQKVGYAIGVDMGSSIAQLGISDGEELDFNAVILGLRDAYQKKDLLLTQDEMTKTLQDFSEKRLQAMKKEMEKIAAEEAEKGKAFLEENAKKDGVITTESGLQYKVVKKGTGAKPNSDDRVTVDYTGTLIDGTEFDSSKGREPITINVQDVIAGWVEGLQLMTEGANYIFYIPSDLAYGSRGAGNAIPPNATLIFDVNLLKIEKNEAEAEADKKESIAKSINKSLEEATEIVKAEVEADKKESIAKSINKSLEEATETVKAEAEADKKEAIANSINKSLEEAAEAVKEVIEAKPDEAAKK

SEQ ID NO: 10679 - DNA, 831 bp, Klebsiella pneumoniae subsp. pneumoniae MGH 78578
  CDS (1)..(831): transl_table=11
atgaaatcactgtttaaagtaacgctgctgacggccacaatggccgtcgccctgaatgcaccgctgaccttcgctgcagatacggcaacgaaggcagccccggcggctgagagtaaatcggcatttaaaaatgacgatcagaaatcggcctatgcgctgggcgcgtccctggggcgttacatggaaaactccctgaaagaacaagagaagctgggcattaagctggataaagcccagctgatcgccggcgtacaggacgcgtttgccgataagagcaaactgtccgaccaggagatcgaacagactctgcaggcctttgaaacgcgcgtgaagaccgcggctcagcagaaaatggaaaaagacgccactgagaacgaagccaaaggcaaagctttccgtgacaactttgccaaagagaagggcgtgaaaacctcaaaaactggcctgctgtataaagtcgagaaagaaggcgctggcgatgcgccgaaagacagcgataccgtggtggtaaactacaaaggtaccctgatcgacggtaaagagtttgataactcttatactcgcggcgagccgctctctttccgtctcgacggcgtgatcccgggctggactgaaggcctgaagaacatcaagaaaggcggcaaaatcaagctggttattccgccggacctggcctacggtaaaactggcgtcccgggcatcccggccaactctacgctggtctttgatgtagaactgctggatatcaaaccggcgccgaaggcagatgcacagccggaagccgcaggcgatgcgaaagccgcggacgcgaaagctgacgctaagaagtaa

SEQ ID NO: 10680 - protein, 276 aa, Klebsiella pneumoniae subsp. pneumoniae MGH 78578
MKSLFKVTLLTATMAVALNAPLTFAADTATKAAPAAESKSAFKNDDQKSAYALGASLGRYMENSLKEQEKLGIKLDKAQLIAGVQDAFADKSKLSDQEIEQTLQAFETRVKTAAQQKMEKDATENEAKGKAFRDNFAKEKGVKTSKTGLLYKVEKEGAGDAPKDSDTVVVNYKGTLIDGKEFDNSYTRGEPLSFRLDGVIPGWTEGLKNIKKGGKIKLVIPPDLAYGKTGVPGIPANSTLVFDVELLDIKPAPKADAQPEAAGDAKAADAKADAKK

SEQ ID NO: 10681 - DNA, 681 bp, Klebsiella pneumoniae subsp. pneumoniae MGH 78578
  CDS (1)..(681): transl_table=11
atggctgttatgctttcgcacgcttttatcttgatgtttatcacccaaaaaggaacaacgatggcaaccccaacttttgacactatcgaagcgcaggcaagttacggtatcggcttgcaggttggacaacagctgagcgaatccggcctgcaggggctgctgccggaagcgctggtggcgggtatcgccgatgcgctggaaggtaaccagccgcaggtgccggtggaagccgttcaccgcgcgctgcgtgaaatccacgagcgtgctgacgctgtgcgtcgcgagcgttttcaggccatggccgctgacggccaaaaataccttgatgaaaaccgcgagaaagaaggtgtgaacagcaccgagtctggtctgcagttccgcgtactgacccagggcgaaggcccgatcccggcgcgtactgaccgcgttcgcgtgcactacactggcaaactgatcgacggcaccgtcttcgacagctccgtcgctcgcggtgaaccggctgaattcccggtgaccggcgtgatcggcggctggattgaagcgctgactctgatgccggtaggttccaaatgggaactgacgatcccgcacaacctcgcctacggtgagcgcggcgctggcgcatcgattcctccgttcagcaccctgatcttcgaagttgaactgctggacattatctaa

SEQ ID NO: 10682 - protein, 226 aa, Klebsiella pneumoniae subsp. pneumoniae MGH 78578
MAVMLSHAFILMFITQKGTTMATPTFDTIEAQASYGIGLQVGQQLSESGLQGLLPEALVAGIADALEGNQPQVPVEAVHRALREIHERADAVRRERFQAMAADGQKYLDENREKEGVNSTESGLQFRVLTQGEGPIPARTDRVRVHYTGKLIDGTVFDSSVARGEPAEFPVTGVIGGWIEALTLMPVGSKWELTIPHNLAYGERGAGASIPPFSTLIFEVELLDII

SEQ ID NO: 10683 - DNA, 753 bp, Desulfococcus oleovorans Hxd3
  CDS (1)..(753): transl_table=11
atgaaaaaaatgattaccttttttgtcaccatcgccatgattgccggcctgacagcctgccagaagagcgccgatacccaggccgcaccaccggcccttgaaaccgacaaggacaaggccagctacgccatcggcgtgaacatggcccaggccctggtcaagattaaagacgaggtcaacatcgacatggtggcagccggcctgaaagacaaggtcgacggcaacaccctgcttattgaagaagcggacgcccgatccctgctggctgatttctccaaaaagttacgggaaaagcagatggcggagcgggaggccctgggccagaaaaaccttgaagaaggacaggcctttcttgaggccaacaaggcaaagcccgatgtggtgaccacggaaagcggccttcaatacatggttgtcaaaaagggggatggcccggtgcccacgaacgaagaccgggtcaaggtacactaccggggcaccaccatcgacggcaccgagtttgacagctcctacgagcgggaagagcctgtcaccctggcggttaccggtgtgatcaagggctggaccgaggccctgcaactgatgccggtgggcagcacctacaaactttttgtacccgctgaccttgcctacggccccaggggcgcgggcgaccgcatcggccccaatgccgttctggtgttcgatgtggaactgctggagatcgtgacgccggaaaaaacgcccgccgaaacacccggtccggagatgtaa

SEQ ID NO: 10684 - protein, 250 aa, Desulfococcus oleovorans Hxd3
MKKMITFFVTIAMIAGLTACQKSADTQAAPPALETDKDKASYAIGVNMAQALVKIKDEVNIDMVAAGLKDKVDGNTLLIEEADARSLLADFSKKLREKQMAEREALGQKNLEEGQAFLEANKAKPDVVTTESGLQYMVVKKGDGPVPTNEDRVKVHYRGTTIDGTEFDSSYEREEPVTLAVTGVIKGWTEALQLMPVGSTYKLFVPADLAYGPRGAGDRIGPNAVLVFDVELLEIVTPEKTPAETPGPEM

SEQ ID NO: 10685 - DNA, 663 bp, Salmonella enterica subsp. arizonae serovar 62:z4,z23:--
  CDS (1)..(663): transl_table=11
atgctgcccgctacttttttgttatccgataaaggaaaaataatggccaccccgacttttgacactatcgaagcgcaagcgagctacggcattggtttgcaggtagggcagcaactcagcgaatccggtcttgaagggctgttgcctgaagcgctggttgcaggtattgctgatgcgctggaaggtaaacacccggcggttcctgttgatgtggtgcatcgtgcactgcgtgaaattcatgaacgtgcggacgcggtgcgtcgtgagcgtttcaaagcgatggcggccgaaggggtgaaatatctggaagaaaaccgcgaaaaagacggtgtgaacagcaccgaatccggtttgcagttccgcgttctgacgcagggcgaaggtgagattccggcgcgtaccgatcgcgtgcgcgtgcattataccggtaaacttattgatggcaccgtatttgacagctccgttgcgcgcggcgaaccggctgaattcccggtaaatggcgtgatcgccggctggattgaagcgctgactctgatgccggtaggttccaaatgggaactgacgatcccgcaggagctggcctatggcgagcgtggggccggggcatctattccgccattcagcaccctggtgtttgaggtggagctgctggaaattctctaa

SEQ ID NO: 10686 - protein, 220 aa, Salmonella enterica subsp. arizonae serovar 62:z4,z23:--
MLPATFLLSDKGKIMATPTFDTIEAQASYGIGLQVGQQLSESGLEGLLPEALVAGIADALEGKHPAVPVDVVHRALREIHERADAVRRERFKAMAAEGVKYLEENREKDGVNSTESGLQFRVLTQGEGEIPARTDRVRVHYTGKLIDGTVFDSSVARGEPAEFPVNGVIAGWIEALTLMPVGSKWELTIPQELAYGERGAGASIPPFSTLVFEVELLEIL

SEQ ID NO: 10687 - DNA, 852 bp, Salmonella enterica subsp. arizonae serovar 62:z4,z23:--
  CDS (1)..(852): transl_table=11
atggggcgagatgccccggccctggagatatggatgaaatcactgtttaaagccacgctgctggcaactacgatggccgttgctatgcacgctccgatcacttttgctgctgatgcggcgaaaccggcagctaccgctgatagcaaagcagcctttaaaaacgacgatcaaaaagcggcttatgcgctgggcgcctcgctgggtcgttacatggaaaattcgcttaaagagcaggaaaagttggggatcaaactggataaagaccagctgatcgccggtgttcaggatgcatttgcagacaagagcaaactgtccgatcaggaaatcgagcagacgttgcaaacgtttgaggcgcgcgtgaagaccgccgctcaggcgaagatggaaaaagacgctgccgataacgaagcaaaaggtaaagccttccgtgacgcatttgctaaagaaaaaggcgtgaagacctctaaaaccggtctgctctacaaagtagaaaaagaaggtactggcgaggcaccgaaagatagcgataccgtcgtagtgaattacaaaggcacgctgattgacggtaaagagtttgataactcttacacgcgcggcgaaccgctctccttccgtctggacggcgttatccctggctggactgaaggcctgaaaaatattaagaaaggcggcaagattaagctggttatcccaccggcgctggcctacggcaaaacgggcgttccgggtatcccggcgaactccaccctggtgttcgacgtagagctgctggatatcaaaccagcgccgaaagcggatgctaaacctgccgatgcggctgacgctaaagccgcagatgctgctaaaaaataa

SEQ ID NO: 10688 - protein, 283 aa, Salmonella enterica subsp. arizonae serovar 62:z4,z23:--
MGRDAPALEIWMKSLFKATLLATTMAVAMHAPITFAADAAKPAATADSKAAFKNDDQKAAYALGASLGRYMENSLKEQEKLGIKLDKDQLIAGVQDAFADKSKLSDQEIEQTLQTFEARVKTAAQAKMEKDAADNEAKGKAFRDAFAKEKGVKTSKTGLLYKVEKEGTGEAPKDSDTVVVNYKGTLIDGKEFDNSYTRGEPLSFRLDGVIPGWTEGLKNIKKGGKIKLVIPPALAYGKTGVPGIPANSTLVFDVELLDIKPAPKADAKPADAADAKAADAAKK

SEQ ID NO: 10689 - DNA, 663 bp, Salmonella enterica subsp. enterica serovar Paratyphi B str. SPB7
  CDS (1)..(663): transl_table=11
atgctgcccgctacttttttgatatccgatgaaggaaaaataatggccaccccgacttttgacactattgaagcgcaagcgagctacggcattggtttgcaggtagggcagcagctcagcgaatccggtcttgaagggctgttgcctgaagcgctggttgcaggcattgctgatgcgctggaaggtaaacacccggcggttcctgttgatgtggtgcatcgtgcgctgcgtgaaattcatgagcgtgcggacgcggtgcgtcgtgagcgtttcaaagcgatggcggccgaaggcgtgaaatacctggaagaaaaccgcgaaaaagacggtgtgaacagtactgaatctggtttacagttccgcgttctgacgcagggcgaaggcgcgattccggcgcgtaccgaccgcgtacgcgtgcattacaccggtaagcttattgatggcaccgtatttgacagctccgtcgcgcgcggcgaaccggctgaattcccggtaaatggcgtgatcgccggctggattgaagcgctgactctgatgccggtaggttccaaatgggaactgactatcccacaggagctggcctatggcgagcgtggggccggggcatctattccgccattcagcaccctggtgtttgaagtggaactgctggaaattctgtaa

SEQ ID NO: 10690 - protein, 220 aa, Salmonella enterica subsp. enterica serovar Paratyphi B str. SPB7
MLPATFLISDEGKIMATPTFDTIEAQASYGIGLQVGQQLSESGLEGLLPEALVAGIADALEGKHPAVPVDVVHRALREIHERADAVRRERFKAMAAEGVKYLEENREKDGVNSTESGLQFRVLTQGEGAIPARTDRVRVHYTGKLIDGTVFDSSVARGEPAEFPVNGVIAGWIEALTLMPVGSKWELTIPQELAYGERGAGASIPPFSTLVFEVELLEIL

SEQ ID NO: 10691 - DNA, 639 bp, Pseudomonas putida GB-1
  CDS (1)..(639): transl_table=11
ttgcctcgatatcttgttttaggtttatgcctgctggcccccatcgccttggccgacagcgacgaccatgacctggcctacagcctgggcgccagcctgggtgagcggctgcgtcaggagatgccgggcttgcagctggatgcactggtcgaaggcctgaagcagtcctatcaggggcaacccctcaagctcgacaaggcacgcatgcaggcggtgctccagcagcatgaagcgcaggaaggtgacgcctcggtgcaaaagctgcaggccgcagaaacacgcttcatggccaacgagcgtgggcgttacggggtacacgaactagcggaaggtgtgctctacagcgaactgcaagcaggtacgggtgcgcagccaaaagcaggcggcaaggtgcaggtgcgttatgtgggcaggttgcctgatggttcggtgttcgaccagaaccaaacgccccagtggttcaacctggattctgtaatcgagggctggcaggtggccttgccgaagatgcacgcgggcgccaaatggcgcctggtgattccttcagcgcaagcctatggcgccgagggggcgggtgatttgattgccccctacacccccctggtgttcgagatcgaactgctggcggttggcgactga

SEQ ID NO: 10692 - protein, 212 aa, Pseudomonas putida GB-1
MPRYLVLGLCLLAPIALADSDDHDLAYSLGASLGERLRQEMPGLQLDALVEGLKQSYQGQPLKLDKARMQAVLQQHEAQEGDASVQKLQAAETRFMANERGRYGVHELAEGVLYSELQAGTGAQPKAGGKVQVRYVGRLPDGSVFDQNQTPQWFNLDSVIEGWQVALPKMHAGAKWRLVIPSAQAYGAEGAGDLIAPYTPLVFEIELLAVGD

SEQ ID NO: 10693 - DNA, 618 bp, Pseudomonas putida GB-1
  CDS (1)..(618): transl_table=11
atgtccgaactcaatctgtccaccgacgaaacgcgcgtcagctacggtatcggccgtcagctgggcggccagctgcgcgacaacccgccaccaggcgtcagcctggaagccatcctggccggcctgaccgacgccttcaacggcgccgacagccgcgtcagcgaagccgacctgtcggccagcttcaaagtgatccgtgacatcatgcaagccgaagcggccgccaaggctgaagccgctgctggcgctggcaaggaattcctggccgaaaacgccaagcgtgatggcatcaccaccctggcttcgggcctgcagttcgaagtactgaccgcaggtgaaggcgccaagccgacccgcgaaagcaacgtgcgtacgcactaccacggcaccctgatcgacggcaccgtgttcgacagctcctacgagcgcggccagccggctgaattcccggttggtggtgtgatcgctggctggaccgaagccctgcagctgatgaacgctggcagcaaatggcgcctgtacgtgccgagcgagctggcttacggtgcccaaggcgttggcagcatcccgccgcacagcgtactggtgttcgacgtcgagttgctcgacgttctgtaa

SEQ ID NO: 10694 - protein, 205 aa, Pseudomonas putida GB-1
MSELNLSTDETRVSYGIGRQLGGQLRDNPPPGVSLEAILAGLTDAFNGADSRVSEADLSASFKVIRDIMQAEAAAKAEAAAGAGKEFLAENAKRDGITTLASGLQFEVLTAGEGAKPTRESNVRTHYHGTLIDGTVFDSSYERGQPAEFPVGGVIAGWTEALQLMNAGSKWRLYVPSELAYGAQGVGSIPPHSVLVFDVELLDVL

SEQ ID NO: 10695 - DNA, 765 bp, Pseudomonas putida GB-1
  CDS (1)..(765): transl_table=11
atgaaacagcatcgtttggcggctgcggttgccctggtaggcctggtactggctggctgtgaccaacaggccagcagccccgagctgaagactccggcgcagaaagcctcctacggtatcggcctgaacatgggcaagagcctggctcaggaaggcatggaagaccttgattccaaagcagtcgccctcggcatcgaagacgccgtcagcaagaaagagcagcgcatcaaggatgaagagctggtagaagcgttcaccgcattgcagaagcgcgccgaagagcgcctggccaaggccagcgaagaagccgcctccgccggcaagaaattcctcgaagaaaacgccaagaagccaggcgtggtcaccaccgcttcgggcctgcagtacgaagtggtcaagaaggccgacggcccgcagcctaagccgactgacgtggtcactgtccactacgaaggcaagctgatcgatggcaaggtattcgacagctccgtagagcgtggcagcccgatcgacctgccggtcagcggcgtgatcccaggttgggtcgaaggcctgcagctgatgcacgttggcgagaaatacaagctgttcattccggctgaactggcctacggcgcacaaagcccgagcccgttgatccctgccaactcggtactggtgttcgacctggaactgatcgccatcaaggacccggcccagctgcaaggtgccgagcctgaaggtgaggccccggccgaagcgcctacggaagcacctgccaagtaa

SEQ ID NO: 10696 - protein, 254 aa, Pseudomonas putida GB-1
MKQHRLAAAVALVGLVLAGCDQQASSPELKTPAQKASYGIGLNMGKSLAQEGMEDLDSKAVALGIEDAVSKKEQRIKDEELVEAFTALQKRAEERLAKASEEAASAGKKFLEENAKKPGVVTTASGLQYEVVKKADGPQPKPTDVVTVHYEGKLIDGKVFDSSVERGSPIDLPVSGVIPGWVEGLQLMHVGEKYKLFIPAELAYGAQSPSPLIPANSVLVFDLELIAIKDPAQLQGAEPEGEAPAEAPTEAPAK

SEQ ID NO: 10697 - DNA, 699 bp, Acinetobacter sp. ADP1
  CDS (1)..(699): transl_table=11
atgatgaaaaaaataggtttggctctgatcgcctcaagtatgacagtgactgcttttgccgcatcgattggtgcatcgagtccacaaaaagatcaactgggctatagctatggttacgttatgggacgtaccaatgcagatacattaaaggatctgaatgtagatgcttttgttcagggccttaaagaaggtgctcaaggcaaggattcagctttgagcgatgaggccatggctaaagttctaagccagtataaaaagcaggtcgaagccaaacagctctatgcatttcagcaattggcacaagataacctcaaacgtggtgaagcttttcttgcagaaaatgccaagaaatcgggtgtgattagcactaaatcgggtttgcagtatcaagtactcagtgcagggaaaggtaaatcaccgaaagccagttctcgcgtaaaagtaaattacgaggggcgtttactggacggtacagtctttgacagctcaattgcccgtaatcatcctgtcgagtttcagctcagccaagtgattccaggctggaccgaaggcttgcaactgatgaaagaaggtgaaaaagcgcgtctgtttattccagccaaacttgcgtatggtgaagtcggtagcggtgatgcgattggaccaaatagtacgctgatttttgatatcgaattactggaaattcttccatccaaataa

SEQ ID NO: 10698 - protein, 232 aa, Acinetobacter sp. ADP1
MMKKIGLALIASSMTVTAFAASIGASSPQKDQLGYSYGYVMGRTNADTLKDLNVDAFVQGLKEGAQGKDSALSDEAMAKVLSQYKKQVEAKQLYAFQQLAQDNLKRGEAFLAENAKKSGVISTKSGLQYQVLSAGKGKSPKASSRVKVNYEGRLLDGTVFDSSIARNHPVEFQLSQVIPGWTEGLQLMKEGEKARLFIPAKLAYGEVGSGDAIGPNSTLIFDIELLEILPSK

SEQ ID NO: 10699 - DNA, 708 bp, Acinetobacter sp. ADP1
  CDS (1)..(708): transl_table=11
atgagtaaagccttacccattgctgtcgctgtaattttaggcggtgctgcacttatccctgtttattacgcctctcagcatcctgcgacagatgtaggtagcaaggcagataaaaatgcgactccagtacaaaaaatcagttatgcactgggctacgaagtagcaaaccagacgcctgccgagctcgatgttaatacatttgtgcaaggtattcgtgatggtcatgcacatgctcctgccgcttataccgaagaacagttacaagcagcttataaagaatatcagcaggaaatgcagaaaaaacagcttgatcaaactcatcagtctgcctcaagcagcaacaattttcttgcagaaaatgccaaaaaagaaggcgttaaaaccactgcttctggtttgcagtacaaaattattaccgaaggtacaggtaaacgtccaagcgcttcatctgtggtaaaggtcaattataaaggtcaattgactgatggtaaggtatttgacagctcttacgagcgtggtcaacctgtcgagttcccattaaatcaagtgattccaggctggactgaaggcttacagcttctcaaggaaggtggtaaagcgaccttgtatatcccagccaaactgggctatggtgagcaaggtgttcctggcatgatcccaccaaacagtactttaatttttgatgtagaactgttagaagtgaaatag

SEQ ID NO: 10700 - protein, 235 aa, Acinetobacter sp. ADP1
MSKALPIAVAVILGGAALIPVYYASQHPATDVGSKADKNATPVQKISYALGYEVANQTPAELDVNTFVQGIRDGHAHAPAAYTEEQLQAAYKEYQQEMQKKQLDQTHQSASSSNNFLAENAKKEGVKTTASGLQYKIITEGTGKRPSASSVVKVNYKGQLTDGKVFDSSYERGQPVEFPLNQVIPGWTEGLQLLKEGGKATLYIPAKLGYGEQGVPGMIPPNSTLIFDVELLEVK

SEQ ID NO: 10701 - DNA, 819 bp, Pectobacterium atrosepticum SCRI1043
  CDS (1)..(819): transl_table=11
atgaaatcactgtttaaagtaacgctgttagcaacaacgatggctctggctctgaacgcgggccaggctctggcagcagacaaggcacaggcgtctgagagtactacggcagccaaattcaaaaacgatgagcaggcagcggcttacgcgttaggtgcatctttagggcgttacatggataactctctgaaagagcaggaaaaattaggtatcaagctggataaggatcagctgattgctggtgttcaggatgcctttgctgataagagcaagctgactgacgaagaaatcgaaaaaacactgcaaggctttgaaggtaaagttaaagctgctgctgaagccaagatgaagcaagatgcgaaagataacgctgataaaggcgccaagtatcttgagtcctttgctaaagaaaaaggcgtgaagaaaactgaatctggccttctgtatcaggttgagaaagaaggtagcggcaacgcgccgaaagacagcgatactgtagtggttaactacaaaggtacgctggtcgacggtagcgagttcgacaactcctacaaacgtggtgagccgctttctttccgtctggacggtgtgatccctggctggactgaaggcctgaagcacgttaagaaaggcggcaaaatcaagttggctatcccgccagcacaggcctatggcgaaaacggtgtacctggtatcccggctaactctacgctggtgtttgacgttgaactgttggacattaaatctgaagctgacttgaaagcagcggatgatgcgaaagctgaaaaaccagctgccgcagagaaaaccgctaaataa

SEQ ID NO: 10702 - protein, 272 aa, Pectobacterium atrosepticum SCRI1043
MKSLFKVTLLATTMALALNAGQALAADKAQASESTTAAKFKNDEQAAAYALGASLGRYMDNSLKEQEKLGIKLDKDQLIAGVQDAFADKSKLTDEEIEKTLQGFEGKVKAAAEAKMKQDAKDNADKGAKYLESFAKEKGVKKTESGLLYQVEKEGSGNAPKDSDTVVVNYKGTLVDGSEFDNSYKRGEPLSFRLDGVIPGWTEGLKHVKKGGKIKLAIPPAQAYGENGVPGIPANSTLVFDVELLDIKSEADLKAADDAKAEKPAAAEKTAK

SEQ ID NO: 10703 - DNA, 837 bp, Mannheimia succiniciproducens MBEL55E
  CDS (1)..(837): transl_table=11
atgttattcgtcatttttgttaaacccactgagccgaggctctcaataaaggaaatagtgatgttaaaaattcaaaagttttcagcagtggcattattagtcggcgccgtattggcgacctctgcctgtaaagatgacaaaaaagcgcaagcggcggcagagcctgcaaaacaggaagcaccggcagccgcgcaggcggaaaatagccgggttaaagatccttcttatgcggtaggcgtgttaatcggtaatgatttaaaaggtttggttgaagcgcagaaagacgtaatcgcttatgataacgataaaattcttgcgggcgttgcggaagcattgcagggcaaaattgatttaaccaaccaagacgtggtgaacacgttaaaggatattgatgaaaaattaaaagttgccgcccaaaccaaagccgaagaacaagcgaaacaggccaaagcggaaagtgagaaattcattgccgaatttaagcaaaaagacggcgtgaaagaaaccaaatccggtttgctgtatcgcattgaaaaagaaggtgaaggcgcagctattaaaccgacagattccgtgaaagtacattacaccggcaaattaactaacggtacggtatttgacagctcggtagaacgtggtcagccggtagaatttttattggatcaggttattccgggttggaccgaaggtctgcagttagtgaaaaaaggcggcaaaatcgaattggttattcctgccgaacttgcttacggcgagcaggatttaggtacgattccacctaactcaacacttcattttgaagttgaagtattagacgttactccggctaaaaaataa

SEQ ID NO: 10704 - protein, 278 aa, Mannheimia succiniciproducens MBEL55E
MLFVIFVKPTEPRLSIKEIVMLKIQKFSAVALLVGAVLATSACKDDKKAQAAAEPAKQEAPAAAQAENSRVKDPSYAVGVLIGNDLKGLVEAQKDVIAYDNDKILAGVAEALQGKIDLTNQDVVNTLKDIDEKLKVAAQTKAEEQAKQAKAESEKFIAEFKQKDGVKETKSGLLYRIEKEGEGAAIKPTDSVKVHYTGKLTNGTVFDSSVERGQPVEFLLDQVIPGWTEGLQLVKKGGKIELVIPAELAYGEQDLGTIPPNSTLHFEVEVLDVTPAKK

SEQ ID NO: 10705 - DNA, 708 bp, Legionella pneumophila subsp. pneumophila str. Philadelphia 1
  CDS (1)..(708): transl_table=11
ttgtttatgaagatgaaattggtgactgcagctgttatggggcttgcaatgtcaacagcaatggctgcaaccgatgccacatcattagctacagacaaggataagttgtcttatagcattggtgccgatttggggaagaattttaaaaatcaaggcatagatgttaatccggaagcaatggctaaaggcatgcaagacgctatgagtggcgctcaattggctttaaccgaacagcaaatgaaagacgttcttaacaagtttcagaaagatttgatggctaagcgtactgctgaattcaataagaaagcggatgaaaataaagtaaaaggggaagcctttttaactgaaaacaaaaacaagccaggcgttgttgtattgccaagtggtttgcaatacaaagtaatcaattctggaaatggtgttaaacccggaaaatcggatacagtcactgtcgaatatactggtcgtctgattgatggtaccgtttttgacagtaccgaaaaaactggtaagccagcaacgttccaggtttcacaagttatccctggatggacagaagctttgcaattgatgccagctggatcaacttgggaaatttatgttccctcaggtcttgcatatggcccacgtagcgttggcggacctattggcccaaatgaaactttaatatttaaaattcacttaatttcagtgaaaaaatcatcttaa

SEQ ID NO: 10706 - protein, 235 aa, Legionella pneumophila subsp. pneumophila str. Philadelphia 1
MFMKMKLVTAAVMGLAMSTAMAATDATSLATDKDKLSYSIGADLGKNFKNQGIDVNPEAMAKGMQDAMSGAQLALTEQQMKDVLNKFQKDLMAKRTAEFNKKADENKVKGEAFLTENKNKPGVVVLPSGLQYKVINSGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSS

SEQ ID NO: 10707 - DNA, 819 bp, Neisseria gonorrhoeae FA 1090
  CDS (1)..(819): transl_table=11
atgaacaccattttcaaaatcagcgcactgaccctttccgccgctttggcactttccgcctgcggcaaaaaagaagccgcccccgcatctgcatccgaacctgccgccgcttctgccgcgcagggcgacacctcttcaatcggcagcacgatgcagcaggcaagctatgcaatgggcgtggacatcggacgctccctgaaacaaatgaaggaacagggcgcggaaatcgatttgaaagtctttaccgatgccatgcaggcagtgtatgacggcaaagaaatcaaaatgaccgaagagcaggcccaggaagtgatgatgaaattcctgcaggagcagcaggctaaagccgtagaaaaacacaaggcggatgcgaaggccaacaaagaaaaaggcgaagccttcctgaaggaaaatgccgccaaagacggcgtgaagaccactgcttccggtctgcagtacaaaatcaccaaacagggtgaaggcaaacagccgacaaaagacgacatcgttaccgtggaatacgaaggccgcctgattgacggtaccgtattcgacagcagcaaagccaacggcggcccggccaccttccctttgagccaagtgattccgggttggaccgaaggcgtacggcttctgaaagaaggcggcgaagccacgttctacatcccgtccaaccttgcctaccgcgaacagggtgcgggcgaaaaaatcggtccgaacgccactttggtatttgacgtgaaactggtcaaaatcggcgcacccgaaaacgcgcccgccaagcagccggatcaagtcgacatcaaaaaagtaaattaa

SEQ ID NO: 10708 - protein, 272 aa, Neisseria gonorrhoeae FA 1090
MNTIFKISALTLSAALALSACGKKEAAPASASEPAAASAAQGDTSSIGSTMQQASYAMGVDIGRSLKQMKEQGAEIDLKVFTDAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 10709 - DNA, 585 bp, Bacteroides fragilis NCTC 9343
  CDS (1)..(585): transl_table=11
atggataaatttagttatgcaattggtctcggaatcggccagaatttgttaggaatgggtgctaaaggcatcgcagtagatgactttgctcaagctataaaagatgtgctcgaaggaaatcagacagccatcagccatcaggaggctcgagaaatcgtaaacaagtatttcgaagagctggaaaccaaaatgaatgcagccaacatcgaacaaggaaaagcattcctcgaagaaaacaaaaaaagaccgaacgttgttaccctgccaagtggactacaatacgaagtaatcactgaaggtacaggcaagaaagcacaggctaccgaccaggtaaaatgccactacgaaggtaccctgattgacggaaccctgttcgacagttctatcaaacgtggacagcctgccgtattcggtgtaaaccaagtaatcccgggatgggtagaggctttgcaactgatgccggaaggttcaaaatggaaactttttatcccttctgaactggcttacggcgcacagggagccggtgaaatgatccctcctcacagcacactcgtgttcgaagtagaattaatcgaagtattataa

SEQ ID NO: 10710 - protein, 194 aa, Bacteroides fragilis NCTC 9343
MDKFSYAIGLGIGQNLLGMGAKGIAVDDFAQAIKDVLEGNQTAISHQEAREIVNKYFEELETKMNAANIEQGKAFLEENKKRPNVVTLPSGLQYEVITEGTGKKAQATDQVKCHYEGTLIDGTLFDSSIKRGQPAVFGVNQVIPGWVEALQLMPEGSKWKLFIPSELAYGAQGAGEMIPPHSTLVFEVELIEVL

SEQ ID NO: 10711 - DNA, 678 bp, Pseudomonas syringae pv. syringae B728a
  CDS (1)..(678): transl_table=11
atgtcgcgctacctgttaacgtcgttgttcctcttgctacccctggctcaggccgccgaggcgccgcctgcgtccagcgacggccacgatctcgcctacagcctgggtgcaagcctcggcgagcggttgcatcaggaagtccctgacctggacctcaaggcgctggtagaaggcttgcagcaggcctatcagggcaagccgctggcgctcaagcaggaacgcatcgaccagattctgcgcgagcatgacgccgcgatcgcccaggccgagactgccggtacggatgcgccgaccgaggcggctctcaaggccgagcgcacgttcatggacagcgagaaggccaagccgggtgtgaaggtgctggctgacgggattctcatgaccgagctgactcctggcaccggccccaagcccagtgccgatggccgggttgaagtgcgttatgtcggtcgcttgccggacggcaccatcttcgatcagagcacccagccccagtggttccggctcgacagtgtgatcagcggctggaccagcgccttgcagaacatgccgaccggcgcgaagtggcggctggtgatcccttcggatcaagcctatggtgccgagggcgctggtgatctgatcgatccgtttacgccactggtatttgaaatcgagctggttgcggtttcacagtaa

SEQ ID NO: 10712 - protein, 225 aa, Pseudomonas syringae pv. syringae B728a
MSRYLLTSLFLLLPLAQAAEAPPASSDGHDLAYSLGASLGERLHQEVPDLDLKALVEGLQQAYQGKPLALKQERIDQILREHDAAIAQAETAGTDAPTEAALKAERTFMDSEKAKPGVKVLADGILMTELTPGTGPKPSADGRVEVRYVGRLPDGTIFDQSTQPQWFRLDSVISGWTSALQNMPTGAKWRLVIPSDQAYGAEGAGDLIDPFTPLVFEIELVAVSQ

SEQ ID NO: 10713 - DNA, 771 bp, Pseudomonas syringae pv. syringae B728a
  CDS (1)..(771): transl_table=11
atgaaacagcatcggttggcagcggcgattgccctggtcggtctggtactcgcaggttgtgacaagcaagccagcaccgtagagctgaaaaccccagcacaaaaagcgtcttatggcatcggtctgaacatgggcaaaagcctggctcaggaaggtatggatgatctggattccaaggctgtagccctgggtatcgaagatgctgttggcaagaaagatcagaaactcaaggacgaagagctggttgaagccttctccgcgctgcaaaagcgttccgaagagcgtctggcgaagatgagcgaagaggcttctgccgctggcaagaaattcctcgaagagaacggtaagaaggacggcgtggtcaccaccgcttccggcctgcagtatcagatcatcaagaaagccgatggcgctcagcccaagcctaccgatgttgtgactgttcactacgaaggcaagctgatcgacggcaaggtcttcgacagttccgttgagcgcggcagcccgatcgacctgccggttggcggtgtgattccgggttgggtcgaaggtctgcaactgatgcacgtcggcgagaagatcaaactcttcatcccgagtgatctggcttacggcgcacagagcccgagcccggcgatccctgccaactcggtactggtgttcgatcttgaactgctgggtatcaaggaccctgcagcggcaccgactcctggtgctgatgccgacgaagaagaggcagctcctgccgcttcggctccggccaagaagtaa

SEQ ID NO: 10714 - protein, 256 aa, Pseudomonas syringae pv. syringae B728a
MKQHRLAAAIALVGLVLAGCDKQASTVELKTPAQKASYGIGLNMGKSLAQEGMDDLDSKAVALGIEDAVGKKDQKLKDEELVEAFSALQKRSEERLAKMSEEASAAGKKFLEENGKKDGVVTTASGLQYQIIKKADGAQPKPTDVVTVHYEGKLIDGKVFDSSVERGSPIDLPVGGVIPGWVEGLQLMHVGEKIKLFIPSDLAYGAQSPSPAIPANSVLVFDLELLGIKDPAAAPTPGADADEEEAAPAASAPAKK

SEQ ID NO: 10715 - DNA, 618 bp, Pseudomonas syringae pv. syringae B728a
  CDS (1)..(618): transl_table=11
atgtccgaagtcaatctgtccaccgacgaaacccgcgtcagctacggcattggccgtcagttgggcgatcagttgcgcgacaacccgccaccgggcgtcgatctggaagccatcgtggcaggcctgcgcgatgcgtttggcggtcagccaagccgtgtcggtcaggaagaaatgtccgccagcttcaaggtcatccgcgaaatcatgcaggctgaagcagccgccaaggctgaacaggctgcgggcgccggcaaggcctacctggctgaaaacgccaagcgcgaaggcgtgaccacgctggcttcgggtctgcaattcgaagtcgtgaccgctggtactggcgccaagccaacccgtgaagaccaggtacgcgttcactaccacggcacgttgatcgacggtaacgtcttcgacagctcctacgatcgtggcgagccggccgaatttccggtcagcggcgtgattgccggctggaccgaggcgctgcaactgatgaacgccggcagcaaatggcgtctgcacgtgccgagcgaactggcttacggcgctcagggcgtaggcagcatcgcaccgcacagcgtgctggtgtttgacgtggaactgctggacgttctgtaa

SEQ ID NO: 10716 - protein, 205 aa, Pseudomonas syringae pv. syringae B728a
MSEVNLSTDETRVSYGIGRQLGDQLRDNPPPGVDLEAIVAGLRDAFGGQPSRVGQEEMSASFKVIREIMQAEAAAKAEQAAGAGKAYLAENAKREGVTTLASGLQFEVVTAGTGAKPTREDQVRVHYHGTLIDGNVFDSSYDRGEPAEFPVSGVIAGWTEALQLMNAGSKWRLHVPSELAYGAQGVGSIAPHSVLVFDVELLDVL

SEQ ID NO: 10717 - DNA, 714 bp, Pseudomonas fluorescens Pf-5
  CDS (1)..(714): transl_table=11
atgaaacagcatcggttggcggcggcggtggccctggttagcctggtacttgcgggttgtgattcgcagaccagcgtagagctgaaaaccccggcgcaaaaagcttcctacggtatcggcctgaacatgggcaagagtctggctcaggaaggcatggatgacctggactccaaagcggtcgcccagggcatcgaagatgccgtcggcaagaaagaacagaagctgaaggatgaagagttggtcgaagccttcgccgcgctgcaaaagcgtgccgaagagcgcatggccaagatgagcgaagagtcggcggctgccggcaagaaattcctcgaagagaacggcaagaaaaccggtgtgaccaccaccgcttccggtctgcagtacgaagtattgaaaaaggctgacggtcctcagcccaagccgactgatgtcgtgactgttcactacaccggcaccctgaccaacggcactgtgttcgacagctcggtagagcgtggcagcccgatcgatctgccggtcagcggcgtgatcccgggttgggtcgaaggcctgcaactgatgcacgtgggcgagaagtataagctgtacatcccgagcgacctggcctacggcgcccagagcccgagcccggccattccagccaactcggtgctggtcttcgaattggagctgctgggtatcaaggatccagccaagcaggacgccgccaagtaa

SEQ ID NO: 10718 - protein, 237 aa, Pseudomonas fluorescens Pf-5
MKQHRLAAAVALVSLVLAGCDSQTSVELKTPAQKASYGIGLNMGKSLAQEGMDDLDSKAVAQGIEDAVGKKEQKLKDEELVEAFAALQKRAEERMAKMSEESAAAGKKFLEENGKKTGVTTTASGLQYEVLKKADGPQPKPTDVVTVHYTGTLTNGTVFDSSVERGSPIDLPVSGVIPGWVEGLQLMHVGEKYKLYIPSDLAYGAQSPSPAIPANSVLVFELELLGIKDPAKQDAAK

SEQ ID NO: 10719 - DNA, 618 bp, Pseudomonas fluorescens Pf-5
  CDS (1)..(618): transl_table=11
atgtccgaagtaaatctgtccaccgacgaaacccgcgtcagctacggcatcggccgtcagctgggcgaccaactgcgtgacaacccgcccccgggcgtgagcctagatgcaatcctggccggtctgaccgacgctttcgccggtaagccgagccgtgtgggtcaggaagaaatgtctgccagcttcaaagtcatccgcgaaatcatgcaggctgaagccgctgccaaggccgaagcggctgccggtgccggtctggcattcctggcggaaaacgccaagcgtgaaggcatcaccaccctggcttccggcctgcagttcgaagtgctgacccagggcgaaggcgccaagccatcccgtgaagacagcgttcgcactcactaccacggcaccctgatcgacggcactgtgttcgacagctcctacgagcgcggccagcctgccgaattcccggttggcggcgtgatcgctggctggaccgaagcgctgcaactgatgaacgccggtagcaaatggcgtctgtacgtgccgagcgaactggcttacggcgcacaaggcgtgggcagcatcccgccgcacagcgtcctggtgttcgacgtcgagctgctggacgttctgtaa

SEQ ID NO: 10720 - protein, 205 aa, Pseudomonas fluorescens Pf-5
MSEVNLSTDETRVSYGIGRQLGDQLRDNPPPGVSLDAILAGLTDAFAGKPSRVGQEEMSASFKVIREIMQAEAAAKAEAAAGAGLAFLAENAKREGITTLASGLQFEVLTQGEGAKPSREDSVRTHYHGTLIDGTVFDSSYERGQPAEFPVGGVIAGWTEALQLMNAGSKWRLYVPSELAYGAQGVGSIPPHSVLVFDVELLDVL

SEQ ID NO: 10721 - DNA, 732 bp, Psychrobacter arcticus 273-4
  CDS (1)..(732): transl_table=11
atgaaaaaaatcactaccctaagcatcagtgccctggctagcgctatgttattaattacaggctgtagcgcaaacaacggtaataaagaaactgctgccaaaagtgtttcagttactgaacaaagccctgccaaggaaaaagtaggttatagcttgggctatatgatggcagaagggaataaagaagcggttggggatctgaaccttgatacttttgaaaaaggcttccgtgatggctatgaaggtaaaaaagcggcattgacagaagagcaaatgcaagaagtgttaacgacctatcaaaaagaacaggaagcgaagtttgtgaaagatatggaatctaaagcgggtgcaaacaaaaccaagggctcagcattcttagtagagaatggcaaaaaagccggcgtgaaaaccactgcttctggcctacaatataaagtagtgaccgcaggtactggtaaatcaccaaaagctacggatgtggttgaagtaaactatgaaggtaaattgattgacggtaccgtattcgacagctcatatgagcgcggtgagccagttgaattcccacttaatcaagtgattgctggctggactgaaggtctacagttgatgaaagagggtggtaaatacgagttttatatcccatctgatatcgcttatggcgaagcgggtaacgcaggtatcgagcctaacagcacgcttatctttaccgttgaactattaaaagtaaaataa

SEQ ID NO: 10722 - protein, 243 aa, Psychrobacter arcticus 273-4
MKKITTLSISALASAMLLITGCSANNGNKETAAKSVSVTEQSPAKEKVGYSLGYMMAEGNKEAVGDLNLDTFEKGFRDGYEGKKAALTEEQMQEVLTTYQKEQEAKFVKDMESKAGANKTKGSAFLVENGKKAGVKTTASGLQYKVVTAGTGKSPKATDVVEVNYEGKLIDGTVFDSSYERGEPVEFPLNQVIAGWTEGLQLMKEGGKYEFYIPSDIAYGEAGNAGIEPNSTLIFTVELLKVK

SEQ ID NO: 10723 - DNA, 768 bp, Colwellia psychrerythraea 34H
  CDS (1)..(768): transl_table=11
atgaaattgtttaagcctaccttagtagcccttgccttatttgccgttgttggttgtaacgaaaaagctgttgaagaagtaaaagcaccggtattagatactgaagtgcaaaaacaagcctacggcttaggtgcctcaattggtatgtacatgcaacgtaacttagaagagcatgacaaactaggtttaacgttagataaagagcttatcgtacgcggttttgtagacagcattgacggtaaatctgttatcgaaaaagaagaaattcaagccttattgatgaaccttgatactagcatgaaagaaaaacagcaagcagctgcaatcgccgcttctgaatctagcctagctgacggcgctaagtttcttgaagacaacgctaaaaaagaaggcgtaacagtaactgaatcaggtattcaatacgaagtattaaccgctgccgaaggtgatacacctttagcaactgatactgttaaagttcactataaaggtactttcttaaacggtgaaacctttgatagttcatacaaacgtggtgaaccagcagtattcccacttaatcgtgtaatcaaaggttggactgaaggcgtacaattaatgcctgtaggcgctaagtacaagttcactatcccttcagatttagcctatggtcctaacggtaacccaccaagtattccgggtaactcagtattgcaatttgaaattgaattattagaaattcaaaaagcagaagaagctccaaaggctgatgaacacgctgctcactag

SEQ ID NO: 10724 - protein, 255 aa, Colwellia psychrerythraea 34H
MKLFKPTLVALALFAVVGCNEKAVEEVKAPVLDTEVQKQAYGLGASIGMYMQRNLEEHDKLGLTLDKELIVRGFVDSIDGKSVIEKEEIQALLMNLDTSMKEKQQAAAIAASESSLADGAKFLEDNAKKEGVTVTESGIQYEVLTAAEGDTPLATDTVKVHYKGTFLNGETFDSSYKRGEPAVFPLNRVIKGWTEGVQLMPVGAKYKFTIPSDLAYGPNGNPPSIPGNSVLQFEIELLEIQKAEEAPKADEHAAH

SEQ ID NO: 10725 - DNA, 642 bp, Colwellia psychrerythraea 34H
  CDS (1)..(642): transl_table=11
atgacagtattgtctggagtttatataccaatgagttttgatactattgaacaacgtgttagttatggcgtaggtcgtcaattaggtgaccaacttcgcaacaacccttttaaagagtttgatatcaccgctgtacaagctggtattgctgatgctcttgctgatgcggctagccaagtttcagatgaagatttaaacgatgctttttctataatttctaaaaaattacaagaacaagagcaagctgctgctaaagaagcttcagctgaaggcgaagtattcctagctgataacgctaagcgtgatgaagttactgtaactgaatctggtttacagtatgaagtaattactacaggtgaaggtgaaaaaccttcagctgaaagcactgtaagtgtacattaccacggtacttttgctaacggtgatgtttttgatagttctgttgaacgtggccaaccggctgaattcccagtaaacggcgttatcgctggttggactgaagcactacagttaatgactgaaggcagtaagtggaaattaactatcccttatgatttagcatacggtgagcgcggttctcaaggtgctatacctccttatgctacgttagtttttgatgttgaattattaagcatcaaataa

SEQ ID NO: 10726 - protein, 213 aa, Colwellia psychrerythraea 34H
MTVLSGVYIPMSFDTIEQRVSYGVGRQLGDQLRNNPFKEFDITAVQAGIADALADAASQVSDEDLNDAFSIISKKLQEQEQAAAKEASAEGEVFLADNAKRDEVTVTESGLQYEVITTGEGEKPSAESTVSVHYHGTFANGDVFDSSVERGQPAEFPVNGVIAGWTEALQLMTEGSKWKLTIPYDLAYGERGSQGAIPPYATLVFDVELLSIK

SEQ ID NO: 10727 - DNA, 681 bp, Pseudomonas syringae pv. phaseolicola 1448A
  CDS (1)..(681): transl_table=11
atgtcgcgctacctgttaacgtcgttgttcctcttgctacccctggctcaagctgccgaagcaccacctgcggcggccgatgatggtcatgatctcgcctacagcctgggtgcaagcctgggtgaacgcttgcatcaggaagtccctgaccttgatctcaaggcacttgtcgacggtctgaaacaggcttatcagggcaagccgctggcactcaagcaggagcgtatcgaccaggtcctgcgtgagcatgacgccgcaatcgcgcaggccgagaccgcaggcacagacgcgcctaccgaagcagccctgaaggcagagcgcacgttcatggacagcgagaaggccaagccgggtgtgaaggtattggcggacgggattctcatgaccgagctgacacctggcacgggccccaaacctgatgccaatggcagggttgaagtgcgctatgtgggtcgtttgccggacggcacgatcttcgatcagagcacccagccgcaatggttccggctcgacagcgtgatcagcggctggaccagcgcattgcagacgatgccgaccggcgcgaaatggcgactggtgattccttcggatcaagcctacggcgctgagggtgctggcgacctgatcgatccgttcactccgctggtatttgaaatcgagctgattgccgtttcacagtaa

SEQ ID NO: 10728 - protein, 226 aa, Pseudomonas syringae pv. phaseolicola 1448A
MSRYLLTSLFLLLPLAQAAEAPPAAADDGHDLAYSLGASLGERLHQEVPDLDLKALVDGLKQAYQGKPLALKQERIDQVLREHDAAIAQAETAGTDAPTEAALKAERTFMDSEKAKPGVKVLADGILMTELTPGTGPKPDANGRVEVRYVGRLPDGTIFDQSTQPQWFRLDSVISGWTSALQTMPTGAKWRLVIPSDQAYGAEGAGDLIDPFTPLVFEIELIAVSQ

SEQ ID NO: 10729 - DNA, 771 bp, Pseudomonas syringae pv. phaseolicola 1448A
  CDS (1)..(771): transl_table=11
atgaaacagcatcggttggcagcggcgattgccctggtcggtctggtactcgcaggttgtgacaagcaagccagcaccgtagagctgaaaactccggcacaaaaagcgtcttatggcatcggtctgaacatgggcaaaagcctggctcaggaaggtatggatgatctggattccaaggctgtggccctgggtatcgaagacgcagtcggcaagaaagatcagaaactcaaagacgaagagctggttgaagccttctcggccctgcagaagcgctccgaggagcgtctggccaagatgagcgaagaggcttcggccgctggcaagaaattcctcgaagagaacggcaaaaaggatggcgtggtcaccactgcttccggcttgcagtatcaaatcatcaagaaagcggatggcgctcagcctaagcctaccgatgttgtgactgttcactacgaaggcaaactgattgacggcaaggtcttcgacagttccgttgaacgcggcagcccgattgacctgcctgtaggcggcgttatcccgggttgggtcgaaggtctgcaactgatgcacgtaggcgagaagatcaaactcttcatccctagtgatctggcgtacggcgcgcagagcccgagccctgcgatcccggcaaattcggtactggtttttgaccttgagttgcttggcatcaaagacccggcagctgctccgacagctggtgctgatgctgacgaagaagaggcagctcctgccgcttccgctccggccaagaagtaa

SEQ ID NO: 10730 - protein, 256 aa, Pseudomonas syringae pv. phaseolicola 1448A
MKQHRLAAAIALVGLVLAGCDKQASTVELKTPAQKASYGIGLNMGKSLAQEGMDDLDSKAVALGIEDAVGKKDQKLKDEELVEAFSALQKRSEERLAKMSEEASAAGKKFLEENGKKDGVVTTASGLQYQIIKKADGAQPKPTDVVTVHYEGKLIDGKVFDSSVERGSPIDLPVGGVIPGWVEGLQLMHVGEKIKLFIPSDLAYGAQSPSPAIPANSVLVFDLELLGIKDPAAAPTAGADADEEEAAPAASAPAKK

SEQ ID NO: 10731 - DNA, 660 bp, Pseudomonas syringae pv. phaseolicola 1448A
  CDS (1)..(660): transl_table=11
ttgcgtgattgccgactgcgtgcccctctgcggagcagtgtcatgtccgaagtcaatctgtccaccgatgaaacccgcgtcagctacggcattggccgtcagttgggcgaccagttgcgcgacaatccgccaccgggtgtcgacctggaagccatcgtggcaggcctgcgtgatgcatttggcggtcagccaagccgtgtgggtcaggaagaaatgtccgccagcttcaaggttatccgtgaaatcatgcaggccgaagcggccgccaaggctgaacaggctgtgggtgccggcaaggcttacctggctgaaaatgccaagcgcgaaggcgtgaccacgctggcctcaggtctgcaattcgaagtgctgaccgctggcgctggcgccaagccaacccgtgaagatcaggtgcgcgtgcactatcacggtacgctgatcgacggtaacgtcttcgacagctcctatgatcgtggcgagcctgcggaatttccggtcagcggcgtgattgctggctggaccgaggcgctgcaactgatgaacgctggcagcaaatggcgtctgcacgtaccgagcgagctggcttacggcgctcagggcgtgggcagcatcgcaccgcacagcgtgctggtgttcgacgtggaactgctcgacgttctgtaa

SEQ ID NO: 10732 - protein, 219 aa, Pseudomonas syringae pv. phaseolicola 1448A
MRDCRLRAPLRSSVMSEVNLSTDETRVSYGIGRQLGDQLRDNPPPGVDLEAIVAGLRDAFGGQPSRVGQEEMSASFKVIREIMQAEAAAKAEQAVGAGKAYLAENAKREGVTTLASGLQFEVLTAGAGAKPTREDQVRVHYHGTLIDGNVFDSSYDRGEPAEFPVSGVIAGWTEALQLMNAGSKWRLHVPSELAYGAQGVGSIAPHSVLVFDVELLDVL

SEQ ID NO: 10733 - DNA, 723 bp, Pseudomonas fluorescens PfO-1
  CDS (1)..(723): transl_table=11
atgaaacagcatcggttggcggcggcggttgccctggttagcctggtcctcgcgggttgtgattcgcagaccagcgtagagctgaaaaccccggcgcaaaaagcttcctacggtatcggcctgaacatgggcaagagccttgctcaggaaggcatggatgatctggactccaaagcggtagcccagggcatcgaagatgccgtcggcaagaaagaacagaagctgaaagatgaagaactggtcgaagctttcgccgcgctgcaaaagcgtgccgaagagcgtatggccaagatgagcgaagagtcggcagccgccggcaagaaattcctcgaagaaaacggcaagaaggctggcgtgaccaccaccgcttccggtctgcagtacgaagtggtcaagaaagccgacggcccacaacccaagcctaccgatgtcgtgaccgttcactacaccggcaagctgaccaacggcaccgttttcgacagctccgtcgagcgcggaagcccgatcgatctgccggtcagcggtgtgatcccgggttgggtcgaaggcctgcaactgatgcacgttggcgagaagtacaagctgtacatccctagcgatctggcttacggcgcacaatcgccaagcccggcaatcccggccaactcggtcctggttttcgacctggaactgctggccatcaaggatccagccaaagaagacgccgctgccgccaagcaataa

SEQ ID NO: 10734 - protein, 240 aa, Pseudomonas fluorescens PfO-1
MKQHRLAAAVALVSLVLAGCDSQTSVELKTPAQKASYGIGLNMGKSLAQEGMDDLDSKAVAQGIEDAVGKKEQKLKDEELVEAFAALQKRAEERMAKMSEESAAAGKKFLEENGKKAGVTTTASGLQYEVVKKADGPQPKPTDVVTVHYTGKLTNGTVFDSSVERGSPIDLPVSGVIPGWVEGLQLMHVGEKYKLYIPSDLAYGAQSPSPAIPANSVLVFDLELLAIKDPAKEDAAAAKQ

SEQ ID NO: 10735 - DNA, 618 bp, Pseudomonas fluorescens PfO-1
  CDS (1)..(618): transl_table=11
atgtccgaagtaaatctgtccaccgacgaaacccgcgtcagctacggtatcggccgtcagctgggtgaccagctgcgcgacaacccgccaccgggtgtcagcctggacgccatcctggccggtctgaccgacgcattcgccggcaaggaaagccgtgtcagccaggaagccatgtccgccagcttcaaggtgatccgcgagatcatgcaagctgaagccgctgccaaggctgaagccgccgcaggcgaaggtctggcattcctggctgaaaacgccaagaaagaaggcatcacgactctggcatccggcctgcagttcgaagtgctgactcagggtgaaggcgccaagccatcccgtgaagacaccgtgcgtactcactaccacggcacactgatcgacggcactgtgttcgacagctcctacgagcgcggccagccggctgaattcccggtcggtggcgttatcgcgggctggaccgaagccctgcaactgatgaatgccggcagcaaatggcgtctgtacgtgccgagcgaactggcttacggcgctcaaggcgttggcagcatcccgccgcacagcgttctggtatttgacgtcgagctgctcgaggttctgtaa

SEQ ID NO: 10736 - protein, 205 aa, Pseudomonas fluorescens PfO-1
MSEVNLSTDETRVSYGIGRQLGDQLRDNPPPGVSLDAILAGLTDAFAGKESRVSQEAMSASFKVIREIMQAEAAAKAEAAAGEGLAFLAENAKKEGITTLASGLQFEVLTQGEGAKPSREDTVRTHYHGTLIDGTVFDSSYERGQPAEFPVGGVIAGWTEALQLMNAGSKWRLYVPSELAYGAQGVGSIPPHSVLVFDVELLEVL

SEQ ID NO: 10737 - DNA, 666 bp, Pseudomonas fluorescens PfO-1
  CDS (1)..(666): transl_table=11
atgtcgcgctacctttttttatccctctgcatgattttctccatggctcaggccgacgaaaaaaccaccgcgaacgatgcccatgatctggcttacagcctcggtgccagcctcggtgaacgactgcgtcaggaagtgccgcagctacagatccaggcactgatcgaaggtctgcaacaggcttatcaaggtaagccgctggcattgagcgaagcacgtatcgagcagatcctcgccgatcacgaatcgcagacagccgagcaggcagccatgccttcgactgaagccgcgatggaaaacgagcgacggtttctcaccgccgaaaaagccaagccgggtgtaaaggagctggccgacggcatcctgttgaccgagctgacaccgggaaatggcacgaaggccggcccggatggaaaagtgcaggtgctgtacatcggtcgactgcctgacggcaccgtgttcgatcagaacagtcagccgcagtggttcaatctcgacagcgtgatcgccggatggcgcaccgcgctgcagaacatgccggtcggcgcgaagtggcgactggtgattccatcggatcaggcttatggcgccgacggtgccggtgacttgatcgcgccgttcacaccgttggtgttcgaagtggaattgcgcggcgcgaccagttga

SEQ ID NO: 10738 - protein, 221 aa, Pseudomonas fluorescens PfO-1
MSRYLFLSLCMIFSMAQADEKTTANDAHDLAYSLGASLGERLRQEVPQLQIQALIEGLQQAYQGKPLALSEARIEQILADHESQTAEQAAMPSTEAAMENERRFLTAEKAKPGVKELADGILLTELTPGNGTKAGPDGKVQVLYIGRLPDGTVFDQNSQPQWFNLDSVIAGWRTALQNMPVGAKWRLVIPSDQAYGADGAGDLIAPFTPLVFEVELRGATS

SEQ ID NO: 10739 - DNA, 732 bp, Saccharophagus degradans 2-40
  CDS (1)..(732): transl_table=11
atgaaaaaactaccattggttacagctatgtgcgcagtgatcgcattggctgggtgcaacaaagaagaagcatccgttaaaaaagaattggtattggaaacctccgagcaaaaagttagctatcttattggccaaaacttagggtccaacatgggccaagataagtttgagttggatatggatgcaatggttgcgggcttagaagaaggtcttgcgggtaaagaaagccgcatttctgaagaagacgctcgcgccgtaatgatggctttccaagccgagcaacgcgccaaaatggaagcggctcagcaagaagaagcgcaaaaaactttggctgaggcacaagctttcttagctgaaaacgccactaaagaaggtgtagtacaaaccgaaagcggcttacagtataaagaattgaaagctggcgacggcgcaacccctaccgcatctgacacggttgtggttcactactctggtacgttattagacggtaccgaatttgacagctctcacaagcgcggtaagcctgctgaatttatggtgggtgcacttattcctggttgggttgaagcgctacagttgatgcaagtgggcgacgagtgggaactatatgtacctgccgacttagcttacggccctggcggcacgccaaacattcctggcaactctacgttgatcttcaaaatggaattgttagacatcaaagctaaagaggctcctgctgaagcgaaataa

SEQ ID NO: 10740 - protein, 243 aa, Saccharophagus degradans 2-40
MKKLPLVTAMCAVIALAGCNKEEASVKKELVLETSEQKVSYLIGQNLGSNMGQDKFELDMDAMVAGLEEGLAGKESRISEEDARAVMMAFQAEQRAKMEAAQQEEAQKTLAEAQAFLAENATKEGVVQTESGLQYKELKAGDGATPTASDTVVVHYSGTLLDGTEFDSSHKRGKPAEFMVGALIPGWVEALQLMQVGDEWELYVPADLAYGPGGTPNIPGNSTLIFKMELLDIKAKEAPAEAK

SEQ ID NO: 10741 - DNA, 879 bp, Acidobacteria bacterium Ellin345
  CDS (1)..(879): transl_table=11
atgcaaacatccaaaacttccatccttgtgcttctcgcgacaggaatggcgctgagcggactcggcttggcgcagacacctgctgcttccaccaaacccgccaccggcactaagaccgcaacagccacacctgccacgaaaggcacaaccgcaaagagcacaaccgccgctccgttgaaactcacgaccgacaaagaaaaggcgagttacgccatcggtatgagcgtcggcaagaagatccacgacgataaggtcgacatcaacctgctgcttctccagcgtggactgaaggatgggattgcaggcgggaaggctttgctaactgacgaggaagtgcgtacggctttggtaaacctgcagaagacgatgcgggacgacatgctggcgaagaacaagaagcagggcgtagattacctggcggcaaacaaagcgaagccgggcgtggttacgctgccggatgggctgcaatataaggtcatccagcaaggatcaggaccgaagccgactgcttcagattcagtggtgtgcaactacaagggcaccttcatcgatggcaaagagtttgacagctcgtacaagcgcggggagcccgctacgtttccggtcactggtgtgatcaaaggttggacggaagtgttgcagatgatgccggtgggatcaaaatggcagctcgtcataccctctgagcttgcgtacggagagaacggccgtcccagcattccgcccaattccacgctggtcttcgaagtggaactcgtgaagattgcggagaagccgaaagcggaacccgcgccccaagcaacggatggtgccggccagccaggtcagcaggcgccgcccgataaatcttcgcagcccccgcaaaaccctaagaactag

SEQ ID NO: 10742 - protein, 292 aa, Acidobacteria bacterium Ellin345
MQTSKTSILVLLATGMALSGLGLAQTPAASTKPATGTKTATATPATKGTTAKSTTAAPLKLTTDKEKASYAIGMSVGKKIHDDKVDINLLLLQRGLKDGIAGGKALLTDEEVRTALVNLQKTMRDDMLAKNKKQGVDYLAANKAKPGVVTLPDGLQYKVIQQGSGPKPTASDSVVCNYKGTFIDGKEFDSSYKRGEPATFPVTGVIKGWTEVLQMMPVGSKWQLVIPSELAYGENGRPSIPPNSTLVFEVELVKIAEKPKAEPAPQATDGAGQPGQQAPPDKSSQPPQNPKN

SEQ ID NO: 10743 - DNA, 756 bp, Myxococcus xanthus DK 1622
  CDS (1)..(756): transl_table=11
atgaaaggtggatgcatgcgatcgatgtggacggcggccctggtgttcgcgctcggcgcgacgggcgcccaggcgcaggactcgaagtcggcgaagaagcccgcggccaaggccgcaccggcgactccggccgccgcgccggcggcgcccgctgcgctgtccgaggaggaccagcagaccctctacacgctcggtctctccattggccgtgatttgtccctcttcgcgctgtcgcccgaggagttgaaggtgctgcaacagggcctgtccgacggactcggtggaaagacgtccgacatcgacccgaaggagcaggctcagcggattcaggccttcgccaagagccggcaggcccttgcgggcaaggccgcgctggagcgcgccgccaaggagcccggcgcggaggtgcttccctccggcgtcatctacaagcaggtccaggcgggaaccggccgcagcccgcgcgccgtcgacaccgtcaaggtccactacgagggccggctggtggacggcaccatcttcgacacctccgcccgccgtggaatccccgtcgagttcccgctcaacggcgtcatcccctgctggacgcagggcgtggcgaagatgaaggtgggcggcaaggcgaagctcacctgccctggcaacaccgcctacggtgagcggccgccctctggctcgcgcatcccgcccaacgccgtcctcaccttcgacgtcgagctcatcgacatccccggcgacacgtcccggcagccgtag

SEQ ID NO: 10744 - protein, 251 aa, Myxococcus xanthus DK 1622
MKGGCMRSMWTAALVFALGATGAQAQDSKSAKKPAAKAAPATPAAAPAAPAALSEEDQQTLYTLGLSIGRDLSLFALSPEELKVLQQGLSDGLGGKTSDIDPKEQAQRIQAFAKSRQALAGKAALERAAKEPGAEVLPSGVIYKQVQAGTGRSPRAVDTVKVHYEGRLVDGTIFDTSARRGIPVEFPLNGVIPCWTQGVAKMKVGGKAKLTCPGNTAYGERPPSGSRIPPNAVLTFDVELIDIPGDTSRQP

SEQ ID NO: 10745 - DNA, 780 bp, Myxococcus xanthus DK 1622
  CDS (1)..(780): transl_table=11
atgcagaagacgtggctggtcgcgggaatgctggtgctggcgggctgccagcagcagggcaagacggattcgacgccggcggcgacggcgacggcgcccggcgcgagcgcgaatccgcagacggaggaccagaagacgctgtacgcgctcggcctgtccattggccgcagcgtgagcgtgttcgacatgactcccgaggagctggagtacgtcaaggcgggcatcaccgcgcaggtgaagggcgacaagcccgcggtggagctggagacgtacggcccgaagctgcaggagctggcgcgcgcgcgcagcacccgcaaggcggaggctgagaaggagaaggcgaaggcgttcctggagacggcctcgaaggaagagggcgcccagaagacggagtccggcctcatctacaaggagctgaccgccggtacgggcgcgtcgccccaggcgtcggacatcgtgaaggtgcactaccgtggcacgctgccggacggcaccgagttcgacagctcgcacaagcgtggcgagcccacgcagttcccgctccagggcgtcatcaagtgctggaccgagggcgtgcagaagatgaaagtgggcggcaaggccaagctcgtgtgcccgtccgacatcgcctacggtgaccgcggcgcgccgccgaacatcccgggtggcgccgccctggtgttcgaggtggagctgctggagatcgtcaagccgccggagatgccggccatgggcggcacgccgccggcgggcaagccctccgcggccgagaagaagtag

SEQ ID NO: 10746 - protein, 259 aa, Myxococcus xanthus DK 1622
MQKTWLVAGMLVLAGCQQQGKTDSTPAATATAPGASANPQTEDQKTLYALGLSIGRSVSVFDMTPEELEYVKAGITAQVKGDKPAVELETYGPKLQELARARSTRKAEAEKEKAKAFLETASKEEGAQKTESGLIYKELTAGTGASPQASDIVKVHYRGTLPDGTEFDSSHKRGEPTQFPLQGVIKCWTEGVQKMKVGGKAKLVCPSDIAYGDRGAPPNIPGGAALVFEVELLEIVKPPEMPAMGGTPPAGKPSAAEKK

SEQ ID NO: 10747 - DNA, 633 bp, Haemophilus somnus 129PT
  CDS (1)..(633): transl_table=11
atgacaaaacaattttttgcacaggttgccttagatgatgtttcagctcaaggtagttatggtatcggtttacaaatcggtcaacaattagtcgatagcaaattagcggttaaagctgaagccgttgcaaaagggatttatgacgcattgaatcaaaatccgcccgctttagaattaaacgaagttgctaaagcgttacaggaattacagcaacaagccagcgaaattgcacaagcacaatttaagcaaattgaagaagaaggtaaaaaataccttgaagaaaatgcgaaaaaagactgcgtaaaagtaactgaaaccggtttgcaatatgaagtgttagtagaaggtaatggtgcaattccaactcgtcaagatcaggttcgtgttcattatacagggactttaattgacggtactgtatttgatagctcggtaaatcgtgggcaaccagccgaatttccagtaagtggcgtaattgcaggttggattgaagcattatctatgatgccgctaggttcaaaatggaaattaactattccacatcatttggcttatggtgaacgtggtgccggtgcatcaattccaccgttcagcacgttggtatttgaagtggaattattggatattttgtaa

SEQ ID NO: 10748 - protein, 210 aa, Haemophilus somnus 129PT
MTKQFFAQVALDDVSAQGSYGIGLQIGQQLVDSKLAVKAEAVAKGIYDALNQNPPALELNEVAKALQELQQQASEIAQAQFKQIEEEGKKYLEENAKKDCVKVTETGLQYEVLVEGNGAIPTRQDQVRVHYTGTLIDGTVFDSSVNRGQPAEFPVSGVIAGWIEALSMMPLGSKWKLTIPHHLAYGERGAGASIPPFSTLVFEVELLDIL

SEQ ID NO: 10749 - DNA, 687 bp, Haemophilus somnus 129PT
  CDS (1)..(687): transl_table=11
atgttaaaaattaaaaaacgttctgcaatagcgttaatagcaagtgcggtcgtttctcaatctgtttttgctgataagcagttcaatgatgatgtttcttatgctttgggctattttatgggaaaatatttaacggtgatgggtgaagaacacaaagatgttgccagttacaattatgagaaaattgtcgctggcattaaagatgttgtagaaaataaaagcactttaactgatgaaaaagcacaagaaacgttgcaagagttagaaaacaaagcacgtcatgcaaaaatggctaaaatcaaagctgaaaatgagaaatttacagcagaatttgctaaaaaatcgaatgtgaaaaaaacggaaagcggtttactttatcgtattgaaaaaatgggagaaggtaagagcattaaaccgacagatcgtgttaaagtacattatacgggcaaactagccaatggcaaagtattcgatagttccagagagcgtggacaacctgctgaatttaaattaaatcaagtgattttaggttggaaagagggtttacaattcattaaaaaaggcggaaaaattgagttggttattcctgccgacttagcttatggcgaaagaggtgcaggtctaattccaccgagttcaacgctatattttgatattgaaatcttagatgtaacgtctgaaaaataa

SEQ ID NO: 10750 - protein, 228 aa, Haemophilus somnus 129PT
MLKIKKRSAIALIASAVVSQSVFADKQFNDDVSYALGYFMGKYLTVMGEEHKDVASYNYEKIVAGIKDVVENKSTLTDEKAQETLQELENKARHAKMAKIKAENEKFTAEFAKKSNVKKTESGLLYRIEKMGEGKSIKPTDRVKVHYTGKLANGKVFDSSRERGQPAEFKLNQVILGWKEGLQFIKKGGKIELVIPADLAYGERGAGLIPPSSTLYFDIEILDVTSEK

SEQ ID NO: 10751 - DNA, 780 bp, Shewanella sp. MR-4
  CDS (1)..(780): transl_table=11
atgaaaatatctatgccaacttcttttatcccaaaaaacctcacagtggcgacctgcgctgcattgtttgtctctatggcgagctttgctgccccaacgcttaaaaccgatgcggataaagcgtcttacagcatcggcgcctctgtgggtaattacatttctggccagatttataaccaagtcgaactgggcgccgaagtgaatgtggacttagtggtgaagggctttgtggatgcgctgaaaaaacagcagcaattaaccgatgaagaagtgctgacctatcttaaccaacgcgccgaacagttaaaccaagtgagaaaggctaacgccgagaagctcgctgcggaaaacactaaggcaggtgaagcatatcttgctgaaaataagaagaaatcaggcgtaaccgttacagagtcaggcctgcaatacgaagtgttaacccaaggctctggcaataaacccaaccctgaagatgtggtcaccgtcgagtacgttggcaagcttatcgatggcaccgagtttgaaaataccgtcggccgtgaggaacccacacgtttcgccctgatgacagtcatcccaggttgggaagagggcttaaaactcatgcctatgggctctaaataccgttttgttatcccggcagagctggcctatggcaatgagtttgtcggtgaaatcccaccgcaatccaccttaatttttgaaatcgaactgaaaaatatcgaaaagcccagcgagaaaaaagaagcccgcatgatgggcatgatgcctgcccactaa

SEQ ID NO: 10752 - protein, 259 aa, Shewanella sp. MR-4
MKISMPTSFIPKNLTVATCAALFVSMASFAAPTLKTDADKASYSIGASVGNYISGQIYNQVELGAEVNVDLVVKGFVDALKKQQQLTDEEVLTYLNQRAEQLNQVRKANAEKLAAENTKAGEAYLAENKKKSGVTVTESGLQYEVLTQGSGNKPNPEDVVTVEYVGKLIDGTEFENTVGREEPTRFALMTVIPGWEEGLKLMPMGSKYRFVIPAELAYGNEFVGEIPPQSTLIFEIELKNIEKPSEKKEARMMGMMPAH

SEQ ID NO: 10753 - DNA, 618 bp, Shewanella sp. MR-4
  CDS (1)..(618): transl_table=11
atgtctgataaattcagtactgttgaacagcaagcaagctatggtgtaggtcgtcaaatgggcgagcaactggctgctaattcttttgaaggtgtggatattgctgccgttcaagcaggtttagccgatgcatttgctggcgttgaaagcgctgtatctatgcaagatatgcaagttgcattcactgagatcagccgtcgtattcaagcggctcaagagcaagctgctgctgccgcttctgctgaaggcgaagcctttttagctgaaaacgctaagcgtgccggcgtgaccgtgactgactctggtctgcaatacgaagtattagttcaaggtagcggtgcaaaaccaacctacgaagacactgtgcgtactcactaccatggttctttcatcaatggtgatgtgttcgatagctctgttgttcgtggtcaaccagctgaattcccagtatctggcgttatcgctggctggactgaagcgctgcaactgatgccagttggtactaagttaaaattattcgttccacatcacttagcttacggtgagcgtggtgcgggtgcttctattcctccatactcaaccttagtgtttgaagtcgagttattagacatcgtctaa

SEQ ID NO: 10754 - protein, 205 aa, Shewanella sp. MR-4
MSDKFSTVEQQASYGVGRQMGEQLAANSFEGVDIAAVQAGLADAFAGVESAVSMQDMQVAFTEISRRIQAAQEQAAAAASAEGEAFLAENAKRAGVTVTDSGLQYEVLVQGSGAKPTYEDTVRTHYHGSFINGDVFDSSVVRGQPAEFPVSGVIAGWTEALQLMPVGTKLKLFVPHHLAYGERGAGASIPPYSTLVFEVELLDIV

SEQ ID NO: 10755 - DNA, 774 bp, Shewanella sp. MR-4
  CDS (1)..(774): transl_table=11
atgaaatcgatttataaattatcgttagttgcattggctgttattggcctatctgcttgtaatcaagaagaaaaagcaacaaatgcaagcacaaatgttgaattaacgactgaagcacaaaaagaagcctacagtgttggcgcttcaatcggtcgttatatgtctggccatatcaaagagcaagaagaattaggcctgccagttgaccgtacgctgatcgtgactggttttactaacggtctgaatgatcaactgaaattaaccgaagaagaaatgcaaaccattcttcaaggtttagataaaaagttaaacgacaaacgtcaagaacaagcgacagccattgctgctaaaaacatcgaggaaggtaaaaagttcctcgaggaaaacaaagctaagccaggcgttgtgaccactgaatcgggcctgcaatacgaagtattaacgccaggttctggtgaaaagccagcggctgaagatacagtggaagtggattacgtaggtactctgcttgacggtactgagtttgatagctcatacaagcgtggtcaaaccgctaagttcccattgaaccgcgttattccaggttggaccgaaggcgtacagttaatgcctgttggcgctaagtacaagtttgtgatcccttcaaacttagcttacggtgagcgcgatactggtactatcccaccaaactcaaccctgatttttgaagttgaactgaaatcaattgagaaagcgcaagcggcaccagctgcagctgagcctgctaaaaagtaa

SEQ ID NO: 10756 - protein, 257 aa, Shewanella sp. MR-4
MKSIYKLSLVALAVIGLSACNQEEKATNASTNVELTTEAQKEAYSVGASIGRYMSGHIKEQEELGLPVDRTLIVTGFTNGLNDQLKLTEEEMQTILQGLDKKLNDKRQEQATAIAAKNIEEGKKFLEENKAKPGVVTTESGLQYEVLTPGSGEKPAAEDTVEVDYVGTLLDGTEFDSSYKRGQTAKFPLNRVIPGWTEGVQLMPVGAKYKFVIPSNLAYGERDTGTIPPNSTLIFEVELKSIEKAQAAPAAAEPAKK

SEQ ID NO: 10757 - DNA, 774 bp, Shewanella sp. MR-7
  CDS (1)..(774): transl_table=11
atgaaatcgatttataaattatcgttagttgcattggctgttattggcctatctgcttgtaatcaagaagaaaaagcaacaaatgcaagcacaaatgttgaattaacgactgaagcacaaaaagaagcctacagtgttggcgcttcaatcggtcgttatatgtctggccatatcaaagagcaagaagaattaggcctgccagttgaccgtacgctgatcgtgactggttttactaacggtctgaatgatcaactgaaactaaccgaagaagaaatgcaaaccattcttcaaggtttagataaaaagttaaacgacaaacgtcaagaacaagcgacagccattgctgctaaaaacatcgaggaaggtaaaaagttcctcgaggaaaacaaagctaagccaggcgttgtgaccactgaatcgggcctgcaatacgaagtattaacgccaggttctggtgacaagccagcggctgaagatacagtggaagtggattatgtaggtactctgcttgacggtactgagtttgatagctcatacaagcgtggtcaaaccgctaagttcccattgaaccgcgttattccaggttggaccgaaggcgtacagttaatgcctgttggcgctaagtacaagtttgtgatcccttcaaacttagcttacggtgagcgcgatactggtactattccaccaaactcaaccctgatttttgaagttgaactgaaatcaattgagaaagcgcaagcggcaccagctgcagctgagcctgctaaaaagtaa

SEQ ID NO: 10758 - protein, 257 aa, Shewanella sp. MR-7
MKSIYKLSLVALAVIGLSACNQEEKATNASTNVELTTEAQKEAYSVGASIGRYMSGHIKEQEELGLPVDRTLIVTGFTNGLNDQLKLTEEEMQTILQGLDKKLNDKRQEQATAIAAKNIEEGKKFLEENKAKPGVVTTESGLQYEVLTPGSGDKPAAEDTVEVDYVGTLLDGTEFDSSYKRGQTAKFPLNRVIPGWTEGVQLMPVGAKYKFVIPSNLAYGERDTGTIPPNSTLIFEVELKSIEKAQAAPAAAEPAKK

SEQ ID NO: 10759 - DNA, 618 bp, Shewanella sp. MR-7
  CDS (1)..(618): transl_table=11
atgtctgataaattcagtactgttgaacagcaagcaagctatggtgtaggtcgtcaaatgggcgagcaactggctgccaattcttttgaaggtgtggatattgctgccgttcaagcaggtttagccgatgcatttgctggcgttgaaagcgctgtatctatgcaagatatgcaagttgcattcactgagatcagccgtcgtattcaagcggctcaagagcaagcagctgctgccgcttctgctgaaggcgaagcctttttagctgaaaacgctaagcgtgctggcgtgatcgtgactgactctggtctgcaatacgaagtattagttcaaggtagcggtgcaaaaccaagctacgaagacacagtgcgtactcattaccatggttctttcatcaatggtgacgtgttcgacagctctgttgttcgtggtcaaccagctgaattcccagtatctggcgttatcgctggctggactgaagcgctgcaactgatgccagttggtactaagttaaaattattcgttccacatcacttagcttacggtgagcgtggtgcgggtgcttctattcctccatactcaaccttagtgtttgaagtcgagttattagacatcgtctaa

SEQ ID NO: 10760 - protein, 205 aa, Shewanella sp. MR-7
MSDKFSTVEQQASYGVGRQMGEQLAANSFEGVDIAAVQAGLADAFAGVESAVSMQDMQVAFTEISRRIQAAQEQAAAAASAEGEAFLAENAKRAGVIVTDSGLQYEVLVQGSGAKPSYEDTVRTHYHGSFINGDVFDSSVVRGQPAEFPVSGVIAGWTEALQLMPVGTKLKLFVPHHLAYGERGAGASIPPYSTLVFEVELLDIV

SEQ ID NO: 10761 - DNA, 780 bp, Shewanella sp. MR-7
  CDS (1)..(780): transl_table=11
atgaaaatatctatgccaacttcttttatcccaaaaaccctcacagtggcgacctgcgctgcattgtttgtctctatggcgagctttgctgccccaacgcttaaaaccgatgcagataaagcgtcttacagcatcggcgcctctgtgggtaactacatttctggccagatttataaccaagtcgaactgggcgccgaagtgaatgtggacttagtggtgcaggggtttgtggatgcgctgaaaaagcagcagcaattaaccgatgaagaagtgctgacctatcttaaccaacgcgccgaacaattaaacgaggtacgtaaggctaacgccgagaagctcgctgcggaaaacactcaggcgggtgaagcttatcttgctgaaaataagaagaaatcaggcgttaaagtcacagactctggcctgcaatacgaagtgttaactcaaggtactggcaataagcccaacccagaagatgtggtcactgtcgagtacgttggcaagcttatcgatggcaccgagtttgaaaataccgtcggtcgtgaggaccccacacgtttcgccctgatgacagtcatcccaggttgggaagagggcttaagactcatgcctatgggctcgaaataccgttttgttattccagccaacttagcctatggcaatgagtttgtcggtgaaatcccgccgcaatccaccttaatttttgaaatcgaactgaaaaatatcgaaaagcccagtgagaaaaaagaagcccgcatgatgggcatgatgccagcccactaa

SEQ ID NO: 10762 - protein, 259 aa, Shewanella sp. MR-7
MKISMPTSFIPKTLTVATCAALFVSMASFAAPTLKTDADKASYSIGASVGNYISGQIYNQVELGAEVNVDLVVQGFVDALKKQQQLTDEEVLTYLNQRAEQLNEVRKANAEKLAAENTQAGEAYLAENKKKSGVKVTDSGLQYEVLTQGTGNKPNPEDVVTVEYVGKLIDGTEFENTVGREDPTRFALMTVIPGWEEGLRLMPMGSKYRFVIPANLAYGNEFVGEIPPQSTLIFEIELKNIEKPSEKKEARMMGMMPAH

SEQ ID NO: 10763 - DNA, 762 bp, Pseudomonas aeruginosa UCBPP-PA14
  CDS (1)..(762): transl_table=11
atgaaacaacatcggttggcagcagcgatcgcactggtcggtctggttctctccggctgcgattcgcagaccaacgttgagttgaagaccccggcgcagaaagcttcctatggtatcggcctgaacatgggcaagagcctgtcccaggaaggcatggacgacctggattcgaaagccgtcgccaagggcatcgaggacgccctcggcaagaagaagcagcagctcaccgatgaagagctgaccgaagccttcgccttcctgcagaaacgtgccgaggagcggatggccgccatcggcgacgaaaacgccaaggccggcaagaagttcctcgaggaaaacggcaagcgcgacggcgtgaccaccaccgcttccggcctccagtacgaaatcgtgaagaaggccgatggcccgcaaccgaaggccaccgacgtggtgaccgtccactacgaaggccgcctgaccgatggcaccgtcttcgacagctccatcgagcgcggcagcccgatcgacctgccggtcagcggcgtgatcccgggttgggtcgaagccctgcaactgatgcacgtcggcgagaagatcaagctgtacatccccagcgagctggcctacggcgcgcagagcccgagcccggcgatcccggccaactcggtactggtcttcgacatggaactgctcggcatcaaggatccgtccaagccggacgcggagcccgaggccggtgccgcagcgcagcccgaagccaaggcggacgcgaagaagtaa

SEQ ID NO: 10764 - protein, 253 aa, Pseudomonas aeruginosa UCBPP-PA14
MKQHRLAAAIALVGLVLSGCDSQTNVELKTPAQKASYGIGLNMGKSLSQEGMDDLDSKAVAKGIEDALGKKKQQLTDEELTEAFAFLQKRAEERMAAIGDENAKAGKKFLEENGKRDGVTTTASGLQYEIVKKADGPQPKATDVVTVHYEGRLTDGTVFDSSIERGSPIDLPVSGVIPGWVEALQLMHVGEKIKLYIPSELAYGAQSPSPAIPANSVLVFDMELLGIKDPSKPDAEPEAGAAAQPEAKADAKK

SEQ ID NO: 10765 - DNA, 618 bp, Pseudomonas aeruginosa UCBPP-PA14
  CDS (1)..(618): transl_table=11
atgagcgaactcaacctgaccactgacgaagcccgtgtcagctacggcatcggccgtcaactgggcgaccaactgcgcgagaatccggttccaggcatgaccctggacgcagtcctggccggcctgtccgatgcgttcgcaggtatcgacagccgggtttccggcgaggcgctgtcggccagcttccaggtgatccgcgaacgcatgcaggccgaagcccaggccaaggccgaagccgccgctggcgaaggccgcgcctacctggccgagaacgccaagcgcgaaggcgtgaccgtgctgccgtcgggcctgcaattcgaagtgctgagtactggcgagggcgccaagccttcccgcgaggataccgtgcgcacccactaccacggcaccctgatcgacggcaccgtattcgacagctcctaccagcgcggccagccggccgagttcccggtgggcggcgtgatcgccggctgggtcgaagcgctgcaactgatgaacgccggctccaagtggcgcctgcacgtaccgagcgaactggcctatggcggccaggcggtcggcagcattcccccgcacagcgtgctggtgttcgacgtcgaactgctggaaatcctctga

SEQ ID NO: 10766 - protein, 205 aa, Pseudomonas aeruginosa UCBPP-PA14
MSELNLTTDEARVSYGIGRQLGDQLRENPVPGMTLDAVLAGLSDAFAGIDSRVSGEALSASFQVIRERMQAEAQAKAEAAAGEGRAYLAENAKREGVTVLPSGLQFEVLSTGEGAKPSREDTVRTHYHGTLIDGTVFDSSYQRGQPAEFPVGGVIAGWVEALQLMNAGSKWRLHVPSELAYGGQAVGSIPPHSVLVFDVELLEIL

SEQ ID NO: 10767 - DNA, 795 bp, Solibacter usitatus Ellin6076
  CDS (1)..(795): transl_table=11
atgcgtggattgcttcttttgattcccgcggtgatgctcgctcagacagcgccggccccggcgcccaaagccgccaccaccgccaccggccagacggccgctcctaaacccgcgaccgctacgcccggacgcggcgcccccggacgcggcgccaccaccgccaggccggctgcccccaagcccgccgcccctcccccgttgactacggacgaccagaagaccatctacgcgctcggcctttcgatcgccaaatcgctgtcgcccttcgatctgtcgccggccgaaatcgacattatcaagcgcgccctcaccgacgcggccgccaacaagccggaagtgcaactggaagaatggggccccaagatcgacccgctcgtgcgtgctcgcggcgccaaagtcgccgaaagggagaaggctgcttccgcggcttacctggccaaatgcgccaccgagcccggcgcggtcaagactgaatccggaatgatcttcaaggaactgcgcgccggcaccggcgcatcgcccaaggccaccgataccgtgaaggtcaactaccgcggcaccctggtcaacggcaccgagttcgacagctcctacaagcgcaatgagcccgcctccttccccctgaacggcgtcatcccctgctggacggaaggcgtgcagcgcatgaaggtcggcggcaaggcgcagctggtctgcccctcgaacctcgcctatggcgatcagggacgtccgtcgatccccggcggagccacgctcatcttcgaaatcgaactgctcgatatcggcgccaaataa

SEQ ID NO: 10768 - protein, 264 aa, Solibacter usitatus Ellin6076
MRGLLLLIPAVMLAQTAPAPAPKAATTATGQTAAPKPATATPGRGAPGRGATTARPAAPKPAAPPPLTTDDQKTIYALGLSIAKSLSPFDLSPAEIDIIKRALTDAAANKPEVQLEEWGPKIDPLVRARGAKVAEREKAASAAYLAKCATEPGAVKTESGMIFKELRAGTGASPKATDTVKVNYRGTLVNGTEFDSSYKRNEPASFPLNGVIPCWTEGVQRMKVGGKAQLVCPSNLAYGDQGRPSIPGGATLIFEIELLDIGAK

SEQ ID NO: 10769 - DNA, 699 bp, Magnetococcus sp. MC-1
  CDS (1)..(699): transl_table=11
atgatgcgtttgattaaaccctctgcactggccttctgtctggtggttgctatgacgcccggatttggcatggcaggcaagctggagagcagcaaggatagactctcctatgctctgggggccgatttggccgatagcatgaccgagaacggttttgatgtagatccagatattttaatcatggggctgcgggataaattggcaggtcaggcgctgcaaatgagccctgaggagatgcaaaaggccatgaaagaggaaattttgcgccgccgtgccctggtgacggaaaaaaaagatagcctcaaaaaagataatctaaaagaggccgaagcgtttttgaaagagaatggccgcaagccaggtgtgcggaccaccatgtcggggttacaatacaaagagctcaaggcaggtaccggtgctaagccggccaatcgcaccgctaaagttaaggtgcactacgagggccgtttgttggatggtaccatttttgacagctcttataagcgtaacgagcctgttgagtttacgctgtcccaagtggttatgggctggaccgaggggctgcaattgatgaagacgggcagtatctatgaactctatctacctccccacttggcctatggcgaagcagggcgtccccctgtgatcgccccgaacaagctgctcatcttcaaggtggagctgcttgaggttaaataa

SEQ ID NO: 10770 - protein, 232 aa, Magnetococcus sp. MC-1
MMRLIKPSALAFCLVVAMTPGFGMAGKLESSKDRLSYALGADLADSMTENGFDVDPDILIMGLRDKLAGQALQMSPEEMQKAMKEEILRRRALVTEKKDSLKKDNLKEAEAFLKENGRKPGVRTTMSGLQYKELKAGTGAKPANRTAKVKVHYEGRLLDGTIFDSSYKRNEPVEFTLSQVVMGWTEGLQLMKTGSIYELYLPPHLAYGEAGRPPVIAPNKLLIFKVELLEVK

SEQ ID NO: 10771 - DNA, 780 bp, Shewanella sp. ANA-3
  CDS (1)..(780): transl_table=11
atgaaaatatctatgccaacttcttttatccccaaaaacctcacagtggcgacctgcgctgctttgtttgtctctatggcgagctttgctgcccctagccttaaaaccgatgcggataaagcgtcttacagcatcggcgcctccgtaggtaactacatttctggccagatttataaccaagtcgaactgggcgcagaagtgaatgtggacttagtggtgcagggctttgtcgatgcgctgaaaaaacagcagcaattaaccgatgaagaagtgctgacctatcttaatcagcgcgccgaagagttaaaccaagtgagaaaggcgaacgctgagaaactcgccgcggaaaatactcgggcgggtgaagcatatcttgctgaaaataagaaaaaatcaggcgtaaccgttacagaatcaggcctgcaatacgaagtattaacccaaggctcgggcaataagcccaaccctgaagatgtggtcaccgtcgagtatgtcggcaagcttatcgatggtactgagtttgaaaataccattggtcgtaaagaacccacacgtttcgctctgatgagcgtgatcccaggttgggaagagggcttaaaactcatgcctatgggctcgaaataccgttttgttattccagccaacttagcctatggcaatgaatttgtcggtgaaatcccaccgcaatccaccttaatttttgaaatcgaactgaaaaatatcgaaaagcccagtgagaaaaaagaagcccgcatgatgggtatgatgccagcccactaa

SEQ ID NO: 10772 - protein, 259 aa, Shewanella sp. ANA-3
MKISMPTSFIPKNLTVATCAALFVSMASFAAPSLKTDADKASYSIGASVGNYISGQIYNQVELGAEVNVDLVVQGFVDALKKQQQLTDEEVLTYLNQRAEELNQVRKANAEKLAAENTRAGEAYLAENKKKSGVTVTESGLQYEVLTQGSGNKPNPEDVVTVEYVGKLIDGTEFENTIGRKEPTRFALMSVIPGWEEGLKLMPMGSKYRFVIPANLAYGNEFVGEIPPQSTLIFEIELKNIEKPSEKKEARMMGMMPAH

SEQ ID NO: 10773 - DNA, 771 bp, Shewanella sp. ANA-3
  CDS (1)..(771): transl_table=11
atgaaatcgatttataaattatcgttagttgcattggctgttattggcctatctgcttgtaatcaagaagaaaaagcaacaaatgcaagcacaaatgttgaattaacgactgaagcacaaaaagaagcctacagtgttggcgcttcaatcggtcgttatatgtctggccatatcaaagagcaagaagaattaggcctgccagttgaccgtgcgctgatcgtgactggttttactaacggtctgaatgaccaactgaaattaaccgaagaagaaatgcaaaccattcttcaaggtttagacaaaaagttaaacgacaaacgtacagaacaagctaaagccattgcagcgaaaaacatcgaggacggtaaaaagttcctcgaggaaaacaaagctaagcctggcgtagtaaccactgaatcgggtctgcaatacgaagtgttaacaccaggttctggtgacaagccagcggctgaagacactgtagaagtggattacgtaggtactctgcttgacggcactgagtttgatagctcatacaaacgtggtcaaacggctaagttcccattaaaccgcgttattccaggctggaccgaaggcgtacagttaatgcctgtgggcgctaagtacaagtttgtgatccctgcaaacttagcttacggcgaccgtgatactggtactattccaccaaactcaaccctgatttttgaagttgaactgaaatcaattgagaaagcacaagcggctcctgctgctgagcctgctaaaaagtaa

SEQ ID NO: 10774 - protein, 256 aa, Shewanella sp. ANA-3
MKSIYKLSLVALAVIGLSACNQEEKATNASTNVELTTEAQKEAYSVGASIGRYMSGHIKEQEELGLPVDRALIVTGFTNGLNDQLKLTEEEMQTILQGLDKKLNDKRTEQAKAIAAKNIEDGKKFLEENKAKPGVVTTESGLQYEVLTPGSGDKPAAEDTVEVDYVGTLLDGTEFDSSYKRGQTAKFPLNRVIPGWTEGVQLMPVGAKYKFVIPANLAYGDRDTGTIPPNSTLIFEVELKSIEKAQAAPAAEPAKK

SEQ ID NO: 10775 - DNA, 618 bp, Shewanella sp. ANA-3
  CDS (1)..(618): transl_table=11
atgtctgataaattcagtactgttgaacagcaagcaagctatggtgtaggtcgtcaaatgggcgagcaactggctgctaattcttttgaaggtgtggatattgctgccgttcaagcaggtttagccgatgcatttgctggcgttgaaagcgctgtatctatgcaagatatgcaagttgcattcactgagatcagccgtcgcattcaagcggctcaagagcaagctgcagcagaagcttctgccgaaggcgaagcctttttagctgaaaacgctaagcgtgcaggcgtgatcgtgactgactctggtctgcaatacgaagtattagttcaaggtagcggtgcaaaaccaacctacgaagacacagtacgtactcactaccatggttctttcatcaatggtgacgtgttcgacagctctgttgttcgtggtcaaccagctgaattcccagtatctggcgttatcgctggctggactgaagctctgcaactgatgccagttggtaccaagttaaagttattcgttccacatcacttagcatacggtgagcgtggtgcgggtgcttctattcctccatactcaacgttagtattcgaagtcgagttattagacatcgtctaa

SEQ ID NO: 10776 - protein, 205 aa, Shewanella sp. ANA-3
MSDKFSTVEQQASYGVGRQMGEQLAANSFEGVDIAAVQAGLADAFAGVESAVSMQDMQVAFTEISRRIQAAQEQAAAEASAEGEAFLAENAKRAGVIVTDSGLQYEVLVQGSGAKPTYEDTVRTHYHGSFINGDVFDSSVVRGQPAEFPVSGVIAGWTEALQLMPVGTKLKLFVPHHLAYGERGAGASIPPYSTLVFEVELLDIV

SEQ ID NO: 10777 - DNA, 807 bp, Neisseria meningitidis FAM18
  CDS (1)..(807): transl_table=11
atgaacaccattttcaaaatcagcgcactgaccctttccgccgctttggcactttccgcctgtggcaaaaaagaagccgcatccgaacctgccgccgcttctgccgcgcagggcgacacctcttcgatcggcagcacgatgcagcaggcaagctatgcgatgggcgtggacatcggacgctccctgaagcaaatgaaggaacagggtgcggaaatcgatttgaaagtctttaccgaagccatgcaggcagtgtatgacggcaaagaaatcaaaatgactgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggtgaaggcaaacagccgtccaaagacgacatcgttaccgtggaatacgaaggccgcctgattgacggtacggtattcgacagcagcaaagccaacggcggcccggtcaccttccctttgagccaagtgattccgggttggaccgaaggcgtacagcttctgaaagaaggcggcgaagccacgttctacatcccgtccaaccttgcctaccgcgaacagggtgcgggcgacaaaatcggcccgaacgccactttggtatttgatgtgaaactggtcaaaatcggcgcacccgaaaacgcgcccgccaagcagccggctcaagtcgacatcaaaaaagtaaattaa

SEQ ID NO: 10778 - protein, 268 aa, Neisseria meningitidis FAM18
MNTIFKISALTLSAALALSACGKKEAASEPAAASAAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPSKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 10779 - DNA, 726 bp, Haemophilus influenzae R2846
  CDS (1)..(726): transl_table=11
atgttaaaaattcaaaaattatctatcgcagcattaatggtaagtgcggtaatttctagtcaagtttttgcagaagataacacattcgatgaaaaagcggcatcttatgcagtaggtacgctcatgggcagtcaaatgaaagatcttgttgattcccacaaagaagttattaaatatgataatgtgcgtattttagatggcttaaaagatgctttagaaggcaaagtggatgttcgtaaagatgaaaaaatccaaaaaaccttagaatctattgaagcaaaattagtggctgcatcaaaagcaaaagcagaagcgattgctaaacaagcaaaagaagaaggcgataaattccgtgctgaatttgctaaaggtaaagatgtaaaaacgacgcaatctggtttaatgtataaaattgaaagtgcaggtaaaggcgatacaatcaaatcaacggatacggttaaagtacattacacgggtaaattaccaaatggaaaagtatttgatagctctgtcgagcgcggacaacctgtagaattccaacttgatcaagtaattaaaggctggactgaaggtcttcaattagtgaaaaaaggcggaaaaattcaattagttattgcacctgaattaggctatggcgaacaaggtgctggcgcatctattccaccaaattcaacattaatttttgatgtggaagtattagacgtcaatccgaaatctgaaaaataa

SEQ ID NO: 10780 - protein, 241 aa, Haemophilus influenzae R2846
MLKIQKLSIAALMVSAVISSQVFAEDNTFDEKAASYAVGTLMGSQMKDLVDSHKEVIKYDNVRILDGLKDALEGKVDVRKDEKIQKTLESIEAKLVAASKAKAEAIAKQAKEEGDKFRAEFAKGKDVKTTQSGLMYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 10781 - DNA, 957 bp, Xylella fastidiosa Ann-1
  CDS (1)..(957): transl_table=11
atgaagatacaaatgcgccatgctgtcgtgtcgctactggtcgcagcaatgtctgcctccttacccgctatgtccaaacaatcggtttccgttgtgaataatcaagagaaaacggtgttgagcaccgaaaaagagaaagtcagttatgccattggtttggacattgcgcgatcgcatgtgttcgagctgattgctcaagacattgatgttgctgcactacagcgtgcgatcgaaaatgtcttcaagggtgggccgcctttgatctctgaggaagttgctcagacaaccgatactgcgctgcgtgccatgttggcagcccgttccgggcaacaggaagcttcggggactgcgccgcctgctgtatccaaagagaatattggtctcatgcttgggagctatatggtcggcccgtcgctgctggcgatcaaggatgatattgatcttccggtgcttctacaggcactgcgtaccagattcgcaaagcgcacaccgttgatggatgaacaagaaatgaccacaaggatgcaagcatttgtggcctctaaaaatgctgtggttgcaggaaaaaatcgtgatgagggcagtgcttttctctctaagaacaagaacgagaagggcgtggtcaccaccgcttcaggtcttcagtacatggtgttgcggcagggaagcggctcacgtccgaccccaagtaataatgtgcgtgtcaactacgagggcaagctgctcagcggtcaagtgtttgatagctcttatcagcgtggtcagccggccgaatttggtcttgctcaggtgattaaagggtggtctgaggggctgtcgttgatgtctgtcggttctaagtaccgtttttggattcctgctgatcttgcttacgggcagcaggggactccgggtggtccgattggccctgatgcaacgttgacctttgacgtggagctgctcagtatcctcccttaa

SEQ ID NO: 10782 - protein, 318 aa, Xylella fastidiosa Ann-1
MKIQMRHAVVSLLVAAMSASLPAMSKQSVSVVNNQEKTVLSTEKEKVSYAIGLDIARSHVFELIAQDIDVAALQRAIENVFKGGPPLISEEVAQTTDTALRAMLAARSGQQEASGTAPPAVSKENIGLMLGSYMVGPSLLAIKDDIDLPVLLQALRTRFAKRTPLMDEQEMTTRMQAFVASKNAVVAGKNRDEGSAFLSKNKNEKGVVTTASGLQYMVLRQGSGSRPTPSNNVRVNYEGKLLSGQVFDSSYQRGQPAEFGLAQVIKGWSEGLSLMSVGSKYRFWIPADLAYGQQGTPGGPIGPDATLTFDVELLSILP

SEQ ID NO: 10783 - DNA, 618 bp, Pseudoalteromonas tunicata D2
  CDS (1)..(618): transl_table=11
atgtctgataaatttacaactcacgctgagcaagcaagctacggtatcggtttacaaatgggtgatcaattaaaagcaaatccatttgatggcttaaacttaaacgctgtgtttgaaggtatgaaagacgcttatactgatgctgatttccaagttgaaatcccagcaatccaagctgcatttgaacttattaatactgaaattcaagctcgtcaagaagagcaagctaaagtattagctgccgaaggcgaagctttcctagctgataatgcacagcgtgctgaagtgactgtaactgcatctggtttacaatatgaagtactaacgactggtgaaggcgaaaaaccgactgcggcttcaactgtgcgtacgcattatcatggtacattagtcaatggtactgtgtttgatagctcttatgagcgtggccaaccagctgaatttccagtaggtggcgtgatcaaaggttggactgaagcattacaaatgatgactgttggctcaaaatggcgtttatacgtaccacatgatcttgcttatggcgagcgtggtgctggtgcttctattgcgccattctctacattaatctttgatgttgaattaatcgctatcgtttaa

SEQ ID NO: 10784 - protein, 205 aa, Pseudoalteromonas tunicata D2
MSDKFTTHAEQASYGIGLQMGDQLKANPFDGLNLNAVFEGMKDAYTDADFQVEIPAIQAAFELINTEIQARQEEQAKVLAAEGEAFLADNAQRAEVTVTASGLQYEVLTTGEGEKPTAASTVRTHYHGTLVNGTVFDSSYERGQPAEFPVGGVIKGWTEALQMMTVGSKWRLYVPHDLAYGERGAGASIAPFSTLIFDVELIAIV

SEQ ID NO: 10785 - DNA, 759 bp, Pseudoalteromonas tunicata D2
  CDS (1)..(759): transl_table=11
atgaaaaaaacactaaaattatctttgatcgcagcgtctgtactcgctttaacagcctgtaatcaagaagcaaaacaagaaacagccgcagaagtgaaattagatactgtagcgcaacagcaagcttatggtattggtgcgtctgttggtggcttcttacaaaaagatttagccgataaaaaagcgctgggttttgagttagatcaagcgttattagttaaaggttttcaagatgcgctagctggttcggcaaaaatcgaagaagataaaattcgtgaagtattaactcagttagatactgatgtgcgtgctaaacaagaagaaaaagcgaaattagatgctgaagaaaacaaagcaaaaggtttagctttcttaactgaaaacggtaagcgtgaaggtgtgacaactacagagtcaggtttacaatatgaagtacttgcccaaggtgaaggtgcaaaaccatcagaaactgatgtggtggttgttcactataaaggtactttaattgatggtactgaatttgatagttcttacaaacgtaatgagccagtaaacttcccacttaaccgtgttattaaaggttggactgaaggcgttcagttaatgaatgtaggttcaaagtttaaatttgcgatcccttcagaacttgcatacggtgagcgagctttaggcaacattcctgcacattcaacgctgatttttgaagtagaactacttgaaattgaacagcctgaaaaagctgaagctgctggcgagtaa

SEQ ID NO: 10786 - protein, 252 aa, Pseudoalteromonas tunicata D2
MKKTLKLSLIAASVLALTACNQEAKQETAAEVKLDTVAQQQAYGIGASVGGFLQKDLADKKALGFELDQALLVKGFQDALAGSAKIEEDKIREVLTQLDTDVRAKQEEKAKLDAEENKAKGLAFLTENGKREGVTTTESGLQYEVLAQGEGAKPSETDVVVVHYKGTLIDGTEFDSSYKRNEPVNFPLNRVIKGWTEGVQLMNVGSKFKFAIPSELAYGERALGNIPAHSTLIFEVELLEIEQPEKAEAAGE

SEQ ID NO: 10787 - DNA, 855 bp, Photobacterium sp. SKA34
  CDS (1)..(855): transl_table=11
atgaaacctgttctaaagatgtctgtattggcagcaacaattttcctcgctgttggttgtcaggatgataataaagcagacaccaataagcctgcagagcctgcgaaagtagagcaggttgctgctaagactccagcagctgatgctaaagtagaatttaaaactgaagatcaaaaagctgcttatgcaattggtgcgtcactggcccaatatctctctgctaaccttgagcagcaaaaagagctgggtctagacctaaaccgtcaagacgtacttcaaggtgttgaagatgtatttgcgggtaagagtcgtttaacgcaagagcaaacccaacaagcgcttcaagagcttgaccagcgcgtagctaaaattgttgaagaaaaagcaaaaactgaagctgaaaaaaacgtaaaagccggtgaagagttccgtactaagttctcgaaagaaacgggtgtagtaacaactaaaacgggcctaatgtacaagattgaaaaagaaggtacaggtccaaaaccaacagcaaccgatacagttgaagttcattacaaaggcatgctaactgacggtactgtatttgacagttcttacaagcgtaatcaacctgcaactttccctctaaatcaagttatccctggttggactgaaggtgttcagctaatgcctgtaggctcaaagtttgagtttgttattccgccacagctagcttacggcgcacaagcaaacccaagcattcctgctaactcaacattggtattccaagttgagctactaagtattaaaggtaatgaaactgcaaaacctgcagcggcaccagctgaaaaatcagcagctacagagacaaaaacacaataa

SEQ ID NO: 10788 - protein, 284 aa, Photobacterium sp. SKA34
MKPVLKMSVLAATIFLAVGCQDDNKADTNKPAEPAKVEQVAAKTPAADAKVEFKTEDQKAAYAIGASLAQYLSANLEQQKELGLDLNRQDVLQGVEDVFAGKSRLTQEQTQQALQELDQRVAKIVEEKAKTEAEKNVKAGEEFRTKFSKETGVVTTKTGLMYKIEKEGTGPKPTATDTVEVHYKGMLTDGTVFDSSYKRNQPATFPLNQVIPGWTEGVQLMPVGSKFEFVIPPQLAYGAQANPSIPANSTLVFQVELLSIKGNETAKPAAAPAEKSAATETKTQ

SEQ ID NO: 10789 - DNA, 705 bp, Neptuniibacter caesariensis
  CDS (1)..(705): transl_table=11
atgaaacaaacgttactggcggttgcactgggtgccgcactggtatcttctacagctaccgcggtagagctgaaaactgacgagcagaaagagagctacgcgattggtttacagctgggcttgcaattgcaacaggttgataacatcgattttaaaattctgacagaaggcctgaaggcaacttataaccaggaagagcctgaaatgacacctgaagaggtgaacaaggctctgatgggcctgcagcagaaaatgcaggaaaaacagcgtcaggcattcgaaaagcttagctcagataaccttgaaaaaggtaaagagtatatggctgaaaacggtaagaaagacggtgtgacaaccactgagtctggcttgcagtttgaagaactggaagcaggcaaaggcaagaagccaacagcagacgataccgttaaagtacattatcgcggcacgctgatcgacggtacagagtttgatagctcttacgcgcgtcaggaacctgtttcattctctctgaaaggtgtgattcctggttggactgaaggtgtacagatgatcaaggaaggcggtaaagcgcgcctggtgattccagctgaccttgcttatggcccaggtggtatgggtaatgcgattggaccaaacgaaacgctggtttttgaaattgagcttctggaagtgaatccaggtgctgaagaagctgcgaagtaa

SEQ ID NO: 10790 - protein, 234 aa, Neptuniibacter caesariensis
MKQTLLAVALGAALVSSTATAVELKTDEQKESYAIGLQLGLQLQQVDNIDFKILTEGLKATYNQEEPEMTPEEVNKALMGLQQKMQEKQRQAFEKLSSDNLEKGKEYMAENGKKDGVTTTESGLQFEELEAGKGKKPTADDTVKVHYRGTLIDGTEFDSSYARQEPVSFSLKGVIPGWTEGVQMIKEGGKARLVIPADLAYGPGGMGNAIGPNETLVFEIELLEVNPGAEEAAK

SEQ ID NO: 10791 - DNA, 627 bp, Neptuniibacter caesariensis
  CDS (1)..(627): transl_table=11
atgtctgaagctaaattcgaaacactggaacaaaaagctagctacggtatcggtcgccagatgggcgatcagctggctcaacagccatttgacggcatggatctaaatgcaatctctgcaggtatcacggacgcgtttaacggcgaagcgatgcaggttgaagtacaagagattcaggaagcatttaacgtgatcaacgagcgtcttcgcgctaagcaggaagaagaagctaagaaagctgctgctgttggtgaagagttcctggctgaaaatgctaagcgtgacgaagtaaccgtacttgagtctggcctacagtacgaaatcatcgaagccggtgaagaaggtagtgaaaaacctactgctgagtctaaagttcgtacgcattaccacggcacattcatcgatggtaacgtattcgacagctcctatgatcgcggccagccggcagaattcccagtgggcggtgttatcgctggctggactgaagcactgcagcttatgaacaaaggcgctaagtggaagctatacatcccttacaacctggcatacggcgctcagggctccccgggcggcatccctccatattctgctctggtatttgacgtagaattgctggaaatcctgtaa

SEQ ID NO: 10792 - protein, 208 aa, Neptuniibacter caesariensis
MSEAKFETLEQKASYGIGRQMGDQLAQQPFDGMDLNAISAGITDAFNGEAMQVEVQEIQEAFNVINERLRAKQEEEAKKAAAVGEEFLAENAKRDEVTVLESGLQYEIIEAGEEGSEKPTAESKVRTHYHGTFIDGNVFDSSYDRGQPAEFPVGGVIAGWTEALQLMNKGAKWKLYIPYNLAYGAQGSPGGIPPYSALVFDVELLEIL

SEQ ID NO: 10793 - DNA, 711 bp, delta proteobacterium MLMS-1
  CDS (1)..(711): transl_table=11
atgaagcaaaaaatctgccgtttgcccctggtttttgccctgaccctggcggtcaccgcctgcgggcccaatgatacccaggccgacccgcaactggagacggtcaaggataaggtcagctacgccatcggcctcaacatcggtgaggatttcaccgcccagggcatggatatcgatgtcgacctgctggcccggggtatcaaggacgccgtcgcgcaggccgagccgctgctcagcgaagaagagatgcagcaggcgatcatggccttccaggaagagatggtcgcccgccaggaagagatgatgggcgaggcgggggccgaaaaccgccggctgggcgagcagttcctgcaggaaaacgccgccctggatgatgtggtggtcctggatagtggtctgcagtaccgggtggtggaggagggcgatggcgccagccccggtgccgccgacacggtggcggtgcattacgaaggtcgcctggttgatggcacggtctttgacagctcccaccagcgcggcgaacccgccgttttcccggtggaaggagtgattcccggctggacccaggccctgcaactgatgcaggaaggcgatcaatgggagatcgtgctgccctcggagctggcttacggcgcccagggcgccccgccggccatcgggccggattcggtgctggtcttcgacgtccagctactggaagttaatccttaa

SEQ ID NO: 10794 - protein, 236 aa, delta proteobacterium MLMS-1
MKQKICRLPLVFALTLAVTACGPNDTQADPQLETVKDKVSYAIGLNIGEDFTAQGMDIDVDLLARGIKDAVAQAEPLLSEEEMQQAIMAFQEEMVARQEEMMGEAGAENRRLGEQFLQENAALDDVVVLDSGLQYRVVEEGDGASPGAADTVAVHYEGRLVDGTVFDSSHQRGEPAVFPVEGVIPGWTQALQLMQEGDQWEIVLPSELAYGAQGAPPAIGPDSVLVFDVQLLEVNP

SEQ ID NO: 10795 - DNA, 612 bp, Oceanobacter sp. RED65
  CDS (1)..(612): transl_table=11
atgaaatttgagactccagcgcaaaaagtgagctacttgatcggtcgtcaagtgggtgatcaattaaaaggttcacaattcccaggctttgaactagatggcgtagtgaaaggtattcaggattcgatggcgggcgaagctatgccgtttagccaagaagaaatccaagaggcgtatcaagtgattcaagctgagcttgaaaagatgcaagcagaagctgcagaacaagccaaagcagtcggtgacgaattcctagccgaaaacgccaaaaaagaaggtgttcaagtaacggactctggtcttcagtatgaagtaattagtgaaggttcaggcgcgacgccaagtaaagaaaatacagtgcgtgtacattatcacggtaccttcatcgatggtcgtatgtttgatagttcagttgagcgtggtgagccagctgaattccctgtaggtggagtaatcgcaggctggacagaagcccttcaactgatgaaagaaggcgacaaatggcgtctaaccgtaccaagtgaattagcttatggtgcgcagggtagccaaggcgctattcctccacacagtgttttagtatttgaagtagaacttctaaacgtactgtaa

SEQ ID NO: 10796 - protein, 203 aa, Oceanobacter sp. RED65
MKFETPAQKVSYLIGRQVGDQLKGSQFPGFELDGVVKGIQDSMAGEAMPFSQEEIQEAYQVIQAELEKMQAEAAEQAKAVGDEFLAENAKKEGVQVTDSGLQYEVISEGSGATPSKENTVRVHYHGTFIDGRMFDSSVERGEPAEFPVGGVIAGWTEALQLMKEGDKWRLTVPSELAYGAQGSQGAIPPHSVLVFEVELLNVL

SEQ ID NO: 10797 - DNA, 687 bp, Oceanobacter sp. RED65
  CDS (1)..(687): transl_table=11
atgcgtaaattagccttagttacagcattgagtgcagctgccctagtagggtgcagccaagacaaagaagtcgctttagaaagtgatatcgacaaaatgagctatggtatcggcttgagtatggcacgcagtgttgctggtcagccaattgaatttaaccatgatgcattggtaatgggtcttaaagatgctttggctgaaaaagagccaaagattgatgaagccacccttcgtgaagcgtttgcatcggttcgtgagtcgcaaatgcagaaacaagaagaagcttctgctgaagcattgcaagtcggtgaagactatcttgcagaaaacgctaaaaaggaaggtgtagaaacaactgagagtggtcttcagtatgaagtgctgtcttctggtgagggcgcaacacctgctgcaacagatacagtaaaagttcattaccatggcactttgattgatggaactgtgtttgatagctctgttgagcgtgattcgccagcaacctttcctgttaaccgtgtgatcagtggttggaccgaagctcttcagttgatgcaagaaggtgataagtggcgcctgactgtacctgctgatttggcctatggtgcgcaaagcccaagtcctaagatcccagccaactctgtattgatctttgaagtagagttgctagaagttcaaaaagagtcttaa

SEQ ID NO: 10798 - protein, 228 aa, Oceanobacter sp. RED65
MRKLALVTALSAAALVGCSQDKEVALESDIDKMSYGIGLSMARSVAGQPIEFNHDALVMGLKDALAEKEPKIDEATLREAFASVRESQMQKQEEASAEALQVGEDYLAENAKKEGVETTESGLQYEVLSSGEGATPAATDTVKVHYHGTLIDGTVFDSSVERDSPATFPVNRVISGWTEALQLMQEGDKWRLTVPADLAYGAQSPSPKIPANSVLIFEVELLEVQKES

SEQ ID NO: 10799 - DNA, 729 bp, Alteromonadales bacterium TW-7
  CDS (1)..(729): transl_table=11
ttgtcattgattgcagcgtcggttttagcgcttacagcttgtaatcaagaagcaaaaaaagagcaagctgaagtaacattagacactgtagagcaacaacaagcatacggtattggtgcttctgtaggtaactttttaaataaagacctagcagacaaatctgaaattggcattgagctagaccaagcgctattaattcgtggttttgaagatgcacttgctggcaatgcaaaaattgacgaagaaaaaattcgtgaagtgttaacagctttagatacctcagtacgcactaagcaagaagaaaaagcaaaagttgagtctgaaaaaagcaaagcggcaggtgttcaatacctagctgataacgctaaaaaagaaggcgtaacagtaactgagtctggcctacaatacgaagtattaagcgaaggcgaaggcgaaaagccagcagcaacagacgttgttaaagtacattacaaaggtactttattagacggcactgagtttgacagctcatatgcgcgtaacgaaccaactacattcccacttaaccgcgtaattgctggttggacggaaggtttacagcttatgcctgtagggtctaagtacaagtttactattccttcagagcttgcttacggcgatcgtgaccttggtaaaattccagccaattcaacactggtttttgaagttgaattactagaaattcaaaatgcagaagcacctgcagaataa

SEQ ID NO: 10800 - protein, 242 aa, Alteromonadales bacterium TW-7
MSLIAASVLALTACNQEAKKEQAEVTLDTVEQQQAYGIGASVGNFLNKDLADKSEIGIELDQALLIRGFEDALAGNAKIDEEKIREVLTALDTSVRTKQEEKAKVESEKSKAAGVQYLADNAKKEGVTVTESGLQYEVLSEGEGEKPAATDVVKVHYKGTLLDGTEFDSSYARNEPTTFPLNRVIAGWTEGLQLMPVGSKYKFTIPSELAYGDRDLGKIPANSTLVFEVELLEIQNAEAPAE

SEQ ID NO: 10801 - DNA, 735 bp, marine gamma proteobacterium HTCC2143
  CDS (1)..(735): transl_table=11
atgaaacgtaaaatagtactggctgtcgctatcagtgcgacattgatagcatgtgatcaacaagccgctgaaccaacagtagatgccgctcccgccgctatgaccctcgatagtgaagtgaagagggtgagttatggcatgggtattgggctgggtcagcgtataaagcaagaatcattctccattgatgctgacgcgttctcacagggcgtaaaagatgccattgacggtgctgaacagttaatgtctcaggaagaaattatgacggaaatgcaggcctttcagcagcagcaaatggcccagcaacaagaagaagcgggtaaaattgctgagcagaatatggcggaaggcgagtcatttcttgtcgaaaatggaaccaaagatggtgttttgacgactgagagcggtttgcagtataaaattattacagcggggtctggtgctaagccggaggcaaccgatacggttgaagtccattatgcgggtactttgatcgatggtactgaatttgatagttcttatgcgcgtggcgccacggttagttttccagtcaatggcgtgattcctgggtggaccgaagcattgcagctgatgccggttggttcaaagtggcagctgttcattccttctgcgctggcttatggccccggcggcacgggtggtggtcctattggtcctaatgctacgttaatttttgatgtagagttgatatcgattaagggggcggaaggctaa

SEQ ID NO: 10802 - protein, 244 aa, marine gamma proteobacterium HTCC2143
MKRKIVLAVAISATLIACDQQAAEPTVDAAPAAMTLDSEVKRVSYGMGIGLGQRIKQESFSIDADAFSQGVKDAIDGAEQLMSQEEIMTEMQAFQQQQMAQQQEEAGKIAEQNMAEGESFLVENGTKDGVLTTESGLQYKIITAGSGAKPEATDTVEVHYAGTLIDGTEFDSSYARGATVSFPVNGVIPGWTEALQLMPVGSKWQLFIPSALAYGPGGTGGGPIGPNATLIFDVELISIKGAEG

SEQ ID NO: 10803 - DNA, 705 bp, marine gamma proteobacterium HTCC2143
  CDS (1)..(705): transl_table=11
atgatttttcattatccttttggcgattcagtagacaaaattatggtagacttccgttccattttttttagtgaagagagcactatgtctgataaatattctacggtagaacagcgggttagttacggtattggtcgccagatgggcgatcagttggcaagtaactcatttgatggggtcgatgttgacgccgtcgcagaaggtttgaaagatgccttgaacggtattcctagcgtggttgagaccggattgctgagagaggcttttgaagaaattactaagcgtatggaggccaaacaggccgaagagtcaaagacgcttgcagctgacggtgaggtatttctggcggaaaattcgcagcgggaaggcattacagttacggcgtcaggactacagtatgaagtgctgactgctggcgacggtgataagcctctagcaacgtcgaccgttcgcactcattatcacggtacgctagtggacggtactgtattcgatagttctgttgatcgtggtgaaccgacggagtttccagttaatggcgttatcgctggctggacagaagccttacaaatgatgggtgttgggtcaaagtggcgtttatatgttccgtacacactggcctacggtgaacgtggagcgggtggcgctatcggtccctatgcggcattagtctttgaagtcgaattattagccatcgtcagctag

SEQ ID NO: 10804 - protein, 234 aa, marine gamma proteobacterium HTCC2143
MIFHYPFGDSVDKIMVDFRSIFFSEESTMSDKYSTVEQRVSYGIGRQMGDQLASNSFDGVDVDAVAEGLKDALNGIPSVVETGLLREAFEEITKRMEAKQAEESKTLAADGEVFLAENSQREGITVTASGLQYEVLTAGDGDKPLATSTVRTHYHGTLVDGTVFDSSVDRGEPTEFPVNGVIAGWTEALQMMGVGSKWRLYVPYTLAYGERGAGGAIGPYAALVFEVELLAIVS

SEQ ID NO: 10805 - DNA, 717 bp, Marinobacter sp. ELB17
  CDS (1)..(717): transl_table=11
atgaagaaaacgctgtttgcactgacgattgccggccttgttgcgggctgctcttccgctcaagaagcacctaaagaccccgcgttggaatccaacagcgaaaaagtcagttacggcatgggcctggtaatgggtgagcgcatgggtaacgacctgccagacctgcagatggaacagtttctgcagggcatccagcacggcaacaacggcgaccaggcacagcgccggatgacccaggaagaaattcaggaagcgctgatggcttaccagcagaaactgcaggaagatcaatccaaacaaattgaggaaatggcgcagaaaaatgtgaatgcgggaaacgcttttctagctgaaaatgccaagcgcgagggcgtaagaaccaccgattccggcttgcagtacgaagtgcttgaagccggcaatggcccgcaaccaggcgccggcgaaacggtaacagtccactacacgggcgaattgttgaatggcgaggtgtttgacagctcccgcgagcgcggtgaaccggtctcattccgcctggaccaggttattcccggctggacagagggcctgcagctgatgaacgaaggcgcgcgttacaaactctatattccgtcagacctggcatatgggccgggcggcaatcgcgcgattggttccaatgaaacattggtgtttgacgtggaactgttggcggttaatccggacagcgcccagtaa

SEQ ID NO: 10806 - protein, 238 aa, Marinobacter sp. ELB17
MKKTLFALTIAGLVAGCSSAQEAPKDPALESNSEKVSYGMGLVMGERMGNDLPDLQMEQFLQGIQHGNNGDQAQRRMTQEEIQEALMAYQQKLQEDQSKQIEEMAQKNVNAGNAFLAENAKREGVRTTDSGLQYEVLEAGNGPQPGAGETVTVHYTGELLNGEVFDSSRERGEPVSFRLDQVIPGWTEGLQLMNEGARYKLYIPSDLAYGPGGNRAIGSNETLVFDVELLAVNPDSAQ

SEQ ID NO: 10807 - DNA, 753 bp, Moritella sp. PE36
  CDS (1)..(753): transl_table=11
atgaaaaaattttttaaagtaacggtactcgcttcagcagtatctctgttagcggcatgtggtcaagaagcaccagaagcgccagcagaaaaaataacagacattaagacttacagcgaagatcaacaagcggcttatgcaatcggttcaatcgttgcacgcaacttggttgcaccccttaagcgtcaagaagagctaggtgcaccattggataaagaaatcattgttcaaggtattactgatgcgttaaatgaatcaacgcaattatctgacgaagagctacaagctgtattaaaagcgtatgacgaaaaaatgaatacgctttcaacggaagctgcacgtattgaaggtgagaaactggaagctgaagctgctagtttctttgctgaaaacggcaaaaaagaaggcattaccactaccgattcaggtcttcaatatgaagtgctaacggctggtgaaggtgaacttgcatcgccagatgataccgtcactgtgcattacaccggttcactattagacggttcggtatttgatagttctgtcgaacgtggcgaaccagcaacatttgcacttaatcgtgtgatccctggttggactgaaggtgtttcactaatgaacgtgggcagtaagtataaattatacatcccatctgagctaggttatggcgcacaaggtgcgggtgcagatatcccaccaaattcaacattagtatttgaagttgaattgatcgaaattgctggacaagaaaaataa

SEQ ID NO: 10808 - protein, 250 aa, Moritella sp. PE36
MKKFFKVTVLASAVSLLAACGQEAPEAPAEKITDIKTYSEDQQAAYAIGSIVARNLVAPLKRQEELGAPLDKEIIVQGITDALNESTQLSDEELQAVLKAYDEKMNTLSTEAARIEGEKLEAEAASFFAENGKKEGITTTDSGLQYEVLTAGEGELASPDDTVTVHYTGSLLDGSVFDSSVERGEPATFALNRVIPGWTEGVSLMNVGSKYKLYIPSELGYGAQGAGADIPPNSTLVFEVELIEIAGQEK

SEQ ID NO: 10809 - DNA, 618 bp, Moritella sp. PE36
  CDS (1)..(618): transl_table=11
atgtctgaatttgcaacaagtgaacaaaaaggtagttacggtattggtctacaaatgggtcaacagcttgctgctaatccattcgaaggtctagacatttcagctgttcaagctggtcttgcagatgcgttcgctggtgcagaaagcaaagttagcgatgaagagctaaacgatgctttcaaactgatccatgagaaattagaagctgaaaaagctgagaaatctaaattatttgctgctgaaggcgaaaaattcttagctgaaaatgcagaacgtgaagaagttactgtaactgaatctggtctacagtatgaagttatggcacgtggtgacatcgaggaaaaaccaactgcagaatctacagtgcgtgttcattatcatggcatgctaactgacggtactgtatttgacagctctgttgaacgtggtcaacctgctgaattcccagttggcggcgttatcgctggttggactgaagcactacaactaatgaacgttggtgataaattcaagctatctatcccacacaaccttgcttatggcgaacagggcgcaggcgctgcaatcggtccattccaagcactagtatttgaagtagaactattagacatcatctaa

SEQ ID NO: 10810 - protein, 205 aa, Moritella sp. PE36
MSEFATSEQKGSYGIGLQMGQQLAANPFEGLDISAVQAGLADAFAGAESKVSDEELNDAFKLIHEKLEAEKAEKSKLFAAEGEKFLAENAEREEVTVTESGLQYEVMARGDIEEKPTAESTVRVHYHGMLTDGTVFDSSVERGQPAEFPVGGVIAGWTEALQLMNVGDKFKLSIPHNLAYGEQGAGAAIGPFQALVFEVELLDII

SEQ ID NO: 10811 - DNA, 756 bp, Rickettsiella grylli
  CDS (1)..(756): transl_table=11
atgacaagattaccactattgactgtcctggctggcatacttatcagtccaaacttattggctgcacagagtacccctccccttacggttaatcaacagaaatcccctataaactttccaaagatagtcagtcattccccgctattaaaaacggcaaaaggccaaattagttatagtatcggcgccgatttagcggtcaattttaaagaacagggtatccaggttgatcccatcgctctcgaaaaagggttagcagatggtatgaatggaaaatttttattaactcaagcacagatggcggatattttgaaaaattttcaacaagaattaatgaataagcgacatgctgaatttaaaaatcttagtcttaaaaataaacagcaaggtgatgctttcttggctgctaataaaatcaaacccggcgttatcaccttgaaaagtggaatccaatataaaataatacaagccggtagtggcgagcgtcccacagatacatccctggtcaaagtagaatatacaggaagcgatattcatggtactgtttttgaaaaatcaaaagaaccggtcacgtttcctttaaataatgtcattccaggatggatagaagttttaaagataatgaagcctggagcgacctatcaagttgttatcccaccacaatttgcttatggcgaacatggtattgataaagccattggaccgaatcaaacacttgtatttacgattcacctgattgacgtaaagaaaaacacttaa

SEQ ID NO: 10812 - protein, 251 aa, Rickettsiella grylli
MTRLPLLTVLAGILISPNLLAAQSTPPLTVNQQKSPINFPKIVSHSPLLKTAKGQISYSIGADLAVNFKEQGIQVDPIALEKGLADGMNGKFLLTQAQMADILKNFQQELMNKRHAEFKNLSLKNKQQGDAFLAANKIKPGVITLKSGIQYKIIQAGSGERPTDTSLVKVEYTGSDIHGTVFEKSKEPVTFPLNNVIPGWIEVLKIMKPGATYQVVIPPQFAYGEHGIDKAIGPNQTLVFTIHLIDVKKNT

SEQ ID NO: 10813 - DNA, 894 bp, Xanthomonas campestris pv
  CDS (1)..(894): transl_table=11
atgtcgcaacaaccggccgcagcggccaccaaggagaagccggctttgaatgcatcgtctgaaaagagcaacgtgagttacgccatcggtatggacgtggcacgttcgttcgagccgatcgcgcaggacatcgatgtgagcgccatgcagcgcgccatcgagaacgctttcaagggcggcaagccgctgttgtccgacgagcagacccaggccaccgacaccgcactgcgcaccgcgctggcggcacgcaatggccagcagatgccgggcatggcaccgggcagcgccccggcggcgccgtccaaggaaaatgtcggcctgatgctgggtgaccgcgcggttggcccgtcgctggccggcatcaaggacgagatcgatctgtcgatcctgatggaagctgtccgcaccgtattcgccaagggcaccacgcggttgacccagcaggaagcggccgcaacgatgcaggcgttcgccactgccaagcagggcgcagccggcgccaagaatcgcgaagaaggcaatgcgttcctggccaagaacaacaccgaaaagggcgtgatcaccacggcctcgggtctgcagtacatggtgctgcgccagggcagcggcgagcgcccgatgcctaccaacacggtgcgcgtcaactacgaaggcaagctgctcgacgggaaggtcttcgatagctcttaccagcgcggccagccggccgagtttggtctgaatcaagtgattgctggttggaccgagggtgtcgccttgatgccggtcggttcgaaatatcgtttctggattccatccaacttggcctatggcccgaacggcacgcaaggggggccgatcggaccggacgcaacgttgacgttcgatgtcgaactgatgggtatccttccctga

SEQ ID NO: 10814 - protein, 297 aa, Xanthomonas campestris pv
MSQQPAAAATKEKPALNASSEKSNVSYAIGMDVARSFEPIAQDIDVSAMQRAIENAFKGGKPLLSDEQTQATDTALRTALAARNGQQMPGMAPGSAPAAPSKENVGLMLGDRAVGPSLAGIKDEIDLSILMEAVRTVFAKGTTRLTQQEAAATMQAFATAKQGAAGAKNREEGNAFLAKNNTEKGVITTASGLQYMVLRQGSGERPMPTNTVRVNYEGKLLDGKVFDSSYQRGQPAEFGLNQVIAGWTEGVALMPVGSKYRFWIPSNLAYGPNGTQGGPIGPDATLTFDVELMGILP

SEQ ID NO: 10815 - DNA, 705 bp, Legionella adelaidensis
  CDS (1)..(705): transl_table=11
atgaagatgaaactggtcgctgctgctgccatgggattggccatgaccacctcaatcgctgctaccaataatacacaattaaccactgaaatggataaattgtcttatagcataggtacagatttgggcaaaaattttaagcgtcagggaattgatattaacccggatatgatggctaaaggcttaaaagatggtatgaatggaggtactcttctcttaactgatgatcaaatgaaggaagtacttaataagttccaaaaagatttaatggcgaaacgcactgcagagtttaataaaaaagcagaacaaaataagaccaaaggcgaaagctttttaaaagaaaacaaacagaagcaaggtgtggtgactttacctagtggtttgcaatataaaattattactgctggcaatggtgaaaaaccaaacaaagaagatactgtaacggtggaatacaccggtcgtttaatcgatggtgaagtttttgatagcaccgaaagaaccgggaagcctgctacttttaatctgtcccaagtcattcctggctggactgaagcgttacaattaatgcctgctggttctacttgggaaatttatgtcccggctgatttggcttacggcacccgaagtgtggggggaccgataggaccaaatgaaacacttatttttaatattcatttaatatctgtaaaaaaaaataatgcctga

SEQ ID NO: 10816 - protein, 234 aa, Legionella adelaidensis
MKMKLVAAAAMGLAMTTSIAATNNTQLTTEMDKLSYSIGTDLGKNFKRQGIDINPDMMAKGLKDGMNGGTLLLTDDQMKEVLNKFQKDLMAKRTAEFNKKAEQNKTKGESFLKENKQKQGVVTLPSGLQYKIITAGNGEKPNKEDTVTVEYTGRLIDGEVFDSTERTGKPATFNLSQVIPGWTEALQLMPAGSTWEIYVPADLAYGTRSVGGPIGPNETLIFNIHLISVKKNNA

SEQ ID NO: 10817 - DNA, 699 bp, Legionella anisa
  CDS (1)..(699): transl_table=11
atgaagatgaaattggtcactgcggccgtcatggggctggcaatgtctactgtaatggcagctgatgctacatcgcttgttacggataaggataaattatcttatagtattggtgctgatttaggaaaaaatttcaaaaatcaaggtattgatattaatccggacgcattagctaaaggaatgcaagacggaatgtctggtgcccaattgattttgacagaacaacaaatgaaagatgttctgaataaattccaaaaagagttgatggcgaaacgcagcgctgagtttaataaaaaagctgaagaaaacaaatctaaaggcgatgcttttttatcaactaacaaatcaaaatctggcgtaacggtactgccaagcggtttacaatataaagttattgaagcaggtacaggaaataaacccggtaaagcggacacagtaactgttgaatacactggtactttaattgatggtactgtatttgatagtactgaaaaaacaggtaagccagctacattccaagtatcacaagttattcctggttggactgaagcattacaattaatgcctgctggttctacttgggaaatttatgttccttcagacttagcttatggcccacgtagtgtaggtggtcctataggtccaaatgaaactttgattttcaaaattcatttgatctctgtgaaaaaatctgcctaa

SEQ ID NO: 10818 - protein, 232 aa, Legionella anisa
MKMKLVTAAVMGLAMSTVMAADATSLVTDKDKLSYSIGADLGKNFKNQGIDINPDALAKGMQDGMSGAQLILTEQQMKDVLNKFQKELMAKRSAEFNKKAEENKSKGDAFLSTNKSKSGVTVLPSGLQYKVIEAGTGNKPGKADTVTVEYTGTLIDGTVFDSTEKTGKPATFQVSQVIPGWTEALQLMPAGSTWEIYVPSDLAYGPRSVGGPIGPNETLIFKIHLISVKKSA

SEQ ID NO: 10819 - DNA, 702 bp, Legionella birminghamensis
  CDS (1)..(702): transl_table=11
atgaagatgaaactggtcgctgcagctaccatgggtctggctatgtccaccgcaattgctgcgtccgatgtgactctctctactgacatggataaattatcctacagtattggcgctgatttgggtaaaaatttcaaaaaacaaggtattgaaataaacccaacagcaatggcgaaaggcttacaggatggtatgagcggcagccagctcatgttgactgaagatcagatgaaagaagttctgaacaactttcaaaaagatttgatggctaagcgaaatgcggagttcagtaaaaaatctgaagaaaacaaagcaaaaggtgaaacctttttaagccagaataaatccaaagaaggtgttgtcagcttacccagcggactccagtacaaaattattgaaactggcagcggtgcaaaacctgctaaagacgatacagtaactgtagagtacactggcagaacaattgatggtcaggtatttgacagcactgacaagtctggcaaaccggctaccttcaaagtatctcaggtcattcctggctggaccgaagcgctgcagttaatgccagctggctcaacctgggaaatctatattccttcagggctggcttacggtccaagaagtgttggcgggcccattggtccaaatgaaactttaattttcaagattcatttgatttctgtaaagaaagctggcgcttaa

SEQ ID NO: 10820 - protein, 233 aa, Legionella birminghamensis
MKMKLVAAATMGLAMSTAIAASDVTLSTDMDKLSYSIGADLGKNFKKQGIEINPTAMAKGLQDGMSGSQLMLTEDQMKEVLNNFQKDLMAKRNAEFSKKSEENKAKGETFLSQNKSKEGVVSLPSGLQYKIIETGSGAKPAKDDTVTVEYTGRTIDGQVFDSTDKSGKPATFKVSQVIPGWTEALQLMPAGSTWEIYIPSGLAYGPRSVGGPIGPNETLIFKIHLISVKKAGA

SEQ ID NO: 10821 - DNA, 702 bp, Legionella bozemanii
  CDS (1)..(702): transl_table=11
atgaagatgaaattggtcactgcggccgtcatggggctggcaatgtctactgtaattgctgctactgatgctacatcgcttgttacggataaagataaattatcttatagtattggtgctgatttagggaaaaacttcaaaaatcaaggtattgatattaatccggacgcattagctaaaggaatgcaagacggaatgtctggtgcccaattgattttgactgaacaacaaatgaaagatgttctgaataaattccaaaaagagttgatggcaaaacgcagcgctgagtttaataaaaaagctgaagaaaacaaatctaaaggcgaagcctttttatcaactaacaaatcaaaatctggcgtagttgtattgccaagcggcttgcaatataaagttattgaagcaggcacaggaaataaacccggcaaatcggacacagtaactgttgaatacactggtactttaattgatggtactgtatttgatagcactgaaaaaacaggtaagccagctacattccaagtatcacaagtaattcctggttggactgaagcattacaattaatgcctgccggttctacttgggaaatttatgtaccttcagatttagcgtatggtccacgtagtgtaggtggtcctataggtccaaatgaaactttgattttcaaaattcatttgatctctgtgaaaaaatctgcctaa

SEQ ID NO: 10822 - protein, 233 aa, Legionella bozemanii
MKMKLVTAAVMGLAMSTVIAATDATSLVTDKDKLSYSIGADLGKNFKNQGIDINPDALAKGMQDGMSGAQLILTEQQMKDVLNKFQKELMAKRSAEFNKKAEENKSKGEAFLSTNKSKSGVVVLPSGLQYKVIEAGTGNKPGKSDTVTVEYTGTLIDGTVFDSTEKTGKPATFQVSQVIPGWTEALQLMPAGSTWEIYVPSDLAYGPRSVGGPIGPNETLIFKIHLISVKKSA

SEQ ID NO: 10823 - DNA, 750 bp, Legionella brunensis
  CDS (1)..(750): transl_table=11
atgaagatgagactggtcgctgcagctgtcataggtttgacaatgtcaacggcaatcgttgctgccgatgcatcagctactgccacacctgcacctgcaacatctgctacacctacaacatcattaaatagtgacatggataagctgtcttacagtattggcgctgatttaggtaaaaactttaaaaagcaaggtattgatatcaatccttcagcaatggccaaaggtttgcaagatggtatgagcggtgggcaattgttattgacagaacagcaaatgaaagatgtattgaataaatttcaaaaagatttgatggcaaagcgtactgctgaattcagcaagaaagctgacgaaaataaagctaaaggtgaagcctttttaaatcagaataaagcaaaagaaggtgttgttagtttaccaagtggtttgcaatataaaataattcaaaagggtgatggtgctaaaccttctaaagaggacactgttaccgttgaatacactggtacactgattgatggccaagtttttgacagtaccgataaagctggtaaaccagccactttcaaggtatcacaagtgattcctgggtggactgaagcactacaactgatgccagctggctcaacttgggaagtttatgttcctgcggatttagcttatggtcctcgcagtgtaggtggtcctattggtccaaatgaaacattaatttttaaaattcatttgatctctgtaaaaaaatctgacgcttaa

SEQ ID NO: 10824 - protein, 249 aa, Legionella brunensis
MKMRLVAAAVIGLTMSTAIVAADASATATPAPATSATPTTSLNSDMDKLSYSIGADLGKNFKKQGIDINPSAMAKGLQDGMSGGQLLLTEQQMKDVLNKFQKDLMAKRTAEFSKKADENKAKGEAFLNQNKAKEGVVSLPSGLQYKIIQKGDGAKPSKEDTVTVEYTGTLIDGQVFDSTDKAGKPATFKVSQVIPGWTEALQLMPAGSTWEVYVPADLAYGPRSVGGPIGPNETLIFKIHLISVKKSDA

SEQ ID NO: 10825 - DNA, 702 bp, Legionella cherrii
  CDS (1)..(702): transl_table=11
atgaagatgaaattggtcactgcggccattatggggctggcaatgtctactgcaatggctgctactgatgctacatcgcttgttacggataaagataaattatcttatagtattggtgctgatttaggaaaaaacttcaaaaatcaaggtattgatattaatccggacgcattagctaaaggaatgcaagatggaatgtctggtgcccaattgattttgactgaacaacaaatgaaagatgttctgaataaatttcagaaagatttgatggcaaagcgcagcgccgagttcaataaaaaagctgaagagaacaaggctaaaggtgaagcgttcttatcaaccaacaaatcaaaatcaggtgtagttgtattgccaagtggtttgcaatataaaattattgaagccggtacaggagctaagccaggcaaatctgatacagtaacagttgaatatactggtactttaattgatggtactgtatttgacagcactgaaaaagcaggtaaaccagcgacattccaagtatcacaagtaatacctggttggactgaagcattacaattaatgcctgctggttctacttgggaaattttcgtaccttcagacttagcttatggcccacgtagcgttggtggtcctatcggtccaaatgaaactttaattttcaaaattcatttgatctccgttaaaaaagctgcctaa

SEQ ID NO: 10826 - protein, 233 aa, Legionella cherrii
MKMKLVTAAIMGLAMSTAMAATDATSLVTDKDKLSYSIGADLGKNFKNQGIDINPDALAKGMQDGMSGAQLILTEQQMKDVLNKFQKDLMAKRSAEFNKKAEENKAKGEAFLSTNKSKSGVVVLPSGLQYKIIEAGTGAKPGKSDTVTVEYTGTLIDGTVFDSTEKAGKPATFQVSQVIPGWTEALQLMPAGSTWEIFVPSDLAYGPRSVGGPIGPNETLIFKIHLISVKKAA

SEQ ID NO: 10827 - DNA, 705 bp, Fluoribacter dumoffii
  CDS (1)..(705): transl_table=11
atgaagatgaaattggtcactgcagccattatggggctggcaatgtctactgcaatggctgctactgatgctacatcgcttgttacggataaagataaattatcttacagtattggtgctgatttaggaaaaaacttcaaaaatcaaggtattgatattaatccggaagcattagctaaagggatgcaagatggaatgtctggtgcccaattgattttgactgaacaacaaatgaaagatgttctgaataaattccagaaagatttgatggcaaaacgtagtgctgaattcaacaagaaagctgaagagaataaagcaaaaggcgaagcgttcttatcaagtaacaaatcaaaatctggtgtggttgtactgccaagtggcttgcaatacaaagtcatcgaagcaggttcaggcgctaagccaggtaaatctgacacagtaactgtagaatatacaggtactttaattgatggaactgtatttgatagcactgagaaagcaggtaaacctgctactttccaggtatctcaagtgattcctggttggactgaagctttacaattaatgcctgctggttctacctgggaaatttatgtgccttcaaacctggcatatggtccccgtagcgtaggtggtcctatcggtccaaatgaaactttgattttcaaaattcatttgatttccgtgaaaaaagcctcagcctaa

SEQ ID NO: 10828 - protein, 234 aa, Fluoribacter dumoffii
MKMKLVTAAIMGLAMSTAMAATDATSLVTDKDKLSYSIGADLGKNFKNQGIDINPEALAKGMQDGMSGAQLILTEQQMKDVLNKFQKDLMAKRSAEFNKKAEENKAKGEAFLSSNKSKSGVVVLPSGLQYKVIEAGSGAKPGKSDTVTVEYTGTLIDGTVFDSTEKAGKPATFQVSQVIPGWTEALQLMPAGSTWEIYVPSNLAYGPRSVGGPIGPNETLIFKIHLISVKKASA

SEQ ID NO: 10829 - DNA, 741 bp, Legionella erythra
  CDS (1)..(741): transl_table=11
atgaagataaaactggtcgctgcagctgtcgtaagcctggcaatgacaaccgcatttgctgaaacaactactcctgctgccggcacgactacaccagctactgccgcaacacccgccacgttaactaccgatattgacaagctgtcttacagtattggggctgatttaggcaaaaattttaaaaagcaagggattgaaatcagtccttctgcaatggctaagggtttgcaggatggcatgagcggttctcagttactgttgactgaagatcaaatgaaagatgtattgagtaaatttcaaaaagacctgatggcgaaacgaaacgctgaattcactaaaaaagcagaagagaacaagtctaaaggtgaagcgttcctgtcccagaacaaaaccaaagaaggcgttgtgacgctgccaagcggcctgcaatataaaatcattgaaaaaggcaatggtgctaaaccaaccaaagaagacacggtaaccgtcgagtacaccggtcgtttgattgatggtcaagtgtttgacagtaccgataaaaccggtaaaccagctacattcaaggtttctcaggttatcccgggctggactgaagccctgcaattaatgcctgccggctccgtgtgggaagtgtatgttcctgcgtcgttagcttacggcccacgcagtgttggtggacccattggccccaacgaaaccttgattttcaaaatccatttgatttctgtcaaaaaatcttaa

SEQ ID NO: 10830 - protein, 246 aa, Legionella erythra
MKIKLVAAAVVSLAMTTAFAETTTPAAGTTTPATAATPATLTTDIDKLSYSIGADLGKNFKKQGIEISPSAMAKGLQDGMSGSQLLLTEDQMKDVLSKFQKDLMAKRNAEFTKKAEENKSKGEAFLSQNKTKEGVVTLPSGLQYKIIEKGNGAKPTKEDTVTVEYTGRLIDGQVFDSTDKTGKPATFKVSQVIPGWTEALQLMPAGSVWEVYVPASLAYGPRSVGGPIGPNETLIFKIHLISVKKS

SEQ ID NO: 10831 - DNA, 726 bp, Legionella fairfieldensis
  CDS (1)..(726): transl_table=11
atgaagatgagactagtcgctgcagctgtcatgagtttggcaatgtcaacgacaattgctgcaactgatgctgctacagtagcaccctctgcaacatcattgaatagcgacatggataagctgtcttatagtattggcgctgatttgggaaaaaatttcaaaaagcaaggcattgatataagccctgccgcaatggcaaaaggcttgcaggatggcatgaacggtagccagttgttgttaactgaagatcagatgaaagacgttctcaataagtttcaaaaagatttgatgatgaaacgtactgctgaattcaataaaaaatctgaagaaaataaaaccaaaggagaagcctttttaaatgccaataagactaaagagggggtggttagtctgccaagtggcttacaatacaaaattattgaaaaaggagaaggtgcaaaaccggcgaaagaggatacagtgaccgtagaatatactggtcgattaatagacggacaggtttttgatagtacagataaaacaggcaagccagctacttttaaagtatcgcaggttataccaggctggactgaggctttacaattaatgcccgcaggttctacctgggaagtgtatgttccttcggcacttgcttatggtcctcgtagcgtaggcggccctatcggacctaacgaaacattaatctttaaaattcatttaatttctgtcaaaaaatctgatgcgtaa

SEQ ID NO: 10832 - protein, 241 aa, Legionella fairfieldensis
MKMRLVAAAVMSLAMSTTIAATDAATVAPSATSLNSDMDKLSYSIGADLGKNFKKQGIDISPAAMAKGLQDGMNGSQLLLTEDQMKDVLNKFQKDLMMKRTAEFNKKSEENKTKGEAFLNANKTKEGVVSLPSGLQYKIIEKGEGAKPAKEDTVTVEYTGRLIDGQVFDSTDKTGKPATFKVSQVIPGWTEALQLMPAGSTWEVYVPSALAYGPRSVGGPIGPNETLIFKIHLISVKKSDA

SEQ ID NO: 10833 - DNA, 714 bp, Legionella feeleii
  CDS (1)..(714): transl_table=11
atgaagatgagactggtcgctgcagctgtcataagtatggcaatgtcaacgacaattgctgcggctgatgcgacagctacaacatcattaaatagtgacatggataagttgtcttatagcattggcgctgatttaggtaagaattttaaaaagcaaggcatcgaaatcagtccggctgctatggctaagggattacaagacggcatgagtggtggtcaactgttgctgactgaacaacaaatgaaagacgttttaaataaatttcaaaaagacctaatggcaaaacgaaatgcggaattcactaaaaaagctgaagaaaataaagcgaaaggtgaagcgttcatgagccagaataaggccaaagaaggcgtagttagtttgccaagcgggttacaatataaaataatccaggctggtactggtgcaaaaccagcaaaagatgacactgtcactgttgaatacactggcaagttaattgatggccaggtttttgatagcactgaaaaaacgggtaagcctgctacgttcaaagtatcacaggttatccctggctggactgaagcattacaattaatgcctgccggttctacttgggaagtctatgttcctgccggtcttgcctatggtccacgcagtgttggtggcccaatcggacctaatgaaacattgattttcaaaattcatctgatttctgtcaagaaatctgacgcttaa

SEQ ID NO: 10834 - protein, 237 aa, Legionella feeleii
MKMRLVAAAVISMAMSTTIAAADATATTSLNSDMDKLSYSIGADLGKNFKKQGIEISPAAMAKGLQDGMSGGQLLLTEQQMKDVLNKFQKDLMAKRNAEFTKKAEENKAKGEAFMSQNKAKEGVVSLPSGLQYKIIQAGTGAKPAKDDTVTVEYTGKLIDGQVFDSTEKTGKPATFKVSQVIPGWTEALQLMPAGSTWEVYVPAGLAYGPRSVGGPIGPNETLIFKIHLISVKKSDA

SEQ ID NO: 10835 - DNA, 699 bp, Fluoribacter gormanii
  CDS (1)..(699): transl_table=11
atgaagatgaaattggtcactgcggccattatggggctggcaatgtctactgcaatggctgctactgatgctacatcgcttgttacggataaagataaattatcttatagtattggtgctgatttaggaaaaaatttcaaaaatcaaggtattgatattaatccggaagcattggctaaaggaatgcaagatggtatgtctggtgcccaattgattttgaccgaacaacaaatgaaagatgttctgaataaatttcagaaagatctgatggcaaaacgcagcgcagagtttaacaagaaagctgaagagaacaaatctaaaggcgaagcttttttgtcaactaacaagtcaaaatctggtgtagttgtattgccaagtggtttgcaatataaagttattgaagcaggtacaggcagtaaaccaggtaaatctgatacagtaactgttgaatacacgggtactctaattgatgggactgtatttgatagcactgaaaaaacaggaaaacccgctacattccaagtatcacaagtgattccaggttggacagaagcattacaattaatgccggctggttctacatgggagatttatgtgccttcagacttagcttatggcccacgtagtgtaggtggtcctataggtccaaatgaaactttgattttcaaaattcatttgatctctgtaaaaaaagcctaa

SEQ ID NO: 10836 - protein, 232 aa, Fluoribacter gormanii
MKMKLVTAAIMGLAMSTAMAATDATSLVTDKDKLSYSIGADLGKNFKNQGIDINPEALAKGMQDGMSGAQLILTEQQMKDVLNKFQKDLMAKRSAEFNKKAEENKSKGEAFLSTNKSKSGVVVLPSGLQYKVIEAGTGSKPGKSDTVTVEYTGTLIDGTVFDSTEKTGKPATFQVSQVIPGWTEALQLMPAGSTWEIYVPSDLAYGPRSVGGPIGPNETLIFKIHLISVKKA

SEQ ID NO: 10837 - DNA, 702 bp, Legionella gratiana
  CDS (1)..(702): transl_table=11
atgaagatgaaattagtcactgcggccattatggggctggcaatgtctactgcaatggctgcaactgatgctacatcgcttgctacagacaaagataagttatcttatagtattggtgctgatttaggaaaaaactttaaaaatcaaggtattgaagttaatccagaagtattagctaaaggaatgcaagatggaatgtctggtgcacagttgattttgactgaagagcagatgaaagacgttctgagtaagtttcaaaaagatttgatggctaaacgcagcgcagaattcaataagaaagccgaagaaaacaaagcaaaaggtgatgccttcttatctgctaataaggcaaagccaggggtagttgcattgccaagtggtttgcaatataagattattgatgctgggaatggtactaagccaggtaaatcagatactgtaactgttgaatatactggtactttaattgatggtacagtgtttgatagcactgaaaaagcaggcaagccagctacattccaagtatcacaagtaattcccggttggacagaagcattacaattgatgcccgctggttctacatgggaagtttatgtcccttcagatttggcttatggtccacgtagtgtaggtggtcctataggtccaaatgaaactttgattttcaaaattcatttgatttctgtaaaaaaagaagcctaa

SEQ ID NO: 10838 - protein, 233 aa, Legionella gratiana
MKMKLVTAAIMGLAMSTAMAATDATSLATDKDKLSYSIGADLGKNFKNQGIEVNPEVLAKGMQDGMSGAQLILTEEQMKDVLSKFQKDLMAKRSAEFNKKAEENKAKGDAFLSANKAKPGVVALPSGLQYKIIDAGNGTKPGKSDTVTVEYTGTLIDGTVFDSTEKAGKPATFQVSQVIPGWTEALQLMPAGSTWEVYVPSDLAYGPRSVGGPIGPNETLIFKIHLISVKKEA

SEQ ID NO: 10839 - DNA, 750 bp, Legionella hackeliae
  CDS (1)..(750): transl_table=11
atgaagatgagactggtcgctgcagctgtcataggtttgacaatgtcaacggcaatcattgccgctgatgcatcagctactgctacaactgcgcctgcaacttctgctacacctgcaacatcattaaatagcgacatggataaactgtcttatagtattggtgctgatttaggtaagaattttaaaaagcaaggtatcgatattagccctgctgctatggctaaaggtttgcaagatggcatgagtggcggtcaattgctgttaactgaacagcaaatgaaagatgtattgaataaattccaaaaagatttaatggctaagcgtaatgcagatttcaataaaaaagctgaagaaaacaaagctaagggcgatgcctttttaaatcaaaataaagctaaagatggcgtagtgagtttaccaagtggtttgcaatacaaaattttgcaaaagggtgacggcgctaaaccttctaaagatgatactgttaccgttgaatacactggtacattaattgatggtcaggtttttgatagtactgaccgaactggcaagccagctacgttcaaagtatcacaagttatccctggctggactgaagcactacaattgatgcctgctggctcaacttgggaagtttatgttcctgctgatttagcctatggtcctcgcagtgttggtggcccaattggtccaaatgaaactttaattttcaaaattcatttaatctctgtaaaaaaatctgacgcttaa

SEQ ID NO: 10840 - protein, 249 aa, Legionella hackeliae
MKMRLVAAAVIGLTMSTAIIAADASATATTAPATSATPATSLNSDMDKLSYSIGADLGKNFKKQGIDISPAAMAKGLQDGMSGGQLLLTEQQMKDVLNKFQKDLMAKRNADFNKKAEENKAKGDAFLNQNKAKDGVVSLPSGLQYKILQKGDGAKPSKDDTVTVEYTGTLIDGQVFDSTDRTGKPATFKVSQVIPGWTEALQLMPAGSTWEVYVPADLAYGPRSVGGPIGPNETLIFKIHLISVKKSDA

SEQ ID NO: 10841 - DNA, 729 bp, Legionella israelensis
  CDS (1)..(729): transl_table=11
atgaaactgaaactggtcgctgcaacggtcatgagcatggcgatatctacggcaatagcagctactgatgcttcgtcattgaatacggatgtagaaaaattatcctacagtattggagctgatcttggtaaaaatttcaaaaagcaagggattgaaattgatccccaagctatggcagcgggaatgaaggatggaatgagcggtgataaattaaaattgaccgagcagcaaatgcgagatgttttaaataaatttcagcaagagctgatggcgaaaagaaatgccgaatttaataaaaaagccgccgaaaataaagctaaaggggaagcttttctcgagcaaaataaaggcaaggaaggcgttgttaccttacccagtggtttacaatataaaatccttgagaaaggaacaggcactaaaccttccaaatccgacacagttacagttgaatatactggacgtttgattaatggccaggtttttgacagttctgaaagagtgggaaaaccagccacatttaaagtatcacaggtcatccctggttggactgaagcattacaattgatgcctgctggttctacttgggaaatttatgttccttctgatctggcatatggtcctcgtagtatcggtggtcctattggtccaaacgagacattaattttcaaaattcatttgatatctgttaagaaagacaaggacacagatactgctcaaaaagatgcttaa

SEQ ID NO: 10842 - protein, 242 aa, Legionella israelensis
MKLKLVAATVMSMAISTAIAATDASSLNTDVEKLSYSIGADLGKNFKKQGIEIDPQAMAAGMKDGMSGDKLKLTEQQMRDVLNKFQQELMAKRNAEFNKKAAENKAKGEAFLEQNKGKEGVVTLPSGLQYKILEKGTGTKPSKSDTVTVEYTGRLINGQVFDSSERVGKPATFKVSQVIPGWTEALQLMPAGSTWEIYVPSDLAYGPRSIGGPIGPNETLIFKIHLISVKKDKDTDTAQKDA

SEQ ID NO: 10843 - DNA, 756 bp, Legionella jordanis
  CDS (1)..(756): transl_table=11
atgaagatgagactggtcgctgcagctgtaatgggcttagcaatgacatccgcaattgctgcgaatgacgcaacaaatacagcaacttctgctacgcctgcttccaacactgcaacatctgctacatcattaaatagcgacatggataagctgtcctacagtatcggcgccgatttaggcaagaattttaaaaaacaaggtattgatatcaatcctgctgctatggcaaaagggttacaagacgggatgagcggtgttcaactgcaactgaccgaacaacagatgaaagatgtactcaataaattccaaaaagatttaatggcaaaacgcaatgctgaattcagcaaaaaagctgatgaaaataaatcaaaaggtgaagcattcttaaacgcaaacaaaagtaaagagggtgttgtcagcttaccaagtgggttgcagtacaaaatcttagaaaaaggaaatggcgttaagccttctaaggatgacaccgttacggttgaatacacaggcaagttgatcgatggccaggtgtttgatagcactgaaagaacaggtaagcctgcaacgttcaaagtttcacaagtgattcctggttggactgaagctctgcaattaatgcctgctggttctacatgggaagtgtatgtccccgctgatttagcctacggcccacgcagcgtaggtggcccaattggtcctaatgaaaccttaattttcaaaatccatttgatttccgttaaaaaatcagatgcctaa

SEQ ID NO: 10844 - protein, 251 aa, Legionella jordanis
MKMRLVAAAVMGLAMTSAIAANDATNTATSATPASNTATSATSLNSDMDKLSYSIGADLGKNFKKQGIDINPAAMAKGLQDGMSGVQLQLTEQQMKDVLNKFQKDLMAKRNAEFSKKADENKSKGEAFLNANKSKEGVVSLPSGLQYKILEKGNGVKPSKDDTVTVEYTGKLIDGQVFDSTERTGKPATFKVSQVIPGWTEALQLMPAGSTWEVYVPADLAYGPRSVGGPIGPNETLIFKIHLISVKKSDA

SEQ ID NO: 10845 - DNA, 750 bp, Legionella lansingensis
  CDS (1)..(750): transl_table=11
atgaagatgagactggtcgctgcagctgtcatgggtttggcgatgacaacagcaattgctgcaagcaacacaccaaacgcagcaacgcctactacacccgcagccgcaacatctgctacatcattaaatagcgacacggataagctgtcttatagtatcggtgctgacttgggtaaaaattttaaaaagcaagggattgatattaatccttcagcaatggctaagggcttacaagatggtatgagcggtggtcagttgttactcacagagcagcaaatgaaagaagttttgaataaatttcaaaaagatctaatggcaaaacgtaatgctgagttcactaaaaaggctgaagaaaacaagattaaaggcgaagcctttttaactgcaaataaaaacaaagatggtgttattagtctgccaagtggtttgcaatataaagtccttgaaaaaggaaatggcgctaaacctacaaaaaatgatactgtgactgttgaatatacgggcaaattaattgacggccaagtttttgacagtaccgaaagaaccggtaaaccagcaacgttcaaagtatctcaagtaataccaggctggactgaggctctgcaattaatgcctgctggttcaacttgggaagtatatgttcctgccgatttagcttatggtcctcgaagcgtaggcggcccaattggtccaaacgaaacgttgattttcaaaattcatctgatatctgttaaaaaatcagaggcttaa

SEQ ID NO: 10846 - protein, 249 aa, Legionella lansingensis
MKMRLVAAAVMGLAMTTAIAASNTPNAATPTTPAAATSATSLNSDTDKLSYSIGADLGKNFKKQGIDINPSAMAKGLQDGMSGGQLLLTEQQMKEVLNKFQKDLMAKRNAEFTKKAEENKIKGEAFLTANKNKDGVISLPSGLQYKVLEKGNGAKPTKNDTVTVEYTGKLIDGQVFDSTERTGKPATFKVSQVIPGWTEALQLMPAGSTWEVYVPADLAYGPRSVGGPIGPNETLIFKIHLISVKKSEA

SEQ ID NO: 10847 - DNA, 735 bp, Tatlockia maceachernii
  CDS (1)..(735): transl_table=11
atgaagatgagattggtcgctgcagctgccatgggtttggcaatgtcaacgacaatagctgcaagcgctactaccactgatacagcaacttctgcaccagctacatcattggctacagacacagaaaaactttcttacagtattggcgctgatttaggtaagaattttaaaaagcaaggaatagagattagtcctgctgcaatggcaaaaggtttacaagatggaatgagcggcgggcaattgttgctgactgatgagcaaatgaaagaggtgttaaataagtttcaaaaagatctcatgatgaagcgcagcgctgagttcaataagaaagctgaagacaataaggcaaaaggagaagcgtttcttaatgacaataaatcaaaagaaggtgttgttagcttaccaagcggcttacagtacaaaatcattgagcgcggtgatggtgctaaacctactaaggaagacgtcgttactgtggaatacacaggtaaattgatcgatggtcaagtgtttgattctactgataaaactggcaaaccagcaaccttcaaagtttcacaagtgattcctggttggacagaagccttgcaattaatgccagctggttctacttgggaagtctatattcctgctaatctggcttatggtccacgcagtgtcggaggcccgattggacctaatgaaactttaattttcaaaattcatctgatttcagtgaagaaatctgacgcataa

SEQ ID NO: 10848 - protein, 244 aa, Tatlockia maceachernii
MKMRLVAAAAMGLAMSTTIAASATTTDTATSAPATSLATDTEKLSYSIGADLGKNFKKQGIEISPAAMAKGLQDGMSGGQLLLTDEQMKEVLNKFQKDLMMKRSAEFNKKAEDNKAKGEAFLNDNKSKEGVVSLPSGLQYKIIERGDGAKPTKEDVVTVEYTGKLIDGQVFDSTDKTGKPATFKVSQVIPGWTEALQLMPAGSTWEVYIPANLAYGPRSVGGPIGPNETLIFKIHLISVKKSDA

SEQ ID NO: 10849 - DNA, 702 bp, Legionella moravica
  CDS (1)..(702): transl_table=11
atgaagatgaaattggtcactgcggccgtcttggggctggcaatgtctagtgcaatggcaaccgatgccacatccttacctacagacaaagataaattgtcttacagtattggtgctgatttaggaaagaatttcaaaaatcaaggtattgatgtaaacccagaggcattagctaaaggtatgcaagacggtatgagtggagctcaattgatcttgaccgaacagcaaatgaaagatgttcttaataaattccaaaaagatttaatggcaaagcgtacatctgaatttaataagaaagcagaagaaaacaaatcaaaaggcgaagcgtttttaactgaaaataaaagcaaaactggtgttgtagtattgccaagtggtttgcaatataaaatcatagacgctggcacaggcgctaaacccggtaaaacagatactgtaacagtagaatataccggccgattgattgacggcactgtttttgacagtactgaaaaaacaggcaaaccagcaacattccaggtttcacaagtaattcctggttggactgaagctctgcaattaatgcctgccggatcgacctgggaaatttatgttcctgcatcgctggcttatggaccacgtagtgttggtggaccaattggaccaaatgaaactttgatctttaaaattcatttgatttcagttaaaaaatccgcatcctaa

SEQ ID NO: 10850 - protein, 233 aa, Legionella moravica
MKMKLVTAAVLGLAMSSAMATDATSLPTDKDKLSYSIGADLGKNFKNQGIDVNPEALAKGMQDGMSGAQLILTEQQMKDVLNKFQKDLMAKRTSEFNKKAEENKSKGEAFLTENKSKTGVVVLPSGLQYKIIDAGTGAKPGKTDTVTVEYTGRLIDGTVFDSTEKTGKPATFQVSQVIPGWTEALQLMPAGSTWEIYVPASLAYGPRSVGGPIGPNETLIFKIHLISVKKSAS

SEQ ID NO: 10851 - DNA, 726 bp, Legionella nautarum
  CDS (1)..(726): transl_table=11
atgaagatgagattggtcgctgctgctgccatgagtttggccatgtcaacgacaatagctgcaaatgctacagcaacttctacgccatcagcggcatcattatctactgatacggataagctgtcttacagcatcggagcggatttaggtaagaacttcaagaagcagggaattgatattagtcctgcagcaatggcaaaaggtttacaagatggaatgagtggtgggcaattattgctaactgaagaacaaatgaaagaggtattaaataaatttcagaaagaattgatgatgaagcgcagcgctgaattcaataaaaaatctgaagaaaataaatcaaaaggggaagcgttcctcaaagataataaatcaaaagatggtgttgtgagtttacctagcggtttgcaatacaaaatccttgaaaaaggggatggcgcaaaaccagctaaagacgacactgttactgttgaatacactggtcgattgatcaatggtcaagtctttgacagtacggaaaaaactggcaagcctgcaactttcaaagtttcacaggttattcctggttggactgaagctttacagttaatgccttctggttctacttgggaagtttatattccatctgatttagcctacggtccacgtagcgttggcggccctatcggacctaatgaaaccttaattttcaagattcatctgatttcagttaagaaaactgatgcctaa

SEQ ID NO: 10852 - protein, 241 aa, Legionella nautarum
MKMRLVAAAAMSLAMSTTIAANATATSTPSAASLSTDTDKLSYSIGADLGKNFKKQGIDISPAAMAKGLQDGMSGGQLLLTEEQMKEVLNKFQKELMMKRSAEFNKKSEENKSKGEAFLKDNKSKDGVVSLPSGLQYKILEKGDGAKPAKDDTVTVEYTGRLINGQVFDSTEKTGKPATFKVSQVIPGWTEALQLMPSGSTWEVYIPSDLAYGPRSVGGPIGPNETLIFKIHLISVKKTDA

SEQ ID NO: 10853 - DNA, 705 bp, Legionella oakridgensis
  CDS (1)..(705): transl_table=11
atgaaactgaaactggtcgctgcagcggtcatgggactggctatgtcaacggcaatggctgcaacggatgcttcatcattaactacggacacagacaagctgtcttacagtattggtattgatcttggcaaaaattttaaacggcaaggcattgaaatcaacccgcaagcaatggttcaagggttgcaagatggtatcagtggcaataagcaacaattgactgaagaacaaatgaaagatgttctcactaaatttcaacgtgatctgatgacgaagcgtacggctgaatataataaaaaagcagaagacaataaaaagaaaggcgaagaatttctggagcaaaataaatccaaagaaggggtagtgaccttacccagtggattacaatataaaattcttaaagcaggggatggccaaaaacctgtaaaagaagataccgtgacagtggagtatactggtcggttgattaatggtgaagtatttgacagtacggaaaaaaatggaaaaccagccagttttaaactgtctcaagtcattccaggctggactgaagcactgcaattaatgccggctggctccgtttgggaagtgtatgttccctctgacctggcatatggttcacgcagtgttggcggacccattggaccaaatgaaacgttgatttttaaaattcatttgatttcagtgaaaaaaagtgacgcttaa

SEQ ID NO: 10854 - protein, 234 aa, Legionella oakridgensis
MKLKLVAAAVMGLAMSTAMAATDASSLTTDTDKLSYSIGIDLGKNFKRQGIEINPQAMVQGLQDGISGNKQQLTEEQMKDVLTKFQRDLMTKRTAEYNKKAEDNKKKGEEFLEQNKSKEGVVTLPSGLQYKILKAGDGQKPVKEDTVTVEYTGRLINGEVFDSTEKNGKPASFKLSQVIPGWTEALQLMPAGSVWEVYVPSDLAYGSRSVGGPIGPNETLIFKIHLISVKKSDA

SEQ ID NO: 10855 - DNA, 702 bp, Legionella parisiensis
  CDS (1)..(702): transl_table=11
atgaagatgaaattggtcactgcggccgtcatggggctggcaatgtctactgtaatggctgctactgatgctacatcgcttgttacggataaggataaattatcttatagtattggtgctgatttaggaaaaaactttaaaaatcaaggtattgatattaatccggacgcattagctaaaggaatgcaagacgggatgtctggtgcccaattgattttgactgaacaacaaatgaaagatgttctgaataaattccaaaaagagttgatggcgaagcgcagcgctgagtttaataagaaagctgaagaaaacaaatctaaaggtgatgcttttttatcaactaataaatcaaaatctggcgtaactgtattaccaagcggtttgcaatataaggtgatcgaagctggtacaggaaataaaccaggcaaatcggatacagtaactgttgagtacactggtactttaatcgatggtactgtatttgatagcactgaaaaaacaggtaagccagctacattccaagtatcacaagttattcctggttggaccgaagcattacaattaatgcctgctggttctacttgggaaatttatgtaccttcagacttagcttatggtccacgtagtgtaggtggtccaataggtccaaatgaaactttgattttcaaaatacatttgatctctgtgaaaaaatctgcctaa

SEQ ID NO: 10856 - protein, 233 aa, Legionella parisiensis
MKMKLVTAAVMGLAMSTVMAATDATSLVTDKDKLSYSIGADLGKNFKNQGIDINPDALAKGMQDGMSGAQLILTEQQMKDVLNKFQKELMAKRSAEFNKKAEENKSKGDAFLSTNKSKSGVTVLPSGLQYKVIEAGTGNKPGKSDTVTVEYTGTLIDGTVFDSTEKTGKPATFQVSQVIPGWTEALQLMPAGSTWEIYVPSDLAYGPRSVGGPIGPNETLIFKIHLISVKKSA

SEQ ID NO: 10857 - DNA, 702 bp, Legionella quateirensis
  CDS (1)..(702): transl_table=11
atgaagatgaaattggtcactgcggccgtcttggggctggcaatgtctactgcaatggcaaccgatgccacatccttacctacagacaaagataaattgtcatacagtattggtgctgatttaggaaagaatttcaaaaatcagggtattgatgtaaacccagaggcattagctaaaggtatgcaagatggtatgagtggagctcaattgatcttgaccgaacagcaaatgaaagatgttcttaataaattccaaaaagatttaatggctaaacgtacatcggaatttaacaagaaagcagaagaaaacaaatcaaaaggcgaagcgtttttaactgaaaataaaagtaaaaccggtgttgtagtattgccaagcggtttgcaatataaaattatagatgctggtacaggtgctaaacccggtaaatcagatactgtaactgtagaatatactggtcgattgattgatggcactgtatttgacagtactgaaaaaacaggaaaaccagcaacattccaggtatcacaagtaattcctggatggactgaagcattacaattaatgcctgctggatctacctgggaaatttatgttcctgcatctctggcttatggcccacgtagtgttggtggacctattggaccaaatgaaactttaatttttaaaattcatttgatttcagttaaaaaatccgcgtcttaa

SEQ ID NO: 10858 - protein, 233 aa, Legionella quateirensis
MKMKLVTAAVLGLAMSTAMATDATSLPTDKDKLSYSIGADLGKNFKNQGIDVNPEALAKGMQDGMSGAQLILTEQQMKDVLNKFQKDLMAKRTSEFNKKAEENKSKGEAFLTENKSKTGVVVLPSGLQYKIIDAGTGAKPGKSDTVTVEYTGRLIDGTVFDSTEKTGKPATFQVSQVIPGWTEALQLMPAGSTWEIYVPASLAYGPRSVGGPIGPNETLIFKIHLISVKKSAS

SEQ ID NO: 10859 - DNA, 702 bp, Legionella quinlivanii
  CDS (1)..(702): transl_table=11
atgaagatgaaactggtcgctgcagctaccatgagtttggctatgtccaccgctattgctgcatccgatgtgactctatctactgacatggataaattatcctacagtattggtgctgatttgggtaaaaatttcaaaaagcaaggaattgaagttaatcctgcggcaatggcaaaaggcttacaggatggtatggcaggcagccaactgatgctgacagatgatcagatgaaagaagtgttgaacaaatttcaaaaagatctgatgtccaagcgaaatgccgaattcagcaaaaaatctgaagagaataaatccaaaggtgaagcttttttaaaccagaataaaactaaagaaggcgttgtcagtttacccagcgggcttcaatacaaagtgattgaaaccggaagcggtgccaaaccggctaaagaggataccgtgacggttgagtacactggcaagacaattgatggtcaggtatttgatagcaccgacaagtccggcaaacctgctacctttaaagtttctcaagtaattccaggatggactgaagcgttacagttaatgcctgctggttctacctgggaaatctacattccttcaaatctggcttatggtccacgaagtgtgggtggtccgattggtccaaatgaaaccttgattttcaaaattcatttgatttccgtaaaaaaggccgccgcttaa

SEQ ID NO: 10860 - protein, 233 aa, Legionella quinlivanii
MKMKLVAAATMSLAMSTAIAASDVTLSTDMDKLSYSIGADLGKNFKKQGIEVNPAAMAKGLQDGMAGSQLMLTDDQMKEVLNKFQKDLMSKRNAEFSKKSEENKSKGEAFLNQNKTKEGVVSLPSGLQYKVIETGSGAKPAKEDTVTVEYTGKTIDGQVFDSTDKSGKPATFKVSQVIPGWTEALQLMPAGSTWEIYIPSNLAYGPRSVGGPIGPNETLIFKIHLISVKKAAA

SEQ ID NO: 10861 - DNA, 747 bp, Legionella rubrilucens
  CDS (1)..(747): transl_table=11
atgaagataaaactggtcgctgcagctgtcgtaggcctggcaatgacaaccgcgtttgctgatacaaataccaccgctcccagcacgactacaccagccactgccgcaacacctgcaaccttaaacaccgatattgacaagttgtcttacagtattggtgctgatttaggcaaaaactttaaaaagcaaggcatcgaaatcagtccttcggcaatggccaaagggttacaggatggcatgagcggttctcagttattgctgactgaagatcaaatgaaagacgtgttgagtaaatttcagaaagacctgatggccaagcgaaatgctgaattcactaaaaaggcagaagagaataagtccaaaggcgaagcatttctgtctcagaacaaaagcaaagaaggcgtggtgacgctgccaagcggtttgcaatataaaatcattgaaaaaggcaatggcgccaaaccaaccaaggatgacacggtcacggttgagtacaccggtcgtctgattgatggtcaagtgtttgacagcacggataaaaccggcaagccagcaacattcaaagtgtctcaggttattcctggctggactgaagccctgcaattaatgcctgccggctccgtctgggaagtttatgttcctgcttccttagcttacggtccacgcagtgttggcggacccattggcccgaatgaaaccttgattttcaaaattcatttgatttctgtcaaaaagtctgacgcgtaa

SEQ ID NO: 10862 - protein, 248 aa, Legionella rubrilucens
MKIKLVAAAVVGLAMTTAFADTNTTAPSTTTPATAATPATLNTDIDKLSYSIGADLGKNFKKQGIEISPSAMAKGLQDGMSGSQLLLTEDQMKDVLSKFQKDLMAKRNAEFTKKAEENKSKGEAFLSQNKSKEGVVTLPSGLQYKIIEKGNGAKPTKDDTVTVEYTGRLIDGQVFDSTDKTGKPATFKVSQVIPGWTEALQLMPAGSVWEVYVPASLAYGPRSVGGPIGPNETLIFKIHLISVKKSDA

SEQ ID NO: 10863 - DNA, 702 bp, Legionella sainthelensi
  CDS (1)..(702): transl_table=11
atgaagatgaaattggtcactgcggccattatggggttggcaatgtctacagcaatggctgcaactgatgctacatcgcttactacggacaaagataaattatcttatagtattggtgctgatttaggaaaaaactttaaaaatcaaggcattgacattaatccagacgtattagctaaaggaatgcaagatggaatgtctggtgctcaattgattttgactgaagaacaaatgaaagatgttctgagtaaatttcagaaagatttgatggctaagcgtagcgctgaatttaataaaaaagcagaagagaacaaagcgaaaggtgaagcgttcttatctgctaacaaatcaaagcctggaatagtagtgttaccaagtggtttgcagtataaaattattgatgctggtactggtgcgaaacccggtaaatcagatactgtaactgttgaatatactggtacattaattgacggtactgtatttgacagtactgaaaaagcaggcaagccggcgacatttcaagtatctcaagtaattcctggttggacagaagcattacaattaatgccttctggttctacatgggaagtttatgttccagcagatttagcttatggcccacgtagtgtaggtggccctataggtccaaatgaaacattgatcttcaaaattcatttgatttcagtaaaaaaagcagcctaa

SEQ ID NO: 10864 - protein, 233 aa, Legionella sainthelensi
MKMKLVTAAIMGLAMSTAMAATDATSLTTDKDKLSYSIGADLGKNFKNQGIDINPDVLAKGMQDGMSGAQLILTEEQMKDVLSKFQKDLMAKRSAEFNKKAEENKAKGEAFLSANKSKPGIVVLPSGLQYKIIDAGTGAKPGKSDTVTVEYTGTLIDGTVFDSTEKAGKPATFQVSQVIPGWTEALQLMPSGSTWEVYVPADLAYGPRSVGGPIGPNETLIFKIHLISVKKAA

SEQ ID NO: 10865 - DNA, 702 bp, Legionella santicrucis
  CDS (1)..(702): transl_table=11
atgaagatgaaattggtcactgcggccattatggggctagcaatgtctacggcaatggctgcaactgatgctacatcgcttactacggacaaagataaattatcttatagtattggtgctgatttaggaaaaaatttcaaaaatcaaggtattgacattaatccagaagcattagctaaaggaatgcaagatggtatgtctggcgctcaattgattttgactgaagagcaaatgaaagacgttctgagtaaatttcaaaaagatctgatggctaagcgtagtgctgaatttaataaaaaagcagaagaaaacaaagcaaaaggtgatgctttcttatctgctaataagtcaaagcctggaatagtggtgttaccaagtggtttgcagtataaaattattgatgccggtactggttcaaaaccaggtaaatcagatactgtaactgttgaatatactggtactttaattgatggtactgtctttgatagcactgaaaaagcaggcaagccagctacatttcaagtatcacaagtaatccctggttggacagaagcattacaattaatgccttctggttctacatgggaagtttatgttcctgcagatttagcctatggttcacgtagtgtaggtggtcctataggtccaaatgaaactttgattttcaaaattcatttgatttctgtaaaaaaagcagcctaa

SEQ ID NO: 10866 - protein, 233 aa, Legionella santicrucis
MKMKLVTAAIMGLAMSTAMAATDATSLTTDKDKLSYSIGADLGKNFKNQGIDINPEALAKGMQDGMSGAQLILTEEQMKDVLSKFQKDLMAKRSAEFNKKAEENKAKGDAFLSANKSKPGIVVLPSGLQYKIIDAGTGSKPGKSDTVTVEYTGTLIDGTVFDSTEKAGKPATFQVSQVIPGWTEALQLMPSGSTWEVYVPADLAYGSRSVGGPIGPNETLIFKIHLISVKKAA

SEQ ID NO: 10867 - DNA, 705 bp, Legionella shakespearei
  CDS (1)..(705): transl_table=11
atgaagatgaaattggtcactgcggccgtcatgggactggcactgtcaacagcaatggctgcacccgatgctacatcattacctacagacaaagataaattgtcttacagtattggtgctgatttaggaaaaaatttcaaaactcaaggtattgatattaatccagaagcattagcaaaaggaatgcaagatggtatgagcggtacccaattgattttgactgaacaacaaatgaaagatgtcttaaataaattccagaaagatttaatggcaaaacgcacttctgaatttaataaaaaagcagatgaaaacaagtcaaaaggcgaagcgtttttagttgaaaataaaggtaaaacaggcgtggtggtattaccaagcggcttgcaatacaaaattatcgacgcgggtactggcgctaaaccaggaaaatcagatacggtaactgtggaatacactggacgtttgattgatggtactgtatttgacagcactgataaaactggtaaaccagctacattccaggtttctcaggttattcctggctggactgaagccttgcaattaatgcctgctggctctacctgggaaatttatgttccttcagctctggcttatggttcacgcagtgttggcggaccaatcggaccaaatgaaactttaattttcaaaattcatttgatttcagttaaaaagactgaagcttaa

SEQ ID NO: 10868 - protein, 234 aa, Legionella shakespearei
MKMKLVTAAVMGLALSTAMAAPDATSLPTDKDKLSYSIGADLGKNFKTQGIDINPEALAKGMQDGMSGTQLILTEQQMKDVLNKFQKDLMAKRTSEFNKKADENKSKGEAFLVENKGKTGVVVLPSGLQYKIIDAGTGAKPGKSDTVTVEYTGRLIDGTVFDSTDKTGKPATFQVSQVIPGWTEALQLMPAGSTWEIYVPSALAYGSRSVGGPIGPNETLIFKIHLISVKKTEA

SEQ ID NO: 10869 - DNA, 708 bp, Legionella spiritensis
  CDS (1)..(708): transl_table=11
atgaagatgaaactggtcgctgcagctgccttgggtttggcaatgtcaacgacgcatgctgtaaccgatactactacgaacttaaatacggataccgataaattgtcttatagtattggggctgatttaggtaaaaacttcaaaaaacagggtattgatatcagtccggccgcaatggcaaaagggatccaggatggcatgagcggtggtgagctgatgatgaccgaccagcagatgaaagatgtgctcaataaatttcagaaagatttaatggccagacgaagtgcggaatttgccaaaaaatcagaagaaaacaaagccagaggcgagacgtttcttagccagaataaaaccaaggatggcgtggtaactttgccaagcggcctgcaatataaagttattgaaaaaggcaatggcgccaagccaagtaaagacgatgtcgtcacggttgaatacaccggacgattgattgacggacaggtttttgacagcacggaaaaaacaggcaaaccggcgacatttaaagtgtctcaggttattccgggatggactgaagcgttacaattgatgccggcagggtctacctgggaagtatatattcctgcttctctggcctatggctcacgcagcgttggcggcccaatcggacccaacgaaacactcatttttaaaatccatttgatttccgtcaaaaaaacggacgcataa

SEQ ID NO: 10870 - protein, 235 aa, Legionella spiritensis
MKMKLVAAAALGLAMSTTHAVTDTTTNLNTDTDKLSYSIGADLGKNFKKQGIDISPAAMAKGIQDGMSGGELMMTDQQMKDVLNKFQKDLMARRSAEFAKKSEENKARGETFLSQNKTKDGVVTLPSGLQYKVIEKGNGAKPSKDDVVTVEYTGRLIDGQVFDSTEKTGKPATFKVSQVIPGWTEALQLMPAGSTWEVYIPASLAYGSRSVGGPIGPNETLIFKIHLISVKKTDA

SEQ ID NO: 10871 - DNA, 699 bp, Legionella steigerwaltii
  CDS (1)..(699): transl_table=11
atgaagatgaaattggtcactgcggccattatggggctggcaatgtctactgcaatggctgctactgatgctacatcgcttgttacggataaagataagttatcttatagtattggtgctgatttaggaaaaaacttcaaaaatcaaggtattgatattaatccggacgcattagctaaaggaatgcaagatggaatgtctggtgcccaattgattttgaccgaacaacaaatgaaagatgttctgaacaaatttcagaaagatttgatggcaaaacgtagcgctgagttcaataaaaaagctgaagagaacaaggctaaaggggaagctttcttatcatctaacaaatcaaaatctggtgtagttgtattgccaagtggcttacaatacaaaattattgaagcaggtacaggaaacaaaccaggtaaatctgatacagtaactgttgaatatactggtactttaattgatggtactgtgtttgatagcactgagaaaacaggcaagcctgctacattccaagtatcacaagtgattcccggttggactgaagcattacaattaatgcctgctggctctacttgggaaatttttgttccttcagacttagcttatggcccacgtagcgtaggtggtcctattggtccaaatgaaactttgattttcaaaattcatttgatctctgtgaaaaaagcctaa

SEQ ID NO: 10872 - protein, 232 aa, Legionella steigerwaltii
MKMKLVTAAIMGLAMSTAMAATDATSLVTDKDKLSYSIGADLGKNFKNQGIDINPDALAKGMQDGMSGAQLILTEQQMKDVLNKFQKDLMAKRSAEFNKKAEENKAKGEAFLSSNKSKSGVVVLPSGLQYKIIEAGTGNKPGKSDTVTVEYTGTLIDGTVFDSTEKTGKPATFQVSQVIPGWTEALQLMPAGSTWEIFVPSDLAYGPRSVGGPIGPNETLIFKIHLISVKKA

SEQ ID NO: 10873 - DNA, 702 bp, Legionella tucsonensis
  CDS (1)..(702): transl_table=11
atgaagatgaaattggtcactgcggccgtcatggggctggcaatgtctactgtaattgctgctactgatgctacatcgcttgttacggataaggataaattatcttatagtattggtgctgatttaggaaaaaacttcaaaaatcaaggtattgatattaatccggacgcattagctaaaggaatgcaagatgggatgtctggtgcccaattgattttgactgaacaacaaatgaaagatgttctgaataaattccaaaaagagttgatggcgaagcgcagcgctgagtttaataaaaaggctgaagaaaacaaatctaaaggtgaaacctttttatcaactaacaaatcaaaatccggcgtagttgtattgccaagtggtttgcaatataaaattattgaagcaggtactggaaataaaccaggaaaatcggacacagtaactgttgaatacactggtactttaattgatggtactgtatttgatagcactgaaaaagcaggtaagccagctacattccaagtatcacaagtgattcctggttggactgaagcattacaattaatgcctgccggttctacttgggaaatttatgtaccttcagacttagcttatggcccacgtagtgtaggtggtcctataggtccaaatgaaactttgattttcaaaattcatttgatctctgtgaaaaaatctgcctaa

SEQ ID NO: 10874 - protein, 233 aa, Legionella tucsonensis
MKMKLVTAAVMGLAMSTVIAATDATSLVTDKDKLSYSIGADLGKNFKNQGIDINPDALAKGMQDGMSGAQLILTEQQMKDVLNKFQKELMAKRSAEFNKKAEENKSKGETFLSTNKSKSGVVVLPSGLQYKIIEAGTGNKPGKSDTVTVEYTGTLIDGTVFDSTEKAGKPATFQVSQVIPGWTEALQLMPAGSTWEIYVPSDLAYGPRSVGGPIGPNETLIFKIHLISVKKSA

SEQ ID NO: 10875 - DNA, 705 bp, Legionella wadsworthii
  CDS (1)..(705): transl_table=11
atgaagatgaaattggtcaatgcggccattttagggctggcaatgtctactgcaatggctgctaccgatgctacatcgcttgttacggataaggataaattatcttacagtattggtgctgatttaggaaaaaacttcaaaactcaaggtattgatatcaatccggacgcattagctaagggaatgcaagatggaatgtctggtgcccaattgattttgactgaacaacaaatgaaagatgttctcaataaattccagaaagatttgatggctaagcgtagcgctgagtttaataaaaaagctgaagaaaacaaatctaaaggcgattcattcttatcatcaaacaaaagcaaatctggtgttgtcgtattaccaagcggtttgcaatataaagtgattgaagcaggtacaggaaataagcccagtaagacagatactgttactgtagaatacaccggtacattaattgatggtactgtatttgacagcacagaaaaaacggggaaaccagctacattccaagtatcacaagttattcctggctggactgaagcattacaattaatgcctgctggttctacgtgggaaatctatgtcccttcagacttagcttacggtccacgtagtgtaggtggtccaataggtccaaatgaaactttaatatttaaaattcatttgatctctgtgaaaaaagcttctgcataa

SEQ ID NO: 10876 - protein, 234 aa, Legionella wadsworthii
MKMKLVNAAILGLAMSTAMAATDATSLVTDKDKLSYSIGADLGKNFKTQGIDINPDALAKGMQDGMSGAQLILTEQQMKDVLNKFQKDLMAKRSAEFNKKAEENKSKGDSFLSSNKSKSGVVVLPSGLQYKVIEAGTGNKPSKTDTVTVEYTGTLIDGTVFDSTEKTGKPATFQVSQVIPGWTEALQLMPAGSTWEIYVPSDLAYGPRSVGGPIGPNETLIFKIHLISVKKASA

SEQ ID NO: 10877 - DNA, 702 bp, Legionella worsleiensis
  CDS (1)..(702): transl_table=11
atgaagatgaaattggtcgctgcagccgtcttggggctggcaatgtctggtgcaatggcagctgatgctacatccttaactacagacaaagataaattgtcttacagtatcggtgctgatttgggaaagaattttaaaaatcagggtatagatgtgaatccagaggcattggctaaaggaatgcaagacgggatgagtggcacgcaattaatccttacagaacagcaaatgaaagacgttcttaataaattccaaaaagatttaatggcaaaacgcacctcggaattcaataagaaagccgatgaaaacaaattaaaaggcgaagcctttttaactgcaaataaaactaaagccggtgttgtagttctgcccagcggcttgcaatataaaattttagatgccggtacaggcaccaagcccggtaaatcagatacagtgactgtagagtatactggtcgtttaattgacggcactatatttgacagttcagacaaaactggtaaaccagcaacattccaggtgtcacaagttattcctggatggactgaggctctgcaattaatgccagctggatctacctgggagatttatgttccagcggctctggcttatggttcacgcagtattggcggacctattggacccaatgaaactttgattttcaaaattcatttgatttctgttaaaaaatctgatgcctaa

SEQ ID NO: 10878 - protein, 233 aa, Legionella worsleiensis
MKMKLVAAAVLGLAMSGAMAADATSLTTDKDKLSYSIGADLGKNFKNQGIDVNPEALAKGMQDGMSGTQLILTEQQMKDVLNKFQKDLMAKRTSEFNKKADENKLKGEAFLTANKTKAGVVVLPSGLQYKILDAGTGTKPGKSDTVTVEYTGRLIDGTIFDSSDKTGKPATFQVSQVIPGWTEALQLMPAGSTWEIYVPAALAYGSRSIGGPIGPNETLIFKIHLISVKKSDA

SEQ ID NO: 10879 - DNA, 675 bp, Pseudomonas syringae pv
  CDS (1)..(675): transl_table=11
atgaccgttcaggttttacgcaattatcgactgcgtgcccctctgcggagcagtgtcatgtccgaagtcaatctgtccaccgacgaaacccgcgtcagctacggcatcggccgtcagttgggcgaccagttgcgcgacaacccgccaccgggcgtcaatctggaagccattgttgcaggcttgcgcgatgcgtttggcggtcagccaagccgtgtgggtcaggaagaaatgtccgccagcttcaaggtcatccgtgaaatcatgcaggccgaagcagccgccaaggccgaacaggctgcaggcgccggcaaggcttacctggctgaaaacgccaagcgcgaaggcgtgaccaccctggcttccggccttcaatttgaagcgctgacttccggtgatggcgccaagccaacccgtgaagaccaggtgcgcgtgcactatcacggcacgctgatcgacggcactgtcttcgacagctcttacgatcgtggcgaacctgccgagtttccggtcagcggcgtgatcgcgggctggaccgaagcactgcaattgatgaacgccggcagcaaatggcgtctgcacgtgccgagcgagctggcgtacggtgctcagggcgtcggcagcatcgcaccgcacagcgtgctggtgttcgacgtggaactgctggacgttctgtaa

SEQ ID NO: 10880 - protein, 224 aa, Pseudomonas syringae pv
MTVQVLRNYRLRAPLRSSVMSEVNLSTDETRVSYGIGRQLGDQLRDNPPPGVNLEAIVAGLRDAFGGQPSRVGQEEMSASFKVIREIMQAEAAAKAEQAAGAGKAYLAENAKREGVTTLASGLQFEALTSGDGAKPTREDQVRVHYHGTLIDGTVFDSSYDRGEPAEFPVSGVIAGWTEALQLMNAGSKWRLHVPSELAYGAQGVGSIAPHSVLVFDVELLDVL

SEQ ID NO: 10881 - DNA, 732 bp, Salmonella choleraesuis
  CDS (1)..(732): transl_table=11
ttgtttctttttccctgcgatttgtcatcctccctgagaccaagttttaccagaagaagcgtggctgttatgctgcccgctacttttttgatatccgatgaaggaaaaataatggccaccccgacttttgacactattgaagcgcaagcgagctacggcattggtttgcaggtagggcagcagctcagcgaatccggtcttgaagggctgttgcctgaagcgctggttgcaggcattgctgatgcgctggaaggtaaacacccggcggttcctgttgatgtggtgcatcgtgcgctgcgtgaaattcatgagcgtgcggacgcggtgcgtcgtgagcgtttcaaagcgatggcggccgaaggcgtgaaatacctggaagaaaaccgcgaaaaagacggtgtgaacagtactgagtctggtttacagttccgcgttctgacgcagggcgaaggcgcgattccggcgcgtaccgaccgcgtacgcgtgcattacaccggtaagcttattgatggcaccgtatttgacagctccgtcgcgcgcggcgaaccggctgaattcccggtaaatggcgtgatcgccggctggattgaagctctgactctgatgccggtaggttccaaatgggaactgactatcccacaggagctggcctatggcgagcgtggggccggggcctctgttccgccattcagcaccctggtgtttgaggtggaactgctggaaattctctaa

SEQ ID NO: 10882 - protein, 243 aa, Salmonella choleraesuis
MFLFPCDLSSSLRPSFTRRSVAVMLPATFLISDEGKIMATPTFDTIEAQASYGIGLQVGQQLSESGLEGLLPEALVAGIADALEGKHPAVPVDVVHRALREIHERADAVRRERFKAMAAEGVKYLEENREKDGVNSTESGLQFRVLTQGEGAIPARTDRVRVHYTGKLIDGTVFDSSVARGEPAEFPVNGVIAGWIEALTLMPVGSKWELTIPQELAYGERGAGASVPPFSTLVFEVELLEIL

SEQ ID NO: 10883 - DNA, 618 bp, Shewanella sp
  CDS (1)..(618): transl_table=11
atgtcagatttgttcagcactatggaacagcatgctagctacggtgtaggtcgtcaaattggcgagcaactagcagcaaactcttttgaaggtattgatatccctgctgttcaagctggtcttgctgatgcatttgccgggaaagaaagcgcagtatcaatggaagagcttcaagttgcatttactgaaattagtcgtcgtttacaagcagcacaagaagctgctgcagaagctgctgccgctgaaggtgatacattcctagctgaaaacgctaagcgtgacggtattacgatcacagagtctggtcttcaatacgaagtacttgttcaaggcgacggtgaaacaccaacgtatgattcaactgtacgtactcattaccatgggactttcatcagtggtgatgtgttcgatagttctgttgctcgtggccagcctgctgagttcccagtatctggcgttatcgccggttggactgaagcattacagttaatgccagttggcactaagcttaaattatatgtcccacatcacttggcttacggtgagcggggcgcgggtgcttcaatcccgccttattcggctttggtcttcgaagttgaattgttagaaattatctag

SEQ ID NO: 10884 - protein, 205 aa, Shewanella sp
MSDLFSTMEQHASYGVGRQIGEQLAANSFEGIDIPAVQAGLADAFAGKESAVSMEELQVAFTEISRRLQAAQEAAAEAAAAEGDTFLAENAKRDGITITESGLQYEVLVQGDGETPTYDSTVRTHYHGTFISGDVFDSSVARGQPAEFPVSGVIAGWTEALQLMPVGTKLKLYVPHHLAYGERGAGASIPPYSALVFEVELLEII

SEQ ID NO: 10885 - DNA, 702 bp, Legionella cincinnatiensis
  CDS (1)..(702): transl_table=11
atgaagatgaaattggtcactgcggccattatggggctggcaatgtctacagcaatggctacaactgatgctacatcgcttactacggacaaagataaattatcttatagtattggtgctgatttaggaaaaaactttaaaaatcaaggtattgacattaatccagaggcattagctaaaggaatgcaagatggaatgtctggggctcaattgattttgactgaagagcaaatgaaagatgttctgagtaaatttcaaaaagatctgatggctaagcgtagtgctgaatttaataaaaaagcagaagaaaacaaagcaaaaggtgaagctttcttatctgctaataagtcaaagcctgggatagtagtgttaccaagtggtttgcagtataagattattgatgccggtactggtgcaaaaccaggtaagtcagacactgtaactgttgaatatactggaactttaattgacggtactgtatttgatagcactgaaaaagcaggtaagccagctacatttcaagtatcgcaagtaatccctggttggacagaagcattacaattaatgccttctggttctacatgggaagtttatgttcctgctgatttagcttatggtccacgtagtgtaggtggtcctataggtccaaatgaaactttgatcttcaaaattcatttgatttctgtaaaaaaagcagcctaa

SEQ ID NO: 10886 - protein, 233 aa, Legionella cincinnatiensis
MKMKLVTAAIMGLAMSTAMATTDATSLTTDKDKLSYSIGADLGKNFKNQGIDINPEALAKGMQDGMSGAQLILTEEQMKDVLSKFQKDLMAKRSAEFNKKAEENKAKGEAFLSANKSKPGIVVLPSGLQYKIIDAGTGAKPGKSDTVTVEYTGTLIDGTVFDSTEKAGKPATFQVSQVIPGWTEALQLMPSGSTWEVYVPADLAYGPRSVGGPIGPNETLIFKIHLISVKKAA

SEQ ID NO: 10887 - DNA, 732 bp, Legionella micdadei
  CDS (1)..(732): transl_table=11
atgaagatgagattggtcgctgcagctgccatgggtttggcaatgtcaacgacaatagctgcaaccgctacaactgatgcgacaacttctgcaccaggaacatcattgactacagacacagaaaagctctcatacagcattggtgctgatttgggtaagaattttaaaaagcagggaatagaaattagtcctgctgctatggcaaaaggtttacaagatggaatgagcggcggccaattgttgctgaccgacgaccagatgaaggatgtgctaaataagtttcaaaaagatctaatgatgaaacgcagcgcagaattcaataagaaagctgaagagaataagtcgaaaggagaagctttccttaacgaaaataaatcaaaagaaggtgttgttagtttacctagcggtttgcagtataagatccttgaacgaggcgatggtgctaaaccgaccaaggatgacgtcgttactgtggaatacaccggcaagctgattgacggtcaggttttcgacagtactgaaaagacaggcaaacctgcaacctttaaagtttctcaagttattccaggttggactgaagcactgcaattaatgccagcaggttctacttgggaagtgtatatcccttccaatctggcttatggcccacgtagcgttggcggcccaattggacctaatgaaactttaattttcaaaattcatctgatttcagtgaagaaatctgacgcgtaa

SEQ ID NO: 10888 - protein, 243 aa, Legionella micdadei
MKMRLVAAAAMGLAMSTTIAATATTDATTSAPGTSLTTDTEKLSYSIGADLGKNFKKQGIEISPAAMAKGLQDGMSGGQLLLTDDQMKDVLNKFQKDLMMKRSAEFNKKAEENKSKGEAFLNENKSKEGVVSLPSGLQYKILERGDGAKPTKDDVVTVEYTGKLIDGQVFDSTEKTGKPATFKVSQVIPGWTEALQLMPAGSTWEVYIPSNLAYGPRSVGGPIGPNETLIFKIHLISVKKSDA

SEQ ID NO: 10889 - DNA, 780 bp, Escherichia coli O157
  CDS (1)..(780): transl_table=11
atgatgtccgtggtaaacccgcctttattatattcatacgggatattgctattgtttctttttccctgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggtattgccgatgcgctggaaggcaaacatccggctgttccggttgatgtggtgcatcgcgcgctgcgtgaaatccacgagcgcgccgatgccgttcgtcgtcagcgtttccaggcgatggctgctgaaggtgtgaaatacctggaagaaaacgccaaaaaagaaggtgtgaatagcaccgaatctggcctgcaattccgcgtgatcaaccagggtgaaggcgcaattccggcacgtaccgaccgcgttcgtgttcattacaccggtaaactgatcgacggcaccgtgtttgacagctccgttgctcgtggtgaacccgctgaatttccggttaatggcgtgatccctggctggattgaagcactgactctgatgccggtaggttctaaatgggaactgactatcccgcaggaactggcatatggcgagcgcggcgcaggcgcatccatccctccgttcagcaccctggtgtttgaagtcgaactgctggaaatcctctaa

SEQ ID NO: 10890 - protein, 259 aa, Escherichia coli O157
MMSVVNPPLLYSYGILLLFLFPWDLSSFPRQSFTQRSVADMLPATLYPKKGNTMTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 10891 - DNA, 639 bp, Photorhabdus luminescens subsp
  CDS (1)..(639): transl_table=11
ttgatcacaggtattttcatggcaaaactttcttttgactctatcgaagcacaagcaagttatggggttggcttgcaagttggtcagcaattactggagtctggcctgcaaggtctggaacctgaagcgttgttagcggggttatgcgatgcgctggaaaatcattctccagcggtgccggtcgatatattgcatcgtgccttacgtgaaatgcatgaacgtgcagatggtgtgcgtcgtgaacgtcagcaagttatggcagaagagggacagaaatttctggcagaaaatgctcagcgtgacggtataagcacgacagaatctggtttacagttctctgtactaaagcagggtgatggtgcaattcctgcccatactgaccacgtgcgtgtccattacacggggcgtctgattgatggcaccgtgtttgacagctcagtacagcgtggtgaacctgctgaatttcctgtgaatggggtgattgctggatggattgaagcattgacgttgatgcctgtcggttctaaatgggaactttatatcccttataatttggcttatggcgagcgtggtgccggtgcatcgattcccccatatagcactctgattttcgaggtggaattgttggatattctgtaa

SEQ ID NO: 10892 - protein, 212 aa, Photorhabdus luminescens subsp
MITGIFMAKLSFDSIEAQASYGVGLQVGQQLLESGLQGLEPEALLAGLCDALENHSPAVPVDILHRALREMHERADGVRRERQQVMAEEGQKFLAENAQRDGISTTESGLQFSVLKQGDGAIPAHTDHVRVHYTGRLIDGTVFDSSVQRGEPAEFPVNGVIAGWIEALTLMPVGSKWELYIPYNLAYGERGAGASIPPYSTLIFEVELLDIL

SEQ ID NO: 10893 - DNA, 780 bp, Escherichia coli O6
  CDS (1)..(780): transl_table=11
atgatgtccgtggtaaacccgcctttattatattcatacgggatattgctattgtttctttttccccgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggcattgccgatgcgctggaaggcaaacatccggctgttccggttgatgtggtgcaccgcgcgctgcgtgaaatccacgaacgcgccgatgccgttcgtcgtcagcgtttccagacgatggctgctgaaggtgtgaaatacctggaagaaaacgccaaaaaagaaggtgtaaatagcaccgaatctggcctgcaattccgcgtgatcaaccagggcgaaggcgcaattccggcacgtaccgaccgcgttcgtgttcattacaccggaaaactgatcgacggcaccgtgtttgacagctccgttgctcgcggcgagccagctgaattcccggttaacggcgtgatccctggctggattgaagcactgactctgatgccagtaggttctaaatgggaactgactatcccgcaggaactggcatatggcgagcgtggcgcaggcgcgtccatccctccgttcagcaccctggtgtttgaagtcgaactgctggaaatcctctaa

SEQ ID NO: 10894 - protein, 259 aa, Escherichia coli O6
MMSVVNPPLLYSYGILLLFLFPRDLSSFPRQSFTQRSVADMLPATLYPKKGNTMTTPTFDTIEAQASYGIGLQVGQQLSESGLEGLLPEALVAGIADALEGKHPAVPVDVVHRALREIHERADAVRRQRFQTMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 10895 - DNA, 711 bp, Legionella pneumophila serogroup 8
  CDS (1)..(711): transl_table=11
atgaagatgaaattggtgactgcagctgttatggggcttgcaatgtcaacagcaatggctgcaaccgatgccacatcattagctacagacaaggataagttgtcttatagcattggtgccgatttggggaagaattttaaaaatcaaggcatagatgttaatccggaagcaatggctaaaggcatgcaagacgctatgagtggcgctcaattggctttaaccgaacagcaaatgaaagacgttcttaacaagtttcagaaagatttgatggcaaagcgtactgctgaattcaataagaaagcggatgaaaataaagtaaaaggggaagcctttttaactgaaaacaaaaacaagccaggcgttgttgtattgccaagtggtttgcaatacaaagtaatcaattctggaaatggtgttaaacccggaaaatcggatacagtcactgtcgaatacactggtcgtctgattgatggtaccgtttttgacagtaccgaaaaaactggtaagccagcaacttttcaggtttcacaagttatccctggatggacagaagctttacaattgatgccagctggatcaacctgggaaatttatgttccctcaggtcttgcatatggcccacgtagcgttggcggacctattggcccaaatgaaactttaatatttaaaattcacttaatttcagtgaaaaaatcatctaagtttttttga

SEQ ID NO: 10896 - protein, 236 aa, Legionella pneumophila serogroup 8
MKMKLVTAAVMGLAMSTAMAATDATSLATDKDKLSYSIGADLGKNFKNQGIDVNPEAMAKGMQDAMSGAQLALTEQQMKDVLNKFQKDLMAKRTAEFNKKADENKVKGEAFLTENKNKPGVVVLPSGLQYKVINSGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSSKFF

SEQ ID NO: 10897 - DNA, 702 bp, Legionella pneumophila serogroup 1
  CDS (1)..(702): transl_table=11
atgaagatgaaaacggtgactgcagctgttatggggcttgcaatgtcaacagcaatggctgcaaccgatgccacatcattagctacagacaaggataagttgtcttatagcattggtgccgatttggggaagaattttaaaaatcaaggcatagatgttaatccggaagcaatggctaaaggcatgcaagacgctatgagtggcgctcaattggctttaaccgaacaacaaatgaaagacgttcttaacaagtttcagaaagatttgatggcaaagcgtactgctgaattcaataagaaagcggatgaaaataaagtaaaaggggaagcctttttaactgaaaacaaaaacaagccaggcgttgttgtattgccaagtggtttgcaatacaaagtaatcaattctggaaatggtgttaaacccggaaaatcggatacagtcactgtcgaatacactggtcgtctgattgatggtaccgtttttgacagtaccgaaaaaactggtaagccagcaacgttccaggtttcacaagttatccctggatggacagaagctttgcaattgatgcccgctggatcaacttgggaaatttatgttccctcaggtcttgcatatggcccacgtagcgttggcggacctattggcccaaatgaaactttaatatttaaaattcacttaatttcagtgaaaaaatcatcttaa

SEQ ID NO: 10898 - protein, 233 aa, Legionella pneumophila serogroup 1
MKMKTVTAAVMGLAMSTAMAATDATSLATDKDKLSYSIGADLGKNFKNQGIDVNPEAMAKGMQDAMSGAQLALTEQQMKDVLNKFQKDLMAKRTAEFNKKADENKVKGEAFLTENKNKPGVVVLPSGLQYKVINSGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSS

SEQ ID NO: 10899 - DNA, 726 bp, Actinobacillus actinomycetemcomitans
  CDS (1)..(726): transl_table=11
atgttaaaaatgaagaaaatttcagtgccggtgctgattttaagtgcggtcgtttctagcggtgttttggcggaaagcaaaactgatgcaaaatttaccgatgattcctcttacgcggtaggcgtattattcggttccgatttacaaggcttaattaacgcacaaaaaggcatgattgattacaacaatgcgaaagtgattgccgggatttccgacgtgttaaacggcaaagtaaaattggaaggcaacaaagaaatcgcctctaccttgcaaggcattaatgccaagttaaaagcggaaaatgaaaaacgtgtcgccgtcatggtgaaaaaagcggaagaagaaggcaaaaaattcacggcagaatttgctaagaaagatggcgtgaagaaaactgcttccggtttgttatatcgtgtggaaaaagaagggtccggtgatgccattaaagctgccgatgtggttaaagttcactataccggtaaattgccggacggtaccgtatttgacagctcccgtgagcgtggaacgcctgctgagtttccattaaatcaagtgattaaaggttggaccgaaggtctgcaattagttaaaaaaggcggacaaattgagttggtcattccggcggacttggggtacggtgaggacggtgcgggcgataaaattccaccgcattccacactttactttgatattgaagtattggacgtcaccccggcgaaataa

SEQ ID NO: 10900 - protein, 241 aa, Actinobacillus actinomycetemcomitans
MLKMKKISVPVLILSAVVSSGVLAESKTDAKFTDDSSYAVGVLFGSDLQGLINAQKGMIDYNNAKVIAGISDVLNGKVKLEGNKEIASTLQGINAKLKAENEKRVAVMVKKAEEEGKKFTAEFAKKDGVKKTASGLLYRVEKEGSGDAIKAADVVKVHYTGKLPDGTVFDSSRERGTPAEFPLNQVIKGWTEGLQLVKKGGQIELVIPADLGYGEDGAGDKIPPHSTLYFDIEVLDVTPAK

SEQ ID NO: 10901 - DNA, 780 bp, Escherichia coli O157; identical to SEQ ID NO: 10607
  CDS (1)..(780): transl_table=11
  misc_feature (731)..(731): y is t or c

SEQ ID NO: 10902 - protein, 259 aa, Escherichia coli O157
  misc_feature (244)..(244): The Xaa at location 244 stands for Leu, or Pro.
MMSVVNPPLLYSYGILLLFLFPWDLSSFPRQSFTQRSVADMLPATLYPKKGNTMTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIXPFSTLVFEVELLEIL

SEQ ID NO: 10903 - DNA, 702 bp, Legionella pneumophila
  CDS (1)..(702): transl_table=11
atgaagatgaaattggtgactgcagctgttatggggcttgcaatgtcaacagcaatggctgcaaccgatgccacatcattagctacagacaaggataagttgtcttatagcattggtgccgatttgggaaagaactttaagaatcaaggcattgatgttagtccggaagcaatggctaaaggcatgcaagacgctatgagtggcgctcaattggctttaaccgaacagcaaatgaaagacgttcttaacaagtttcagaaagatttgatggcaaaacgtactgctgaattcaataaaaaggcggatgaaaataaagtaaaaggggaagcctttttaactgaaaacaaaaacaagccaggtgttgttgtattaccaagcggtttgcaatacaaagtaatcaatgctggaaatggtgttaaacccggtaaatcggatacagttactgtcgaatatactggtcgtctgattgatggtaccgtttttgacagtaccgaaaaaactggtaagccagccacttttcaggtttcacaagtgattccaggatggacagaggctttacaattgatgccagcaggatcaacctgggaaatttatgttccttcaggtctcgcatatggtccacgcagcgttggcggacccattggcccaaatgaaactttaatattcaaaattcacttaatttcagtgaaaaaatcatcttaa

SEQ ID NO: 10904 - protein, 233 aa, Legionella pneumophila
MKMKLVTAAVMGLAMSTAMAATDATSLATDKDKLSYSIGADLGKNFKNQGIDVSPEAMAKGMQDAMSGAQLALTEQQMKDVLNKFQKDLMAKRTAEFNKKADENKVKGEAFLTENKNKPGVVVLPSGLQYKVINAGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSS

SEQ ID NO: 10905 - DNA, 702 bp, Legionella pneumophila
  CDS (1)..(702): transl_table=11
atgaagatgaaattggtgactgcagctgttatggggcttgcaatgtcaacagcaatggctgcaaccgatgccacatcattagctactgacaaggataagttgtcttatagcattggtgccgatttgggaaagaattttaaaaatcaaggcattgatgttagtccggaagcattggctaaaggcatgcaagacgctatgagtggcgctcaattggctttaaccgaacagcaaatgaaagacgttcttaacaaatttcaaaaagatttgatggcaaaacgtacagctgaattcaataagaaagcagatgaaaataaagtaaaaggggaagcctttttaactgaaaacaaaaacaagccaggcgttgttgtattaccaagtggtttgcaatataaagtaatcaatgctggaaatggtgttaaacctggtaaatcggatacagtgactgtcgaatacactggtcgtctgattgatggtaccgtttttgacagtaccgaaaaaactggtaagccagctacttttcaggtttcacaagttatcccaggatggacagaggctttacaattgatgccagccggatcaacttgggaaatttatgttcctgcaggtcttgcttatggaccccgtagcgttggcggacctattggcccgaatgaaactttaatatttaaaattcacttaatttcagtgaaaaaatcatcttaa

SEQ ID NO: 10906 - protein, 233 aa, Legionella pneumophila
MKMKLVTAAVMGLAMSTAMAATDATSLATDKDKLSYSIGADLGKNFKNQGIDVSPEALAKGMQDAMSGAQLALTEQQMKDVLNKFQKDLMAKRTAEFNKKADENKVKGEAFLTENKNKPGVVVLPSGLQYKVINAGNGVKPGKSDTVTVEYTGRLIDGTVFDSTEKTGKPATFQVSQVIPGWTEALQLMPAGSTWEIYVPAGLAYGPRSVGGPIGPNETLIFKIHLISVKKSS

SEQ ID NO: 10907 - DNA, 831 bp, Porphyromonas gingivalis
  CDS (1)..(831): transl_table=11
atgaaaaaaacaattgcaattatcgcctcagccctcttggctttaggagccgtcggctgtaagaaaaatgctgacactaccgctgtcagtgaaaaggatagcatagccttgtccatgggtattttgtacggacaggattttgccaatcagttcgaaatgtcccgcttgcaaggccagccgattgattcggtagctttcttggacggtttcaaatatggtatcgatacgacgcgcttctcgtacaatctgggagccatctatgcttccaatatagctcgtcagctggctcatgattccatcgatatcgacaagttctatgcagccatgcgtgcggctcttcttaaagacaccgtatctatcgccatgaagcctgcagatgcacaggctttcatgcaacgaatccaagccagaaagcagcgagaaaacaatatgaagcagtttggccagaacatcgaaaagggtaatgaatacatcgatacctttaaaaaagaagatggtgtaactgttacgacaagtggtctggcatacaagactcttcaggaaggtacgggagctactccctctttggccgatactgtacgtgtcaagtatgtgggtactctggtcgatggtaaagagttcgacaaaaacgaagaaggaatcgaatttgccgttaccggtgtgattaaaggctggacggagatgctccaactcatgaaggtcggtcagaaagttcgcgtggtaatcccacaggagctggcttatggggagaccggcaactataccatcgaaccgttctctaccctgacgttcgagatggaacttatcgggatcaagcccgggaaaaagtaa

SEQ ID NO: 10908 - protein, 276 aa, Porphyromonas gingivalis
MKKTIAIIASALLALGAVGCKKNADTTAVSEKDSIALSMGILYGQDFANQFEMSRLQGQPIDSVAFLDGFKYGIDTTRFSYNLGAIYASNIARQLAHDSIDIDKFYAAMRAALLKDTVSIAMKPADAQAFMQRIQARKQRENNMKQFGQNIEKGNEYIDTFKKEDGVTVTTSGLAYKTLQEGTGATPSLADTVRVKYVGTLVDGKEFDKNEEGIEFAVTGVIKGWTEMLQLMKVGQKVRVVIPQELAYGETGNYTIEPFSTLTFEMELIGIKPGKK

SEQ ID NO: 10909 - DNA, 732 bp, Amoeba proteus symbiotic bacterium
  CDS (1)..(732): transl_table=11
atgaagatgagactggtcgctgcaactgtcataggtttggcaatgtcaacgacaatggctgcaagcgctgcacctgacgcagcaactactgcgtcatctgcaacatcattgactactgatatggataagctgtcttacagtatcggcgctgatttaggtaagaatctcaaaaaacagggtattgatatcagtcctgctgcgatggccaaggggttacaagacggtataagcggtggccaattgttgttgactgagcagcaaatgaaggatgtgttgaataaatttcaaaaagatttaatggcgagacgaacggctgattttaataaaaaggctgaagaaaataaaacaaagggcgactcttttttaaaccaaaataaaggaaaagacggcgtagtcagtttgccaagtggtttgcagtataaggtcattcaaaaaggcgatggggcaaaaccttccaaagaagacacagtgactgtcgactatacgggtacattacttgatggccaagtttttgatacgactgaaaaaacgggtaagcctgctacgtttaaagtatcacaggtcattcctggctggactgaggcactgcaattaatgcccgcaggctctacctgggaagtgtttgttcctgcaggtcttgcttatggtccgcgtagcgttggcggacctattggcccaaatgaaactttaatattcaaaattcacctaatttcagtgaaaaaatcatcttaa

SEQ ID NO: 10910 - protein, 243 aa, Amoeba proteus symbiotic bacterium
MKMRLVAATVIGLAMSTTMAASAAPDAATTASSATSLTTDMDKLSYSIGADLGKNLKKQGIDISPAAMAKGLQDGISGGQLLLTEQQMKDVLNKFQKDLMARRTADFNKKAEENKTKGDSFLNQNKGKDGVVSLPSGLQYKVIQKGDGAKPSKEDTVTVDYTGTLLDGQVFDTTEKTGKPATFKVSQVIPGWTEALQLMPAGSTWEVFVPAGLAYGPRSVGGPIGPNETLIFKIHLISVKKSS

SEQ ID NO: 10911 - DNA, 807 bp, Aeromonas hydrophila
  CDS (1)..(807): transl_table=11
atgaacaattttctgaaggtgtccctgttggccgcggcagttgccgtaagtctgactgcttgccaaaaagacgagaagactgctgcgaataccgcagaggtcaaggcagaagccagcaagccggcagaggcccccaaggctgaagccaagagctttgaagagcaatccggctatgcaattggcctctccatgggtcgttatatcgccaataccctggaacgtcagcaggaactcggcatcaagctggacaacagcgtcatcctcaagggtgtgaccgacggtctgggcaaagaagccaagatgaccgacgaggagatccagaaggttctgcagcagtacgacgccaagatcaacgagctgaccaaggccaaggctgacaaggatgccgtggaaaaccagaagaagggtgaagagtacctggctgccaacgccaagaaagagggcgtgaagagcaccgaatccggcctgcaataccaggtcgagaagatgggtaccggcgccaagccgaaggccaccgacatcgtcaaggtccactacaccggtaccctgaccgatggcaccaagttcgacagctccgtcgatcgcggtgagccggccaccttcccgctcaaccaggtgatcccgggctggaccgaaggcgtgcagctgatgccggtcggttccaagttcaagttcttcctgccgtccaagctggcctatggcgaacacggtgcgggttccatcccggccaatgccgtgctggtattcgacgttgagctgctggctatcgagaaaccggctgccgatggcgacaacgccaagaagtaa

SEQ ID NO: 10912 - protein, 268 aa, Aeromonas hydrophila
MNNFLKVSLLAAAVAVSLTACQKDEKTAANTAEVKAEASKPAEAPKAEAKSFEEQSGYAIGLSMGRYIANTLERQQELGIKLDNSVILKGVTDGLGKEAKMTDEEIQKVLQQYDAKINELTKAKADKDAVENQKKGEEYLAANAKKEGVKSTESGLQYQVEKMGTGAKPKATDIVKVHYTGTLTDGTKFDSSVDRGEPATFPLNQVIPGWTEGVQLMPVGSKFKFFLPSKLAYGEHGAGSIPANAVLVFDVELLAIEKPAADGDNAKK

SEQ ID NO: 10913 - DNA, 726 bp, Buchnera aphidicola subsp
  CDS (1)..(726): transl_table=11
atgatattatatgttccaaaatctttttcaatttcagcgcctatatcagatatacatttgcaatctgttttagaaacaaaaaatacatttcataataataatgaaaagttaggttatattttaggtctatccttcggtaattatgtaaaccaaacttttgaaaaacaaaaaaaaataggaatcgagttagataggaatagtcttttaaaaggaatacaagatgctatatctggaaatttaaaactctcgcatcaagatatttcttcgggtctaaaagaactagaaaaaaaattaaaacatgcgactaaaattcaattgaaaaaaaacgcaaaagaaaattttattcaaggagaattatatatgaaaaatttttctaaattaaagggtgtaaaaaaaacgtctagtggtcttctatatcttttagaaagagctggagaaggagaagcattaaaagacgagacgaaaatcactgttcattataaaggtacactaattaatggtttggaatttgataattcttacaaaagaggtagacctgtatctctaagattaaaagatgttatcttaggctggaaagaaggattaaaatatataaagaaaggcggtaaaataaaattagtaatacctcccaacttggcatatggaacagaagaagttaatggtattccagcaaattctactctcatctttgatatagaactattagatgtagttaatggagtatag

SEQ ID NO: 10914 - protein, 241 aa, Buchnera aphidicola subsp
MILYVPKSFSISAPISDIHLQSVLETKNTFHNNNEKLGYILGLSFGNYVNQTFEKQKKIGIELDRNSLLKGIQDAISGNLKLSHQDISSGLKELEKKLKHATKIQLKKNAKENFIQGELYMKNFSKLKGVKKTSSGLLYLLERAGEGEALKDETKITVHYKGTLINGLEFDNSYKRGRPVSLRLKDVILGWKEGLKYIKKGGKIKLVIPPNLAYGTEEVNGIPANSTLIFDIELLDVVNGV

SEQ ID NO: 10915 - DNA, 759 bp, Buchnera aphidicola subsp
  CDS (1)..(759): transl_table=11
atgattgtttttttattaaaaagaattttattattatatttaattttttttgttccgaaatctttttcagaaaacctacctttttttaaaattaaatcttattcagagaagaaagaattttttcaaaatgataacgaaaaagtaggatactctttaggagtatctttaggtaattatgtaaatgaatcttttgaaagacaaaaaaaaatgggaataaacttagacaaatataatattttgttaggagtacaagacgctatttcaggtaatttaaaattatcaaatgaagaaatttcaacaattcttcaaaaattagaaaaaaatttgaagaatgcagcaaaaattgaatttgaaaaaagtgaaaaagaaaacttaattcaaggaaaattatatatgaaaaaattttctgaaatgaaaggagtaagtaaaacctctagcggtcttttatatattattgataaattaggtgaaggtgaagagataaaaacaaaaaatgcagaaattacagttcattataaaggatcactaatcaatggtacagaatttgacagttcttataaacgaggaaagcctataacattaatgttaaaagatgttatattaggttggcaagaaggtttaaagtatattaaaaaaggtggtaaaattaaattaatcatacctcctaatttagggtacggaagcaatagaattaatgaaataccagcaaattctattttaatttttgatatagaattattagatatcaaaaatatttaa

SEQ ID NO: 10916 - protein, 252 aa, Buchnera aphidicola subsp
MIVFLLKRILLLYLIFFVPKSFSENLPFFKIKSYSEKKEFFQNDNEKVGYSLGVSLGNYVNESFERQKKMGINLDKYNILLGVQDAISGNLKLSNEEISTILQKLEKNLKNAAKIEFEKSEKENLIQGKLYMKKFSEMKGVSKTSSGLLYIIDKLGEGEEIKTKNAEITVHYKGSLINGTEFDSSYKRGKPITLMLKDVILGWQEGLKYIKKGGKIKLIIPPNLGYGSNRINEIPANSILIFDIELLDIKNI

SEQ ID NO: 10917 - DNA, 756 bp, Buchnera aphidicola subsp
  CDS (1)..(756): transl_table=11
atgattttgttgaaaattatacacataatttttgtaatgatttttctatcaatattttttccaaaatctttatatgctagtacatctttgattcgaaaagatcatattattcaaaagaatcttgaaaattttgatgatcaatcagcttatgcgttgggagtatcattaggaaattacattaatcattcttttcgtgagcagaagcgattaggagtgattttagataaaaatagtttattatcaggaataagagactctctttcaggaaagactatattatctgaccaagaaatttcaatggaattaataaaattagaaaaaaaattaaaatattttgaagatatagttttaaagaaggaagcacataataataaaattcaaggagatttatatattaaaaaaatgctaaagaaaaaagatgcgagacacacgtcttcgggtttagttttttttattaagaaaaaaggaagtggtaaatttttgcatgatagtgatgttatcacagttcattataaaggatcattgattaatggtaatgagtttgataattcttacaagcgaggtcaacctttatctttttctttagatagcgttattccaggttggatagaaggtttaaaatatataaaaaaaggtggtttaataaaattagtaataccaccgaaattagcatatggggaaactggagtacctggaattccaggaaattcgactttaatatttgaaatagaattaatagacatacaatctaagtaa

SEQ ID NO: 10918 - protein, 251 aa, Buchnera aphidicola subsp
MILLKIIHIIFVMIFLSIFFPKSLYASTSLIRKDHIIQKNLENFDDQSAYALGVSLGNYINHSFREQKRLGVILDKNSLLSGIRDSLSGKTILSDQEISMELIKLEKKLKYFEDIVLKKEAHNNKIQGDLYIKKMLKKKDARHTSSGLVFFIKKKGSGKFLHDSDVITVHYKGSLINGNEFDNSYKRGQPLSFSLDSVIPGWIEGLKYIKKGGLIKLVIPPKLAYGETGVPGIPGNSTLIFEIELIDIQSK

SEQ ID NO: 10919 - DNA, 621 bp, Escherichia coli
  CDS (1)..(621): transl_table=11
atgaccaccccaacttttgacaccatcgaagcgcaagcaagctacggcattggtttgcaggtagggcaacaactgagtgaatctggcctggaagggctgctgccagaagcactggttgcaggtattgccgatgcgctggaaggcaaacatccggctgttccggttgatgtggtgcatcgcgcgctgcgtgaaatccacgagcgcgccgatgccgttcgtcgtcagcgtttccaggcgatggctgctgaaggtgtgaaatacctggaagaaaacgccaaaaaagaaggtgtgaatagcaccgaatctggcctgcaattccgcgtgatcaaccagggtgaaggcgcaattccggcacgtaccgaccgcgttcgtgttcattacaccggtaaactgatcgacggcaccgtgtttgacagctccgttgctcgtggtgaacccgctgaattcccggttaatggcgtgatccctggctggattgaagcactgactctgatgccggtaggttctaaatgggaactgactatcccgcaggaactggcatatggcgagcgcggcgcaggcgcatccatccctccgttcagcaccctggtgtttgaagtcgaactgctggaaatcctctaa

SEQ ID NO: 10920 - protein, 206 aa, Escherichia coli
MTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 10921 - DNA, 726 bp, Haemophilus influenzae
  CDS (1)..(726): transl_table=11
atgttaaaaattcaaaaattatctattgcagcattaatggtaagtgcggtgatttctggccaagtttttgcagaagataacacattcgatgaaaaagcggcatcttatgcagtaggtacgctcatgggcagtcaaatgaaagatcttgttgattcccacaaagaagtcattaaatatgataatgcgcgtattttagatggcttaaaagatgctttagaaggcaaagtggatgttcgtaaagatgaaaaaatccaaaaaaccttagaatctattgaagcaaaattagtggctgcatcaaaagcaaaagcagaatcgattgctaaacaagcaaaagaagaaggcgataaattccgtgctgaatttgctaaagggaaagatgtaaaaacgacgcaatctggtttaatgtataaaattgaaagtgcaggtaaaggcgatacaatcaaatcaacggataccgttaaagtacattacacgggtaaattaccaaatggaaaagtatttgatagctctgtcgagcgcggacaacctgtagaattccaacttgatcaagtaattaaaggctggactgaaggtcttcaattagtgaaaaaaggcggaaaaattcaattcgttattgcacctgaattaggctatggcgaacaaggtgctggtgcatctattccaccaaattcaacattaatttttgatgtggaagtattggacgtcaatccgaaatctgaaaaataa

SEQ ID NO: 10922 - protein, 241 aa, Haemophilus influenzae
MLKIQKLSIAALMVSAVISGQVFAEDNTFDEKAASYAVGTLMGSQMKDLVDSHKEVIKYDNARILDGLKDALEGKVDVRKDEKIQKTLESIEAKLVAASKAKAESIAKQAKEEGDKFRAEFAKGKDVKTTQSGLMYKIESAGKGDTIKSTDTVKVHYTGKLPNGKVFDSSVERGQPVEFQLDQVIKGWTEGLQLVKKGGKIQFVIAPELGYGEQGAGASIPPNSTLIFDVEVLDVNPKSEK

SEQ ID NO: 10923 - DNA, 693 bp, Coxiella burnetii
  CDS (1)..(693): transl_table=11
atgaaacgattgattttacctttcttaagtgtgggcttacttttggggacgacggcgcacgcggctactcccttaaaaacagaacaagataaattgagctattccatgggcgttatgactggaaaagctttcagaaagcatgacataaagatcgaccctcaaacgttttcaatggggttaagcgatgcttatttaggcaaagaaacccagatgactgaagccgaaatgcgtcaaaccctgcaacaattcgaaaaacaatccctgcaaaaaatgcaacacaaaatgaaacaaacagctcaacagaatgccgaaaaaagccgcgcttttttaacggctaataaaaataaaccgggtgtgaaaaccttagcgaatggtctgcaatacaaagtcttgcaggcgggccagggacaaagccccaccttgaacgatgaagtcaccgttaattacgaagggcgtttgataaatgggaccgtgtttgacagttcctacaaacggggtcaaccggcgacgttccccctaaaaagtgttattaaaggttggcaagaagctttaacacgtatgaagccgggggcaatatgggaaatttacgtgccgccacaattggcctatggtgaacaaggcgcaccgggcgttattggaccgaatgaagctttaatttttaaagtaaatttaatttctgtaaaaaagaaataa

SEQ ID NO: 10924 - protein, 230 aa, Coxiella burnetii
MKRLILPFLSVGLLLGTTAHAATPLKTEQDKLSYSMGVMTGKAFRKHDIKIDPQTFSMGLSDAYLGKETQMTEAEMRQTLQQFEKQSLQKMQHKMKQTAQQNAEKSRAFLTANKNKPGVKTLANGLQYKVLQAGQGQSPTLNDEVTVNYEGRLINGTVFDSSYKRGQPATFPLKSVIKGWQEALTRMKPGAIWEIYVPPQLAYGEQGAPGVIGPNEALIFKVNLISVKKK

SEQ ID NO: 10925 - DNA, 702 bp, Legionella longbeachae
  CDS (1)..(702): transl_table=11
atgaagatgaaattggtcactgcggccattatgggtttggcaatgtctacagcaatggctgcaactgatgctacatcgcttactacggacaaagataaattatcttatagtattggtgctgatttaggaaaaaactttaaaaatcaaggcattgacattaacccagacgtattagctaaaggaatgcaagatgggatgtctggtgctcaattgattttgactgaagaacaaatgaaagacgttcttagtaaatttcagaaagatctgatggctaagcgtagtgctgagtttaataaaaaagcagaagaaaacaaagcaaaaggtgacgctttcttatctgctaataagtcaaaacctgggatagtagttttaccaagtggtttgcagtataagattattgatgccggcactggcgcaaaaccaggtaaatcagatactgtaactgttgaatatactggtaccttgattgatggtactgtatttgatagtactgaaaaagcaggcaaaccagctacattccaagtttcgcaagtaatccctggttggacagaagcattacaattaatgcctgctggttctacatgggaagtttttgttcctgcagatttagcttatggcccacgtagcgtaggtggtccaataggtccaaatgaaactttgattttcaaaattcatttgatttctgtaaaaaaagcagcctaa

SEQ ID NO: 10926 - protein, 233 aa, Legionella longbeachae
MKMKLVTAAIMGLAMSTAMAATDATSLTTDKDKLSYSIGADLGKNFKNQGIDINPDVLAKGMQDGMSGAQLILTEEQMKDVLSKFQKDLMAKRSAEFNKKAEENKAKGDAFLSANKSKPGIVVLPSGLQYKIIDAGTGAKPGKSDTVTVEYTGTLIDGTVFDSTEKAGKPATFQVSQVIPGWTEALQLMPAGSTWEVFVPADLAYGPRSVGGPIGPNETLIFKIHLISVKKAA

SEQ ID NO: 10927 - DNA, 702 bp, Legionella pneumophila subsp
  CDS (1)..(702): transl_table=11
atgaagatgaaattggtgactgcagctgttatggggcttgcaatgtcaacagcaatggctgcaaccgatgccacatcattagctacagacaaggataagttgtcttatagcattggtgccgatttggggaagaattttaaaaatcaaggcatagatgttaatccggaagcaatggctaaaggcatgcaagacgctatgagtggcgctcaattggctttaaccgaacagcaaatgaaagacgttcttaacaagtttcagaaagatttgatggctaagcgtactgctgaattcaataagaaagcggatgaaaataaagtaaaaggggaagcctttttaactgaaaacaaaaacaagccaggcgttgttgtattgccaagtggtttgcaatacaaagtaatcaattctggaaatggtgttaaacccggaaaatcggatacagtcactgtcgaatatactggtcgtctgattgatggtaccgtttttgacagtaccgaaaaaactggtaagccagcaacgttccaggtttcacaagttatccctggatggacagaagctttgcaattgatgccagctggatcaacttgggaaatttatgttccctcaggtcttgcatatggcccacgtagcgttggcggacctattggcccaaatgaaactttaatatttaaaattcacttaatttcagtgaaaaaatcatcttaa

SEQ ID NO: 10928 - protein, 233 aa, Legionella pneumophila subsp
MKMKLVTAAVMGLAMSTAMAATDATSLATDKDKLSYSIGADLGKNFKNQGIDVNPEAMAKGMQDAMSGAQLALTEQQMKDVLNKFQKDLMAKRTAEFNKKADENKVKGEAFLTENKNKPGVVVLPSGLQYKVINSGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSS

SEQ ID NO: 10929 - DNA, 26 bp, Artificial sequence
  primer
atgaaatcactgtttaaagtaacgct

SEQ ID NO: 10930 - DNA, 25 bp, Artificial sequence
  primer
ttattttttagcagaatctgcggct

SEQ ID NO: 10931 - protein, 252 aa, Artificial sequence
  consensus sequence
  Variant (2)..(2): Xaa in position 2 is any amino acid
  Variant (3)..(3): Xaa in position 3 is any or no amino acid
  Variant (5)..(7): Xaa in position 5 to 7 is any amino acid
  Variant (8)..(18): Xaa in position 8 to 18 is any or no amino acid
  Variant (20)..(33): Xaa in position 20 to 33 is any amino acid
  Variant (34)..(53): Xaa in position 34 to 53 is any or no amino acid
  Variant (55)..(93): Xaa in position 55 to 93 is any amino acid
  Variant (94)..(117): Xaa in position 94 to 117 is any or no amino acid
  Variant (119)..(127): Xaa in position 119 to 127 is any amino acid
  Variant (128)..(129): Xaa in position 128 to 129 is any or no amino acid
  Variant (131)..(131): Xaa in position 131 is any amino acid
  Variant (132)..(139): Xaa in position 132 to 139 is any or no amino acid
  Variant (141)..(144): Xaa in position 141 to 144 is any amino acid
  Variant (148)..(148): Xaa in position 148 is any amino acid
  Variant (150)..(154): Xaa in position 150 to 154 is any amino acid
  Variant (156)..(156): Xaa in position 156 is any amino acid
  Variant (157)..(157): Xaa in position 157 is any or no amino acid
  Variant (159)..(166): Xaa in position 159 to 166 is any amino acid
  Variant (167)..(167): Xaa in position 167 is any or no amino acid
  Variant (169)..(169): Xaa in position 169 is any amino acid
  Variant (171)..(171): Xaa in position 171 is any amino acid
  Variant (173)..(173): Xaa in position 173 is any amino acid
  Variant (175)..(175): Xaa in position 175 is any amino acid
  Variant (177)..(178): Xaa in position 177 to 178 is any amino acid
  Variant (179)..(179): Xaa in position 179 is any or no amino acid
  Variant (181)..(182): Xaa in position 181 to 182 is any amino acid
  Variant (186)..(187): Xaa in position 186 to 187 is any amino acid
  Variant (188)..(189): Xaa in position 188 to 189 is any or no amino acid
  Variant (191)..(191): Xaa in position 191 is any amino acid
  Variant (193)..(194): Xaa in position 193 to 194 is any amino acid
  Variant (196)..(199): Xaa in position 196 to 199 is any amino acid
  Variant (202)..(202): Xaa in position 202 is any amino acid
  Variant (205)..(205): Xaa in position 205 is any amino acid
  Variant (207)..(207): Xaa in position 207 is any amino acid
  Variant (209)..(210): Xaa in position 209 to 210 is any amino acid
  Variant (212)..(213): Xaa in position 212 to 213 is any amino acid
  Variant (215)..(221): Xaa in position 215 to 221 is any amino acid
  Variant (223)..(224): Xaa in position 223 to 224 is any amino acid
  Variant (229)..(232): Xaa in position 229 to 232 is any amino acid
  Variant (233)..(239): Xaa in position 233 to 239 is any or no amino acid
  Variant (241)..(245): Xaa in position 241 to 245 is any amino acid
  Variant (247)..(247): Xaa in position 247 is any amino acid
  Variant (249)..(251): Xaa in position 249 to 251 is any amino acid
YXXGXXXXXXXXXXXXXXGXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXGXXXXXXXXXXXGXXXXXXXXXVXXXXSGLXYXXXXXGXXGXXXXXXXXXVXVXYXGXLXXXGXXFDSXXXXGXPXXFXXXXVIXGWXEXLXXMXXGXXXXXXXPXXLAYGXXXXXXXXXXXIXXXXXLXFXXXL

SEQ ID NO: 10932 - protein, 32 aa, Artificial sequence
  protein pattern
  Variant (2)..(4): Xaa in position 2 to 4 is any or no amino acid
  Variant (6)..(6): Xaa in position 6 is any amino acid
  Variant (9)..(9): Xaa in position 9 is any amino acid
  Variant (11)..(11): Xaa in position 11 is any amino acid
  Variant (12)..(12): Xaa in position 12 is Leu or Val
  Variant (13)..(14): Xaa in position 13 to 14 is any amino acid
  Variant (15)..(15): Xaa in position 15 is Ile, Met or Val
  Variant (16)..(17): Xaa in position 16 to 17 is any amino acid
  Variant (19)..(19): Xaa in position 19 is Ala, Asp, Glu, Gly, Gln, Ser or Thr
  Variant (20)..(22): Xaa in position 20 to 22 is any amino acid
  Variant (23)..(23): Xaa in position 23 is Phe, Ile, Leu or Val
  Variant (24)..(24): Xaa in position 24 is any amino acid
  Variant (25)..(25): Xaa in position 25 is Ile or Val
  Variant (27)..(28): Xaa in position 27 to 28 is any amino acid
VXXXIXGWXEXXXXXXXGXXXXXXXPXXLAYG

SEQ ID NO: 10933 - protein, 17 aa, Artificial sequence
  protein pattern
  Variant (2)..(2): Xaa in position 2 is any or no amino acid
  Variant (4)..(6): Xaa in position 4 to 6 is any amino acid
  Variant (7)..(7): Xaa in position 7 is any or no amino acid
  Variant (9)..(9): Xaa in position 9 is Ile or Val
  Variant (11)..(11): Xaa in position 11 is Asp, Glu or Lys
  Variant (12)..(12): Xaa in position 12 is Ile, Leu or Val
  Variant (13)..(13): Xaa in position 13 is any amino acid
  Variant (15)..(16): Xaa in position 15 to 16 is any amino acid
  Variant (17)..(17): Xaa in position 17 is Ile or Val
IXPXXXXLXFXXXLXXX

SEQ ID NO: 10934 - DNA, 939 bp, Saccharomyces cerevisiae
  CDS (1)..(939)
atgaatataatgaaaagacaattatgcacctcctctaagcgatttttttctacagcaaaaaacgttgtcaaatataatacgattcaggatatcaggaacaaatattttactggtacgcctttgtcgatgtgtactgcgtatgacttcattactgcaacatgggttaacaaggctaattgtgatttactcttagtcggagattctttggcgatgacttcattggggtacgatagcacaattacactatccttgaatgagtttaaatatcatgttgcctctgtgtgcagagctgaaggttcttccatggtagtggtagacatgccattcggtacgtttgaatcgggcatatctgatggcttgaagaatgccatagatatcatgaaattggacagtaaagtcacctcagtcaaagttgaagtcggttcttacaccaaagacaaatatgcaatgaaatttattgaagaactgtgctcccggggtatacctgttatggctcatataggactaactccccaaaaagttcattcacttggaggttataaagtgcaaggtagcaaaagtctattacaaatgcaggagctgtatgaaaccgccatgcaactacaaaaaattggctgttggtctatcctgattgaatgtgtcccccataagatggctcagttcataacatctaaactctcagtaccaacaataggtatcggtgcaggtaacggtaccagtggacaagttctagttatatctgaccttctcgggatgcaaggcgattctgtcccaaaatttgtgaagcaagctgtaaatatgacagatattgccactcagggcttgaaggagtacattgcaagtgtagaggataggacatttcctgagagaggtactcatactttcaaagttaaggaggacttatggaatgaattcctctcttcaattaacgaaaagtaa

SEQ ID NO: 10935 - protein, 312 aa, Saccharomyces cerevisiae
MNIMKRQLCTSSKRFFSTAKNVVKYNTIQDIRNKYFTGTPLSMCTAYDFITATWVNKANCDLLLVGDSLAMTSLGYDSTITLSLNEFKYHVASVCRAEGSSMVVVDMPFGTFESGISDGLKNAIDIMKLDSKVTSVKVEVGSYTKDKYAMKFIEELCSRGIPVMAHIGLTPQKVHSLGGYKVQGSKSLLQMQELYETAMQLQKIGCWSILIECVPHKMAQFITSKLSVPTIGIGAGNGTSGQVLVISDLLGMQGDSVPKFVKQAVNMTDIATQGLKEYIASVEDRTFPERGTHTFKVKEDLWNEFLSSINEK

SEQ ID NO: 10936 - DNA, 1014 bp, Coprinopsis cinerea okayama7#130
  CDS (1)..(1014)
atgtcgacgactacgacgactctccggatggcctacggtctcaaccgtgtctcgcgagctggcctccagctgagactaacccccgctcgacgatggatgagcgtccgaccgccctcccccgacgcacaaacgacgacgacgaagacaccgacaaccccagcatcgcgtaaaaaagtgacgatccaaacgctccactcgctccggcaatccaagacgccgataacaatggtgacggcctacgactaccccaccgccctcgcctgctcctcctcgcctctcaccgacatcaccctcgtcggcgactccctcgcccaggtatgcctcggctactcgtccacgacccagctctccctcgacgagatgatccaccacgcacgcgccgtgtcgcgcgggaacaagcaccccctactcgtcgcggacatgccgttcgggtcgtaccaggtttcggtagaggatgcgattaggaacgcagtccggttggtccgcgaagctggggtggaggctgtgaagctcgagggagggcaggagattgtggaggtcgtccggaggttgacggaagtgggtattccggtgatggcgcatgtcggtttgcttccgcagaggcacgcgtcgttgtctgggtatcgagtgcaggggaggagtattgaaggtgcgaagaggcttttggaggacgcgttggccttgcaggacgctggtgcgttctctatggtggttgaagccgttccgagagaattgggaacgtacatcacggagcgcttgaacgtgcctacgattggtattggtgctgggccgggaacgagtggacaggttctcgtcattgacgatattatgggcacctggtccggccacaaagccaagttcgtccgtcgattcgccaatctgaaggcagtccgcgacaatggtatccagcaatactgcgaagcagtgcggaacggctccttccctgatccagagagcgagagctacaccatggatcctgccctctgggaacagttcctcgcgtctcaaaagtaa

SEQ ID NO: 10937 - protein, 337 aa, Coprinopsis cinerea okayama7#130
MSTTTTTLRMAYGLNRVSRAGLQLRLTPARRWMSVRPPSPDAQTTTTKTPTTPASRKKVTIQTLHSLRQSKTPITMVTAYDYPTALACSSSPLTDITLVGDSLAQVCLGYSSTTQLSLDEMIHHARAVSRGNKHPLLVADMPFGSYQVSVEDAIRNAVRLVREAGVEAVKLEGGQEIVEVVRRLTEVGIPVMAHVGLLPQRHASLSGYRVQGRSIEGAKRLLEDALALQDAGAFSMVVEAVPRELGTYITERLNVPTIGIGAGPGTSGQVLVIDDIMGTWSGHKAKFVRRFANLKAVRDNGIQQYCEAVRNGSFPDPESESYTMDPALWEQFLASQK

SEQ ID NO: 10938 - DNA, 1005 bp, Coprinopsis cinerea okayama7#130
  CDS (1)..(1005)
atgtttcgcctgccattcaccaccaacgctgcctcacgagctgcccttcggcaaggaccatggtctgcccaaggtgcccgacgctgcatgagcgtccgaccacaagaactttcctctctcaccccgccaccacgcaaaaaggtcaccatccagaccctccactcgatgcgcaaggcaaacaagccaataaccatggtcacagcctacgactaccccactggtcaagccgcctcctcatccccgctcatcgatatgatcctcgtcggcgactccctttcacaagtctgcctcggctttggctcgaccacccaactcaccctcgaagccatgatccatcacgccagcgccgtggcccgtggcgctacccaccccttccgggtcgtcgacatgccttttgggtcgtaccacgtctctgcggaagaaaccatccgaaacgctacccggctagtacgagagggtggtgcagaggcggtcaagatggaaggagggaaagagctcgcagagatcgttcaccgtttgaccgagcttggtatacccgtcatggcacatatcggtttgacgccccagcgccagtcagcattgtctgggttcaaggtgcagggaaagtccgtcgaaggagccagcaaggtgctttcagacgcactagccttgcaggacgccggagcattcgcgatggtagtggaagcagtacctcgcgagctgggaaaacacatcaccgacaaggtgaaggtccctaccatcggaattggtgctggccctggaacaagtggacaggtgatcgtcctcgaagatcttgtgggcacctgggatggccataagcccaagtttgttcgtcggttcgcaaacgtgaaggaggtccgcgatattggcatccacaaatttggtgaagcagtacgaggcggttcattccctcatccagaagaggagagctacaccatggacccgcaactctggcaacagtttatgcagtcacagggcgacaataatctagcactatctgtataa

SEQ ID NO: 10939 - protein, 334 aa, Coprinopsis cinerea okayama7#130
MFRLPFTTNAASRAALRQGPWSAQGARRCMSVRPQELSSLTPPPRKKVTIQTLHSMRKANKPITMVTAYDYPTGQAASSSPLIDMILVGDSLSQVCLGFGSTTQLTLEAMIHHASAVARGATHPFRVVDMPFGSYHVSAEETIRNATRLVREGGAEAVKMEGGKELAEIVHRLTELGIPVMAHIGLTPQRQSALSGFKVQGKSVEGASKVLSDALALQDAGAFAMVVEAVPRELGKHITDKVKVPTIGIGAGPGTSGQVIVLEDLVGTWDGHKPKFVRRFANVKEVRDIGIHKFGEAVRGGSFPHPEEESYTMDPQLWQQFMQSQGDNNLALSV

SEQ ID NO: 10940 - DNA, 870 bp, Clavibacter michiganensis subsp. sepedonicus
  CDS (1)..(870): transl_table=11
atgcagagccccgacgctgccgtcaccccgcccgaacccgcccgcctctcgaccgagcccgccggtccgcccaagcgggtgcggatccggcacttcgcccgggccaaggagcagggcatcaggatcaccgggctcaccagctacgacatgctcaccgccggcgtcttcgacgaggccggcatcgacttcctgctcgtcggcgactcggccggcaacaccgtgctcggctacgacacgaccgtgcccgtcacggtggacgagctgatcccgctcgcgcgcgccgtcgcgtcgtctgccgcccgggccctcgtggtcgccgacctgccgttcggctcctacgagtccgggccggaccaggcgctcgccacctcggtgcgcttcatgaaggaggcccgcgcccacgccgtgaagctcgagggcggcgtgcggagcgccgagcagatccggcgcgtcgtctcgtcgggaatcccggtgatggggcacatcgggttcacgccgcagagcgagcacgggctcggcggccacatcatccagggacgcggcgacgccgccgaggcgcttctggccgacgcgcacgccgtcgaggacgcgggcgccttcgccgtggtgctcgagatggtgcccgagcaggtcgcgcggcgcgtgaccgaggagctgcgcatccccaccatcgggatcggcgcggggaacggcaccgacggccagatcctcgtgtggaccgacttcgccgggctcacctcgggccgcgtgccgcgcttcgtccgtcgctacgcggacatgcgcgccgtgctgctggacgcggcgacccgctaccgcgatgacgtcctgtccggcgacttcccctcagcggcggagagctactccgactga

SEQ ID NO: 10941 - protein, 289 aa, Clavibacter michiganensis subsp. sepedonicus
MQSPDAAVTPPEPARLSTEPAGPPKRVRIRHFARAKEQGIRITGLTSYDMLTAGVFDEAGIDFLLVGDSAGNTVLGYDTTVPVTVDELIPLARAVASSAARALVVADLPFGSYESGPDQALATSVRFMKEARAHAVKLEGGVRSAEQIRRVVSSGIPVMGHIGFTPQSEHGLGGHIIQGRGDAAEALLADAHAVEDAGAFAVVLEMVPEQVARRVTEELRIPTIGIGAGNGTDGQILVWTDFAGLTSGRVPRFVRRYADMRAVLLDAATRYRDDVLSGDFPSAAESYSD

SEQ ID NO: 10942 - DNA, 789 bp, Synechococcus sp. PCC 7002
  CDS (1)..(789): transl_table=11
atgcgggttacaccgagaacactacaaaactataaaaaaacggcacgacccatcgtgaccctgacggcctgggactatgcgatcgcccgcttagttgatcaagccggggtcgatgtcatcctggtgggggactccctcgcgatggtggccctcggctatgaaaatacgctgcctgtgaccctagaggcgatgattcaccatacccaggccgtttgtcggggggttaaaaatgccctcgtggtcagtgatcttccttttttaacctaccaagaaagcctctcccaggcgatccatacggcgggtcgaattctcaaggaaaccaccgcccaggcgatcaaactggaagggggacacccagcgatggccgaaacggtggaacgtctcactcgcttaggggtaccggtgatgggtcatgtgggtctcactccccaatcggtgcataccctgggttatcggcaacagggcaatacggaactagaagcgacacgggtgatccaagaggcgatcgccctcgaacaggccggggcctttgcggtggtcttagaacatattccagcgaccctggcacagacgattaccgaaaaactgacaattccgaccattggcatcggcgcgggacgccattgtgatgggcaagtgctggtaacggcggatcttttgggcctcagtgaaaaagcgcccccctttgccaaacaatatttagacttagacaatctgattaccaacgcagtccaacgctatagcgatgatgttcgtacgcagcagtttccgccccatctgggctcctag

SEQ ID NO: 10943 - protein, 262 aa, Synechococcus sp. PCC 7002
MRVTPRTLQNYKKTARPIVTLTAWDYAIARLVDQAGVDVILVGDSLAMVALGYENTLPVTLEAMIHHTQAVCRGVKNALVVSDLPFLTYQESLSQAIHTAGRILKETTAQAIKLEGGHPAMAETVERLTRLGVPVMGHVGLTPQSVHTLGYRQQGNTELEATRVIQEAIALEQAGAFAVVLEHIPATLAQTITEKLTIPTIGIGAGRHCDGQVLVTADLLGLSEKAPPFAKQYLDLDNLITNAVQRYSDDVRTQQFPPHLGS

SEQ ID NO: 10944 - DNA, 813 bp, Thermotoga sp. RQ2
  CDS (1)..(813): transl_table=11
gtgaacgtcgagaagctcaagaagatgaaaggtaaggaaaagatcgtgatggtcaccgcgtacgatgctcccagcgccagaatcgcgagagatgccggcatagatgtcattctcgttggagactcccttggaaacaacgttctcgggtacgaaaacacgattcccgtaactatggaagaaatgctgatacacgtggcagccgtgaaaaggggagccccagacgctttcatagtagcagacatgcctttcctttcctaccagacttccgtggaaaaagctgtggagaacgctgggaagttcttgaaggtcggtgcgaatgccgtgaaaatagagggtggagaggaattcggtgagctcgttcaaaaactggtcgaaagcggtattccggtgatgggccacataggcctcacacctcagttcgtgaaccgtttcggtggttacagagtccaaggaaagacggaaaaaaacagagaatacctcttgaggagcgccagggagcttgaaaagaggggggcttttgctatcgttctggagctcgttgttgaggaagtcgctaaggagatcaccgaaagcgtctccattccaaccattggcatcggttcaggccgtttctgtgatggtcaggttctcgtctggcacgaccttctcggtctgaatccggacttcgcacctcgcttttccaagaaatacgcaaacctgtacgaagtcatattgaaagctttgcaagagttcagaagagaggtaaaagagggtctgttccccaccgaagaacattcattcacagataaatccaaaggaggtgtgtcttcatga

SEQ ID NO: 10945 - protein, 270 aa, Thermotoga sp. RQ2
MNVEKLKKMKGKEKIVMVTAYDAPSARIARDAGIDVILVGDSLGNNVLGYENTIPVTMEEMLIHVAAVKRGAPDAFIVADMPFLSYQTSVEKAVENAGKFLKVGANAVKIEGGEEFGELVQKLVESGIPVMGHIGLTPQFVNRFGGYRVQGKTEKNREYLLRSARELEKRGAFAIVLELVVEEVAKEITESVSIPTIGIGSGRFCDGQVLVWHDLLGLNPDFAPRFSKKYANLYEVILKALQEFRREVKEGLFPTEEHSFTDKSKGGVSS

SEQ ID NO: 10946 - DNA, 801 bp, Cyanothece sp. ATCC 51142
  CDS (1)..(801): transl_table=11
ttggcagattttgggaatatcatgggactaacaacgcaacaattgattacctggaaacaacaaggccgtcctattgtggcgttaacagcttgggatttcgcttttgctcaattattagacgcagccggtattgatattattttggtgggtgattcgttggccatggttgctttagggtacgaaaccactttaccccttaccctcgatgccatgtcacaccatgcggccgccgttcgtcgaggcgttaaacgggctttagtggtgtgtgatttaccctttcttagttatcaagaaagcatcagtcaagcgattcatgctgcaggacgggttttaaaagaaacaggggtacaagccgttaaactcgaagggggacaccctacagccatcgaaaccgttgcccgtttaagtgatattggtattcctgtgatgggtcatgtggggttaacgcctcagtcggtgcatcgtttggggtatcgtcaacaaggaaccactgaaagcgaggctgaacgtattttatcagaagcgatcgctttatcagaggcgggggcgtttgctgtggttttagaacatattccagctaaccttgctagaataatcacggcaaagttaccgattccaactattggcattggtgcagggtctgattgtgatggacaggtattagtaacggcagatttattaggattatctgaaaaacagcctccttttgctaaaacttatctcaatttaagagacattgttactaaagcagttagtgatttttctcaagatgttcgagacaaaaagtttcctgagaattaa

SEQ ID NO: 10947 - protein, 266 aa, Cyanothece sp. ATCC 51142
MADFGNIMGLTTQQLITWKQQGRPIVALTAWDFAFAQLLDAAGIDIILVGDSLAMVALGYETTLPLTLDAMSHHAAAVRRGVKRALVVCDLPFLSYQESISQAIHAAGRVLKETGVQAVKLEGGHPTAIETVARLSDIGIPVMGHVGLTPQSVHRLGYRQQGTTESEAERILSEAIALSEAGAFAVVLEHIPANLARIITAKLPIPTIGIGAGSDCDGQVLVTADLLGLSEKQPPFAKTYLNLRDIVTKAVSDFSQDVRDKKFPEN

SEQ ID NO: 10948 - DNA, 840 bp, Exiguobacterium sibiricum 255-15
  CDS (1)..(840): transl_table=11
atgcatacgatgacacctttactaaaaaaacaacaggcgggcgaaaaactcgtcatgctcacagcgtacgattatccgtccgcaaaattagcggaagccggacacgtcgatttgctgctggtcggggattcgctcgggaatgtcattctcggatatgattcgacgattgccgtgacagtagacgatatggtccatcacgcaaaagctgtccgtcgcggagcaccggcaacctttatggtcgttgacatgccgtttgccagctatcacggttcgtttgaccggacgcttgaggcggcagcccgtatcttccaggaaagcggagcagacgccttgaaactcgaaggggccggagacatcctgacaacgattcgtcgtctgacggaggccggtatgccttgtgttgcccacttggggctgacaccacaatctgtcggagtgctcgaaggatttaaagttcaggggaaatcgcttgcagcagcggaacagttgattgccgacagtttggccgcagaacaagcgggagcgaagatgcttgttcttgagtgtgtaccgcatccgctggcgaaacgtgttcaggaactcttaacgattccggtaatcggaattggggcaggtgccgatgttgccggacaagtattggtctaccatgatatcttgacgtacggtgtcggacggttgccaaaattcgttaaagcatatgccgactggaacacatccggtacggaagcgatcgcccgttacgtcgaagacgtcaaaaacgggacgttccctgaactcgcccactcgttcctgatggatgaagaactgatcggggcgttatatggaggatttaaagaatga

SEQ ID NO: 10949 - protein, 279 aa, Exiguobacterium sibiricum 255-15
MHTMTPLLKKQQAGEKLVMLTAYDYPSAKLAEAGHVDLLLVGDSLGNVILGYDSTIAVTVDDMVHHAKAVRRGAPATFMVVDMPFASYHGSFDRTLEAAARIFQESGADALKLEGAGDILTTIRRLTEAGMPCVAHLGLTPQSVGVLEGFKVQGKSLAAAEQLIADSLAAEQAGAKMLVLECVPHPLAKRVQELLTIPVIGIGAGADVAGQVLVYHDILTYGVGRLPKFVKAYADWNTSGTEAIARYVEDVKNGTFPELAHSFLMDEELIGALYGGFKE

SEQ ID NO: 10950 - DNA, 1044 bp, Arabidopsis thaliana
  CDS (1)..(1044)
atggcgtcctcactcactaggaattgctctcgcttctcaaaagccatctctgtccgtttcatgagtaacctaccggaaaacaccgtctacggaggaccaaagccacaaaacccaaaccaaagagtgacgctaacgcatctcagacaaaaacaccggagaggagaaccgatcaccgtcgtaactgcctacgattacccatccgccgttcatttagacacagctggtatcgatgtttgtcttgtcggtgactcagcttccatggttgttcatggtcacgacacaacacttcctatctccttagacgagatgcttgttcattgtcgtgccgttgctcgaggcgctaaacgacctctcctagttggtgacttgccatttggtacctacgagtcaagctctagtcaggcggttgatactgcggttagggttttgaaggaaggaggaatggatgcgattaagctcgaaggaggatcagcttctaggatcactgctgcaaaagctatagttgaagcaggaattgcggttattggtcatgtgggtctaacccctcaggcgattagcgttcttggtggtttcagaccccaaggcagaaacatagctagtgctgttaaagttgttgagactgcaatggctttacaagaagctggatgtttttcggttgttttggaatgcgttccacctcctgtagctgctgctgcaacttctgccctcaagataccaaccattggcattggggctggacctttctgcagtggacaggtgctagtttaccatgatcttcttggtatgatgcaacatccacatcatgccaaggttactccaaagttttgcaagcagtacgctaatgtcggagaagtgattaacaaagccctaatggaatacaaagaagaagtctctaaaaaagtgtttccaggtccttctcacagtccttacaagatcacagcaagtgagctcgatgggttcttaaccgagttgcagaagcttggttttgacaaggctgcttctgcagcagctttagcagctgagaacatggagccttcaaagtga

SEQ ID NO: 10951 - protein, 347 aa, Arabidopsis thaliana
MASSLTRNCSRFSKAISVRFMSNLPENTVYGGPKPQNPNQRVTLTHLRQKHRRGEPITVVTAYDYPSAVHLDTAGIDVCLVGDSASMVVHGHDTTLPISLDEMLVHCRAVARGAKRPLLVGDLPFGTYESSSSQAVDTAVRVLKEGGMDAIKLEGGSASRITAAKAIVEAGIAVIGHVGLTPQAISVLGGFRPQGRNIASAVKVVETAMALQEAGCFSVVLECVPPPVAAAATSALKIPTIGIGAGPFCSGQVLVYHDLLGMMQHPHHAKVTPKFCKQYANVGEVINKALMEYKEEVSKKVFPGPSHSPYKITASELDGFLTELQKLGFDKAASAAALAAENMEPSK

SEQ ID NO: 10952 - DNA, 882 bp, Deinococcus radiodurans R1
  CDS (1)..(882): transl_table=11
atgcagcccgaatccgcgtctcctcaattggcgtctccggcccgcgtcaaacgcagcctgcccgacctgacccatcctgaactcacatcctctggcgcgccgctggtgatggtgaccgcctacgactatccgggcgcgcgccacgccgaggccgccggggtggacctgattctggtgggcgacagcctgggcaacgtggtgctgggctacgactccaccgcgccggtcacgcttgccgacatgattcaccacggcaaggccgtgcggcggggagcaccgaacacctttctggtggtggacctgccgttcggcacctaccacgcaggcgtgaccgacgcgatgcggcacgccgtgcgggtcattcaggagacgggcgccgacgccgtgaagatggaaggctccacccccgaggtgctcgacgtcgtgcgggtgctctcgcgcaacggcgtgccggtgatggggcacgtggggctgatgccgcagaccgccgccgcccagggaggcctgcgcgtgcagggcaaggacgacgacagcgcccgccgcaccctggaaggcgcagtcgcgttgcaggaagcaggggccttcgcggtggtcctcgaagccattcccgcccggctcgctcgcctgatttccgagcggctgagcgtcgccaccatcggcatcggcgcaggcgttcattgcgacgggcaggtactcgtctatcacgacctgctggggctctacgaaggcgaggaaaagaaaattgccaagcgctacgccgacctggggcgcgaggcccgtgaagccatcgctcactacgccgccgaggtccgcgcccgcgagtttcccagcaaggacaacagcttcgtgatgaaggacgaggtgctcgacaagctgtattga

SEQ ID NO: 10953 - protein, 293 aa, Deinococcus radiodurans R1
MQPESASPQLASPARVKRSLPDLTHPELTSSGAPLVMVTAYDYPGARHAEAAGVDLILVGDSLGNVVLGYDSTAPVTLADMIHHGKAVRRGAPNTFLVVDLPFGTYHAGVTDAMRHAVRVIQETGADAVKMEGSTPEVLDVVRVLSRNGVPVMGHVGLMPQTAAAQGGLRVQGKDDDSARRTLEGAVALQEAGAFAVVLEAIPARLARLISERLSVATIGIGAGVHCDGQVLVYHDLLGLYEGEEKKIAKRYADLGREAREAIAHYAAEVRAREFPSKDNSFVMKDEVLDKLY

SEQ ID NO: 10954 - DNA, 801 bp, Yersinia pestis CO92
  CDS (1)..(801): transl_table=11
gtgatgaaaaccaccaccatgagccaattacgccaatggaaacaagagaaacgtaaattcgcaacgctgacggcctatgatgccagttttgcccagttatttgccgaacagggtattcaggtgctattggtgggggattcgctcggtatgacgttacaagggttcgattccacgctgccagtgaccgttgccgatatggcctaccatacccgtgcagtgcgccgtggtgcgcctcattgcctgttattggccgatatgccattcatgagttatgccacgccagaactggcctttacccacgcggcagagctaatgcgggccggagccaatatggtcaaactggaaggtgggagctggctgtgcgataccattcgcatgttggcagagcgcgcggtgccggtttgtgggcatctggggctcacgccacaatcggtgaatattttcggcggctataaagtacagggtcgtgaagaagtggcggccaatcaactgttgcaagatgctattgccctggaacaggcaggggctcaactgttggtactggaatgcgtgccggtagaactggcacagcgggtgaccgaagagttaaccataccggttattggtattggtgcggggaatgtcactgacggtcagattttggttatgcatgatgcactcggtattaccgggggtcatacgccaaaattcagtaaaaactttttagcacacagtgcgggcgatattcgtgccgccattaagctctatattgaagaagttgagggggggatttatcctgctgaagagcatacattccagtaa

SEQ ID NO: 10955 - protein, 266 aa, Yersinia pestis CO92
MMKTTTMSQLRQWKQEKRKFATLTAYDASFAQLFAEQGIQVLLVGDSLGMTLQGFDSTLPVTVADMAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 10956 - DNA, 798 bp, Thermosynechococcus elongatus BP-1
  CDS (1)..(798): transl_table=11
gtgtatggaatgatggtgcgtcgctctgtaaccttaccccaactccaagcaaaaaaagcgctgggagaacccattaccatgctcacggcttgggattatctgtgggcacgcctgttggatgcggccggggtggatgtgatccttgtgggggattccctggggatggttgcccttggatatccaaccacattgcctgtgacccttgaccagatgattcaccatgcccaagcggtgcgccgaggcgttagccatagtttccttgtgtgtgatctgccctttttgagctaccaagaaagccctgaacaggctctgagatcggcggggcgcttaatcaaagaggcagaagtgcaagccgtgaaaatggaaggtgcctcccctgtggtccaggcagcaacgcggcgcttagtggaggctggaattccagtgctgggtcatgtgggtctattgccccaacgggtacatcagttgggaggatggcgacaacaggggaatactccccaagacgcagcagcgattctagcgggtgcccttgcccttgctgaagcaggtgtctttgcggtgattttggagcatattcctgcggccttagcgcagcagattaccgcccagttgaagattcccacaattggaattggcgcaggcccccactgtgatggtcaggtactggtgacagcagatgttttgggcttgagtccccaggtgcccccctttgctaaggtgtatgccgacttgggaacacaggcgatcgccgccattgaaaattactgccaagccgtcaaatcgcggcaatttccctga

SEQ ID NO: 10957 - protein, 265 aa, Thermosynechococcus elongatus BP-1
MYGMMVRRSVTLPQLQAKKALGEPITMLTAWDYLWARLLDAAGVDVILVGDSLGMVALGYPTTLPVTLDQMIHHAQAVRRGVSHSFLVCDLPFLSYQESPEQALRSAGRLIKEAEVQAVKMEGASPVVQAATRRLVEAGIPVLGHVGLLPQRVHQLGGWRQQGNTPQDAAAILAGALALAEAGVFAVILEHIPAALAQQITAQLKIPTIGIGAGPHCDGQVLVTADVLGLSPQVPPFAKVYADLGTQAIAAIENYCQAVKSRQFP

SEQ ID NO: 10958 - DNA, 831 bp, Corynebacterium efficiens YS-314
  CDS (1)..(831): transl_table=11
gtggcctctatactcatcgtcatgtctggcattgatgcaaagaagatccgcacccgtcacatccatgaggcgaaggcgaatgggacgaagatttccgtcctcaccagttatgacgcgatgaccgccgccatctttgatgaggcggggatcgatatgctgctggtcggtgattccgccgccaatgtggtgctggggcgggagaccaccctgtcgatcaccctggatgagatgatcgtgctggccaaggcggtcaccatcgcggctaaacgtgcgctggtcattgtggatctgcccttcggcacctatgaggtcagtgagcagcaggcggtggaatccgccgtgcgcgtcatgcgggagaccggcgccgcggccgtcaagatcgagggtggtgtggagatggcctccaccatccggcgcattgtcgacgccggcattcccgtctgcgggcacatcggtttcaccccgcagtccgagcatgccctcggcggacccgtggtccagggccgcggcagcggtgcggacaagctgcttgccgacgcccacgccgtccaggccgccggtgccttcgccgtggtcctggagatggtccccgccgagatcgccaccgaggtgaccaaccagctcgacatcgccaccatcggcatcggcgcaggtaacggcaccgatggccaggtgctcgtgtggcaggatgccttcgggttcaaccggggccgcaagccgcgtttcgtccgtgagtacgccaccttaggcgatcagctgctcgaggccgcccgcgcctacgccgatgaggtgggctccggcgcgttccccggcgaggtggagagctactga

SEQ ID NO: 10959 - protein, 276 aa, Corynebacterium efficiens YS-314
MASILIVMSGIDAKKIRTRHIHEAKANGTKISVLTSYDAMTAAIFDEAGIDMLLVGDSAANVVLGRETTLSITLDEMIVLAKAVTIAAKRALVIVDLPFGTYEVSEQQAVESAVRVMRETGAAAVKIEGGVEMASTIRRIVDAGIPVCGHIGFTPQSEHALGGPVVQGRGSGADKLLADAHAVQAAGAFAVVLEMVPAEIATEVTNQLDIATIGIGAGNGTDGQVLVWQDAFGFNRGRKPRFVREYATLGDQLLEAARAYADEVGSGAFPGEVESY

SEQ ID NO: 10960 - DNA, 897 bp, Bradyrhizobium japonicum USDA 110
  CDS (1)..(897): transl_table=11
atgcggagcggattcaatatgagccacagttcagagcagcctctagagcgtgtcacgattccggcactgcagcagtggaaggataaaggacggcgtgtcgtgatgaccaccgcctacgatgcggttgcggcgcgcatcgcggatcccattgtcgatatcatcctggtcggcgatagcgttggaaacgtctgcctgggattcgacaacacgctgcccgtcagcgtggccatgatgaatcatcacctggaggctgttgcgcgcacgaggcctcatgccttgcttgtggccgacatgccctttctcagctttcatgtcggttctgaggatacgattcgcaatgcaggaggttttttacagcgtggcgccgatgctgtgaaactcgagggtggtgccaaacgcatcgagatggtacgcgccttggtcgattgcgacattcctgtgatgggacatctcggtctgaccccgcagagcgtcaacgtcatgggtggattcaaagtgcagggaaggacaacagataccgccttgcggttgctcgatgacgcgcaccgtctgcaggaagccggttgcttcgcgcttgtcctggagggcattcctgccgagctcgcggcgcgagcgaccgaatctctcacgatacccaccatcgggatcggagcaggagccgattgctcgggccaagtgctcgtgtttcatgatgtcttggggctaaccgaaggccatcgccccaaattcgttcgtgcctatacaaatggattccagttgttccaggaggcgctgtcgcgctgggctgccgatatccgcaaaggggcgttcccgggctcagaggagtgctatcggcttcctgatcagcttcggcatgccgtcgccaactgggtgccctccagttcaacctcaaggtaa

SEQ ID NO: 10961 - protein, 298 aa, Bradyrhizobium japonicum USDA 110
MRSGFNMSHSSEQPLERVTIPALQQWKDKGRRVVMTTAYDAVAARIADPIVDIILVGDSVGNVCLGFDNTLPVSVAMMNHHLEAVARTRPHALLVADMPFLSFHVGSEDTIRNAGGFLQRGADAVKLEGGAKRIEMVRALVDCDIPVMGHLGLTPQSVNVMGGFKVQGRTTDTALRLLDDAHRLQEAGCFALVLEGIPAELAARATESLTIPTIGIGAGADCSGQVLVFHDVLGLTEGHRPKFVRAYTNGFQLFQEALSRWAADIRKGAFPGSEECYRLPDQLRHAVANWVPSSSTSR

SEQ ID NO: 10962 - DNA, 789 bp, Gloeobacter violaceus PCC 7421
  CDS (1)..(789): transl_table=11
gtgggcatggggttatccatccacagtctcagaaagctcaaagagcgcgcccaaccgattgtcgcccttaccgccaccgagtacgcgatggcccgcattctcgatcaagcgggggtcgatctgctgctggtgggcgactcgctttcgatggtcgccctgggccatacgagcaccctgccggtgacagtggacgagttgttgcaccactgccgggcagtgcgccggggggtcgagcgcgctttgctggtagccgatttgcccttcggttcctacgagcagagcccccagcaagctttttccaccgcgacccgatttctcaaagaagcgggagtgcaggcggtcaagctcgaaggcggttacccgcgcatgaccgagacggtcgcttttttgaccgaaagcggcatcccggtgctcgggcatctcggcctcaccccccaggcggttcaccagttggggggctaccgcgtccagggcaagaccgcccaggcggccgaacggctcatcgatcaggctctcgccctggagggggcgggggcgttcgcgctcgtgctggagcacattccctacgatctggcgggggaaattagcggcaaactggtcatcccgactgtcggcatcggcgccggtccgcactgcaacggccagatcctcgtcacccacgatctattgggccttactgagaatccgccgccttttgtaaatccttacgccgacttgcgcgcgcttatcagcaaagcggtcggccgctacagtgcggatgtgcgcgcccatggctcccgtgaggagtga

SEQ ID NO: 10963 - protein, 262 aa, Gloeobacter violaceus PCC 7421
MGMGLSIHSLRKLKERAQPIVALTATEYAMARILDQAGVDLLLVGDSLSMVALGHTSTLPVTVDELLHHCRAVRRGVERALLVADLPFGSYEQSPQQAFSTATRFLKEAGVQAVKLEGGYPRMTETVAFLTESGIPVLGHLGLTPQAVHQLGGYRVQGKTAQAAERLIDQALALEGAGAFALVLEHIPYDLAGEISGKLVIPTVGIGAGPHCNGQILVTHDLLGLTENPPPFVNPYADLRALISKAVGRYSADVRAHGSREE

SEQ ID NO: 10964 - DNA, 1065 bp, Arabidopsis thaliana
  CDS (1)..(1065)
atggctgcttcgctcgtcaggagttgttgctctcgtgcttcgagagccatcaccaccgtccggtttatgagcaacgtaccggaggacacggtttacggaggaccgaaaccgcagaactcgaatcagagagtgactttgacgcaattgagacagaagcatcggaaaggtgagccgataactatggtcaccgcctacgattacccttctgccgttcacatcgatacagctggaatcgatgtttgtctcgtcggagattcagctgccatggttgtccatggctatgacaccactcttcctatctccttagaggagatgcttgttcactgtcgcgccgttgctcgcggagccaaaagaccacttcttgtcggcgatttgccgtttggtacttatgaatctagcaccaatcaggcggttgatactgcagttagggtgttgaaagaaggaggaatggatgctattaaacttgaaggaggatcaccttcaaggatcactgctgcaaaatccattgtggaagcagggattgccgttatgggacatgttgggttgactcctcaagctatcagtgttcttggtggtttcaggccacagggcaaaaacattgctagtgctgttaaggttgtggaaactgctatggctttgcaagaagctggatgtttttcggttgttttagaatgtgttccacctcctgtggctgctgctgcaacctctgctcttaatattccaaccattggcataggagctggccctttctgcagtggtcaggttttagtctaccatgatcttctgggaatgatgcagcatccacatcacgctaaggttactccaaagttttgcaaacagtacgctcaagtaggagaagtgatcaacaaagccctcttggagtataaggaagaagtatccaaacacttgtttccaggtccttctcacagcccttacaagatctcctcaagcgacctggacggattcttaagcgagttacagaaattgggattagataaagctgcttctgatgcagcagcatcagctgaaaagatggatcattcagattcaccatcttctcagtga

SEQ ID NO: 10965 - protein, 354 aa, Arabidopsis thaliana
MAASLVRSCCSRASRAITTVRFMSNVPEDTVYGGPKPQNSNQRVTLTQLRQKHRKGEPITMVTAYDYPSAVHIDTAGIDVCLVGDSAAMVVHGYDTTLPISLEEMLVHCRAVARGAKRPLLVGDLPFGTYESSTNQAVDTAVRVLKEGGMDAIKLEGGSPSRITAAKSIVEAGIAVMGHVGLTPQAISVLGGFRPQGKNIASAVKVVETAMALQEAGCFSVVLECVPPPVAAAATSALNIPTIGIGAGPFCSGQVLVYHDLLGMMQHPHHAKVTPKFCKQYAQVGEVINKALLEYKEEVSKHLFPGPSHSPYKISSSDLDGFLSELQKLGLDKAASDAAASAEKMDHSDSPSSQ

SEQ ID NO: 10966 - DNA, 1326 bp, Chlamydomonas reinhardtii
  CDS (1)..(1326)
atgggccccgccggaggcctgggcgccgcctcagcccccgcgcccggcggcggcggctttcaggcggcgttaggcgccgccaaccgcctccgtcagccctccgccatcatcccatccgccacacgcggccccggcgccgcaggcgccgggtcgccgccgccgcccttcgccccatcgacagcggctgcggcagcgcctgccccggcaccagcgcctgcagccgccgctggcgccgcaacggccacagcggctgcggtgcggcagcaggcggtgcggcagctgtcagtacagccggaggcgaccgtgtacgcggggccgtcgccgcgcaacccggcgcgtgtgacgctgcgcaccattcgcaagaagtatgagcagggcgagcagctgaccatggtgacggcgtacgactacccctccgccgtgcacgtggacgctgccggcatcgacctgctgctggtgggcgacagtgtggccatggtggtgcacggccacgacaccacactgcccatcacgctggaggagatgctggtgcactgcaaggcggcggcgaggggggcgcggagggcattcctggtgggtgacctgccgtttggctgctacgagacggacgtgcgggacgcggtgcgcagtgcggtgcgcatgctcaaggagggaggcatggatgcggtgaagctggagggcggcagtcccgcccgggtggaggcggcccgtgccatcgtggagacaggcgtggcggtgatggggcacgtgggcctcacgccccagtccgtcagcgtcattggcggcttccgcccccaggcgcaggtggcggaggaggctctgcgtgtgttggaccaggcgcaggcgctgcagcgggccggctgcttcgcactggtgctggagtgtattcccgggcccatcgccgccgccatcacgcgctccctcaccatccccaccattggcatcggggccggcggcgagtgcagcggccaggtgctggtgtaccacgacctacttggcatgatgagccacccgcaccacgccaaggtgacgcccaagttctgtaagcagtacgccaaggtgggcgagaccatcagcgccgcgctgcagcagtaccggcaggaggtggaggagcgggcgttcccggggccgcgcttctcgccctactccatctccagctccgaggtccactcgctggcagaggcgctgcgcaagcgcggtatgggtggcgcggcgcaggcggtggaggaggaggcgcaccgggcggcggaggccaaggcgcagctggcggcggcagcggcggcggcgggtggcggcgggccagctggcagcaaagcacccaagtga

SEQ ID NO: 10967 - protein, 441 aa, Chlamydomonas reinhardtii
MGPAGGLGAASAPAPGGGGFQAALGAANRLRQPSAIIPSATRGPGAAGAGSPPPPFAPSTAAAAAPAPAPAPAAAAGAATATAAAVRQQAVRQLSVQPEATVYAGPSPRNPARVTLRTIRKKYEQGEQLTMVTAYDYPSAVHVDAAGIDLLLVGDSVAMVVHGHDTTLPITLEEMLVHCKAAARGARRAFLVGDLPFGCYETDVRDAVRSAVRMLKEGGMDAVKLEGGSPARVEAARAIVETGVAVMGHVGLTPQSVSVIGGFRPQAQVAEEALRVLDQAQALQRAGCFALVLECIPGPIAAAITRSLTIPTIGIGAGGECSGQVLVYHDLLGMMSHPHHAKVTPKFCKQYAKVGETISAALQQYRQEVEERAFPGPRFSPYSISSSEVHSLAEALRKRGMGGAAQAVEEEAHRAAEAKAQLAAAAAAAGGGGPAGSKAPK

SEQ ID NO: 10968 - DNA, 1080 bp, Physcomitrella patens subsp. patens
  CDS (1)..(1080)
atgtggaggaattcgaggaatttgagggacatttacagcaagttgtcgagatgcgtggaaaggcggtccatgagcaacctgcctgagagcacggtatatggaggccccaagtccaagtcgccgtggaaaagggtgacgttgcggcaccttgaagccaagtatcaaacgaatcagcccatcacgatggtaactgcgtatgattatccctccggggcgcatgtggatcgagcaggcatagacatatgtctggtaggggactcagtgggtatggttgtgcatgggcatgacacaacgctgccagtcacaatggaggacatgctgctgcattgcaaggcggtagcaaggggcgcagatcgacctcttctggttggagatttgccatttgggagctatgagcagagcacacagcaggcagtagcaagtgcgacacggatgctcaaggagggtggaatggatgcagtaaagatggagggaggtggaggatctcgcgttcaagcagcgaaagcaatctctgaggcaggcattgcggtcatgggtcatgtgggcctcactccacaggccataagtgtcttgggcggttttcgtcctcaaggccgcaatgttgatagtgcgcttcaggttttggaccatgctttggctttgcaatccgctggctgcttttcgatcgtgctcgagtgcgttccatctcctattgcggcagctgttacatccgcacttaaaattcccaccattgggattggtgctggccctttctgtagtggccaggtcttggtgtaccatgatcttctcggtatgatgcaacacccccatttcgtgcaggtcacaccgaaattctcgaagcagtacgcaagtctagggaacgtgatcaatgatgccctttcgcagtttcgggacgaggtgatatcgaaggcttttccgtcacctgtgcacacgccctaccgaattggcgaggaacaacagcaagcatttgcggaggcactcgagaaacgagggcttcatggggcagcagaagcagtatcagctgccgccgttaaggatgcgactgctggggaaccgactatcaaaactcccttagattga

SEQ ID NO: 10969 - protein, 359 aa, Physcomitrella patens subsp. patens
MWRNSRNLRDIYSKLSRCVERRSMSNLPESTVYGGPKSKSPWKRVTLRHLEAKYQTNQPITMVTAYDYPSGAHVDRAGIDICLVGDSVGMVVHGHDTTLPVTMEDMLLHCKAVARGADRPLLVGDLPFGSYEQSTQQAVASATRMLKEGGMDAVKMEGGGGSRVQAAKAISEAGIAVMGHVGLTPQAISVLGGFRPQGRNVDSALQVLDHALALQSAGCFSIVLECVPSPIAAAVTSALKIPTIGIGAGPFCSGQVLVYHDLLGMMQHPHFVQVTPKFSKQYASLGNVINDALSQFRDEVISKAFPSPVHTPYRIGEEQQQAFAEALEKRGLHGAAEAVSAAAVKDATAGEPTIKTPLD

SEQ ID NO: 10970 - DNA, 1122 bp, Magnaporthe grisea 70-15
  CDS (1)..(1122)
atgcaccctcccgcagccacaacggccctggcccggtcgtgtgcctcagtggcttccacattggtcaggggtcgcgcgatcaacttgcccaggacacaacagccatgccgcactttgagcagcatcgcagtctcgccggcaaggccttcaaaccacccagaccaggtgtctactgcagcctcgcagaaaccacaacaacagcaacaatgcagacatagctcgcattccccaatgggcgcacctattgccaaccagcgcaagaaggtaaccctcggcaccctgcgttccctctacaaaaaaggggaaccaatcactgtcatgacggcgcatgactttcccagcgcccatgtcgccgatgctgccggcatggacatcatcctcgtgggcgacagcctggccatggttgccctgggtatggaggataccagcgaggtcgtgttggacgagatgttgctgcactgccgttcggtcgcaagggccacaaaatccgcattcactattggcgaccttcctatgggctcctatgaggtctcacccgaacaggcccttcagacagctattcgcttcgttaaggaaggccgggtgcagggcattaagatcgaaggcggccgagagatggcaccgacgatccgcaaaatcaccggtgctggcattcccgtcctgggccacattggcctgaccccccaacgccaacactcgctgggtgggttccgagtccaaggcaaaacatctgctgctgcccaatccctcctgcaagatgccctcgcagttcaggaagccgggtgctttgcaacagtcgtcgaagctgtccccgctgaggtttctgcccttttaaccaagaagctgtccatacctacgattggtatcggcgcgggcaatggctgttccggacaggttctggtgcagattgatatgacggggaacttcccacccggtcgcttcctacccaagttcgtcaagaagtacggagatgtttggggagagtcgatgagggcgatcgaggcttatcgggatgaggttaagagcagagcctatcctggccctgagcatacgtatccgatgccgagcgaagagctggctgcgttcaaagccgtgatcgagggcgagaagagcttggaatag

SEQ ID NO: 10971 - protein, 373 aa, Magnaporthe grisea 70-15
MHPPAATTALARSCASVASTLVRGRAINLPRTQQPCRTLSSIAVSPARPSNHPDQVSTAASQKPQQQQQCRHSSHSPMGAPIANQRKKVTLGTLRSLYKKGEPITVMTAHDFPSAHVADAAGMDIILVGDSLAMVALGMEDTSEVVLDEMLLHCRSVARATKSAFTIGDLPMGSYEVSPEQALQTAIRFVKEGRVQGIKIEGGREMAPTIRKITGAGIPVLGHIGLTPQRQHSLGGFRVQGKTSAAAQSLLQDALAVQEAGCFATVVEAVPAEVSALLTKKLSIPTIGIGAGNGCSGQVLVQIDMTGNFPPGRFLPKFVKKYGDVWGESMRAIEAYRDEVKSRAYPGPEHTYPMPSEELAAFKAVIEGEKSLE

SEQ ID NO: 10972 - DNA, 1404 bp, Gibberella zeae PH-1
  CDS (1)..(1404)
atgtcatcccttatcaatcctaccatgaggtcttgcacctctttcctatcccggatgcccgtgtcgtcctatcggccggcgatccggtccctcggcagctccgttcggcccctcatcatccgaggtgtggcgcagtcccggtatagttcacactctcccatgggtgcgcctccggctgcccagcgcaagaaggtcactgtcggaacccttcgctccatgcaccgcaagggtgatcccatcactgtcatgacagctcatgatttccccagtggtcatgttgccgatcatgcaggcatggacatcattcttgtcggtgatagtcttgccatggttgcccttggtatggaagacacaagtgaagttatcatggaggagatgctgctgcactgccggtcggttgcgagagccactaaatccgctttcactgtcggcgacctgcccatgggtacatatgagataagccctgaccaggctcttgcgactgccatccgttttatcaaggaaggtcgtgttcaaggtgtcaagcttgagggtggaaaggagatggctcccaccatcaagaaaatcaccactgctggtattcccgttcttggccatatcggtttgacccctcagcgacagaacgctcttggtggcttccgcgtccagggcaagacaagtagcggtgctatgagcatcctcgaggatgcccttgctcttcaagaagctggctgctttgctatggttgttgaagctgttcctgccgaggtggccgcgctcatcaccgagaagctctctgttcccacgatcggtattggtgctggtaacggtacctctggtcaagtccttgtgcaggtcgacatgattggaaacttccctcctggaagattcctccccaagtttgtcaagaagtacggtgatgtctggggcgagagtttgagagccatcgaggcgtatcgcgacgatgtcaaatcccgtcagtaccctggccccgagcacacgtacccaatttcagcagaggaactcgagagttttaccaaggcgatagaagaaattgacctcgttggcctcatccaaaagcaggtgttagagagtaagcaacaacaagttgaccgtacactgtccgtctctttacacctcaacttcttcctcaagtatctcacaacctcttcaaaacgtctcgtggcactgatcttgcatacatcttgggccaacaacggcgcagacccgacgggtttaaatcgcaccacgatcttgtcggtcttgaaacttcctgcggcttcgagcgcggccgttgcatctcttggtaggtcggccagtactactgacgccgacatgattcaaggcttttctgttttccagtttggtggaaatatgtttgttggtgagagttacgtcttcatcatgactcctcaagctttttaa

SEQ ID NO: 10973 - protein, 467 aa, Gibberella zeae PH-1
MSSLINPTMRSCTSFLSRMPVSSYRPAIRSLGSSVRPLIIRGVAQSRYSSHSPMGAPPAAQRKKVTVGTLRSMHRKGDPITVMTAHDFPSGHVADHAGMDIILVGDSLAMVALGMEDTSEVIMEEMLLHCRSVARATKSAFTVGDLPMGTYEISPDQALATAIRFIKEGRVQGVKLEGGKEMAPTIKKITTAGIPVLGHIGLTPQRQNALGGFRVQGKTSSGAMSILEDALALQEAGCFAMVVEAVPAEVAALITEKLSVPTIGIGAGNGTSGQVLVQVDMIGNFPPGRFLPKFVKKYGDVWGESLRAIEAYRDDVKSRQYPGPEHTYPISAEELESFTKAIEEIDLVGLIQKQVLESKQQQVDRTLSVSLHLNFFLKYLTTSSKRLVALILHTSWANNGADPTGLNRTTILSVLKLPAASSAAVASLGRSASTTDADMIQGFSVFQFGGNMFVGESYVFIMTPQAF

SEQ ID NO: 10974 - DNA, 954 bp, Candida glabrata CBS 138
  CDS (1)..(954)
atgatgatgctaaatagattgaaatgtttgggaaaagggccgttgaggttttattcagttcattcagatacggcaggagctactaagactattttggacttgcagcggaagtatgtggaaaggaaaccacttactatgtgtacagcatatgatttcattactgcaagttgggttcagaaagcggatacagatattcttttgattggtgattccatgggcatgacttccctagggtatgattcaacttcatcgttaactttagatgaatttaaatatcatgtcaaatctgtctgtagagcagaaggtccgtcttttattgtcagtgatatgccattcggaagttttgaaactagcataagccaaggtattcaaacggcaattgatctaatgagatccagcagtaaagtaaaatcaatgaaaattgagtccggttcctgtcatagtgaccatcatacctacaagttaattggcgaactttgttcaagaggtatacctgtgatgggccatataggtttaacaccacagcgacaacactcattgggtggtttcaaagtccaagccaacaagagtgtgcaggaaatacatgatcttttggcatctgcaaagaaattagaagaacttggatgctggggcatcgtattggaatgcatacctcagagagtggctggatttatcacgaaagcattatccataccaacaattggtataggtgctggtaaccagactagtggccaagtccttgttgtatcagatttgttgggcttcctggatagcacaccgccaaaatttgtaaaagaatatgacaacttggggcaacgagcaattgatagcattaaagcatacaactcagacgttactacaaaggctttcccagaaactggaaaacataatttcaaaattaaagaggatatatggaaccaattcttgtcggaagtaaaagttgataaaacataa

SEQ ID NO: 10975 - protein, 317 aa, Candida glabrata CBS 138
MMMLNRLKCLGKGPLRFYSVHSDTAGATKTILDLQRKYVERKPLTMCTAYDFITASWVQKADTDILLIGDSMGMTSLGYDSTSSLTLDEFKYHVKSVCRAEGPSFIVSDMPFGSFETSISQGIQTAIDLMRSSSKVKSMKIESGSCHSDHHTYKLIGELCSRGIPVMGHIGLTPQRQHSLGGFKVQANKSVQEIHDLLASAKKLEELGCWGIVLECIPQRVAGFITKALSIPTIGIGAGNQTSGQVLVVSDLLGFLDSTPPKFVKEYDNLGQRAIDSIKAYNSDVTTKAFPETGKHNFKIKEDIWNQFLSEVKVDKT

SEQ ID NO: 10976 - DNA, 957 bp, Kluyveromyces lactis NRRL Y-1140
  CDS (1)..(957)
atgtggagcaacggtatgattcggtgtataggcaggagatggtactcgctgcagaacagctcggcggttgcagcaaccgccaaagctgttcatcagcttaccgttaaggatattatggcaaaataccatcgtagaaaccccatttcgatggttactgcgtatgactatataacagcaagctgggcacagaatgccaactcagatatgattttagtaggtgactccgtcgctatgtgttctttagggtatgaatcaactactcagctttctcttgacgaatttcaatatcatgttggtgctgtttgtcgcgctccaggtcctgcatttgtcgttgtcgatatgcccttcggatcctttgaaagatcaatttctgatgggatcggtaacgcgttccagttgttacatttgaatcccaaagtgcaagccgtgaaagtagagtgtggattgtctcaagatgattactcgctagaatatatcaaagagttggttagacgtggtatatcagtgatagggcatataggattgactccacaaagagtccattcactaggcgggtacaaggcccagggtggtcaacagagcactgatgctgtggcgttgtacaacgttagtcaaactttgcaacagatcggatgtttcggtattgtattggaatgtattccgcataagatatcttctgtcatcacggacaaattacacattcccaccattggtatcggtgcaggcccagatactagtggccaggtgttggtgcaatctgacgttcttgggatgcttcccggacataaaccgaaatttgttaaaatgttcgcagattttaagaaggacgctgtttctgctttgtctcagtacgttcaagaagttcatgataaatctttcccacatataggccaccacactttcaaagtaaacgatgaagtgtaccaagattttatttctaagatagatactgagtga

SEQ ID NO: 10977 - protein, 318 aa, Kluyveromyces lactis NRRL Y-1140
MWSNGMIRCIGRRWYSLQNSSAVAATAKAVHQLTVKDIMAKYHRRNPISMVTAYDYITASWAQNANSDMILVGDSVAMCSLGYESTTQLSLDEFQYHVGAVCRAPGPAFVVVDMPFGSFERSISDGIGNAFQLLHLNPKVQAVKVECGLSQDDYSLEYIKELVRRGISVIGHIGLTPQRVHSLGGYKAQGGQQSTDAVALYNVSQTLQQIGCFGIVLECIPHKISSVITDKLHIPTIGIGAGPDTSGQVLVQSDVLGMLPGHKPKFVKMFADFKKDAVSALSQYVQEVHDKSFPHIGHHTFKVNDEVYQDFISKIDTE

SEQ ID NO: 10978 - DNA, 963 bp, Debaryomyces hansenii CBS767
  CDS (1)..(963)
atggttctatttagaagtcaaataaggagtatccctcgtttaagatacttcagtaccaagtctataatcaggtcatcgtatcagactgatgttaaacggaagacattactagatatacaacgactctacgagaccaagactcctatatcagtggtgactgcgtacgatttcataacaggtaagtatgcagaaagtgctgatgtagatatcaatttagttggagattcattagctatggttgcgttaggttatgaagatactacagaaatttcattcgacgagttcttataccatacaaaagctgttctcagaggtaataagctgtccttcatggtggcagatataccatttggatctactgaaatatcagttgaacaggcagtttcttcggctataaaattagtgaagtatggaaaagttcaaggtgtaaagattgaaggtggaagtgatatagtgcctactgtcaagaaattgtcctcgataggtattcccgtaatggcccatgttggtttgacaccacaacgccataatgcattgggtggtttcaaagttcaaggaaataatacggagagagctctcgagatctatagagactgtttggacttacaagaagctggggccttttcacttcttctagaatgtatacctaacaaattatctgagtatattactaagaatatatcaataccaacgattggaattggtgccggtccgggttgttcgggccaagttttagttatgtccgatttgcttggaatgggagatccaaaagactcaatgaaacctaaattcgtcaagcaatacaatgacttcttctctagtgctatacattcgctacatgcttacaagagggatttacagcatggaaagtttcctcttgcagacgaccacggctttaaaataaagaaagaggtattccacgatttcaagatgcaggccgaagcaatgaaaaaggctaactaa

SEQ ID NO: 10979 - protein, 320 aa, Debaryomyces hansenii CBS767
MVLFRSQIRSIPRLRYFSTKSIIRSSYQTDVKRKTLLDIQRLYETKTPISVVTAYDFITGKYAESADVDINLVGDSLAMVALGYEDTTEISFDEFLYHTKAVLRGNKLSFMVADIPFGSTEISVEQAVSSAIKLVKYGKVQGVKIEGGSDIVPTVKKLSSIGIPVMAHVGLTPQRHNALGGFKVQGNNTERALEIYRDCLDLQEAGAFSLLLECIPNKLSEYITKNISIPTIGIGAGPGCSGQVLVMSDLLGMGDPKDSMKPKFVKQYNDFFSSAIHSLHAYKRDLQHGKFPLADDHGFKIKKEVFHDFKMQAEAMKKAN

SEQ ID NO: 10980 - DNA, 942 bp, Yarrowia lipolytica CLIB122
  CDS (1)..(942)
atgtctcttttgcgcactctgaggcccgttctgggctcggcccggcctgtcacaccagttttggcccggtcctactcggcccatcactctcctcagacatcagatcaaactcgaaaaaaggtcactattcccgagttggccaagatgcgacgaaacaaggagaagatcagcatggtaacggcccatgattacgtgaccggtctgatcgctgacaaagccggtgttgatatgattctggtcggagactccttggccatggtggctctggggtaccccaacaccaaccaaatcgagctcgaggaaatggtgtatcatgctaaggctgtttctcgaggtgttaagagcgcgtttatggttgcagacctgccttttggttcgtatgaagagtccccagagaaagctatccgatctgctattcagatgatccaaaagggaggaatggaggctgtcaagatggaaggaggcaaggaactggcgcccactatcaagcgactgaccgaggtgggaatccctgttctgggacatatcggactcaccccccagcgtcagtcgtcgttgggaggattcagagtgcagggtaagactgcctctggagcagagagtattctggaagacgcgtatgaactgcagaaggctggatgttttgctattgtgcttgaagcagttcccgacaaggttggagaatggctcagttcgaagctagaggtccctaccatcggtattggtgctggacccggaacctccgggcaggtgctggtcatgctcgatatgctgggaggatttggaagcttcacgcccaagtttctcaaaaagtactcgcagtttcttgatattaatgttggagctgtcaagcagtaccatgaggaggtcaagggtggagtgttccctgcccaggagcattgttataagatgggtgatgaggaagcggctaaactgaaataa

SEQ ID NO: 10981 - protein, 313 aa, Yarrowia lipolytica CLIB122
MSLLRTLRPVLGSARPVTPVLARSYSAHHSPQTSDQTRKKVTIPELAKMRRNKEKISMVTAHDYVTGLIADKAGVDMILVGDSLAMVALGYPNTNQIELEEMVYHAKAVSRGVKSAFMVADLPFGSYEESPEKAIRSAIQMIQKGGMEAVKMEGGKELAPTIKRLTEVGIPVLGHIGLTPQRQSSLGGFRVQGKTASGAESILEDAYELQKAGCFAIVLEAVPDKVGEWLSSKLEVPTIGIGAGPGTSGQVLVMLDMLGGFGSFTPKFLKKYSQFLDINVGAVKQYHEEVKGGVFPAQEHCYKMGDEEAAKLK

SEQ ID NO: 10982 - DNA, 930 bp, Candida albicans SC5314
  CDS (1)..(930): transl_table=12
atgtatagacgagcttttgttgggctgtcacgtctcttttcaacttcttcctatttcagatcttcatacaccagtgcagctagaaagaccattgcggatatacatgagttatacaaaacgggagagtctatctcgatggtcacatcccatgactttattacatcacagatattagaacaagcaaaagttgacataaatcttataggtgactctttggccaacacaactttaggatacgacgacaccaatgagttaacacttgacgaatttttatatcatgtcaaatcagttcagagaggtaactcccattccttgttggttgcagatatgccttttggaagttttgaaagttcgattgaacaggctactacgacagcagtaaaactaatacagaaaggtaaaattcaagctgtgaagatcgaaggaggcaacgaagagattatccctaccatcaagaaaatagtttcagttggtataccagtcatgggtcacgttggattgactccccaaaaacataattcgttaggagggtataaacttcaaggaagaagtgttgatgattccgtcaggatttttcaagaatgccttaatttacaaaatgctggggtgtttgcaattgtgttagagtgtattcctaataaattgtctcagtacataacagataagctttcaattcccacaattggaataggtgctggaccttatacttcgggccaggttttggttatatctgacttgttgggaatgaaagatgggcacgtggctaagtttgttcagcagtataacaatttcttccaacagggtgttgaaggtgtaaaacagtataccaaagatgtcaaatcaaagaagtttccaaatccggatacacatggttataaaatgaagaaagatgtacttgatgagttcaaagaaattgccaaagatttgtag

SEQ ID NO: 10983 - protein, 309 aa, Candida albicans SC5314
MYRRAFVGSSRLFSTSSYFRSSYTSAARKTIADIHELYKTGESISMVTSHDFITSQILEQAKVDINLIGDSLANTTLGYDDTNELTLDEFLYHVKSVQRGNSHSLLVADMPFGSFESSIEQATTTAVKLIQKGKIQAVKIEGGNEEIIPTIKKIVSVGIPVMGHVGLTPQKHNSLGGYKLQGRSVDDSVRIFQECLNLQNAGVFAIVLECIPNKLSQYITDKLSIPTIGIGAGPYTSGQVLVISDLLGMKDGHVAKFVQQYNNFFQQGVEGVKQYTKDVKSKKFPNPDTHGYKMKKDVLDEFKEIAKDL

SEQ ID NO: 10984 - DNA, 831 bp, Herminiimonas arsenicoxydans
  CDS (1)..(831): transl_table=11
atgaccagctatctgcaggaaaatgaaaccgccggacgcaataaggcggtcactgtgccggcattattcgcgctacgcgccaaaggcgaaaaaatcaccatgctgaccgcgtacgacgccagctttgcctcgttgatggatatgtgcggcgtcgaaacactgctggttggcgattcactcggcatggtctgtcaggggcacagctcaaccttgccggtcacgatagaagacatcgcctatcacaccgcctgtgtggcacgcggcaacaagactgcgctgctgttggccgacatgccattcggcagctacgccacacccgaaagtgcatttcaaaacgctgtgaaactgatccaggccggcgcacaaatggtcaagatcgaaggcggcgcctgggtcctcgacaccgtgcgctttttggtcgaacgcgaaattccggtctgcgcacatctgggcctgacaccgcaatcagtgcatcgtttcggcggttacaaggtgcaaggaaaaaccgccgaagcggctcagcaactgaaggacgatgcgctcgcattgcaagctgccggtgcatccctgctgatactggaagcgatcccggccagcctggggaaagaagtcacggatatcctgaccatgcccaccataggcataggcgccggcccggattgttccggtcaggtgttggtgatgcacgatttcatcggtgtcttccccggcaagaaagcgcgcttcgtgaagaacttcatggaaggccagaccagtattgaaggtgcggtacgcgcctatattcgcgaggtcaaggaaggcacttttccggcacccgaacactgcttctga

SEQ ID NO: 10985 - protein, 276 aa, Herminiimonas arsenicoxydans
MTSYLQENETAGRNKAVTVPALFALRAKGEKITMLTAYDASFASLMDMCGVETLLVGDSLGMVCQGHSSTLPVTIEDIAYHTACVARGNKTALLLADMPFGSYATPESAFQNAVKLIQAGAQMVKIEGGAWVLDTVRFLVEREIPVCAHLGLTPQSVHRFGGYKVQGKTAEAAQQLKDDALALQAAGASLLILEAIPASLGKEVTDILTMPTIGIGAGPDCSGQVLVMHDFIGVFPGKKARFVKNFMEGQTSIEGAVRAYIREVKEGTFPAPEHCF

SEQ ID NO: 10986 - DNA, 840 bp, Dehalococcoides sp. BAV1
  CDS (1)..(840): transl_table=11
atgcgtaccactatcagccaacttaaagaaatgaaacaaaacaaacagaagatagccattttgactgcttatgactatcccactgcccaaatactggataaagccggtatcccggccatactggtaggagacagtctgggtatggtagtgctggggtatgattctaccgtaagcgttactatggaagatatgctgcaccatctgaaagccgtagtcaggggcagtcaaaaagccctgattatagcagatatgccatttatgacctaccatctgagtccggaacaggcgctgttaaatgccggtcgttttattcaggagggcggtgctcaggcagtcaagctggagggtggagtaaatgtggctgacaaggttaaaagaatagtagactgcggtatacctgttatggggcatatcggacttaccccccaatctgtaaaccagttaagcggatttaaggtgcaggggaaaactctggcaactgccctatcccttatagaagatgccaaggctctggaaaaagccggggcctttgcaatagtgctggagactatgccggctgaactggcggctattattacagccggtatttccatacctaccataggtataggtgccggagaagaatgtgacgggcaggtacaggtgatatcagatatgctgggtatgtttactgattttatacccaagcacaccaaacggtatgctgatttaaatggcattattacaaaagctgtatctgaatatgccgctgaagtcactaaaggtgcgtttcccactttaaaggagagcttcacccttgataaaaaggtactggaggaactgaaaaagtgcgtattataa

SEQ ID NO: 10987 - protein, 279 aa, Dehalococcoides sp. BAV1
MRTTISQLKEMKQNKQKIAILTAYDYPTAQILDKAGIPAILVGDSLGMVVLGYDSTVSVTMEDMLHHLKAVVRGSQKALIIADMPFMTYHLSPEQALLNAGRFIQEGGAQAVKLEGGVNVADKVKRIVDCGIPVMGHIGLTPQSVNQLSGFKVQGKTLATALSLIEDAKALEKAGAFAIVLETMPAELAAIITAGISIPTIGIGAGEECDGQVQVISDMLGMFTDFIPKHTKRYADLNGIITKAVSEYAAEVTKGAFPTLKESFTLDKKVLEELKKCVL

SEQ ID NO: 10988 - DNA, 819 bp, Synechococcus sp. WH 7803
  CDS (1)..(819): transl_table=11
ttgagagcctcggatctgatccggttcaaacaatccggccgcaccatcacgatgctcacggcctgggatgccctgagcgcttctgtcgttgaagaagccggtgctgacatcgtgctggtgggggactctctggccatggtgagccttgggcacgccaccaccttgcccgtgactcttgagcagatgctgctccacacccaggcggtctgccgtggcttgagcaagcccccctctgagcagccattggtgatcaccgatctgccttttctcagctaccagtgcggtctcgaccgtgccgtggccgctgcaggacacctgctcaagcattcatgcgcaggcggcgtgaaactggaaggcgccgagccggaagtggtgcaggtgatcgagcggctggtgcgcatggggattcctgtgatgggccacctcggactgaccccccaatcggtgcatcaactggggtaccgccgccaggcgaaggatcccgtgagccaggaacggttacggctccaggcttcggaactggagaaggccggttgctttgcaatggttctggagcacgtgcccgaagccctggctggtcacctgcggcgagacctggcgatccctgtgatcggaatcggtgccgggcagaactgcgatggtcaggtgagcgtgaccgctgacctgctgggtctcaccccccggcaaccccccttcagtcctgcccgccttgaggggaggactctgggcattgaggcgcttcggtgctggctggaggaacagcgacagccgggagccgatcccaccactgcacaacctccaccaggatctgattgctga

SEQ ID NO: 10989 - protein, 272 aa, Synechococcus sp. WH 7803
MRASDLIRFKQSGRTITMLTAWDALSASVVEEAGADIVLVGDSLAMVSLGHATTLPVTLEQMLLHTQAVCRGLSKPPSEQPLVITDLPFLSYQCGLDRAVAAAGHLLKHSCAGGVKLEGAEPEVVQVIERLVRMGIPVMGHLGLTPQSVHQLGYRRQAKDPVSQERLRLQASELEKAGCFAMVLEHVPEALAGHLRRDLAIPVIGIGAGQNCDGQVSVTADLLGLTPRQPPFSPARLEGRTLGIEALRCWLEEQRQPGADPTTAQPPPGSDC

SEQ ID NO: 10990 - DNA, 831 bp, Kineococcus radiotolerans SRS30216
  CDS (1)..(831): transl_table=11
atgacctacgccaccgagccgccgccccccgtcccgggccggcgccgcacccgcgtccaccacttccagcagtggaaggacgcgggcgagaagtgggcgatgctcaccagctacgacgcgatgaccgcggccgtcttcgacgaggccggcatcccggcgctgctggtcggggactcggccgccaacaccgtcttcgggatgccgacgacgctgccggtgaccctcgaccacctgctgccgctggtgcgggccgtggtggccggcgcgccgcacgcgttcgtcgtcgccgacctgcccttcgggtcctacgaggtctccgacgacctcgccgtcgcctccgcggtgcgggtcatgaaggagggcggcgcgcacgcggtgaagttcgagggcggggcccggcgggcgggccgggtccgggccgtcgtcgaggcgggcatccccgtcatggcccacatcggcttcaccccgcagtccgagcacgccctcggcggctaccgggtgcagggccgcggcgaggcgggcgagcaggtcctggccgacgcccgggcgctggccgaggccggcgcgttcgcggtgctcatggagatggtccccgccgacgtcgccgcgcaggtcacccgcaccctggccgtgcccaccgtcggcatcggggcgggctccgggaccgacgggcaggtcctggtgtggcaggacttcgcggggctgtccgagcggacggcgaagttcgtcaagcggttcgccgacgtgcgcaccgccctctccgacgcggcgcgccagtacgccgaggaggtccgcggcgggtccttcccggggcccgagcactccttctga

SEQ ID NO: 10991 - protein, 276 aa, Kineococcus radiotolerans SRS30216
MTYATEPPPPVPGRRRTRVHHFQQWKDAGEKWAMLTSYDAMTAAVFDEAGIPALLVGDSAANTVFGMPTTLPVTLDHLLPLVRAVVAGAPHAFVVADLPFGSYEVSDDLAVASAVRVMKEGGAHAVKFEGGARRAGRVRAVVEAGIPVMAHIGFTPQSEHALGGYRVQGRGEAGEQVLADARALAEAGAFAVLMEMVPADVAAQVTRTLAVPTVGIGAGSGTDGQVLVWQDFAGLSERTAKFVKRFADVRTALSDAARQYAEEVRGGSFPGPEHSF

SEQ ID NO: 10992 - DNA, 843 bp, Xanthobacter autotrophicus Py2
  CDS (1)..(843): transl_table=11
atgtccagtcaggccgatgcccgccgcatcacggcgccgcagatccaggcgcgcaaggggggcgagcccatcgtctccctcacctcctaccattcccacacggcacggctgctcgaccgccatgtggacgtgatcctggtgggcgacagcctcggcatggtgatgcacggcatggagaccaccgtgccggtcaccgtggagatgatgatcgtccacggccgcgccgtggtgcgcggcaccaagcgcgccctcatcgtggtggacctgcccttcggcagctacgaggcgagccatacggaagccttccacaccgccgcccgggtgctgaaggagaccggcgccggcgcggtgaagctggagggcggccgccgcatggccgagaccgtgcgcttcctggtggatcgcggcgtgccggtgatgggccatgtgggcctcaccccccaggccatcaacaccctgggctccttcaaggcccgcggccgggacgatgcggaagcctccatcatcctcgatgacgcccgcgccatcgccgaggccggcgctttctccatcgtgctcgaagccatcgccgagccgctggcccgccgcatcacccaggaggtggcgcccccgaccatcggcatcggcggctcgcccgcctgcgacggccagatcctggtgctggaggacatgctgggtcttggcgaccgggtgcccaagttcgtgaagaaatacgccaatctcggccccgacatcgagaaggcggtggcaagctacgccgacgaggtgcgcgcccgcaccttccccgccgccgagcacacctacgccccgcgcctcgtcgagaagccggcgaaagcctcctga

SEQ ID NO: 10993 - protein, 280 aa, Xanthobacter autotrophicus Py2
MSSQADARRITAPQIQARKGGEPIVSLTSYHSHTARLLDRHVDVILVGDSLGMVMHGMETTVPVTVEMMIVHGRAVVRGTKRALIVVDLPFGSYEASHTEAFHTAARVLKETGAGAVKLEGGRRMAETVRFLVDRGVPVMGHVGLTPQAINTLGSFKARGRDDAEASIILDDARAIAEAGAFSIVLEAIAEPLARRITQEVAPPTIGIGGSPACDGQILVLEDMLGLGDRVPKFVKKYANLGPDIEKAVASYADEVRARTFPAAEHTYAPRLVEKPAKAS

SEQ ID NO: 10994 - DNA, 834 bp, Desulfococcus oleovorans Hxd3
  CDS (1)..(834): transl_table=11
atgaaagcactttccgtgtttcgcgattacaaaaaacagggcagaaagatcaccatgctcactgcttatgactatcccaccgcggtactggaagaccgggccggcatcgacattctactggtcggcgacagcgtgggcaggaacatcctcggctatgccagcgaactggaggtgaccatggaggacatgcttcaccatgtccgggccgtggccaggggggcaaaacaggcccatgtgatgggcgacatgccgtatcgctcctgcgacacgccggcccttgccctggaaaacgcccggcgaatgatggatgctggtgcccacagtgtcaagatcgagggtgagcaggacatggtggaccgcatcaagtatgttgtggacgccggcgtgccggtgtgcgcccatatcggatacacgccccagacctcgggcaaggccgcggtccagggcaaggatattgaccgggccaaagccctgatcgacgcggcccttcagcttgaaaaggccggcgccgacatggtggtgtttgagctgattcccgaactgctggcaaaagagatcacaaacctgctttccatacccaccatcggcatcggcgcgggccggttctgcgacggccaggtccaggtctactgcgacatcctcggcctttctgcgcgggtttttcgccatgccaaggcttacgacaccttgggccaacggtacgaagacgcctttgccgcctatgcccgggaggtaaccggcggcacctttcccaccagcgaaaacgccgcggccctgcccgatgacgtagccgaccaggtccgggagtgggtacacaagacctacggcaaatga

SEQ ID NO: 10995 - protein, 277 aa, Desulfococcus oleovorans Hxd3
MKALSVFRDYKKQGRKITMLTAYDYPTAVLEDRAGIDILLVGDSVGRNILGYASELEVTMEDMLHHVRAVARGAKQAHVMGDMPYRSCDTPALALENARRMMDAGAHSVKIEGEQDMVDRIKYVVDAGVPVCAHIGYTPQTSGKAAVQGKDIDRAKALIDAALQLEKAGADMVVFELIPELLAKEITNLLSIPTIGIGAGRFCDGQVQVYCDILGLSARVFRHAKAYDTLGQRYEDAFAAYAREVTGGTFPTSENAAALPDDVADQVREWVHKTYGK

SEQ ID NO: 10996 - DNA, 795 bp, Salmonella enterica subsp. enterica serovar Paratyphi B str. SPB7
  CDS (1)..(795): transl_table=11
atgagcaaacccaccactatctcactgctgcaaaaatgcaaacaggaaaagaagcgcttcgcgacaatcaccgcctacgactatagctttgccaaactgttcgccgatgaaggcatcaacgtgatgctggtgggcgactccctgggcatgacaattcaggggcacgactccaccctgccggtcaccgtggaagatatcgcctaccacacccgcgccgttcgccgtggcgcgccgaactgcctgctgctctccgacctgccgtttatggcttatgccacgccggaacaggcgtttgaaaacgcggccatcgtgatgcgcgccggggccaatatggtcaagatcgaaggcggcacatggctggttgatacggtgaaaatgctcaccgaacgcgccgtgccggtgtgcggccatctggggctgacgccgcagtcggtgaatatcttcggcggctataaaattcaggggcgcggcgacgccgggcaggtgctgctggatgacgcgctggccttagaagcggcgggcgcacagctgctggtgctggaatgcgtgccggttgaactggcgaagcgcgtcacggaagcactgtcgattccggtgatcggcatcggcgcgggcaacgttaccgacgggcagatcctggtaatgcacgacgcgttcggcatcaccggcggccatatccctaaatttgcgaaaaatttccttgccgaaacgggcgacatgcgcgcagctgtacggcagtatatagctgaagtggagtccggcgtttatccgggcgaagaacacagctttcactaa

SEQ ID NO: 10997 - protein, 264 aa, Salmonella enterica subsp. enterica serovar Paratyphi B str. SPB7
MSKPTTISLLQKCKQEKKRFATITAYDYSFAKLFADEGINVMLVGDSLGMTIQGHDSTLPVTVEDIAYHTRAVRRGAPNCLLLSDLPFMAYATPEQAFENAAIVMRAGANMVKIEGGTWLVDTVKMLTERAVPVCGHLGLTPQSVNIFGGYKIQGRGDAGQVLLDDALALEAAGAQLLVLECVPVELAKRVTEALSIPVIGIGAGNVTDGQILVMHDAFGITGGHIPKFAKNFLAETGDMRAAVRQYIAEVESGVYPGEEHSFH

SEQ ID NO: 10998 - DNA, 816 bp, Pseudomonas putida GB-1
  CDS (1)..(816): transl_table=11
atgagcacacacacccgcaacagccgtctcaccgtgccgcaactggtggccatgaaaggccgacagaagatcgtttcgctcaccgcttactcaagctcgatcgcacggctgatcgatccgctggtcgacttcatcctggtcggcgactccaccgccatggtcggctatggccgcccgtccacactgggtatgcgcctggacgaaaccatcgcccatacccgcgccgtggtcgacagcacccgcctggcctgcgtgatcgccgacatgccgttcggcagttatcaggaatcccacgagcaggcgtttcgcaattgtgcccaagtattggccagcaccggctgcgacgcactcaagctggaagcgaaccaggcgttggccagcaccgtcgagttcctggtcgcaagagggataccgatcatggcgcacatcggcctgatgccgcagttcgtcaatgccatgggcggctacaaagcccaggggttgagcccggacagcgctgcagcgttacgggccgacgcgcaagccaacctgcacgctggcgctttcagccttttgctggaaggcgtagccgaacccgtggcccgcgccatcacccaggccaccgacaaacccactgtcggcattggcgcttcccccgcctgcgatggccaggtgctggtcaccgaagacctgctagggctcggtggcgcgcacgtgccacgcttcgtcaagcagtatgccgacctcggcctggcaatccgtgaagcctgcgcccgctacgctgatgaggtgcgcgacggcaccttccctgccatgcaccattgttacggagtgtga

SEQ ID NO: 10999 - protein, 271 aa, Pseudomonas putida GB-1
MSTHTRNSRLTVPQLVAMKGRQKIVSLTAYSSSIARLIDPLVDFILVGDSTAMVGYGRPSTLGMRLDETIAHTRAVVDSTRLACVIADMPFGSYQESHEQAFRNCAQVLASTGCDALKLEANQALASTVEFLVARGIPIMAHIGLMPQFVNAMGGYKAQGLSPDSAAALRADAQANLHAGAFSLLLEGVAEPVARAITQATDKPTVGIGASPACDGQVLVTEDLLGLGGAHVPRFVKQYADLGLAIREACARYADEVRDGTFPAMHHCYGV

SEQ ID NO: 11000 - DNA, 801 bp, Pseudomonas putida GB-1
  CDS (1)..(801): transl_table=11
atgcctgaagtaacccttaccaccctcaatggcctcaaggccaagggtgaaaaaatcaccatgctgacttgctacgacgcgaccttcgccaaggccgccagccaggccggcgttgaagtgttgctggtgggcgactcactggggatggtcctgcagggccacgacagcaccttgccggtaaccacggcagacatggcctaccacaccgcctgcgtcaaacgcggcaacgacggtgcgctgatcctcgccgacctgcctttcatggcgcacgctaccccggagcaggcttttgccaacagcgccacgctgatgcaagccggcgcccacatgatcaagatcgaaggcgcagcctggcttgccgaaaccatccgcctgctggccgagcgtggcgtgccggtgtgcgcacacatgggcctgaccccgcaaaccgtcaatgtgctgggcggctacaaagtgcaaggccgccaggaagcccaggcccggcagatgcgcgccgacgcgattgccctggagcaggccggtgcggccatgctgctgctcgaatgcgtacccagcgaactggcggcggaaatcaccaacgccgtgggtattcccgtaatcggtattggcgcgggcagcgccaccgatggccaggtactggtgctgcacgacatgctcggcttgtcgctgagtggccgggtaccgaagttcgtgaaaaacttcatgcaaggccagccagatatccacagcgccctcgtcgcttatgtcgaggccgtcaagcaagtcagcttcccaggcagcgaacacgggttcagtgcatga

SEQ ID NO: 11001 - protein, 266 aa, Pseudomonas putida GB-1
MPEVTLTTLNGLKAKGEKITMLTCYDATFAKAASQAGVEVLLVGDSLGMVLQGHDSTLPVTTADMAYHTACVKRGNDGALILADLPFMAHATPEQAFANSATLMQAGAHMIKIEGAAWLAETIRLLAERGVPVCAHMGLTPQTVNVLGGYKVQGRQEAQARQMRADAIALEQAGAAMLLLECVPSELAAEITNAVGIPVIGIGAGSATDGQVLVLHDMLGLSLSGRVPKFVKNFMQGQPDIHSALVAYVEAVKQVSFPGSEHGFSA

SEQ ID NO: 11002 - DNA, 879 bp, Mycobacterium abscessus
  CDS (1)..(879): transl_table=11
atgtccgaatctgccttgtatggcgctgcttccgaaaaatcgactgagccgcgtacgcagcctgatgctcttcgcgcaaaacgctcatcgcagacccgtgtgcaccacttgcaaaagtggaaggccgagggccacaagtggtcgatgctcaccgcgtacgactactccaccgcgcgggtattcaacgatgccgggattcccgttctgctggtcggagattcggccgcgaacgtggtctacggatatgacaccaccgtgccgatcaccatcgacgagctgattccgttggtgcgtggcgtggttcgtggcgcgcccgaggcgctggtggtcgccgacctacccttcggttcctatgagggcggcgccgctcaggcgctcgcgagcgccactcggttcatgaaggaagccggcgcccacgccgtgaaactcgaaggcggagaacgggttgccgagcagatcgccacactgaccgccgccggcatcccggtggtggcgcacatcgggttcacgccacagagcgtgaacggccttggcggataccgagtccagggtcgcgacgacgctgccgcacagctcattcacgacgccatcgcggttcaggaggcgggggccatcgccgtggtgatggagatggtgccggcggagctggccacacagatcaccggcaagctcaccatccccaccgtcggcatcggcgcgggccgggagtgcgacgcccaggtgttggtgtggcaggacatggccggaatgaccagcggtaagaccgccaagttcgtcaagcaattcggccaggtcggtgccgagctacgcaaggccgccgagcagtacgccgatgaggtggctcgcggagtgttccccgctcccgagcactcgtactaa

SEQ ID NO: 11003 - protein, 292 aa, Mycobacterium abscessus
MSESALYGAASEKSTEPRTQPDALRAKRSSQTRVHHLQKWKAEGHKWSMLTAYDYSTARVFNDAGIPVLLVGDSAANVVYGYDTTVPITIDELIPLVRGVVRGAPEALVVADLPFGSYEGGAAQALASATRFMKEAGAHAVKLEGGERVAEQIATLTAAGIPVVAHIGFTPQSVNGLGGYRVQGRDDAAAQLIHDAIAVQEAGAIAVVMEMVPAELATQITGKLTIPTVGIGAGRECDAQVLVWQDMAGMTSGKTAKFVKQFGQVGAELRKAAEQYADEVARGVFPAPEHSY

SEQ ID NO: 11004 - DNA, 855 bp, Thermus thermophilus HB27
  CDS (1)..(855): transl_table=11
atgtactcgtccagggtcttgggcctaagggcgaggtcgtccacgctcctccatgatagccttattcccgtgcggcgcacggtgaaggacttccgcaacgccaagggccagcggctcgtctacctcaccgcctacgactaccccacggcccgcctggccgaggcggccggggtggacgccattttggtgggggactccttggggatggtggtcctgggctacccctccacggtgcccgtgaccttggaggagatgctccaccacaccaaggccgcccgcaggggggccccggagacctttctcgtggccgacctcccctacctcgcctacgccaccctggaccgggccctcctcgccgcggagcgcctcctcaaggaggggggggcggacgcggtgaagctggaggggggcgaggaggtggcggagatcgtccggggcctggtgcgggcgggggttccggtcctgggccacgtgggcctcaccccccagacggcgagccagcttggcggctacaagctccaaggccggcgcccggaggaggcggagcgcatcctcaagggggccttggccttggaggaggccggggcctacggcgtggtcttggagatggtgcccgcccgcctggccaaggaggtcaccgagaggctttccgtccacaccgtggggatcggggccgggccccacacggacgcccaggtcctcgtcttccacgacgtggtggggctctacggcgacttcaagccccgcttcgtgaagcgctacctggaggcgggcaggctcatccaggaggccttgagccggtacgcgcaggaggtccgggaaggggtcttccccggggaggagcatagtttctga

SEQ ID NO: 11005 - protein, 284 aa, Thermus thermophilus HB27
MYSSRVLGLRARSSTLLHDSLIPVRRTVKDFRNAKGQRLVYLTAYDYPTARLAEAAGVDAILVGDSLGMVVLGYPSTVPVTLEEMLHHTKAARRGAPETFLVADLPYLAYATLDRALLAAERLLKEGGADAVKLEGGEEVAEIVRGLVRAGVPVLGHVGLTPQTASQLGGYKLQGRRPEEAERILKGALALEEAGAYGVVLEMVPARLAKEVTERLSVHTVGIGAGPHTDAQVLVFHDVVGLYGDFKPRFVKRYLEAGRLIQEALSRYAQEVREGVFPGEEHSF

SEQ ID NO: 11006 - DNA, 753 bp, Acinetobacter sp. ADP1
  CDS (1)..(753): transl_table=11
ttgacttgttatgatgcaagtatggctaaagcgatggagtttgccgaaattgactcgattcttattggggattctttagggatggtcattcagggtcacgattcgactttacctgttacggtggatgatatggcttaccatactgcggctgtacgtcgtggtaatcagcattcgtttattatgactgacttaccctttatgagttatgccaccttgcctgatgccctgaataacgccaaaaaagtcatgcaggcaggggcacagatgatcaagattgaaggtggtgcctggttaagcgaatccattcgtgttttgacacaaaatggtattcctgtatgtgtacacttgggtttaacacctcagtctgtacatgtttttggtggatataaattacaagccaaaactcgagaagctgcggatcaactgattgcagattgtcaggcggtggttgatgcgggagccgcaattttgttactcgaatgtgtgccagcgcagttagggcaggaaattgcagaattatttccacaaacgcctgtcattggtattggtgcgggtaaagaaactgatggacaggtattggttgctcaagacatgctgggactcagctttggcaaagtagcacgttttgtccgtaactttatgaaagaacaagctggagagactgcaattgtagatgcatttaaggcatatcatgctgctgtacaagaccagtcatttcctgcacgagaacatacatttcaggtagagctgtaa

SEQ ID NO: 11007 - protein, 250 aa, Acinetobacter sp. ADP1
MTCYDASMAKAMEFAEIDSILIGDSLGMVIQGHDSTLPVTVDDMAYHTAAVRRGNQHSFIMTDLPFMSYATLPDALNNAKKVMQAGAQMIKIEGGAWLSESIRVLTQNGIPVCVHLGLTPQSVHVFGGYKLQAKTREAADQLIADCQAVVDAGAAILLLECVPAQLGQEIAELFPQTPVIGIGAGKETDGQVLVAQDMLGLSFGKVARFVRNFMKEQAGETAIVDAFKAYHAAVQDQSFPAREHTFQVEL

SEQ ID NO: 11008 - DNA, 855 bp, Desulfotalea psychrophila LSv54
  CDS (1)..(855): transl_table=11
ttgaggattcctgttatgcgtaagaccgttgtggatattattgcaatgaaggccgccgggcagaagataagcatgcttaccgcctatgatgcctccatgtctgccctgcttgatcaggctggaatcgacatcctcttggttggtgattctcttggaatgaccgtgctcggctatgattcgacggttcctgtcaccatggctgatatggttcatcatatggcagcggtgcgtcgcggggccccagatgcctttgtggtgggcgatatgccctttggctcctatcaaacaggggcgcgtgatgctgtccttaatgccatgcgtttgctgaaagagggtggttgtgatgtggtaaagcttgaaggtggtgaggtcgtctgtcctgtggttaaggccattgttgatgcggggattcctgttatgggccatttagggcttactcctcagactgcggcagtgctcggtggttacaaggtgcagggtcgtgatatggaggctgccagaaaactctttgccgatgccaaaagattggaagaggccggggtctgtgggctggttctggagtgcattcctgcaggtcttgccgaagttgttacagcatccatagcggtgcccaccgtaggcattggggcgggcaagggctgtgatggccaggttctggttattaacgatatgctgggactctttgaaaaatttactcccaagtttgtcaaacattatgcccagctagctcctctggtccggcagggagtagaaaactatatcggcgaggttcgtgccggtgcctttccggaggcagagcatacctttaccagttcctgtgattataaggttctcctctccggagatgatcagtaa

SEQ ID NO: 11009 - protein, 284 aa, Desulfotalea psychrophila LSv54
MRIPVMRKTVVDIIAMKAAGQKISMLTAYDASMSALLDQAGIDILLVGDSLGMTVLGYDSTVPVTMADMVHHMAAVRRGAPDAFVVGDMPFGSYQTGARDAVLNAMRLLKEGGCDVVKLEGGEVVCPVVKAIVDAGIPVMGHLGLTPQTAAVLGGYKVQGRDMEAARKLFADAKRLEEAGVCGLVLECIPAGLAEVVTASIAVPTVGIGAGKGCDGQVLVINDMLGLFEKFTPKFVKHYAQLAPLVRQGVENYIGEVRAGAFPEAEHTFTSSCDYKVLLSGDDQ

SEQ ID NO: 11010 - DNA, 801 bp, Yersinia pseudotuberculosis IP 32953
  CDS (1)..(801): transl_table=11
gtgatgaaaaccaccaccatgagccaattacgccaatggaaacaagagaaacgtaaattcgcaacgctgacggcctatgatgccagttttgcccagttatttgctgaacagggtattcaggtgctattggtgggggattcgctcggtatgacgttacaagggttcgattccacgctgccagtgaccgttgccgatgtggcctaccatacccgtgcagtgcgccgtggtgcgcctcattgcctgttattggccgatatgccattcatgagttatgccacgccagaactggcctttacccacgcggcagagctaatgcgggccggagccaatatggtcaaactggaaggtgggagctggctgtgcgataccattcgcatgttggcagagcgcgcggtgccggtttgtgggcatctggggctcacgccacaatcggtgaatattttcggcggctataaagtacagggtcgtgaagaagtggcggccaatcaactgttgcaagatgctattgccctggaacaggcaggggctcaactgttggtactggaatgcgtgccggtagaactggcacagcgggtgaccgaagagttaaccataccggttattggtattggtgcggggaatgtcactgacggtcagattttggttatgcatgatgcactcggtattaccgggggtcatacgccaaaattcagtaaaaactttttagcacacagtgcgggcgatattcgtgccgccattaagctctatattgaagaagttgagggggggatttatcctgctgaagagcatacattccagtaa

SEQ ID NO: 11011 - protein, 266 aa, Yersinia pseudotuberculosis IP 32953
MMKTTTMSQLRQWKQEKRKFATLTAYDASFAQLFAEQGIQVLLVGDSLGMTLQGFDSTLPVTVADVAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 11012 - DNA, 867 bp, Legionella pneumophila subsp. pneumophila str. Philadelphia 1
  CDS (1)..(867): transl_table=11
ttgatccatgagacaggtacctgtattaccatcattcttatctattccaggcgcattctcctattcagggagaacggcatgaaaatccatgattttaaaataaaaaagcaggaacaaaagaaaatttccatgttgacctgttacgattacccttcagcatgcatagtagcagaatcaaatatcgattgtgttctcgtgggtgattccgtagctatggcagtgcacggccaccctacaaccattatggccactatcgaaatgatggaattacatacccaggcagtagctcgtggtttaggcaaacagtttttgattactgacttaccttttctcggacataaatcatctcaaggtcatacagtagaaaacgtaaaaaggctgttacaggctggagcccaagcagttaaaatcgagggcgctgataaagacacctgccaaacgatttcccatttagttaatgccggcatccctgttatgggtcatatcggcttaactccccaatccattcatcaattaggcggttataaagtccagggaaaaaacagcgaacaggcagaaactctattacaacaggcagccaccctggaacaagccggctgctttgcggtagttattgaatgtgttccgcaggagctggcaaaaacgattaccgattcgttagttattcctactataggaattggcgcaggcccaggaactgatgggcaagtccttgtctggcacgatatgctaggtttacagacttcatttaatcctaaatttgtaaaaaaatattttagagccaaagaccattttattgaagccttaaacagctatgtccagcaagtacaacaaatgcatttcccagctaatgaacattctttctag

SEQ ID NO: 11013 - protein, 288 aa, Legionella pneumophila subsp. pneumophila str. Philadelphia 1
MIHETGTCITIILIYSRRILLFRENGMKIHDFKIKKQEQKKISMLTCYDYPSACIVAESNIDCVLVGDSVAMAVHGHPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKVQGKNSEQAETLLQQAATLEQAGCFAVVIECVPQELAKTITDSLVIPTIGIGAGPGTDGQVLVWHDMLGLQTSFNPKFVKKYFRAKDHFIEALNSYVQQVQQMHFPANEHSF

SEQ ID NO: 11014 - DNA, 816 bp, Corynebacterium glutamicum ATCC 13032
  CDS (1)..(816): transl_table=11
atgcccatgtcaggcattgatgcaaagaaaatccgcacccgtcatttccgcgaagctaaagtaaacggccagaaagtttcggttctcaccagctatgatgcgctttcggcgcgcatttttgatgaggctggcgtcgatatgctccttgttggtgattccgctgccaacgttgtgctgggtcgcgataccaccttgtcgatcaccttggatgagatgattgtgctggccaaggcggtgacgatcgctacgaagcgtgcgcttgtggtggttgatctgccgtttggtacctatgaggtgagcccaaatcaggcggtggagtccgcgatccgggtcatgcgtgaaacgggtgcggctgcggtgaagatcgagggtggcgtggagatcgcgcagacgattcgacgcattgttgatgctggaattccggttgtcggccacatcgggtacaccccgcagtccgagcattccttgggcggccacgtggttcagggtcgtggcgcgagttctggaaagctcatcgccgatgcccgcgcgttggagcaggcgggtgcgtttgcggttgtgttggagatggttccagcagaggcagcgcgcgaggttaccgaggatctttccatcaccactatcggaatcggtgccggcaatggcacagatgggcaggttttggtgtggcaggatgccttcggcctcaaccgcggcaagaagccacgcttcgtccgcgagtacgccaccttgggcgattccttgcacgacgccgcgcaggcctacatcgccgatatccacgcgggtaccttcccaggcgaagcggagtccttttaa

SEQ ID NO: 11015 - protein, 271 aa, Corynebacterium glutamicum ATCC 13032
MPMSGIDAKKIRTRHFREAKVNGQKVSVLTSYDALSARIFDEAGVDMLLVGDSAANVVLGRDTTLSITLDEMIVLAKAVTIATKRALVVVDLPFGTYEVSPNQAVESAIRVMRETGAAAVKIEGGVEIAQTIRRIVDAGIPVVGHIGYTPQSEHSLGGHVVQGRGASSGKLIADARALEQAGAFAVVLEMVPAEAAREVTEDLSITTIGIGAGNGTDGQVLVWQDAFGLNRGKKPRFVREYATLGDSLHDAAQAYIADIHAGTFPGEAESF

SEQ ID NO: 11016 - DNA, 783 bp, Burkholderia thailandensis E264
  CDS (1)..(783): transl_table=11
atgacggtgcccaagctgcaggcgatgcgtgaagccggcgagaagatcgccatgctcacctgctacgacgcgagcttcgccgccctcctcgatcgcgcgaacgtcgacgtgcaactgatcggcgattcgctcggcaacgtgctgcaaggccagacgacgacgctgcccgtcacgctcgacgacatcgcgtaccacaccgcctgcgtcgcgcgcgcgcagccgcgcgcgctcatcgtcgcggacctgccgttcggcacctacggcacgcccgccgacgcgttcgcgagcgcggtgaagctgatgcgcgcgggcgcgcagatggtcaagttcgaaggcggcgaatggctcgccgaaacggtgcgcttcctcgtcgagcgagcggtgcccgtgtgcgcgcacgtcggcctcacgccgcaatcggtgcacgcgttcggcggcttcaaggtacagggaaagacggaagcgggcgccgcgcaattgctgcgcgacgcgcgcgcggtcgaagaagcgggcgcgcagctcatcgtgctcgaggccgtgccgacgctcgtcgcggcggaagtcacgcgcgagctgtcgatcccgacgatcggcatcggcgcgggtgcggaatgttccggccaggtcctcgtgctgcacgacatgctcggcgtgttccccggcaaacgccctcgcttcgtcaaggatttcatgcagggacagccgagcatcttcgcggccgtcgaggcttacgtgcgcgcggtgaaggacggcagcttccccgggcccgagcattcgttctga

SEQ ID NO: 11017 - protein, 260 aa, Burkholderia thailandensis E264
MTVPKLQAMREAGEKIAMLTCYDASFAALLDRANVDVQLIGDSLGNVLQGQTTTLPVTLDDIAYHTACVARAQPRALIVADLPFGTYGTPADAFASAVKLMRAGAQMVKFEGGEWLAETVRFLVERAVPVCAHVGLTPQSVHAFGGFKVQGKTEAGAAQLLRDARAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 11018 - DNA, 837 bp, Syntrophus aciditrophicus SB
  CDS (1)..(837): transl_table=11
ttgaaggagaaacagaccatgagtacacaaagtaaaggaaggaaaataaccacatccgtcattcgcggaatgaagaaaaaaggcgaaaagatcaccatgctgacagcctatgattacgccatggcgtcacttctggatgaagtcggtgtggaaatgcttctggtcggcgattccctgggaatggtcgttcttggctacgaaagcaccctcccggtaactatgaatgacatgcttcatcacacccgcgctgtctcccggggagctaacaacgccatggtggtcgcggatcttccgttcatgtcctatcaatgctcggttgaagaggctgtccggaacgccggtcgtttccttcaggaagccggggcccacgccgtcaagctagagggaggccgggagatcgccgaatccgtcaaacggatgactgtttcgggcattcccgtggtgggtcatcttggactgactcctcaatccgtccagcagttcggcggattcaaggtccagggaaagggcgatgcagccgcccagcgaattatggaggatgcaaaaattattgaagaagccggtgcattttccgttgtcctggaatgtgttcctgcaccgctcgctcagcgtatcaccgatgacctggcaatcccgacaatcggcattggcgccggcgccggctgtgatggacaggttctggtcgtcaacgacatgctgggcatttatgaacgattcactcctaaatttgtcaagaaatacgctaatctgagcgataacatccggggggcggtgaaacagtacatcgaagaagtcaaaaacggaacctttcccgaccaggatcactctttcctgtaa

SEQ ID NO: 11019 - protein, 278 aa, Syntrophus aciditrophicus SB
MKEKQTMSTQSKGRKITTSVIRGMKKKGEKITMLTAYDYAMASLLDEVGVEMLLVGDSLGMVVLGYESTLPVTMNDMLHHTRAVSRGANNAMVVADLPFMSYQCSVEEAVRNAGRFLQEAGAHAVKLEGGREIAESVKRMTVSGIPVVGHLGLTPQSVQQFGGFKVQGKGDAAAQRIMEDAKIIEEAGAFSVVLECVPAPLAQRITDDLAIPTIGIGAGAGCDGQVLVVNDMLGIYERFTPKFVKKYANLSDNIRGAVKQYIEEVKNGTFPDQDHSFL

SEQ ID NO: 11020 - DNA, 792 bp, Staphylococcus aureus subsp. aureus NCTC 8325
  CDS (1)..(792): transl_table=11
atgaaacaaaagcaaactaaaatttctatggtaacagcttatgattttccaagtgctaaacaagtggaagcagcgggtattgatatgattcttgttggggattcacttggtatgactgtattaggttatgaaagtaccgtacaagtgacgttagcagatatgattcatcacggtcgtgcagtaagaagaggcgcaccaaatacatttgtagttgttgatatgccgattggtgcagtaggcatctctatgacacaagacttaaatcatgctctaaagctttatcaggagacgaatgcaaatgcaattaaagcagaaggagcgcatattacaccatttattgaaaaagcaacggcaattggtattcctgttgttgcacatttaggattaacacctcaaagtgttggcgttatggggtataaattacaaggtgcaacgaaagaagcagcggagcaacttattttagacgcgaaaaatgtagaacaagctggtgcagttgcgttagtacttgaagcaattccaaatgatttagcagaagaaattagcaagcacttaacaattccagtcattggtattggtgcaggaaaaggtacagatggtcaagtattggtttatcacgatatgttaaattatggtgttgaacataaagcgaaatttgtgaagcaatttgctgattttagtgttggtgtggatggtttaaaacaatacgatcaagaagttaaatctggtgcatttccatcagaagaatatacgtataaaaagaaaattatgaatgaggttaataacaatgactaa

SEQ ID NO: 11021 - protein, 263 aa, Staphylococcus aureus subsp. aureus NCTC 8325
MKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 11022 - DNA, 852 bp, Francisella tularensis subsp. holarctica
  CDS (1)..(852): transl_table=11
atgatgtttttagagcaattgttaataaattttcaaacaaggagaaaagatgaaatgaaatcagttttaggcttcaaaaaagctaaagtaactcaagaaaaaatctcgatggtaacatgctatgactatactttagctaaaattataaactcaacagatatagactgtatcctcgttggcgatagtggtggtatggtattacttggtaaaaaaaatactacttatacaacccttgatgacatgcagttcatgactcaagcggtagctaatggtgctacagataaattcatagtcgctgatttaccatttatgagttatcgccaatcattagaaacaacaatgcaggctgtaatggcactgattcaatcaggagctcatgcgattaagcttgaaggtagttcaggaaatttagatattattaaacatatcgtagattctggtgttccaataatgggacacattggtatgacaccacaatttataaatagctttggaggttttaaagttcaaggtagaactgaagaagccgccaaacacttacttgaagaagctaagcttcttgagcaagcaggatgctttggaatagttctagaatgtataccagcaaatattgctaaagatattacgcaaaatttagacatcccaacaataggtattggtgctggtagcaatactgatggtcagattttagttctccaagatatgcttggcatgaatactgactttcaaccaaaatttgtcaaaaaatatatagatggctcaaagttattttctgatgctataaatacatatgttaaagaaacaaaagctaatacttttcctactaaggagcattgttatgattattgctga

SEQ ID NO: 11023 - protein, 283 aa, Francisella tularensis subsp. holarctica
MMFLEQLLINFQTRRKDEMKSVLGFKKAKVTQEKISMVTCYDYTLAKIINSTDIDCILVGDSGGMVLLGKKNTTYTTLDDMQFMTQAVANGATDKFIVADLPFMSYRQSLETTMQAVMALIQSGAHAIKLEGSSGNLDIIKHIVDSGVPIMGHIGMTPQFINSFGGFKVQGRTEEAAKHLLEEAKLLEQAGCFGIVLECIPANIAKDITQNLDIPTIGIGAGSNTDGQILVLQDMLGMNTDFQPKFVKKYIDGSKLFSDAINTYVKETKANTFPTKEHCYDYC

SEQ ID NO: 11024 - DNA, 834 bp, Synechococcus sp. CC9311
  CDS (1)..(834): transl_table=11
atggcggaagggcggatgcgcccagctgaattgattcgcttcaagcaatccggcagagccatcacgatgctcacagcctgggatgccctcagtgctgccctggtggaagaagccggtgccgacgtcgtcttagtgggtgattcactcgcgatggtggttcttggccatgcgaccacccttccggtcacgcttgaacacatgctccatcacacccaggctgtatgccgtggaatgagcaaacctctcgcgcagcaaccactagtggtctgcgatctaccgttcctgagttatcagtgcggcctcgatcgcgccgtcgccgctgcaggcaccattctcaaagagtcggatgctgctgccatcaagcttgaaggtggagagccagagatcgttgctgttgtggatcgcctcgtccgcatgggtattccagtgatgggccatctcggactcacccctcaggccgtgcaccgactcggctaccggcgtcaaggcatcgatccgcgtagccaggacaaactgcatcgccaagcacaagctctacaggacgccggttgtttctcccttgttgtggagcatgtccccagcgaactcgccggtcggttgagacgcacgttgtccatcccggtgatcggcatcggcgccggacccgattgcgatggacaggtcagcgtcaccgccgacctgctgggcttaacgccaagccaaccgcccttcactccggcccggatgcaaggccgtgaactcagcattaacgctctcaaaagctggcttaaggagcaacgggatcagagagcaactcccaccactccaccacctccaccagcacctgattgctaa

SEQ ID NO: 11025 - protein, 277 aa, Synechococcus sp. CC9311
MAEGRMRPAELIRFKQSGRAITMLTAWDALSAALVEEAGADVVLVGDSLAMVVLGHATTLPVTLEHMLHHTQAVCRGMSKPLAQQPLVVCDLPFLSYQCGLDRAVAAAGTILKESDAAAIKLEGGEPEIVAVVDRLVRMGIPVMGHLGLTPQAVHRLGYRRQGIDPRSQDKLHRQAQALQDAGCFSLVVEHVPSELAGRLRRTLSIPVIGIGAGPDCDGQVSVTADLLGLTPSQPPFTPARMQGRELSINALKSWLKEQRDQRATPTTPPPPPAPDC

SEQ ID NO: 11026 - DNA, 864 bp, Mycobacterium smegmatis str. MC2 155
  CDS (1)..(864): transl_table=11
atgtctgaacaaccaatttatggtgctgcaaacacctcccagagtgttgtggacaccaaacccgcccagcgcaccaaggtgcggaccctgaccttgcagaagtggaaggccgagggccacaagtgggcgatgctcacctgctacgactactccagcgcccgggtcttcgacgacgcaggcattccggtgctcctggtgggtgactcggcggcaaacgtcgtctacggctacgacaccacggtgccgatctccatcgacgaactgatcccgttggcgcgcgccgtggtcaagggcgccccgcatgctctggtgatcggcgatctgccgttcggcagctatgaggacggccccagccaggcgctcgcgaccgccacccgcttcatgaaggaagccggtgtgcacgcggtcaaactcgagggcggtgagcgtgtcgctgatcagatcgcgacgctgtccagggccggcatccccgtggtggcccacatcggcttcacgccgcagagcgtcaacggcctcggcggtttccgcgtgcagggccgcggcgacgccgccgaccagaccatccgcgacgcaatcgccgtcgccgaggccggtgcggtggccgtcgtgctggagatggtgcccgccgagctggcgacgcagatcaccggcaagctcacgatcccgaccgtgggtatcggcgcgggccccaactgcgacgcccaggtgctcgtgtggcaggacatggcgggtctcacgagcggcaagaccgccaagttcgtgcgtcgcttcggcgatgtcggtggcgaactgcaccgtgcggcaacgcaattcgccgatgatgtggcggccggggtgttccccgccgaagaacacagctactga

SEQ ID NO: 11027 - protein, 287 aa, Mycobacterium smegmatis str. MC2 155
MSEQPIYGAANTSQSVVDTKPAQRTKVRTLTLQKWKAEGHKWAMLTCYDYSSARVFDDAGIPVLLVGDSAANVVYGYDTTVPISIDELIPLARAVVKGAPHALVIGDLPFGSYEDGPSQALATATRFMKEAGVHAVKLEGGERVADQIATLSRAGIPVVAHIGFTPQSVNGLGGFRVQGRGDAADQTIRDAIAVAEAGAVAVVLEMVPAELATQITGKLTIPTVGIGAGPNCDAQVLVWQDMAGLTSGKTAKFVRRFGDVGGELHRAATQFADDVAAGVFPAEEHSY

SEQ ID NO: 11028 - DNA, 825 bp, Magnetospirillum magnetotacticum MS-1
  CDS (1)..(825): transl_table=11
atgtcgcaggttgtccaaacccgtcgcctgcaggcggtcgatctgatcaagcgcaaggccgaagggcgcaagatcatcgcgctcaccgcctaccacgcgcatacggcgaacatcgtcgacgcctattgcgacttcgtcctcgtgggtgattccctcggcatggtgatgcacgggatggaatcgaccctgccggtgacgctggagatgatgatcctccaggcccaggcggtgatgcggggaacctcccgcgccctcgtcgtggtcgatatgccgttcggctcctatgaggcgagccgcgagcaggcctttctcaacgccgcccgcgtcctcaaggagacgggggccggagcggtcaagctggagggcggcgcccgcttcgccgagaccgtcgccttcctgaccgagcgcggcgtgccggtgatgggccatatcggcctcaccccccaatccgtgaacaccatgggcggcttcaaggtgcagggccacggggccggcgacgaggagcgcctgcgggcggatgcccgcgccatcagcgatgcgggcgccttctccatcgtcctcgaaggcattgtcgagccggtggcgcgggccatcgccggcgatcccgccatccgtgcggcgaccatcgggatcggcgcgaccgccgcctgcgacgggcagatcctcgtcctcgaggacatgctcggcctcagcgaccgggtgccgcgcttcgtcaaaagcttcggctccctgcgcacgcagatcgaggaagcggtgcgggcctatgcggacgaggtccgggccgggcgcttcccggcggaggatcacacctacccgccccggtga

SEQ ID NO: 11029 - protein, 274 aa, Magnetospirillum magnetotacticum MS-1
MSQVVQTRRLQAVDLIKRKAEGRKIIALTAYHAHTANIVDAYCDFVLVGDSLGMVMHGMESTLPVTLEMMILQAQAVMRGTSRALVVVDMPFGSYEASREQAFLNAARVLKETGAGAVKLEGGARFAETVAFLTERGVPVMGHIGLTPQSVNTMGGFKVQGHGAGDEERLRADARAISDAGAFSIVLEGIVEPVARAIAGDPAIRAATIGIGATAACDGQILVLEDMLGLSDRVPRFVKSFGSLRTQIEEAVRAYADEVRAGRFPAEDHTYPPR

SEQ ID NO: 11030 - DNA, 771 bp, Nostoc punctiforme PCC 73102
  CDS (1)..(771): transl_table=11
atggcaatcactacccagcaattaattcaatggaaacaacagggacgttcaattgtcgcgttgaccgcctgggattatgcgatcgctcaactcatcgatgcagctggtgtagacttaatccttgtgggcgactctatggcagtagttttagggtatgacacaacactgccgataactttggatgagatgatataccacgccaaatctgtgcgtcgtggggttaaacgcgcattagtggtggtagatttaccatttttgacgtatcaagaaagtcttcaacaagcgatgcactcagctgggcgggtactgaaggaaacgggcgctcaagcggtaaaattggagggtggctatccagcgatcgcagaaactattgctcgtttggtacaagctggaattccggtaatgggtcatgtaggtttgacaccacaatcggtacatcaactcggtttgcgacaacaagggaaaacccaagaagcgagtgagagaattttacttgaagcgatcgctctcgaacaagcaggtgtattttctatagttttagagcatatccccgcagatttggcaatgcagattacacaaaaattaagtattccgacaattggtatcggtgcgggaactcactgcgatggacaagttttagttacctcggatgtaatcggactggctgaaaaacatccaccgttcgccaaggtttacaccaacttgcgagagacgattaccaaggctgtgcaagattatgccgtggaagtgcgcgatcggaaatttccatag

SEQ ID NO: 11031 - protein, 256 aa, Nostoc punctiforme PCC 73102
MAITTQQLIQWKQQGRSIVALTAWDYAIAQLIDAAGVDLILVGDSMAVVLGYDTTLPITLDEMIYHAKSVRRGVKRALVVVDLPFLTYQESLQQAMHSAGRVLKETGAQAVKLEGGYPAIAETIARLVQAGIPVMGHVGLTPQSVHQLGLRQQGKTQEASERILLEAIALEQAGVFSIVLEHIPADLAMQITQKLSIPTIGIGAGTHCDGQVLVTSDVIGLAEKHPPFAKVYTNLRETITKAVQDYAVEVRDRKFP

SEQ ID NO: 11032 - DNA, 810 bp, Bacillus cereus G9241
  CDS (1)..(810): transl_table=11
atgaaagagcaaggtgagccgattacaatgctaacggcgtatgattatccatctgctaagttagcggaagaagctaaagttgatatgattctagttggagattcacttgggatggttgtgctcggatacgattcaacggtacctgtaacagtagaggatatgattcatcatacaaaagctgtacgccgaggagcgaaagagacgtttattgtaactgatatgccgtttatgtcgtatcatgtgtcgcctcaagatacgatggtgaatgcacgccgcatcgttcaagagagtggtgctcatgcactgaaggtagaaggtgcaggggaagtgttatcaacgattcattacttgacgaatgcgggaattcctgtcgtggcacacttaggcttaactcctcaatctgtaggagtactaggtgggtataaagtacaaggaaaagatgctgaaagtgcaaaaaaattaatagaagatgcgaagagatgtgaggaagctggtgcgatagcgcttgtattagaatgtgtgccaatgcagttagcggaattgatttcgaagcaactaacaattccaacgattggaattggagcagggaaaaaagtagatgggcaagtactcgtttatcatgatcttatctcatacggtgtaaatcgtgttccgaaattcgtgaagcaatatacgtctgttcaagaggagattgtgcgagggatttcacaatacgttactgaagtaaagacaggacaatttccagaagaaatacattcattcacaatgaaagaggaagaatgcttagctttatacgggggaaaacagtaa

SEQ ID NO: 11033 - protein, 269 aa, Bacillus cereus G9241
MKEQGEPITMLTAYDYPSAKLAEEAKVDMILVGDSLGMVVLGYDSTVPVTVEDMIHHTKAVRRGAKETFIVTDMPFMSYHVSPQDTMVNARRIVQESGAHALKVEGAGEVLSTIHYLTNAGIPVVAHLGLTPQSVGVLGGYKVQGKDAESAKKLIEDAKRCEEAGAIALVLECVPMQLAELISKQLTIPTIGIGAGKKVDGQVLVYHDLISYGVNRVPKFVKQYTSVQEEIVRGISQYVTEVKTGQFPEEIHSFTMKEEECLALYGGKQ

SEQ ID NO: 11034 - DNA, 813 bp, Bacillus anthracis str. A2012
  CDS (1)..(813): transl_table=11
atgaaagagcaaggtgagccgattacaatgctaacggcgtatgattatccttctgctaaattagcagaagaagctgaagttgatatgattctagttggagattctctcgggatggttgtgctcggctacgattcaacagtaccagtaacagtagaggatatgattcatcatacaaaagctgtacgccgcggagcgaaagagacgtttattgtaactgatatgccatttatgtcgtatcatgtgtcactgcaagatacgatggtgaatgcacgccgcatcgttcaagagagtggtgcccatgcactgaaggtagaaggtgcgggagaagtgatatcgactattcactatttgacgaatgcgggaattcctgtcgtggcgcacttaggtttaactcctcaatctgtaggagtgctaggtggatataaagtacaaggaaaagacgctgaaagtgcaaaaaaattaatagaagatgcgaagaaatgtgaggaagctggtgcaattgcactcgtgttagagtgtgtgccaatgcagttagcagaacttatttcagagcaattaacaattccaacaatcgggattggcgcaggacaaaaagtagatgggcaagtgcttgtttatcatgatcttatctcatatggggtaaatcgtgttccgaaatttgtgaagcaatatacgtccgttcaagaagaaattgtacgcgggatttctcaatatgttgctgaagtaaagacaaggcaatttcctgaagaaaaacattcgttcacaatgaaagaggaagaatgcttagcgttatacggaggaaaacaatcatga

SEQ ID NO: 11035 - protein, 270 aa, Bacillus anthracis str. A2012
MKEQGEPITMLTAYDYPSAKLAEEAEVDMILVGDSLGMVVLGYDSTVPVTVEDMIHHTKAVRRGAKETFIVTDMPFMSYHVSLQDTMVNARRIVQESGAHALKVEGAGEVISTIHYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYGVNRVPKFVKQYTSVQEEIVRGISQYVAEVKTRQFPEEKHSFTMKEEECLALYGGKQS

SEQ ID NO: 11036 - DNA, 789 bp, Crocosphaera watsonii WH 8501
  CDS (1)..(789): transl_table=11
atgggactaacgacgcaacaattaatctcttggaaacaacaaggccgtccaattgtagccttaacggcttgggattacgcctttgctcaattattggacaaagccggtgttgatattattttggtgggtgattctttggctatggtagctttgggctatgaaaccaccctaccagttactctggatgagatgttatatcacgcggccgctgttcgtcggggagtcaaacgggctttggtggtgtgtgatttaccttttctaagttaccaagaaagcatcagtcaagctattcatgccgccggaagggttttaaaagaaacaggggtacaaggggttaaactcgaaggtggacaccctgcctccctagaaactgttgctcgtttgagtgatattgggattccagtgatgggccatgtagggttaacccctcagtcggtgcatcgtttgggttatcgtcaacagggaaacaccgaggctgaggctgaacgtattttatcggaagcgatcgctttatcggaagcgggggcttttgctgttgttttagaacatattccagctaacctcgcgagaataattactacaaagttacctattcctactattggtattggtgccggaggcgactgtgatgggcaggttttggtaacagcagatttattgggactctcggagaaaaaaccgccttttgctaaatcttatctcaatttaagagaaatagttattggagcggttaatgatttttcccaagaagttcgagagagaaagtttcctgagagtgatcaattatag

SEQ ID NO: 11037 - protein, 262 aa, Crocosphaera watsonii WH 8501
MGLTTQQLISWKQQGRPIVALTAWDYAFAQLLDKAGVDIILVGDSLAMVALGYETTLPVTLDEMLYHAAAVRRGVKRALVVCDLPFLSYQESISQAIHAAGRVLKETGVQGVKLEGGHPASLETVARLSDIGIPVMGHVGLTPQSVHRLGYRQQGNTEAEAERILSEAIALSEAGAFAVVLEHIPANLARIITTKLPIPTIGIGAGGDCDGQVLVTADLLGLSEKKPPFAKSYLNLREIVIGAVNDFSQEVRERKFPESDQL

SEQ ID NO: 11038 - DNA, 834 bp, Prosthecochloris aestuarii DSM 271
  CDS (1)..(834): transl_table=11
atgaataagcagagcacgcaaaaactgccccacgtcacaacacgacgtcttcatgatatgaaatcagaaggtgagaaaatttcaatgctcactgcatatgattatacaacggccagaattcttgatcgcgccggtgtcgatgttattcttgttggtgattcggcaagcaatgtttttgccggtcacaatacgacgctgcctattaccatcgatcagatgatctaccatgcaagagctgttgtcaggggagttcaggctgaaaccagcagagcgatggttgtgatcgatatgccgttcatgagttatcagctctcgagcgaagaggctttgcgcaatgcgggtaagatcatgaaggagaatgagtgtgatgctgtcaaaatcgaagggggaaacgttattgtcgatacggtaaagaggataaccgatgtcggtatcccggtcatgggacacctgggcctgattccgcagtcgatctataagttcggaagctataaggtgcgtgcacgagaagaacaggaggccgaagagcttcttcgtgatgcgaaactgcttgaagaggcaggggcctttgctcttgttcttgaaaaaattccggcggaccttgccgcagaggtgaccgcttcgatctcgattccaacgataggtatcggtgcggggggggcgtgcgatggtcaggttctggttatcaacgatatgcttggtttgagtaccgaatttcatccccgcttcgttcgcaggtatgctgaactcgatcgtgttatattcgatgccgtcagccgctatgtcgatgatgtccggggcgggacgtttccgggggaagatgaaagctactga

SEQ ID NO: 11039 - protein, 277 aa, Prosthecochloris aestuarii DSM 271
MNKQSTQKLPHVTTRRLHDMKSEGEKISMLTAYDYTTARILDRAGVDVILVGDSASNVFAGHNTTLPITIDQMIYHARAVVRGVQAETSRAMVVIDMPFMSYQLSSEEALRNAGKIMKENECDAVKIEGGNVIVDTVKRITDVGIPVMGHLGLIPQSIYKFGSYKVRAREEQEAEELLRDAKLLEEAGAFALVLEKIPADLAAEVTASISIPTIGIGAGGACDGQVLVINDMLGLSTEFHPRFVRRYAELDRVIFDAVSRYVDDVRGGTFPGEDESY

SEQ ID NO: 11040 - DNA, 819 bp, Croceibacter atlanticus HTCC2559
  CDS (1)..(819): transl_table=11
atgtctacagctaaaaaagaatataaacgcattaccgtaaaaagcctagttgatatgaaacgtagagacgaaaaaatctctatgttaactgcttatgactataccatggccaaaattgttgatgccgctggaatagatgttattttagttggagactctgcctctaatgtaatggctggtcatgaaactacattacctattacattagaccaaatgatttatcatgcctcttctgttgtaagagccattacaaggagtctggtagttgtagatttaccatttggaagttatcaaagtgatccgaaagaagcattaagatctgcaattagaataatgaaagaaagtggtggtcacgctgttaaattagaaggcggaaaagaagtaaaagacagtgtgaaacgtattctaaatgcaggaatcccagtaatgggtcatttagggcttacaccacaaagtatatataaatttggaacatacaccgtaagagctaaggaagaggaagaagctcaaaaacttaaagacgatgcattaatgcttgagaaagctggttgttttgccatagttttagagaaagtgcctgctaagttagccaaagaggttgcagaaagtttaaccattcccataattggtattggtgctggttctggagtagatggacaggtgttagtgcttcacgatttacttgggatgacacacgagtttaacccacgctttttaagacgatacatgaatttatatgacgacatgagtactgcaatatctcaatatgtaacagatgtaaaagctgtagattttccaaatgaagacgagcagtattaa

SEQ ID NO: 11041 - protein, 272 aa, Croceibacter atlanticus HTCC2559
MSTAKKEYKRITVKSLVDMKRRDEKISMLTAYDYTMAKIVDAAGIDVILVGDSASNVMAGHETTLPITLDQMIYHASSVVRAITRSLVVVDLPFGSYQSDPKEALRSAIRIMKESGGHAVKLEGGKEVKDSVKRILNAGIPVMGHLGLTPQSIYKFGTYTVRAKEEEEAQKLKDDALMLEKAGCFAIVLEKVPAKLAKEVAESLTIPIIGIGAGSGVDGQVLVLHDLLGMTHEFNPRFLRRYMNLYDDMSTAISQYVTDVKAVDFPNEDEQY

SEQ ID NO: 11042 - DNA, 828 bp, Sulfitobacter sp. EE-36
  CDS (1)..(828): transl_table=11
atgagcgccacagcccgcaagaccgcccccatgccgacggatattctggcccgcaaagggggggctccgctggtgagcctgaccgcctataccacgccgatggcgcaagtgatggatggcatctgcgatttcgtgcttgtgggcgattcagtggggatggtgctgcacgggctgccctcgacgcttgaggtcacgatggagatgatgatcctgcacggtcaagcggtgcggcgcgggctgacccagtcgatgctggtgatcgatatgcccttcggcagctacgagcaaagcccggcccaagcctttgagaacgcggcacgtttgatgcgcgaaaccggtgccggtgcggtcaagcttgaagggggggaggtgatggaagacaccatcgccttcctgaccaaacgcggcattccggtgatggcgcatatcggcctgacgccgcagtcgattcacacgcttggcgggtataaggtgcaggggcgcggtgcggccgccacgcagctgatggccgatgcgcaggcggtggcgcgggcaggggcctttgccgtggtgcttgagaaagtgccgcaggctttggcggaccagatcactgaaacggtcgccattcccaccatcggcatcggtgcgtcagcgcaatgcgacgggcaaattctggtggtcgatgacatgctggggctgttcaccgccttcaaggcgaaattcgtaaaacgctatgcccatctgggcgatgacgcaaaggccgcggtgcaggcctatgccgacgaggtcacggcgcgatccttccccggacccgagcatgtattttttgacgaggtttccaaaacatga

SEQ ID NO: 11043 - protein, 275 aa, Sulfitobacter sp. EE-36
MSATARKTAPMPTDILARKGGAPLVSLTAYTTPMAQVMDGICDFVLVGDSVGMVLHGLPSTLEVTMEMMILHGQAVRRGLTQSMLVIDMPFGSYEQSPAQAFENAARLMRETGAGAVKLEGGEVMEDTIAFLTKRGIPVMAHIGLTPQSIHTLGGYKVQGRGAAATQLMADAQAVARAGAFAVVLEKVPQALADQITETVAIPTIGIGASAQCDGQILVVDDMLGLFTAFKAKFVKRYAHLGDDAKAAVQAYADEVTARSFPGPEHVFFDEVSKT

SEQ ID NO: 11044 - DNA, 807 bp, Roseovarius nubinhibens ISM
  CDS (1)..(807): transl_table=11
atgcccgatgatatacgggcgatgaagggcggcacgccgattgtcagcctgaccgcctataccacgcctatggccaagatgatggacgcgcattgcgattttgtcctcgtcggcgacagcctcggcatggtggtgcatgggctgccctcgaccctcggtgtgacgatggagatgatgatcctgcatgggcaggcggtggcccgtgggctcagccgggcgatgatggtgatcgacatgccgttcggttcctacgaggaaagccccgagcaggcgtttcgcaacgccgcgcggctcatggccgagacgggcgcgggcgcggtcaagctcgaaggcggcacccatatggccgagaccatcgcgtttctcgtggcgcggggcgtgccggtgatggcgcatgtcgggctcacgccgcagtcgatcaacacgctcggtggctataaggtgcaggggcgcgacgcgggggcggagaagctcttggcggatgcgcaggcggtggccgaggccggggcctttgccgtggtactggaaaaagtgcccgccgtgatggccgaccggatcacccaagaggtcgcaatcccgaccatcggcatcggcgcctcggcgggctgtgatgggcagatccttgtcgtcgatgacatgctcgggctctttaccgcgttcaagccgaaattcgtcaaacgctatgccgatctcggcacccagggtgaggcggcgattgccacctatgccgacgaggtgcgggcaaggcagtttccggccagcgagcatacctttgccgccgaacagccccaaaaggccgccaaatga

SEQ ID NO: 11045 - protein, 268 aa, Roseovarius nubinhibens ISM
MPDDIRAMKGGTPIVSLTAYTTPMAKMMDAHCDFVLVGDSLGMVVHGLPSTLGVTMEMMILHGQAVARGLSRAMMVIDMPFGSYEESPEQAFRNAARLMAETGAGAVKLEGGTHMAETIAFLVARGVPVMAHVGLTPQSINTLGGYKVQGRDAGAEKLLADAQAVAEAGAFAVVLEKVPAVMADRITQEVAIPTIGIGASAGCDGQILVVDDMLGLFTAFKPKFVKRYADLGTQGEAAIATYADEVRARQFPASEHTFAAEQPQKAAK

SEQ ID NO: 11046 - DNA, 831 bp, Oceanicola batsensis HTCC2597
  CDS (1)..(831): transl_table=11
atgagccaatccgccccgcaacgcagcctcaccgcgtccgacatccgtgcgcgcaagggggctgatccgctggtctgcctgaccgcctatacgacccccgtggcacagctggcggacgcggactgcgatctggttctggtcggtgacagcgtcggcatggtgctgcacgggctgccctcgaccctcggcgtgacgatggagatgatggtgctgcacggccgcgccgtcgcccgtggcctcagccgcgcgctgatggtcgtcgacatgcccttcggcagctatgaggaaagcccggcccaggcctttcgcaatgccgcccacctgatggcggaaaccggggccggcgcgatcaagctggaaggcggcgcgcatatggaagagacggtccgctttatcgtggatcgcggcatccccgtcatggcacatatcggcctgacgccacaggcggtgaacgcgctaggcggctataaggtgcaggggcgcggcgcggatgcggaccggatcctggaagacgcccgtgcggtgacccgcgccggggcgttctcggtcgtgctggaaaaggtgcccgccgctctggcggatcagatcaccgcgggtatcgacattcccacggtcggcatcggggcctcttcaggctgtgacggacagatcctggtgatcgacgacatgctgggccttttcgatgccttcaagccgaagttcgtcaagcgctatggcgatcttgccagcgacgcccgcaccgccatccgcacctacgcccaggaggtccgcgcccgcagcttcccggcccccgaacatgtcttttcgcaggaggaaccaggcacatgttga

SEQ ID NO: 11047 - protein, 276 aa, Oceanicola batsensis HTCC2597
MSQSAPQRSLTASDIRARKGADPLVCLTAYTTPVAQLADADCDLVLVGDSVGMVLHGLPSTLGVTMEMMVLHGRAVARGLSRALMVVDMPFGSYEESPAQAFRNAAHLMAETGAGAIKLEGGAHMEETVRFIVDRGIPVMAHIGLTPQAVNALGGYKVQGRGADADRILEDARAVTRAGAFSVVLEKVPAALADQITAGIDIPTVGIGASSGCDGQILVIDDMLGLFDAFKPKFVKRYGDLASDARTAIRTYAQEVRARSFPAPEHVFSQEEPGTC

SEQ ID NO: 11048 - DNA, 813 bp, Erythrobacter sp. NAP1
  CDS (1)..(813): transl_table=11
atgaaacggctcactgtcccgcgcatccgtgcgaagaaaaaggacggcgtcaccgaagagccgctggtgatgctgaccgcctacacggcgcgtcaggcacagctactcgacgcacattgcgacattctgctggttggagattcgcttgggcaagtgatctacgggctggattcgaccatcccggtcagcctcgaaatgatggccaatcacggcgctgcggtagtgcgcgggagctatcattcggttgtagtcgtggacatgcctttcggttcttatgaggcctcgaaagaacaggcattcgaaagcgccgctttcctactgaagcaaacgggcgcagcggcggtgaagctcgaaggcggcgaagcgatggccgagacggtcgagttcctcaattcacgcggcatccctgtcatggggcacgtcgggcttactccgcaggcagtaaatgtgcttggaggctacatggcgcgcggtcggtctgacgccgaagcggacaagattgtcagtgacgccgtagccctcgacaaggcgggtgcctttgccatcgttatcgaaggcgtcgttgaaccgatcgcgattgaagccacacaagcggttgcttgtccaaccatagggatcggcgcatctgcacaatgcgatgggcaggtgttagtcaccgaagatatgctcggcatgttcgaacgcgtcccgcgctttgtgaagaagtacgaggatattgcgagcgttattgagaaaaccgtcgcatcctatgcccaggaagtgcgtgagcgttcattcccgagtgaagaccagacttatcagcccaaggcttga

SEQ ID NO: 11049 - protein, 270 aa, Erythrobacter sp. NAP1
MKRLTVPRIRAKKKDGVTEEPLVMLTAYTARQAQLLDAHCDILLVGDSLGQVIYGLDSTIPVSLEMMANHGAAVVRGSYHSVVVVDMPFGSYEASKEQAFESAAFLLKQTGAAAVKLEGGEAMAETVEFLNSRGIPVMGHVGLTPQAVNVLGGYMARGRSDAEADKIVSDAVALDKAGAFAIVIEGVVEPIAIEATQAVACPTIGIGASAQCDGQVLVTEDMLGMFERVPRFVKKYEDIASVIEKTVASYAQEVRERSFPSEDQTYQPKA

SEQ ID NO: 11050 - DNA, 843 bp, Synechococcus sp. WH 5701
  CDS (1)..(843): transl_table=11
gtgcccctgagacccggtgatctggtggcccgcaagcaggctggggtggcgatcctgatgctcaccgcctgggatgcgctctcggcggcgctggtcgaggaggccggtgccgaagtggtcctcgtgggcgactccctggcgatggtggtgctcggccacgccaccaccctgccggtgaccctggcggagatgatcggccacacccaggccgtggcccgaggtctgcgccggccccagggccagcaaccgctgctgatctgcgatctgcccttcctgagctaccagtgcggcagtgatcaggccgtggccgccgccggccgggtgctcaaggaaagtgcggcggccgccgtgaagctggaaggcggtgagccggaaaccgtggccgtggtcgaccggctggtgcgcagtgggatcccggtgatggggcatctcggcctgaccccccagtcggttcaccggctgggctaccggcgccaggccagggatccgatcagccaggaacgcctgcggcgccaggccctggatctggaggccgccggctgcttcgccctggtgctggaacacgtgccggcggatctggccggcagcctgcggcgccagctggccattcccgtgatcggcatcggcgccggcgatgactgcgacggccaggtgcgggtcacggccgacctgctgggcctgaccccgagccaaccgcccttcagcccgccgctgctggcggggcgccagctctgcgtggaggccctcaggggctggctgcaatcggcgactccgccagttgcgtctcgggaggttgatgggcttcccaccaggccagaagctccctcagcaccgcattgctga

SEQ ID NO: 11051 - protein, 280 aa, Synechococcus sp. WH 5701
MPLRPGDLVARKQAGVAILMLTAWDALSAALVEEAGAEVVLVGDSLAMVVLGHATTLPVTLAEMIGHTQAVARGLRRPQGQQPLLICDLPFLSYQCGSDQAVAAAGRVLKESAAAAVKLEGGEPETVAVVDRLVRSGIPVMGHLGLTPQSVHRLGYRRQARDPISQERLRRQALDLEAAGCFALVLEHVPADLAGSLRRQLAIPVIGIGAGDDCDGQVRVTADLLGLTPSQPPFSPPLLAGRQLCVEALRGWLQSATPPVASREVDGLPTRPEAPSAPHC

SEQ ID NO: 11052 - DNA, 795 bp, Pseudoalteromonas tunicata D2
  CDS (1)..(795): transl_table=11
atggctaaaattactgtttctacgttaaaaaaaatgaaagaagaagggcgtaaaattgcagcactaactgcatatgacgccagtttttcacaactatttcaagataacggcattcatgttctgcttgttggtgattcactgggcatggtactacaagggggcactgatacccttggcgtaaccaaccaagatattgcttaccacacccgctgcgtgcgggccggcgcaaaagatacctttgtgattgctgacatgccttttatgacttattccactgttactgatacctgtaaacatgccgcagaattaatgcgcgcgggtgctaacatggttaaattagaaggtggtgaatggctttatgacagtattaaagcactcacgattcaaggtattcctgtatgtggtcatttaggtttaacaccgcaatcggttcatgtttttggcggatttaaaattcaaggccgtgaaaatgaacaagcgaataaaatggtgcaagatgctcaagctttagagcgtgctggcgcacaattattagtacttgaatgcatcccttctgcacttgctgaacgtataacacagagcgtttctattccaaccattggcattggtgctggaaagctaaccgatggccaaattttagtgatgcatgatttagtcggtatttcagccggttatattccaaaattttcgaaaaactttttacttgaaactggcaacatgccagcggcagtaaaaaaatatttagatgatgtgaccagtggcgcgttccctggcactgagcacgagtttaattaa

SEQ ID NO: 11053 - protein, 264 aa, Pseudoalteromonas tunicata D2
MAKITVSTLKKMKEEGRKIAALTAYDASFSQLFQDNGIHVLLVGDSLGMVLQGGTDTLGVTNQDIAYHTRCVRAGAKDTFVIADMPFMTYSTVTDTCKHAAELMRAGANMVKLEGGEWLYDSIKALTIQGIPVCGHLGLTPQSVHVFGGFKIQGRENEQANKMVQDAQALERAGAQLLVLECIPSALAERITQSVSIPTIGIGAGKLTDGQILVMHDLVGISAGYIPKFSKNFLLETGNMPAAVKKYLDDVTSGAFPGTEHEFN

SEQ ID NO: 11054 - DNA, 795 bp, Photobacterium sp. SKA34
  CDS (1)..(795): transl_table=11
atgaagaaaattactatcaacgatctcatgaaatggaagcaagaaggtcgtaagttcgcatcagtcactgcctacgatgcaagttttgctcaattatttgagcaacaggaaatgccagtattactggttggtgattctcttggcatggttttacaaggccgtgaagatacgcttcctgttactgtagaagaaatcgcttaccacacacgtagtgttcgtgcgggtagccctaatgcattactgatggctgatatgccatttatgagttatgcaacaccagagcaaacttgtgaaaatgcagcaaagctaatgcgttctggcgctaatatggtcaaactagaaggtggcgcatggttagcagataccatttctatgctagctgaacgtgccgtacccgtttgtgctcacctcggtttaacaccacaatccgtcaatatttttggtgggtacaaagtacaaggccgtgatatcgacaaagccgatgaaatggttaaagacgctatcctattaaaaaatgcaggcgcacaaatcattgttcttgaatgtgtaccagctagccttgctgagcgcattaccaaagcggtagagatccccgtaattggtattggtgcaggtaacagtaccgatggtcaaattctagttatgcacgatatgttcggtatttctgccaattatatgccgaagttctcgaaaaacttcctcgcagaaactggcgacatgcgtgcggccgtcactaaatatattaaagatgttgagaaaggtgaatttccaggctctcaacatacctttgaataa

SEQ ID NO: 11055 - protein, 264 aa, Photobacterium sp. SKA34
MKKITINDLMKWKQEGRKFASVTAYDASFAQLFEQQEMPVLLVGDSLGMVLQGREDTLPVTVEEIAYHTRSVRAGSPNALLMADMPFMSYATPEQTCENAAKLMRSGANMVKLEGGAWLADTISMLAERAVPVCAHLGLTPQSVNIFGGYKVQGRDIDKADEMVKDAILLKNAGAQIIVLECVPASLAERITKAVEIPVIGIGAGNSTDGQILVMHDMFGISANYMPKFSKNFLAETGDMRAAVTKYIKDVEKGEFPGSQHTFE

SEQ ID NO: 11056 - DNA, 792 bp, Photobacterium sp. SKA34
  CDS (1)..(792): transl_table=11
atgaaaaaaataaccatcgcagatttaaataactggaaaaaattaggcgaaaaatttgcatcaataaccgcttatgatgcgagcttttctaaaatatttgaagagcaaggcctgcctgtcataattgtcggagattcacttggttcagtaatacaaggtaaaccaacaactttggatgtgagtattgatgaattggtatatcacacaaaatgcgttagagcaggaagcccaaatgctttcattatttcagaccttcctttcatgagttaccacacccctgattcagcatgtgaatcagcagctaaattaatgaaagcaggtgcaaatatggtaaagattgaaggcggtagttggttaaccagtactgttaaaatgctaactgaacgtgcagttccagtttgtgctcatttaggtttaatgccacaagccgtaaatctatatggcggatataaagttcaaggtaaaacagaagaacaagctacagaaatgctagaaacagccaaagagcttcagcgcgcaggtgctcagatactggtacttgaatgtattcctgcgaaattagcacgacaaatcacattagaattacacattccagtaatagggattggtgcaggtaatgataccgatggtcaagttttagttatgcacgatattttaggtgtatcagccaattatattccaagattctctagaaatttcctcgctgaaaccgggtcgattgaagccgctgtgactaagtatatagatgaagtcaaacaacaaaccttcccagaggaaaaacacagcttttaa

SEQ ID NO: 11057 - protein, 263 aa, Photobacterium sp. SKA34
MKKITIADLNNWKKLGEKFASITAYDASFSKIFEEQGLPVIIVGDSLGSVIQGKPTTLDVSIDELVYHTKCVRAGSPNAFIISDLPFMSYHTPDSACESAAKLMKAGANMVKIEGGSWLTSTVKMLTERAVPVCAHLGLMPQAVNLYGGYKVQGKTEEQATEMLETAKELQRAGAQILVLECIPAKLARQITLELHIPVIGIGAGNDTDGQVLVMHDILGVSANYIPRFSRNFLAETGSIEAAVTKYIDEVKQQTFPEEKHSF

SEQ ID NO: 11058 - DNA, 795 bp, Neptuniibacter caesariensis
  CDS (1)..(795): transl_table=11
atgagcaatattactctgcacacgttgtcttcaatgaaacaggcaggcgaaaaatttgcagtactcactgcatacgacgcatgtttctcacacctggttagttccgcaggtacggaagtaattctggtcggtgattcgttgggcatggtgcttcagggcaacgacagcacattacctgtgactgttgaagagatggcctaccacactcaggctgtcgctaaaggaaaccaaggaagcctgatcatggctgacctgcccttcatgagctactcgacgcctgaacaagctatggacagtgcagcagcactgatgcaggccggtgcgaacatggtgaaacttgaaggcggcgcatggctggcagacacaatctcaatgctagctgaacgcggcattccggtctgcgcacatctcggactgacaccacaaaccgtcaacaagctcggcggttatcgtgtacagggaagagatcaggaaactgcgcaacagatgatcaacgacgcagttctcctgcaagacgctggcgcaagtatcattcttctggagtgtgtacctgctattctggcaaaagagatcaccctggcccttgatgtcccagtcattggtatcggggcaggcgctgatacagatgctcaggtactcgtactacatgacatgctaggaatcacaccaggtcgcagccctaaattcgttaagaatttcatggctgatgcagatagcattgaagccgcggttcagctgtacgttgccgaggttaaagcgggtacattccctgcccaagagcatgggttcgcgtaa

SEQ ID NO: 11059 - protein, 264 aa, Neptuniibacter caesariensis
MSNITLHTLSSMKQAGEKFAVLTAYDACFSHLVSSAGTEVILVGDSLGMVLQGNDSTLPVTVEEMAYHTQAVAKGNQGSLIMADLPFMSYSTPEQAMDSAAALMQAGANMVKLEGGAWLADTISMLAERGIPVCAHLGLTPQTVNKLGGYRVQGRDQETAQQMINDAVLLQDAGASIILLECVPAILAKEITLALDVPVIGIGAGADTDAQVLVLHDMLGITPGRSPKFVKNFMADADSIEAAVQLYVAEVKAGTFPAQEHGFA

SEQ ID NO: 11060 - DNA, 819 bp, Flavobacteria bacterium BBFL7
  CDS (1)..(819): transl_table=11
atgtcaactgcaaaaaaagaatacaagagaattacagtaaagtctcttacagagatgaaacgtaataatgaaaagatatcgatgctaactgcatatgattatacgatggcgcgtattatcgatagtgctggagtagatgtgattctagtaggagatagtgctagtaatgttatggctggacatgaaacgactttacctatcacattagatcaaatgatttatcatgctagtagtgtggtgcgtgcggtagagcgatctttagtggttgtagatttaccttttggtagttatcaaagtgatcctaaggaagctttgcgcagtgctatacgtatcatgaaggaaagtggtggacattctgtaaaattagaaggtggaagtgaggtaaaagattctattaagcgcatattacatgcaggaattcctgttatgggacatttaggattaacaccacagtcgatatacaaatttggaacttacacggttagagcaaaagaaaaagccgaagctgaaaaattgaaagaagatgctctagcgttacagcgttggggttgttatgcaatagtactagaaaaagtaccagctgctctggctcaagaggtggcagatagtttaactattccagtgataggtataggagctggtagtggtgtagatggtcaggtacttgtgtcccacgatatgtttggaatgacgcatgagttcaatccacgttttttaagacgatatttgaatttatatgaagatatgggaaatgctgtaggtcagtatgttaaggatgttaaaagtgtagacttccctaacgataaggagcagtattaa

SEQ ID NO: 11061 - protein, 272 aa, Flavobacteria bacterium BBFL7
MSTAKKEYKRITVKSLTEMKRNNEKISMLTAYDYTMARIIDSAGVDVILVGDSASNVMAGHETTLPITLDQMIYHASSVVRAVERSLVVVDLPFGSYQSDPKEALRSAIRIMKESGGHSVKLEGGSEVKDSIKRILHAGIPVMGHLGLTPQSIYKFGTYTVRAKEKAEAEKLKEDALALQRWGCYAIVLEKVPAALAQEVADSLTIPVIGIGAGSGVDGQVLVSHDMFGMTHEFNPRFLRRYLNLYEDMGNAVGQYVKDVKSVDFPNDKEQY

SEQ ID NO: 11062 - DNA, 816 bp, delta proteobacterium MLMS-1
  CDS (1)..(816): transl_table=11
atggacaatattcgccagttgcaggaaaaaaaggcccgcggcgagaagctcaccatgctcaccgcccatgatgccgccctgggtgccctggtcgaccaggccggggttgatttggtgctggtgggtgattccctggggatggtagccttgggctatgactccacggtgccggtgaccatggacgagatgatccaccacgcccgggcagtgcgccgtggggtgagcggcgccctgctggtgggggatatgccctttctctcctaccaggcggataagagaggggccattatcaatgccggccgcttcttgaaagaggccggctgcgcggcggtcaagatggaaggcggggcagccctggcacccaccgtcgaggccgtggtcgccgccgggattccggtattgggccatatcggcctgactccccagaccgccggccagttgggtggtttcaaggtccaggggcgggatgccgcctcggcggcccgcttgcggcatgacgccgaggccctggccgccgccggggttagcgccgtggtgctggaatgcgtgccggccctgctggcccgggaaatcagcgccgccctggcagtgcccaccatcggcatcggggccgggccctattgcgatggccaggtgctggtgagccacgacctgctggggctctttgccggttttacccccaaattcgccaaacgctacgttgatctgggtcagcaggcggccacggccctggccaccttcaaaaaggaggtggaggcgggagaatttcccagcgccagccattcttttggcccgttgactgaaggaaacgagtaa

SEQ ID NO: 11063 - protein, 271 aa, delta proteobacterium MLMS-1
MDNIRQLQEKKARGEKLTMLTAHDAALGALVDQAGVDLVLVGDSLGMVALGYDSTVPVTMDEMIHHARAVRRGVSGALLVGDMPFLSYQADKRGAIINAGRFLKEAGCAAVKMEGGAALAPTVEAVVAAGIPVLGHIGLTPQTAGQLGGFKVQGRDAASAARLRHDAEALAAAGVSAVVLECVPALLAREISAALAVPTIGIGAGPYCDGQVLVSHDLLGLFAGFTPKFAKRYVDLGQQAATALATFKKEVEAGEFPSASHSFGPLTEGNE

SEQ ID NO: 11064 - DNA, 798 bp, Oceanobacter sp. RED65
  CDS (1)..(798): transl_table=11
atgagcaaaaccacgattaacactctacacaaaatcaaacaaaaccaagagaaattctctgtggtcacagcctatgatgcgacttttgcaggacttgcgtctacgtctggcatagacgttctgctggttggtgattctttgggaatggtactgcaaggcaaagatagtaccgtacctgtcaccatggaagagatgtgttaccacacacaggctgtgaaaaacggcaatcaaggttcactactaatggtagacatgcccttcatgagctacgccacaccagagcaagcaatggctaatgcagctgagcttatgcaagcaggtgctgaaattctaaagctagagggtggtgcttggttagttgataccgtcgaaatgctgagtgaacgcggtgttccggtatgcgcacacttaggtttaacgccacagtatgttcacaagtttggtggttacaaggtacaaggtaaagaacaagcggcagcagaacaaatgttagccgacgccaaagctatggaagccgccggggctgatttaattctattggaatgcgtgccttccgaattagccaaaactctcaccgagagtatcaatattccagttatcggtattggtgcgggttcagataccacaggccaagtgttggtttgttacgacatgctaggaatgaattctggccatgtgcctaaattcgttaagaattttttaatagatggtcgcaacatccagcaagcttttgcggcattcgatcaagaagtcaaaagtggtgacttccctggaccggagcacggattcaaagcatga

SEQ ID NO: 11065 - protein, 265 aa, Oceanobacter sp. RED65
MSKTTINTLHKIKQNQEKFSVVTAYDATFAGLASTSGIDVLLVGDSLGMVLQGKDSTVPVTMEEMCYHTQAVKNGNQGSLLMVDMPFMSYATPEQAMANAAELMQAGAEILKLEGGAWLVDTVEMLSERGVPVCAHLGLTPQYVHKFGGYKVQGKEQAAAEQMLADAKAMEAAGADLILLECVPSELAKTLTESINIPVIGIGAGSDTTGQVLVCYDMLGMNSGHVPKFVKNFLIDGRNIQQAFAAFDQEVKSGDFPGPEHGFKA

SEQ ID NO: 11066 - DNA, 921 bp, Desulfitobacterium hafniense DCB-2
  CDS (1)..(921): transl_table=11
atgttttgtgtggttccttctgacaagggggaacttttttgttgctctgttttgtcttctctcctgaaaaaaggaggaaaaacgttgaaaacaacaaaagacttctgggtgatgaaaaatgagggaaaaaagattgtcatgattaccgcctacgattacccctcagccaagcaggccgaacaagcgggtgcggacataattctagtgggggattctctgggcaatgtggtgctgggctacgactctacggtttatgtcaccatggaagacatgatccatcatgggaaagcagctaagcgcggggctcccaatacgtttatcgtggcggacatgccttttatgagctgccatctgtccatcagggatactttgctcaatggagcaaggcttattcaggagacgggggcccaggctgtaaaggtggaaggtgcggatgaaatgatccctcatatcaaagctcttgtccgcgcggggatacctgtagtctctcatcttggtctgacacctcagactgctgcagttctcggtggttttaaagttcagggtaaagatggggaagccgcccgcaaaatgctggaggatgtgaaggaatgccaggaggcaggggcctttgccctggtcctggagtgtattcctaagcagctggcccaggaaatttctacgaccttgacaattcccaccattggcatcggcgcaggtgttcataccgatggacaagtgctcgtctaccatgacatactcacctatggggtgaaccgggctcccaagtttgtcaaagcttatgccaatgctgatcaactcatgctcaaaggattgcaggactatgcggatgaggtaagaagtatgaatttccccgatgatgagcacagctttaccatgaaggaagaggaattaaaaaccttgtatggaggcaggggctaa

SEQ ID NO: 11067 - protein, 306 aa, Desulfitobacterium hafniense DCB-2
MFCVVPSDKGELFCCSVLSSLLKKGGKTLKTTKDFWVMKNEGKKIVMITAYDYPSAKQAEQAGADIILVGDSLGNVVLGYDSTVYVTMEDMIHHGKAAKRGAPNTFIVADMPFMSCHLSIRDTLLNGARLIQETGAQAVKVEGADEMIPHIKALVRAGIPVVSHLGLTPQTAAVLGGFKVQGKDGEAARKMLEDVKECQEAGAFALVLECIPKQLAQEISTTLTIPTIGIGAGVHTDGQVLVYHDILTYGVNRAPKFVKAYANADQLMLKGLQDYADEVRSMNFPDDEHSFTMKEEELKTLYGGRG

SEQ ID NO: 11068 - DNA, 837 bp, Synechococcus sp. RS9916
  CDS (1)..(837): transl_table=11
atgcgccctgctgaactgatccgtttcaagcagtccggtcgcgcgatcacggtgttgaccgcctgggacagcctgtcggcctctctggtgcaggaggcgggggccgacgtggtgctggtgggtgattccctggcgatggtcgtgctgggccatgccaccaccctgccggtcaccctcgagcagatgctttcgcacacccaggcggtttgtcggggattccagggggcgctccatgcccagccccttgtggtggccgatctgccgttcctcagctaccagtgcggacccgagcgagcggtggccgcggcgggtttgctgctcaaggactcaggtgccgcggccgtcaagctggaaggggccgagccggaggtggtggctgtgatcgatcggctggtgcgcatgggaattccggtgatgggtcatctcggcctcaccccccaggcggtgcatcgcctcgggtaccgccgccaggcccaggatccccgcagccaggagaaactgaagcgtcaggcgctcgaccttgaggcggctggatgttttgccctggtgttggagcacatccccgcggagttggcggccgacctgcgcgcccagttgacgattccggtgatcgggattggtgccggtgccggttgtgacggccaggtgcgcgtgacggctgatctgctggggcttactccccagcaaccaccatttagccctgccttgatccagggccggcagctctgcgtggaggccctcaaaggttgggtgagccagcagcaggcgccgcaccttgcagctccgtcggcagttcctcccaccaacacaccagctccaccagcacctggttgctga

SEQ ID NO: 11069 - protein, 278 aa, Synechococcus sp. RS9916
MRPAELIRFKQSGRAITVLTAWDSLSASLVQEAGADVVLVGDSLAMVVLGHATTLPVTLEQMLSHTQAVCRGFQGALHAQPLVVADLPFLSYQCGPERAVAAAGLLLKDSGAAAVKLEGAEPEVVAVIDRLVRMGIPVMGHLGLTPQAVHRLGYRRQAQDPRSQEKLKRQALDLEAAGCFALVLEHIPAELAADLRAQLTIPVIGIGAGAGCDGQVRVTADLLGLTPQQPPFSPALIQGRQLCVEALKGWVSQQQAPHLAAPSAVPPTNTPAPPAPGC

SEQ ID NO: 11070 - DNA, 795 bp, Alteromonadales bacterium TW-7
  CDS (1)..(795): transl_table=11
atgtctaaaataaccgtttctactttaaataaaatgaaagcagaaaataacaaaatcacagcattaactgcttacgatgcaagctttgcaaagttatttcatgataatggcgttaacgttattttagtcggtgattcattaggtatggtgctgcaaggcggtgatgatacgcttggcgtaaccaaccaagatattgcttatcatacgcgctgtgtgcgagcaggaagccgtgaattatttgttattgctgacatgccatttatgacatattcaagcgttaacgacacgtgtaaaaatgccgcagaacttatgcgcgctggtgcaaacatggttaaacttgaaggtggcgaatggctttacgacagtattaaagcgcttactcaacaaggtattcctgtgtgtgggcacttaggccttacccctcaatctgtgcacgtatttggcggctttaaaatccaaggccgcgaagaagacaaagcacaaaaaatgattgatgatgcaaaagcactggaagccgctggcgcacaattattagtacttgagtgtatcccgagtgcattggcaaaacgtattactgatgcgcttagtattccaaccattggcattggtgctggtaatgtgaccgatggtcaaatattagtaatgcacgacctagtgggtatttcggcaggttatattccaaaattttcaaaaaactttttattagaaactggcaacatgccagcggccgttcaaaaatattgtaccgatgtaaaaagtggcgcttttccaagtgctgaacatgagtttaaataa

SEQ ID NO: 11071 - protein, 264 aa, Alteromonadales bacterium TW-7
MSKITVSTLNKMKAENNKITALTAYDASFAKLFHDNGVNVILVGDSLGMVLQGGDDTLGVTNQDIAYHTRCVRAGSRELFVIADMPFMTYSSVNDTCKNAAELMRAGANMVKLEGGEWLYDSIKALTQQGIPVCGHLGLTPQSVHVFGGFKIQGREEDKAQKMIDDAKALEAAGAQLLVLECIPSALAKRITDALSIPTIGIGAGNVTDGQILVMHDLVGISAGYIPKFSKNFLLETGNMPAAVQKYCTDVKSGAFPSAEHEFK

SEQ ID NO: 11072 - DNA, 795 bp, Marinobacter sp. ELB17
  CDS (1)..(795): transl_table=11
atggccgttaccatcaacacactgcgggaatacaaacagcgcggcgaagcattttccgcgctgacctcctacgatgccacctttgcccagctggtcagcgaagccggcgtagacgtcattctgattggagactcgcttggtatggtactgcaaggcaacgacagcaccttgcctgtcaccatggatcaaatggtgtaccacgtcagctgcgtcgccaaaggcaatcgcggctcgctggtgatggccgacatgccatttatgagctacggcacaaccgaagccgcgctggaaaacgcggcaaagctgatgcgtgccggcgcccacatggtcaaactggaaggcaccggctggatgcgagataccattcaggcgctcagcgaacgcggcgttccagtgtgcgcgcacttaggcctgacaccgcaattcgtcaacaagttcggcggctataaagtccaagggcgagacggaaaggcagcagacctgatggttgaacacgcctgcgagctggaagccgccggcgccgatgttattctgttggaatgcgtgcccgccgctctggctgcacgcattgcaaaagccgtcaaggcaccggtgatcggtattggcgccggcgccgacaccgacggccaagtgctggtggtacacgacatgcttggcatgacccctggccgcaaaccgcgctttgtgaaagactttctggctgaaaatggctctgttgccaacgccctggcagcctacgccaaagccgttagcgagcgtacattccccgcagaggagcacacgttcaaagcatga

SEQ ID NO: 11073 - protein, 264 aa, Marinobacter sp. ELB17
MAVTINTLREYKQRGEAFSALTSYDATFAQLVSEAGVDVILIGDSLGMVLQGNDSTLPVTMDQMVYHVSCVAKGNRGSLVMADMPFMSYGTTEAALENAAKLMRAGAHMVKLEGTGWMRDTIQALSERGVPVCAHLGLTPQFVNKFGGYKVQGRDGKAADLMVEHACELEAAGADVILLECVPAALAARIAKAVKAPVIGIGAGADTDGQVLVVHDMLGMTPGRKPRFVKDFLAENGSVANALAAYAKAVSERTFPAEEHTFKA

SEQ ID NO: 11074 - DNA, 837 bp, Bacillus sp. SG-1
  CDS (1)..(837): transl_table=11
atgaaaaaaacatccgattttatcaaaatgaagaaagaaaatgaaaaaatttcgatggtgaccgcatatgattatccctctgccaaacttgctgaacaagccggtctggatatgattttggtgggagactccttaggcatggtcgttttggggtatgactctaccgttgcggttacacttgaggatatgattcatcatacaaaggccgtcaagagaggggcgcctgattcttttattgtaacggatatgccatttatgacgtaccacctctcaaagcgcgatacgctgcaggcagccatggaaatcgtccaaaaaagcggtgcgcatgcacttaaagttgaaggcggcggcaacgtaatcgacactattgcagatttgacaacggcaggtattccggttgtcgcacatcttggattgacacctcagtctgttggagtgctgggaggatataaagtccaggggaaaacagcagaggcagcggcaaagctgattgaagaggctaaacgctgcgaagaagccggtgcatttgcacttgtggtggaatgcattccgcgtcagcttgcggcagaagtcaccaagagtgtcaacatcccgattatcggtatcggtgccggaagtgagacagatggccaggtccttgttttccacgatatcatgacctatggggtcgagagaataccgaagtttgtaaaaaaatacggtgattttaatgaaatagctctggcagggctccaacattatcatagcgaggtcaaagcgggaagttttccggaggtgggtcacacattcaccatgaaagaagaagaacttcattcgttgtatggaggaactaaataa

SEQ ID NO: 11075 - protein, 278 aa, Bacillus sp. SG-1
MKKTSDFIKMKKENEKISMVTAYDYPSAKLAEQAGLDMILVGDSLGMVVLGYDSTVAVTLEDMIHHTKAVKRGAPDSFIVTDMPFMTYHLSKRDTLQAAMEIVQKSGAHALKVEGGGNVIDTIADLTTAGIPVVAHLGLTPQSVGVLGGYKVQGKTAEAAAKLIEEAKRCEEAGAFALVVECIPRQLAAEVTKSVNIPIIGIGAGSETDGQVLVFHDIMTYGVERIPKFVKKYGDFNEIALAGLQHYHSEVKAGSFPEVGHTFTMKEEELHSLYGGTK

SEQ ID NO: 11076 - DNA, 876 bp, Erythrobacter sp. SD-21
  CDS (1)..(876): transl_table=11
atgtcgactacattccagctcgatacgagcaccagccgcgccaatcccaccccccagccgatgaagcggctgaccgtccccaaaatccgcgcgcacaaggcggatggcgagacgaaggacccgctggtcatgctgaccgcctacacggcgcggcaggcgcaactgctcgacgcacattgcgacatgctgctggtcggggattcgctgggccaggtgatttacggcctgccctccaccatccccgtgacgctggagatgatgtcgaaccacgccgctgccgtagtgcgcggcagctatcactcggtggtgatcgtcgacatgcccttcggctcctacgaggcgtcgaaggaacaagccttcgaaaacgccgcgcgcctgctcaaggaaagcggcgcggctgccgtcaagctggaaggcggggagcagatggccgaaacggtcgccttcctgaatcagcgcggtatcccggtgatgggccatgtcggcctgaccccgcaggcggtcaacgtgcttggcggttacatggcgcgcggacgcagcgatgcggaagcggaaaagatcgtcggcgatgcaaaggcgctggacgaggccggggccttcgcaatcgtgctcgaaggggtgctcgaacccatcgccatcgaggcgaccaaggccgtgtcctgccccaccatcggcatcggcgcttcggcccagtgcgacgggcaggtgctggtcaccgaggacatgctcggcatgttcgaacgcgtgccgcgcttcgtaaagaaatacgagaatatcgccgaggtcatatccagcaccgtcggcaaatatgccgaggaagtgcgcagccgcagcttcccgactcgcgaccagacttaccagccgaagaaaggctga

SEQ ID NO: 11077 - protein, 291 aa, Erythrobacter sp. SD-21
MSTTFQLDTSTSRANPTPQPMKRLTVPKIRAHKADGETKDPLVMLTAYTARQAQLLDAHCDMLLVGDSLGQVIYGLPSTIPVTLEMMSNHAAAVVRGSYHSVVIVDMPFGSYEASKEQAFENAARLLKESGAAAVKLEGGEQMAETVAFLNQRGIPVMGHVGLTPQAVNVLGGYMARGRSDAEAEKIVGDAKALDEAGAFAIVLEGVLEPIAIEATKAVSCPTIGIGASAQCDGQVLVTEDMLGMFERVPRFVKKYENIAEVISSTVGKYAEEVRSRSFPTRDQTYQPKKG

SEQ ID NO: 11078 - DNA, 795 bp, Moritella sp. PE36
  CDS (1)..(795): transl_table=11
atgagcaaggttaccgtatctaaactgcttaagatgaaagaagcaggacaaaaatttgccagtattaccgcgtatgacgcgagttttgcggcattatttgatgaagtcggcatgcctgtattattagtcggcgactcgatgggcatggtattacaaggccataatgatacgttacctgtcacagtaacagatattgcttatcatacccgctgtgtgcgtgcaggggcgacaaattcactggttatcgctgatatgccattcatgagttatgccactaaagagcagacgttaaccaatgcggccaccctgatgcaagccggtgccaatatgataaaagttgaaggtggcgaatggttagtagaaagtgttgcagcattaactgaacgtggcattccagtatgtggccaccttggtttaacaccgcagtctgtacacgtctttggcgggtttaaaatacaaggccgcgcacaagataaagccgatgaaatggtcgagcatgcgctgtcattacaggccgcgggtatccaactgttagttgtagaatgtatccctgcaccactggcaaaacgcatcactgaagccttaacgatcccagtgattggtattggcgctggtcgtgatactgatggtcaaatcttagtgatgcatgatgcattcggtatttcaaaaggttttgtacctaaattctcaaagaatttcttagccgaaaccggtgatatgcgcaaagcaattagcgcttatatcgatgaagttgccgcacagacgttccctgccgatgagcacatgttttcataa

SEQ ID NO: 11079 - protein, 264 aa, Moritella sp. PE36
MSKVTVSKLLKMKEAGQKFASITAYDASFAALFDEVGMPVLLVGDSMGMVLQGHNDTLPVTVTDIAYHTRCVRAGATNSLVIADMPFMSYATKEQTLTNAATLMQAGANMIKVEGGEWLVESVAALTERGIPVCGHLGLTPQSVHVFGGFKIQGRAQDKADEMVEHALSLQAAGIQLLVVECIPAPLAKRITEALTIPVIGIGAGRDTDGQILVMHDAFGISKGFVPKFSKNFLAETGDMRKAISAYIDEVAAQTFPADEHMFS

SEQ ID NO: 11080 - DNA, 834 bp, Moritella sp. PE36
  CDS (1)..(834): transl_table=11
atgagtacccatacttcaaataataaaataacgacaaccaagatccagagtatgaaaggtaagggaagtatcgtgtctcttactgcatacacaaagcctatggctcaaatgatggatcaatttgttgacttgattatcgtaggtgattctacaggtatggtggcatatggtttcgattcaactttacctgttactttggatatgatgattgctcatggggctgcggttgtaagaggtgctgagcgagcatgcgtggtgatcgatatgccatttgctacttaccaagagtctaaagaaatcgcttatagaaatgcatcaaaagttttaatcgagacaggagcacaggcaataaagattgaaggtggattagaaatggttgaaaccgttcagtttcttgtaaaacgaggtattcctgttatgcctcatattgggttacgaccacagcatgcaaatactctgggtggttttaaggctcagggtcgagatgatgcagctgcaaatctgcttgtgcaagaagcaaaagagtttgaaaatgccggtgctttctcattacttgtggaaggtgtatttgaaaatgcagcgaaaagagtaaccaatgcaattaaaattccaacgataggaattggtgcttcacctgaatgcgacggtcaagtgctagttacagaggatattctgggtttgttttctgactacactccaaaatttgcgaagaaatacattgatttaagtatcacaatcaaagaggtttttgctgagtacgaaagagaggttagaggcggcgacttcccaactgcagagcattttttcggggttaaagttgaacataacaaatga

SEQ ID NO: 11081 - protein, 277 aa, Moritella sp. PE36
MSTHTSNNKITTTKIQSMKGKGSIVSLTAYTKPMAQMMDQFVDLIIVGDSTGMVAYGFDSTLPVTLDMMIAHGAAVVRGAERACVVIDMPFATYQESKEIAYRNASKVLIETGAQAIKIEGGLEMVETVQFLVKRGIPVMPHIGLRPQHANTLGGFKAQGRDDAAANLLVQEAKEFENAGAFSLLVEGVFENAAKRVTNAIKIPTIGIGASPECDGQVLVTEDILGLFSDYTPKFAKKYIDLSITIKEVFAEYEREVRGGDFPTAEHFFGVKVEHNK

SEQ ID NO: 11082 - DNA, 819 bp, Opitutaceae bacterium TAV2
  CDS (1)..(819): transl_table=11
atggcaccttccatgaaatccgtactcgatttcactgctcgcaaggggggctccccgatcacgatgtccacggcttacacccattgggaagcccgtctgctcgccgattcaccggtcgattgcgtgctggtcggagacagcgtggcaaccgtggttgacggcgagggcagcacatttgccgccacgcctgaaatcatcgcacgccacacggcggcggttgcgcgcgggttgggagggacgaaatttctcatcgccgacttcccttttctcgccgcctgcaaaggcatcccggcggcggtggagtgcgccgctctgctgatgcgcgccggcgctcatgcggtaaaaatcgaggggatcgatggtcacgaagacgttgtccgccacctcgtgcaatccggcgtcccggtcgtcggtcacatcggactgacacctcaatccgtcaacgccatgggcggctacaaagtgcagggacgcggcgccgatgccgccgccagtctgctgcgtcaggcccgcgcattcgaggctgcgggcgcatgtggcattgtggtcgagtgcgtgcccgccgcgctcggcaaggagctgaccgaaacaacaaaaatccccgtcatcggcatcggagccggaccggacaccgacgggcaggtgctggtgtttcacgacatgcttggcctcacgcccgacaccgggcccggcttcaacagacccagatttgtccgcgtattcgcgcaggcaggacaggccgcgcgcgagggccttgccgcctacgtcgccgccgttgccagccgggagtttcccaatgagaaggaaagttaccgctga

SEQ ID NO: 11083 - protein, 272 aa, Opitutaceae bacterium TAV2
MAPSMKSVLDFTARKGGSPITMSTAYTHWEARLLADSPVDCVLVGDSVATVVDGEGSTFAATPEIIARHTAAVARGLGGTKFLIADFPFLAACKGIPAAVECAALLMRAGAHAVKIEGIDGHEDVVRHLVQSGVPVVGHIGLTPQSVNAMGGYKVQGRGADAAASLLRQARAFEAAGACGIVVECVPAALGKELTETTKIPVIGIGAGPDTDGQVLVFHDMLGLTPDTGPGFNRPRFVRVFAQAGQAAREGLAAYVAAVASREFPNEKESYR

SEQ ID NO: 11084 - DNA, 786 bp, Rickettsiella grylli
  CDS (1)..(786): transl_table=11
atgaacgttttagaatttgtaaagaaaaaaataattcaagagaaaatcgtaattttaacgtgttacgattatagttccgccaaaatccttaatagttcttccttagatgcgttattagtgggtgatagtctcgctatgacgatgcatggctttaaaaatacggtgatggctacagtgcctatgatggaacttcatacggcggcagtggctcggggagcgccttcaaagtttattattagtgatcttccttttttaagttaccgtttgtcgatgaatcgcaatgttataacggcacaaaaattaatacgagcaggtgcatcggcagttaagttagaaggttcggcaggaaatctttccctcataacgcatttagttgaatcaggcattccagtgatgggtcatatcggcttaacacctcaatttattcattgtttaggaggatataaagttcaaggaaaaacctttgctcagtcagaacggcttaaacaggaggccatcgctttagaacaagcgggttgttttgctttagtgcttgaatgtgttccctcacaacttgcaaaagagataacggcgtctttaaaaattgcaacaataggtatcggtgcaggtgttgataccgatgggcaagttttagttctgcaagatttattgggactcaatttggatttcaaaccaaaatttgtccacccatttcttgacggtaaacaattgtttttagatgccgttaatcaatatagtgattcggttaaatataaagaatttcctaagcatgaacatagttactaa

SEQ ID NO: 11085 - protein, 261 aa, Rickettsiella grylli
MNVLEFVKKKIIQEKIVILTCYDYSSAKILNSSSLDALLVGDSLAMTMHGFKNTVMATVPMMELHTAAVARGAPSKFIISDLPFLSYRLSMNRNVITAQKLIRAGASAVKLEGSAGNLSLITHLVESGIPVMGHIGLTPQFIHCLGGYKVQGKTFAQSERLKQEAIALEQAGCFALVLECVPSQLAKEITASLKIATIGIGAGVDTDGQVLVLQDLLGLNLDFKPKFVHPFLDGKQLFLDAVNQYSDSVKYKEFPKHEHSY

SEQ ID NO: 11086 - DNA, 807 bp, Gemmata obscuriglobus UQM 2246
  CDS (1)..(807): transl_table=11
atgagcgttgttccctctccgcggccgatcacggcccccgagttccgcgccgcgaaagcccggggcgcgaagctcgcggtcgtgaccgcctacgactacacctcggcccggctctgcgacgaggccggcgtcgactgtatcctcgtgggcgactcggtggggatggtggtgcagggccatccgacctcgctcccggtcacgctcgacgagatgatctaccacaccaagtgcgtgatgcggggcgcccggcgggcgctggtcgtcgcggacctcccgttcatgacgtaccaggtgagcccgcgccaggcggtccggaacgccggccggctgatgaaggaggccggcgcccacgcggtgaagctcgaggggggcgtgcgggcgcgcgacgccatccgcgcgtgcgtggacgcgggcatcccggtaatgggacacgtcgggctgacaccgcaatcggtccaccagatgggcgggttcaaggtccagcgcgacacggagcagctcttggcggacgcactggcggtcgaagcggcgggcgcgttctcggtggtcgtggaaggcgtgcccgcggacctgggcgcgaagatcacgggcacggtcggcatccccaccgtcgggatcggggccggcgccgggtgcgacggtcaggtgctggtgttccacgacatgatggggctgtaccccgacttcaagccgaaattcgcgaagcggtacgccgacctgggcgcggcgatcaaggccgcgacggagcagtactgccgcgaggtccgcgagggggcgttcccggccgcggagcacacgttccggtga

SEQ ID NO: 11087 - protein, 268 aa, Gemmata obscuriglobus UQM 2246
MSVVPSPRPITAPEFRAAKARGAKLAVVTAYDYTSARLCDEAGVDCILVGDSVGMVVQGHPTSLPVTLDEMIYHTKCVMRGARRALVVADLPFMTYQVSPRQAVRNAGRLMKEAGAHAVKLEGGVRARDAIRACVDAGIPVMGHVGLTPQSVHQMGGFKVQRDTEQLLADALAVEAAGAFSVVVEGVPADLGAKITGTVGIPTVGIGAGAGCDGQVLVFHDMMGLYPDFKPKFAKRYADLGAAIKAATEQYCREVREGAFPAAEHTFR

SEQ ID NO: 11088 - DNA, 816 bp, Thauera sp. MZ1T
  CDS (1)..(816): transl_table=11
atgagctatctccaggaccagaagcccgtcaccctcttcgaactcggcaagatgcgcgccgaagggcgcaagatcgcgatgctcaccgcctatgacgcgagcttcgccgcgctcctcggccgcgccggcgtcgattccatcctgatcggcgactcgctcggcaacgtcctgcagggacagaaatccaccctgccggtcaccctcgagcagatggcctaccacaccgaatgcgtggcccgtgccggggcgcgccccttcgtcgtcaccgacatgcccttcggcagctaccacgagagccgcgagcaggccatgcgcaacgccgcccgcctgatggccgccggggcgcagatggtcaagctcgaaggcggcgagttcatggccgagaccgtgcgcttcctcgtcgagcgcggcgtgccggtgtgcgcgcacatcggcctcaccccgcaggcggtgcatcagctcggcggctatcgcgtgcagggccgcagcgaggaaggcgcggcgcgcctcaaggccgacgcgctcgtgctcgagcaggccggcgccgcactgatggtcatggaaatggtgcccgccacgctcgccggcgagatcaccgccagcctctccagcatggcgacgatcggcatcggcgcaggcgccgcctgcgacggccaggtgctggtgctgcacgacctgctcggcgtgttccccggcaagacggcgcgcttcgtgcgcaacttcatggaaggcgcggcgagcatcgaggaagcggttgcgcgctacgcggccgcggtcaaggacggcagcttccccgctcccgagcactgttactga

SEQ ID NO: 11089 - protein, 271 aa, Thauera sp. MZ1T
MSYLQDQKPVTLFELGKMRAEGRKIAMLTAYDASFAALLGRAGVDSILIGDSLGNVLQGQKSTLPVTLEQMAYHTECVARAGARPFVVTDMPFGSYHESREQAMRNAARLMAAGAQMVKLEGGEFMAETVRFLVERGVPVCAHIGLTPQAVHQLGGYRVQGRSEEGAARLKADALVLEQAGAALMVMEMVPATLAGEITASLSSMATIGIGAGAACDGQVLVLHDLLGVFPGKTARFVRNFMEGAASIEEAVARYAAAVKDGSFPAPEHCY

SEQ ID NO: 11090 - DNA, 1101 bp, Oryza sativa subsp
  CDS (1)..(1101)
atgatgatgatgatgcggcgggcgttccggcacctggcgcggcagcagcggcggccgctgagccacgtgccggagtcggccgtctacggcgggccgcggccgcaggatgtgggggcggcggcgggagcgggggcgggggcgggggcgggggcggcgcggcgggtgacggtgacgacgctccgcgggaagcaccgacgcggggagcccatcaccgtcgtcacggcctacgactacccgtccgcggtgcacgtcgactcggccgggatcgacgtctgcctcgtcggggactcggcggccatggtggtgcacggccacgacaccacgctccccatctcgctcgacgtcatgctcgagcactgccgcgccgtcgcccgcggcgccaccaggccgctcctcgtcggcgacctccccttcggttgctatgagtcctcctccacgcgggctgttgactctgcggtgagggtgctaaaagaaggtggaatggacgcaatcaagctggaaggaggtgcaccctcgagaatcagtgcggctaaggctattgtggaggctggaatcgctgtaatggggcatgttgggctcacgccgcaggctattagcgtgcttggtggatttcgaccacaagggaagacggttgatagtgctgtgaaggttgtggagacagcacttgccttgcaggaggctggctgcttctcggttgtgttggagtgtgtgccagctcctgtggcagctgctgcaacatcagcattgcaaatcccaaccattggaattggtgctggaccattctgcagtggacaggtcttagtttaccatgacttgttagggatgatgcaacatccacaccatgccaaggtcacaccgaaattctgcaaacaatttggaaatgtcggccatgtcatcaacaaggctctatcggagtacaagcaggaagtggaaacccggagtttcccaggtcccagccatacgccatacaagatagctgccgcggatgtggatggcttcgcgaatgcactgcagaagatgggcttggacgaggctgcaaatgctgcagctgccgcagctgaaaacgcagagaaagatggagaactacccgagaacaaatga

SEQ ID NO: 11091 - protein, 366 aa, Oryza sativa subsp
MMMMMRRAFRHLARQQRRPLSHVPESAVYGGPRPQDVGAAAGAGAGAGAGAARRVTVTTLRGKHRRGEPITVVTAYDYPSAVHVDSAGIDVCLVGDSAAMVVHGHDTTLPISLDVMLEHCRAVARGATRPLLVGDLPFGCYESSSTRAVDSAVRVLKEGGMDAIKLEGGAPSRISAAKAIVEAGIAVMGHVGLTPQAISVLGGFRPQGKTVDSAVKVVETALALQEAGCFSVVLECVPAPVAAAATSALQIPTIGIGAGPFCSGQVLVYHDLLGMMQHPHHAKVTPKFCKQFGNVGHVINKALSEYKQEVETRSFPGPSHTPYKIAAADVDGFANALQKMGLDEAANAAAAAAENAEKDGELPENK

SEQ ID NO: 11092 - DNA, 834 bp, Bacillus subtilis
  CDS (1)..(834): transl_table=11
atgaaaacaaaactcgattttctaaaaatgaaggagaatgaagaaccgattgtgatgctgaccgcttatgattatccggcagctaagcttgctgaacaagcgggagttgacatgattttagtcggtgattcactcggaatggtcgtcctcggccttgattcaactgtcggtgtgacagttgcggacatgatccatcatacaaaagctgttaaaaggggcgcgcagaatacttttattgtgacagacatgccgtttatgtcttatcacctgtccaaggaggatacgctgaaaaatgcagcagttatcgttcaggaaagcggagctgacgcactgaagcttgagggcggagaaggcgtgtttgaatccattcgcgcattgacgctaggaggcattccggtagtcagtcacttaggcctgacaccgcagtcagtcggtgtattaggcgggtataaagtacagggcaaagacgaacaaagcgccaaaaaattaatagaagatagtataaaatgcgaagaagcaggagctatgatgcttgtgctggaatgtgtgcctgcagaactcacagccaaaattgccgagatgctaagcataccggtcatcggaatcggggctggtgtgaaagcagacgggcaagttctcgtttatcatgatattatcggccatggtgttgagagaacacctaaatttgtaaaacaatatacgcaaattgacgaaacaatcgaaacagcaatcagcggatatgtccaggatgtaagacatcgtgctttccctgagcaaaagcattcctttcagatgaatcagacagtgctggacggcttgtacggaggaaaataa

SEQ ID NO: 11093 - protein, 277 aa, Bacillus subtilis
MKTKLDFLKMKENEEPIVMLTAYDYPAAKLAEQAGVDMILVGDSLGMVVLGLDSTVGVTVADMIHHTKAVKRGAQNTFIVTDMPFMSYHLSKEDTLKNAAVIVQESGADALKLEGGEGVFESIRALTLGGIPVVSHLGLTPQSVGVLGGYKVQGKDEQSAKKLIEDSIKCEEAGAMMLVLECVPAELTAKIAEMLSIPVIGIGAGVKADGQVLVYHDIIGHGVERTPKFVKQYTQIDETIETAISGYVQDVRHRAFPEQKHSFQMNQTVLDGLYGGK

SEQ ID NO: 11094 - DNA, 834 bp, Bacillus subtilis
  CDS (1)..(834): transl_table=11
  misc_feature (274)..(274): n is a, g, c or t
  misc_feature (384)..(384): n is a, g, c or t
  misc_feature (571)..(571): n is a, g, c or t
atgaaaacaaaactcgattttctaaaaatgaaggagaatgaagaaccgattgtgatgctgaccgcttatgattatccggcagctaagcttgctgaacaagcgggagttgacatgattttagtcggtgattcactcggaatggtcgtcctcggccttgattcaactgtcggtgtgacagttgcggacatgatccatcatacaaaagctgttaaaaggggcgcgcagaatacttttattgtgacagacatgccgtttatgtcttatcacctgtccnaggaggatacgctgaaaaatgcagcagttatcgttcaggaaagcggagctgacgcactgaagcttgagggcggagaaggcgtgtttgaatccattcgcgcattgacgctnggaggcattccggtagtcagtcacttaggcctgacaccgcagtcagtcggtgtattaggcgggtataaagtacagggcaaagacgaacaaagcgccaaaaaattaatagaagatagtataaaatgcgaagaagcaggagctatgatgcttgtgctggaatgtgtgcctgcagaactcacagccaaanttgccgagatgctaagcataccggtcatcggaatcggggctggtgtgaaagcagacgggcaagttctcgtttatcatgatattatcggccatggtgttgagagaacacctaaatttgtaaaacaatatacgcaaattgacgaaacaatcgaaacagcaatcagcggatatgtccaggatgtaagacatcgtgctttccctgagcaaaagcattcctttcagatgaatcagacagtgctggacggcttgtacggaggaaaataa

SEQ ID NO: 11095 - protein, 277 aa, Bacillus subtilis
  misc_feature (92)..(92): The Xaa at location 92 stands for Stop, Gln, Glu, or Lys.
  misc_feature (191)..(191): The Xaa at location 191 stands for Ile, Leu, Phe, or Val.
MKTKLDFLKMKENEEPIVMLTAYDYPAAKLAEQAGVDMILVGDSLGMVVLGLDSTVGVTVADMIHHTKAVKRGAQNTFIVTDMPFMSYHLSXEDTLKNAAVIVQESGADALKLEGGEGVFESIRALTLGGIPVVSHLGLTPQSVGVLGGYKVQGKDEQSAKKLIEDSIKCEEAGAMMLVLECVPAELTAKXAEMLSIPVIGIGAGVKADGQVLVYHDIIGHGVERTPKFVKQYTQIDETIETAISGYVQDVRHRAFPEQKHSFQMNQTVLDGLYGGK

SEQ ID NO: 11096 - DNA, 834 bp, Bacillus subtilis
  CDS (1)..(834): transl_table=11
atgaaaacaaaactcgattttctaaaaatgaaggagaatgaagaaccgattgtgatgctgaccgcttatgattatccggcagctaagcttgctgaacaagcgggagttgacatgattttagtcggtgattcactcggaatggtcgtcctcggccttgattcaactgtcggtgtgacagttgcggacatgatccatcatacaaaagctgttaaaaggggcgcgcagaatacttttattgtgacagacatgccgtttatgtcttatcacctgtccaaggaggatacgctgaaaaatgcagcagttatcgttcaggaaagcggagctgacgcactgaagcttgagggcggagaaggcgtgtttgaatccattcgcgcattgacgcttggaggcattccagtagtcagtcacttaggtttgacaccgcagtcagtcggcgtactgggcggctataaagtacagggcaaagacgaacaaagcgccaaaaaattaatagaagacagtataaaatgcgaagaagcaggagctatgatgcttgtgctggaatgtgtgccggcagaactcacagccaaaattgccgagacgctaagcataccggtcattggaatcggggctggtgtgaaagcggacggacaagttctcgtttatcatgatattatcggccacggtgttgagagaacaactaaatttgtaaagcaatatacgcgcattgatgaaaccatcgaaacagcaatcagcggatatgttcaggatgtaagacatcgtgctttccctgaacaaaagcattcctttcaaatgaaccagacagtgcttgacggcttgtacgggggaaaataa

SEQ ID NO: 11097 - protein, 277 aa, Bacillus subtilis
MKTKLDFLKMKENEEPIVMLTAYDYPAAKLAEQAGVDMILVGDSLGMVVLGLDSTVGVTVADMIHHTKAVKRGAQNTFIVTDMPFMSYHLSKEDTLKNAAVIVQESGADALKLEGGEGVFESIRALTLGGIPVVSHLGLTPQSVGVLGGYKVQGKDEQSAKKLIEDSIKCEEAGAMMLVLECVPAELTAKIAETLSIPVIGIGAGVKADGQVLVYHDIIGHGVERTTKFVKQYTRIDETIETAISGYVQDVRHRAFPEQKHSFQMNQTVLDGLYGGK

SEQ ID NO: 11098 - DNA, 834 bp, Bacillus subtilis
  CDS (1)..(834): transl_table=11
atgaaaacaaaactcgattttctaaaaatgaaggagaatgaagaaccgattgtgatgctgaccgcttatgattatccggcagctaagcttgctgaacaagcgggagttgacatgattttagtcggtgattcactcggaatggtcgtcctcggccttgattcaactgtcggtgtgacagttgcggacatgatccatcatacaaaagctgttaaaaggggcgcgcagaatacttttattgtgacagacatgccgtttatgtcttatcacctgtccaaggaggatacgctgaaaaatgcagcagttatcgttcaggaaagcggagctgacgcactgaagcttgagggcggagaaggcgtgtttgaatccattcgcgcattgacgcttggaggcattccagtagtcagtcacttaggtttgacaccgcagtcagtcggcgtactgggcggctataaagtacagggcaaagacgaacaaagcgccaaaaaattaatagaagacagtataaaatgcgaagaagcaggagctatgatgcttgtgctggaatgtgtgccggcagaactcacagccaaaattgccgagacgctaagcataccggtcattggaatcggggctggtgtgaaagcggacggacaagttctcgtttatcatgatattatcggccacggtgttgagagaacacctaaatttgtaaagcaatatacgcgcattgatgaaaccatcgaaacagcaatcagcggatatgttcaggatgtaagacatcgtgctttccctgaacaaaagcattcctttcaaatgaaccagacagtgcttgacggcttgtacgggggaaaataa

SEQ ID NO: 11099 - protein, 277 aa, Bacillus subtilis
MKTKLDFLKMKENEEPIVMLTAYDYPAAKLAEQAGVDMILVGDSLGMVVLGLDSTVGVTVADMIHHTKAVKRGAQNTFIVTDMPFMSYHLSKEDTLKNAAVIVQESGADALKLEGGEGVFESIRALTLGGIPVVSHLGLTPQSVGVLGGYKVQGKDEQSAKKLIEDSIKCEEAGAMMLVLECVPAELTAKIAETLSIPVIGIGAGVKADGQVLVYHDIIGHGVERTPKFVKQYTRIDETIETAISGYVQDVRHRAFPEQKHSFQMNQTVLDGLYGGK

SEQ ID NO: 11100 - DNA, 939 bp, Pichia stipitis
  CDS (1)..(939): transl_table=12
atgtcttccagagtccaaatcttcagaagaacattcagcctgagtgtttctgccaaatcctcctacactggcacagctagaaagactgtggccgatatcaacaggttctatgctagctccaagccaattaccgtcgtaacagcacacgacttcataaccgccaagatggttgatcatgccggtatcgacatttgtttgataggagactctcttgccaatactacgttggggcttgatgacactaacgagttggagtttcaagagatgctttatcacgtgaagtcagtccaaagaggtaatgattcgtctttgatcgtggccgatttaccatttggctcgtacgagaagtcctcggaacaagccttggatacggccatgactattatcaagcacggtaagattcaaggtgtcaaggtcgaaggaggagatgaattcatcttgccaacggtaaaccggttgaccacggtcggaattcctgtaatgggccatgttggacttactccccaaaaacacaacgctcttggaggctacaggcttcaggggaactctgttgaaaatgctgtcagtatatacaagcagtgtcttgacctccaacgagctggtgttttttccattgtgctagagtgtattcccaacaaattggctcagtacatcactgaaaacttgagcgttccgaccattggtattggtgccggtccatttacttccgggcaagttctcgtgatctctgacattctcggaatgaagagtaataaagagaaccacaagcccaagtttgtccgtgcctacgaggacttttataccaaaggagttgaggcgttgaccagctacggtgaacatgtagagaacgctcaatttcctgacgtagatgagcacggttacaagatcaagagagatgtatttgaagagttcaagaaacaggcccaccacatccattag

SEQ ID NO: 11101 - protein, 312 aa, Pichia stipitis
MSSRVQIFRRTFSLSVSAKSSYTGTARKTVADINRFYASSKPITVVTAHDFITAKMVDHAGIDICLIGDSLANTTLGLDDTNELEFQEMLYHVKSVQRGNDSSLIVADLPFGSYEKSSEQALDTAMTIIKHGKIQGVKVEGGDEFILPTVNRLTTVGIPVMGHVGLTPQKHNALGGYRLQGNSVENAVSIYKQCLDLQRAGVFSIVLECIPNKLAQYITENLSVPTIGIGAGPFTSGQVLVISDILGMKSNKENHKPKFVRAYEDFYTKGVEALTSYGEHVENAQFPDVDEHGYKIKRDVFEEFKKQAHHIH

SEQ ID NO: 11102 - DNA, 861 bp, Magnetospirillum gryphiswaldense
  CDS (1)..(861): transl_table=11
atggcccgcctgctgttggaggatccgttgagcgccgaagtcaaagtcaaacgcgtcaccactcgcgacatccgtgcccgcaagggcggcgaccccgtggtggtgctgaccgcttataccgcccccatcgcccgcctgcttgatccccatgtggacgttttgctggtgggcgattcggtcggtatggtgctttacggcatggacaccaccttgggcgtcaccgtggacatgatgatcaatcatggacaggcggtaatgcgcggctcggccagggcttgcgtggtggtcgacatgccgttcggatcgtatcaggaaagcaaggaacaggctttccgcaacgccgcgcgcatcatgagtgaaaccggctgtgccgccgtcaagctggaaggcggtcgtgaaatggccgaaaccatccgcttcttgaccgagcgctgcattccggtgatggcccatatcggcctgaagccgcaggcggtgcacgccgccggcggattccgcgcccagggccgcatcgaggccgaagccgaacagatccgcgacgatgcccgcgccatcaccgaggccggtgccttctgcgtggtggtcgaaggcacggtcgagccggtggcccgggcgctgtcggcggaaatcggcattcccaccatcggcatcggcgcctcgcccgcctgcgacggtcaggtgctggtgaccgaagacgtattggggctgttttccgatttcacccctaaattcgtcaagcgttacgctgatctgtccacgccgatcagcgaagcggcggcgcgttatgccgccgaggtcaagtcccgcgcctttccgggccccgaacattgtttcggtctgcccaagacgcccaaagcatag

SEQ ID NO: 11103 - protein, 286 aa, Magnetospirillum gryphiswaldense
MARLLLEDPLSAEVKVKRVTTRDIRARKGGDPVVVLTAYTAPIARLLDPHVDVLLVGDSVGMVLYGMDTTLGVTVDMMINHGQAVMRGSARACVVVDMPFGSYQESKEQAFRNAARIMSETGCAAVKLEGGREMAETIRFLTERCIPVMAHIGLKPQAVHAAGGFRAQGRIEAEAEQIRDDARAITEAGAFCVVVEGTVEPVARALSAEIGIPTIGIGASPACDGQVLVTEDVLGLFSDFTPKFVKRYADLSTPISEAAARYAAEVKSRAFPGPEHCFGLPKTPKA

SEQ ID NO: 11104 - DNA, 795 bp, Vibrio sp
  CDS (1)..(795)
atgaaaaaaatgaccatcaacgacctaatcaagtggaagcaagaaggtcgtaaatttgctacttcaaccgcttatgatgcgagctttgcccaactgtttgaaagccaagaaatgccagtacttcttgttggtgattctctaggtatggttttgcaaggtcacaacgatactctgccagtaacggtcgatgatatcgcttaccatactcgttgcgtacgcgcaggtagcccaaattgtttgttgatggctgacatgccattcatgagctacaccacgccagagcaagcttgcgaaaatgcggctacactgatgcgtgctggtgccaatatggtgaaaattgaaggtggtgactggctagtcgacactgtaaaaatgctcactgaacgctcggttccagtttgtgctcaccttggtttaactcctcaagccgtgaatatttttggtggttacaaagttcaaggtcgcgatcaagaaaaagcggaccgcatggtgaaagatgcgttagcactgcaagaagcaggcgctcaaatcgtcttactagagtgcgtgcctgctgagcttgctgagcgtattacgcaagtgctcgacgtgcctgttatcggtattggagctggtaacgtgacagatggtcaaattctcgtgatgcatgatatgttcggtatctctgccaactacatgccgaaattctccaaaaactttcttgctgaaacaggtgatatgcgcaaagccgttgctaaatacattgaagatgtagccaacggtgtattcccagacgacgctcataccattgcctag

SEQ ID NO: 11105 - protein, 264 aa, Vibrio sp
MKKMTINDLIKWKQEGRKFATSTAYDASFAQLFESQEMPVLLVGDSLGMVLQGHNDTLPVTVDDIAYHTRCVRAGSPNCLLMADMPFMSYTTPEQACENAATLMRAGANMVKIEGGDWLVDTVKMLTERSVPVCAHLGLTPQAVNIFGGYKVQGRDQEKADRMVKDALALQEAGAQIVLLECVPAELAERITQVLDVPVIGIGAGNVTDGQILVMHDMFGISANYMPKFSKNFLAETGDMRKAVAKYIEDVANGVFPDDAHTIA

SEQ ID NO: 11106 - DNA, 801 bp, Pseudomonas putida
  CDS (1)..(801): transl_table=11
atgcctgaagtaaccctgaccaccctgcacggccgtaaggccaagggtgagaaaatcaccatgctgacctgctacgacgcgaccttcgccaaggtcgccagccaggccggtgtggacgtactgctggtgggtgactcgctgggcatggtcctgcaaggtcacgacagcaccctgccggtcactaccgccgagatggcctatcacacggcctgcgtcaaacgcggcaatgaaggcgcgttgatccttgccgacctgccgttcatggcccacgccaccgccgaacaggcctttgccaactgcgccacactgatgcaggccggcgcccacatgatcaaactcgaaggtgctgcctggctggccgaaaccatccgcctgctggccgagcgcggcgtgccggtgtgcgcacacatgggcctgaccccgcaaactgtcaatgtactgggtggctacaaggtccagggccgccaggaagcccaagcgcggcagatgcgcgctgacgccattgccctggagcaagccggcgcggccatgctgctgctcgaatgcgtacccagcgagttggcggcggagatcacccaggcggtgagcattccggtcattggtattggtgccggcagtgcaactgacggccaggtgctggtgctgcacgacatgctcggcctgtccttgagcggtcgcgtgccgaagttcgtgaagaacttcatggtcggccagccagatatccacagtgcgttggtcgcctatgtcactgcggtcagagacgtcagcttccccgccagcgaacacggattcagcgcatga

SEQ ID NO: 11107 - protein, 266 aa, Pseudomonas putida
MPEVTLTTLHGRKAKGEKITMLTCYDATFAKVASQAGVDVLLVGDSLGMVLQGHDSTLPVTTAEMAYHTACVKRGNEGALILADLPFMAHATAEQAFANCATLMQAGAHMIKLEGAAWLAETIRLLAERGVPVCAHMGLTPQTVNVLGGYKVQGRQEAQARQMRADAIALEQAGAAMLLLECVPSELAAEITQAVSIPVIGIGAGSATDGQVLVLHDMLGLSLSGRVPKFVKNFMVGQPDIHSALVAYVTAVRDVSFPASEHGFSA

SEQ ID NO: 11108 - DNA, 1092 bp, Vitis vinifera
  CDS (1)..(1092)
atgcttgtcgcgagaactctaaagaagtccttgtcctcggtaagcaagccattctctctacacacccacctcaaatggctgagcaacttgccggaaaacactgtatacggcggaccgaagccgcaaaaccctaaccagagagtgacactgaaccacctgaggcagaagcacaggaggggcgagcccttcaccatggtcaccgcctacgactacccgtcggcggtccatctcgacttggccggcatcgatatttgcctcgtgggtgactccgcttccatggtcgtccacggccacgacaccaccctccctatctctctcgaagaaatgctcgtccattgccgcgccgtcgctcgcggcgccaagaggccgcttctcgtcggtgatcttccatttgggacatatgagtctagttcaaatcaggcagttgatgcagctgtcaggatcttgaaggaaggcacaatggatgccattaaattggaaggaggatcaccttcaagaattacagcagcaaaatccattgtcgaggctggaattgctgtaatgggtcatgtgggacttacccctcaggccataagtgttcttgggggatttaggcctcaagggaaaaatattgctagtgctgtcaaggttgtggagactgcaatggctttacaggaagctgggtgttttgctgttgttcttgaatgtgtgcctgcacctgtggctgctgcaacaacatcagcccttcgaatccccaccattggcataggagctggacctttctgcagtggacaggtgctagtttaccatgatctgctgggaatgatgcaacacccacatcatgctaaggttaccccaaagttctgcaagaggtatggacaagtaggagaagtgatcaataaagctcttctggaatacaaggaagaagtaacaaatggttcattccctggtcctgctcatagcccatataaaatctgttctgccgaagtcgatggtttcttgaacgagttacagaagttgggcttggacaaggcggcatcagcagcagctgaagcagctgagaagatcgagacaagtgaatcactggagggaaagagcccgaaaagtgattga

SEQ ID NO: 11109 - protein, 363 aa, Vitis vinifera
MLVARTLKKSLSSVSKPFSLHTHLKWLSNLPENTVYGGPKPQNPNQRVTLNHLRQKHRRGEPFTMVTAYDYPSAVHLDLAGIDICLVGDSASMVVHGHDTTLPISLEEMLVHCRAVARGAKRPLLVGDLPFGTYESSSNQAVDAAVRILKEGTMDAIKLEGGSPSRITAAKSIVEAGIAVMGHVGLTPQAISVLGGFRPQGKNIASAVKVVETAMALQEAGCFAVVLECVPAPVAAATTSALRIPTIGIGAGPFCSGQVLVYHDLLGMMQHPHHAKVTPKFCKRYGQVGEVINKALLEYKEEVTNGSFPGPAHSPYKICSAEVDGFLNELQKLGLDKAASAAAEAAEKIETSESLEGKSPKSD

SEQ ID NO: 11110 - DNA, 768 bp, Microcystis aeruginosa PCC 7806
  CDS (1)..(768): transl_table=11
atggcagtcaccaccagcaaattaatcgagtggaaacagcaaaaacgcgcgattgtcaccctcacagcttgggattatccgatcgcgcgactgctcgatcgagcaggaattgatattatcttggtaggtgattccttagctatgaccgctttgggctatcctaccactttaccgatcaccctcgaggcgatgattcaccacgcggcggccgtgtctcgcggggtaaaacaagctttagttgtctgtgatttgccttttctcagctatcaggaaagtgtcagtcaggcaattcactccgccggaaggatgttaaaggaagcgggagtgcaaggggtaaaattagagggaggttatcccgctatgatcgagactattagccgtttaaccgagataggcatccctgttatgggtcatatcggattaactccccagtcggtgcatcggttaggataccgtcagcagggaaaaactccatcggaggcacaaagattaatcgaggaagctttagccttggagaaagcgggagtatttgccctggttttggaacatattcccgccaatttagccgctactattaccgataaattgactatcccgacgattggtatcggtgcgggggaagattgtgatggtcaggtgttggtaacggcggatatcctaggattaaccgaaaaagctcccccttttgccaaagtttatgctaatttaagcgaaacaattacaaaagcagttgtagaatttgccaaggatgtgaggataaatgaatag

SEQ ID NO: 11111 - protein, 255 aa, Microcystis aeruginosa PCC 7806
MAVTTSKLIEWKQQKRAIVTLTAWDYPIARLLDRAGIDIILVGDSLAMTALGYPTTLPITLEAMIHHAAAVSRGVKQALVVCDLPFLSYQESVSQAIHSAGRMLKEAGVQGVKLEGGYPAMIETISRLTEIGIPVMGHIGLTPQSVHRLGYRQQGKTPSEAQRLIEEALALEKAGVFALVLEHIPANLAATITDKLTIPTIGIGAGEDCDGQVLVTADILGLTEKAPPFAKVYANLSETITKAVVEFAKDVRINE

SEQ ID NO: 11112 - DNA, 1191 bp, Picea sitchensis
  CDS (1)..(1191)
atgattccttcgactatctctagccaaggatcgtctacaagtttcatggctcgacatctttggcaatcaaaaggatcatggataacaatgttaaggaggggttctcactgtttccaaataccataccacaattacaagtttgaactttcatctttgccaaggatgctagatgtgcgtggaatgtctaatcttccagaaaagtctgtctatggaggacctaagtctcaatctccctggaaaaggatcactttaaatcatcttgctgctaaatatgacaaaggcgagccgataacaatggtgactgcctacgattatccctcagcagttcatgtagacaatgctggcattgatatctgcttagtaggggattcagttggaatggtggtgcacggacatgacacaaccttacctgtcaccatggatgatatgctgcttcattgtcgtgctgtatcccgtggagcatctagatctcttcttgttggtgatttgccttttggaagctatgaagaaagcaaggagcaggcagttgcaagtgcaactcgactattgaaggaggggggcatggatgcaataaagcttgaagggggtacaccatctagggttatagcagcaagatctatagttgaggcaggtattgcggtcattggacatgttgggttgactcctcaagcaataagtgtgctaggtggctttaggccacagggtagaaatgctgccagtgcgacgaaggttctggagagcgcattggctttacaggatgcaggttgttttgccattgtactagagtgtgtgccttctccagtcgcagctgctgttacatcttctcttcaaattcctaccattggaattggagctgggcctaattgtagtggccaggtcttagtttatcatgacttgctgcagatgacgcaacatccgcaccatgctcaggttacacccaagttctgcaaggcatatgggaacataggaatcgctgtcaatgaagcattgtgcaagtacagagaagaggtggtttcccagaagtttccatctgcggcatatactccttatcgaattgaccaatctagtgttgaaacctttattgctgaacttagtaagaggggattggggaaagcagcacaggcagctgctgcagctgctgagaatgacaagaaatctggagaaccaaggatcagtacacttccagactag

SEQ ID NO: 11113 - protein, 396 aa, Picea sitchensis
MIPSTISSQGSSTSFMARHLWQSKGSWITMLRRGSHCFQIPYHNYKFELSSLPRMLDVRGMSNLPEKSVYGGPKSQSPWKRITLNHLAAKYDKGEPITMVTAYDYPSAVHVDNAGIDICLVGDSVGMVVHGHDTTLPVTMDDMLLHCRAVSRGASRSLLVGDLPFGSYEESKEQAVASATRLLKEGGMDAIKLEGGTPSRVIAARSIVEAGIAVIGHVGLTPQAISVLGGFRPQGRNAASATKVLESALALQDAGCFAIVLECVPSPVAAAVTSSLQIPTIGIGAGPNCSGQVLVYHDLLQMTQHPHHAQVTPKFCKAYGNIGIAVNEALCKYREEVVSQKFPSAAYTPYRIDQSSVETFIAELSKRGLGKAAQAAAAAAENDKKSGEPRISTLPD

SEQ ID NO: 11114 - DNA, 816 bp, Xanthomonas campestris pv
  CDS (1)..(816): transl_table=11
atgagcagccacgccgacagcaagccctggaccgtgcccgccttggcgcaggccaagcgcgacggtcgaaaactggtcatgttgaccgcctatgacgccgggtttgcgcgcaccttcgacgccaatggcgtggacctgatcctggtgggcgactcgctgggcatggtggtgcaggggcacgagtccacgctgccagtgaccacggccgacatggtctaccacaccgccgcggtggcccgcgtgctggagcgtgcgttgctggtggccgacttgtcgttccaggccgatgccacgccggaacgtgcgctcgatgccgccacccagctgctgcaggcgggtgcggagatggtcaagatcgaaggcgccgggcacaagctcgacgtgatccgctacctggttgagcgcgaaatcccggtgtgttcgcacctggggctcacgccgcaatcggtgctgcgcttcggcggctacaaggtgcaaggccgtggcgaagccggcgaacagctgcgtcgcgacgcccaggccgcggtcgatgccggtgtcagcctgatcgtgctcgaatgcgtgccgacgccgatcgcagcgcagatcagcgccgagttgcgcgtgcccacgatcggcattggtgccggccccggctgcgatggccaggtgctggtgatgcacgacatgctgggcctggacagcggccatcgccgtcccaagttcgtcaaggatttcctggccgaaggcgggtcggtcgcgggcgccgtgcaggcctacgcgcaggccgtgcgcgatggcagctttcccgacgccgagcacgcgtacgccgcatga

SEQ ID NO: 11115 - protein, 271 aa, Xanthomonas campestris pv
MSSHADSKPWTVPALAQAKRDGRKLVMLTAYDAGFARTFDANGVDLILVGDSLGMVVQGHESTLPVTTADMVYHTAAVARVLERALLVADLSFQADATPERALDAATQLLQAGAEMVKIEGAGHKLDVIRYLVEREIPVCSHLGLTPQSVLRFGGYKVQGRGEAGEQLRRDAQAAVDAGVSLIVLECVPTPIAAQISAELRVPTIGIGAGPGCDGQVLVMHDMLGLDSGHRRPKFVKDFLAEGGSVAGAVQAYAQAVRDGSFPDAEHAYAA

SEQ ID NO: 11116 - DNA, 834 bp, uncultured delta proteobacterium
  CDS (1)..(834): transl_table=11
atgaccggtgaaaaaataacagttccggatattatggcagccaaggggaatagaaaactgacaatgctgacagcttatgattatccaacagccctgctcgctgacaaaggggggattgacatgatccttgtcggagactcgcttgcaatggtagtgctgggcatggaggatacactctctattggaatggatgagatgattcaccacacacgtgctgtaaaacgcggaacatctcgcgggcttgtaatcggtgacatgcctttcatgtcttaccagacaagtatcaagcaggctttaatcaatgccggaagatttttaaaggaaggcagggcgcaggcagttaaattagagggtggcgcacgcgtatgtccacagattaaggcaatggtggagtcaggcatacctgtccaggggcatataggtcttacaccacagagcgcagcccaattcggcgggttcaaggtgcaggggaaaaatgccgaagcagcaaaaacgctgattgaagatgcaaaactgctggaacaggccggatgcttcagcattgtgcttgaggccataccagccccaattgccgcaatgattacagatgccgtttccatacctaccataggcattggtgcagggtctgcctgtgatgggcaggtacttgtgatgcatgacatgatcggcctgtttgacagatttgtgccaaaatttgtcaaacagtatgcaaaggtcagcgatattatcctgcaggctgtaaaggcatataaaaatgatgtggaaacaggccagttcccgaccatggatcaaagttttactattaatacagaggaactggaaaaaattaaatag

SEQ ID NO: 11117 - protein, 277 aa, uncultured delta proteobacterium
MTGEKITVPDIMAAKGNRKLTMLTAYDYPTALLADKGGIDMILVGDSLAMVVLGMEDTLSIGMDEMIHHTRAVKRGTSRGLVIGDMPFMSYQTSIKQALINAGRFLKEGRAQAVKLEGGARVCPQIKAMVESGIPVQGHIGLTPQSAAQFGGFKVQGKNAEAAKTLIEDAKLLEQAGCFSIVLEAIPAPIAAMITDAVSIPTIGIGAGSACDGQVLVMHDMIGLFDRFVPKFVKQYAKVSDIILQAVKAYKNDVETGQFPTMDQSFTINTEELEKIK

SEQ ID NO: 11118 - DNA, 816 bp, Campylobacter fetus
  CDS (1)..(816): transl_table=11
atgagaaaaataggaaaaatattgaaaaaagtaaccataaacgatctgtttatgatgaaaaacagagaaaagattgttatgataactgcttatgatgctctgtttgcaaggctttttgatgattatgtggatatgattttggtcggcgatagtttaaatatgagttttggtggtaaaaatgaaactataggactaagcgttgatgatatgatctatcatacaaaagctgtgcaaaatggtgctaaaaaagcatttttagttgtagatatgccctttggctcggcttgcacgccgcaaatagcactaaaaaatgctataaaaatctataaaaaaacaggctgtgacgctgtaaaaatagaaggcacgaaagagatggcggacaccatcaaacttcttagtcaaaatggcataattgttatgtctcacatcggtttaaaacctcaaatgtcacgttttgaaggtggatacaagataaaaggcaaagacgagctaagcgcaaaaagcatattagaagacgctatcgttttggagtctgcgggagctagcttgtttttgctagaaggaatcgtaagtagtgttgcgagcgaaatttctcaaaaattaaaagtaccgactataggaataggaagcggtgcttcttgtgatggacaagttttggtatggagcgatgcgtttggcttttttgatgaatttaaaccaaaatttgtaaaaaggtatttagaaggtgcgactcttataaaaaattctctaaaagagtatgcggacgaagtaaaaaatagcaaattcccaagtagtcagtatgaatataccaaatga

SEQ ID NO: 11119 - protein, 271 aa, Campylobacter fetus
MRKIGKILKKVTINDLFMMKNREKIVMITAYDALFARLFDDYVDMILVGDSLNMSFGGKNETIGLSVDDMIYHTKAVQNGAKKAFLVVDMPFGSACTPQIALKNAIKIYKKTGCDAVKIEGTKEMADTIKLLSQNGIIVMSHIGLKPQMSRFEGGYKIKGKDELSAKSILEDAIVLESAGASLFLLEGIVSSVASEISQKLKVPTIGIGSGASCDGQVLVWSDAFGFFDEFKPKFVKRYLEGATLIKNSLKEYADEVKNSKFPSSQYEYTK

SEQ ID NO: 11120 - DNA, 801 bp, Pseudomonas fluorescens
  CDS (1)..(801): transl_table=11
  misc_feature (554)..(554): r is g or a
atgccagctattaccctgaccacgctgcaaggtctcaagcaaaaaggtgagaaaatcaccatgctgacctgctatgacgcaactttcgcccacgcctgcaatgaggccggtgtcgaagtgttgctggtgggcgattccctcggcatggtgctgcaaggtcacgacagcacgctgccggtgaccaccgccgagatggcctaccatgtggccgccgtcaaacgcggtaacaccgatgcactgattctcgccgacctgccattcatggcctacgccacccttgaacaaaccatgaccaacagcgccatgctgatgcaggccggtgcccacatggtcaaggtcgagggcgcgttgtggctggccgattcgattcggttgctggccgagcggggtatcccagtgtgcgcgcacatgggactgaccccacaatcggtcaatatcctcggtggctacaaggtccagggccgcaatgagaaccaggcgcggcagatgcgcgccgatgcgattgcgctggagcaggctggcgcggcgatgttgctgctcgaatgcgtgcccarcgagttggcggaagaaatcacccaggcggtgaagatcccggtgatcgggatcggcgccggccacgccaccgacggccaggtgctggtgctgcacgacatgctcgggctgtcgatcaccggtcgcgtgcccaagttcgtgaaggacttcatggcagggcaaacgtccatccagggcgccctgagtgcctatgtcgctgaggtcaaggccgcgaccttccctggcgtcgaacacgggttttctgcatga

SEQ ID NO: 11121 - protein, 266 aa, Pseudomonas fluorescens
  misc_feature (185)..(185): The Xaa at location 185 stands for Asn, or Ser.
MPAITLTTLQGLKQKGEKITMLTCYDATFAHACNEAGVEVLLVGDSLGMVLQGHDSTLPVTTAEMAYHVAAVKRGNTDALILADLPFMAYATLEQTMTNSAMLMQAGAHMVKVEGALWLADSIRLLAERGIPVCAHMGLTPQSVNILGGYKVQGRNENQARQMRADAIALEQAGAAMLLLECVPXELAEEITQAVKIPVIGIGAGHATDGQVLVLHDMLGLSITGRVPKFVKDFMAGQTSIQGALSAYVAEVKAATFPGVEHGFSA

SEQ ID NO: 11122 - DNA, 858 bp, Burkholderia sp
  CDS (1)..(858): transl_table=11
atgagcgctcatacccgcaccacccgcaagaccgtcaccgcgatccgttcgaccaagggcatcggcagcctcgtgtcgctgaccgcgtattccgcgccgatggcgaagctggtcgacgaagtggccgacgtgatcatcgtcggcgactccgtcggcatggtgctgtacgggatgcccgatacgctgcgcgtcacgctcgacatgatgattgcacacggtgcggccgtcgtgcgcggcgccgcgcaggcatgtgtcgtcgtcgacttgccgttctcgacgtaccaggaatcgcccgcccaggcctatcgctccgccgcgcgcctgctcgccgaaaccggcgcgcagggcgtgaagctcgaaggcggcaccgagatggccgacgcgatccgcttcctgaccgagcgcggcatcccggtgatggcacacgtcggcctcatgccgcagcaggccaacgcgacgggcggcttccgcgcgcaggggatggacccgcgttccgccgcgcaggtgttcgatgccgcatgctcggctgaacaggccggcgcgttcagcgtcgtcatcgaaggcacggccgaagcgctcgcgcgccatatcaccgaaacgctgacgatcccgacgatcggcatcggtgcatcgcccgcatgcgacgggcaggtgctcgtgaccgaggacatgatcggcgcattcgatgcatacacgccgcgcttcgtgaagcgttatgccgatgcgaacgcagtaatgcgcgatgcgatccgccagtacgcgcacgacgtgcggcagggtgtgtttccggaacccgcgcattgtttcgggtatggcaagccgctgcaactcgtgggtgcggctgacgctgctgcgtga

SEQ ID NO: 11123 - protein, 285 aa, Burkholderia sp
MSAHTRTTRKTVTAIRSTKGIGSLVSLTAYSAPMAKLVDEVADVIIVGDSVGMVLYGMPDTLRVTLDMMIAHGAAVVRGAAQACVVVDLPFSTYQESPAQAYRSAARLLAETGAQGVKLEGGTEMADAIRFLTERGIPVMAHVGLMPQQANATGGFRAQGMDPRSAAQVFDAACSAEQAGAFSVVIEGTAEALARHITETLTIPTIGIGASPACDGQVLVTEDMIGAFDAYTPRFVKRYADANAVMRDAIRQYAHDVRQGVFPEPAHCFGYGKPLQLVGAADAAA

SEQ ID NO: 11124 - DNA, 822 bp, Pseudomonas aeruginosa
  CDS (1)..(822): transl_table=11
atgagcagtcatcgcccgcaacatcgcctgtccgttcccgatatccagcgccgcaagggtgccggcagcctggtggcgctgaccgcctacagcacgcccatggcccgcctcctcgatccgcacgccgacctgctgctggtcggcgattcgctgggcatggtgctctatggcatgcccagtaccctgggagtgagcctggagatgatggtcgcccacaccctggcggtgatgcgcggcagccggcgcgcctgcgtggtggccgacttgccgttcgccagctaccaggaatcgccccgacaggcgttccgcaacgccgcacgcctgctggccgacagcggcgcccaggcggtgaagctggaaggcggtgaggaaatggaagaaaccgtggacttcctggtacgccgtggcataccggtgctcgcccatatcggcctgatgccgcagcaggtcaacgccatgggcggcttcaaggcccaggggcgtgacccggaaagcgccgaacgggtacgccgcgacggcctcgccatgcagcgcggcggcgccttcgcggtggtcatcgaaggcgtaggcgagccgctggcccgtcgccttagcgaagaactggcgatcccctgcatcggtatcggcgcctcgccggcctgcgacggccaggtactggtcagcgaggacctgctcgggctaagcggcgaacaggtaccgcgcttcgtcgaacgctacgcgcgcctcgaccgggaaatcgacgaggcggcccggcgcttcgccgaggacgtgcgcgaacggcgcttccccgaggccaggcattgcttcgccatgcgcgagtga

SEQ ID NO: 11125 - protein, 273 aa, Pseudomonas aeruginosa
MSSHRPQHRLSVPDIQRRKGAGSLVALTAYSTPMARLLDPHADLLLVGDSLGMVLYGMPSTLGVSLEMMVAHTLAVMRGSRRACVVADLPFASYQESPRQAFRNAARLLADSGAQAVKLEGGEEMEETVDFLVRRGIPVLAHIGLMPQQVNAMGGFKAQGRDPESAERVRRDGLAMQRGGAFAVVIEGVGEPLARRLSEELAIPCIGIGASPACDGQVLVSEDLLGLSGEQVPRFVERYARLDREIDEAARRFAEDVRERRFPEARHCFAMRE

SEQ ID NO: 11126 - DNA, 828 bp, Pseudomonas fluorescens
  CDS (1)..(828): transl_table=11
atgagcagccatacccgcacccagcgcctgagcgtcccgcaactggtggccatgaaaggccggcagaagatcgtttccctcaccgcctataccagccacatggcgcggctgatggaccccttcgtggatttcatcctgatcggtgattccaccgccatggtcggttacgggcgcacctcgaccctggacatgagcctggcggaaatcatcgcccacacccgcgcggtggtggccggcagccgcctggcctgcgtgattgccgacatgcccttcggcagctaccaggaatccccgcaacaggcctaccgcaattgcgccgaggtgatggcccgcaccggttgcgccgccctcaagctggagggcggccgggccctggcgcccaccgtggagttcctggtgcagcggggcattccggtgatggcgcatatcggcctgatgccgcagttcgtcaaccagatgggcgggttcaaggcccaggggctcgacagcgaggcggcccgcaagatcgaggaagatgcccgggcccacctcgaggccggcgccttcagcctgttgctggaaggggttgcggagcccctggcgcggcgcatcagcgacttctcgccgatgccgaccattggcatcggcgcctccccggcctgcgacggccaggtactggtgaccgaagacctgctggggctgggcgggccccaggtgccgcgtttcgtcaagcaatacgccgatgccggcgccctgatcagccaggcctgcgaacgcttcgccgcagaggttcgggagcaggcctttccgcagttgcagcattgttatggggtggttcaggaggcctga

SEQ ID NO: 11127 - protein, 275 aa, Pseudomonas fluorescens
MSSHTRTQRLSVPQLVAMKGRQKIVSLTAYTSHMARLMDPFVDFILIGDSTAMVGYGRTSTLDMSLAEIIAHTRAVVAGSRLACVIADMPFGSYQESPQQAYRNCAEVMARTGCAALKLEGGRALAPTVEFLVQRGIPVMAHIGLMPQFVNQMGGFKAQGLDSEAARKIEEDARAHLEAGAFSLLLEGVAEPLARRISDFSPMPTIGIGASPACDGQVLVTEDLLGLGGPQVPRFVKQYADAGALISQACERFAAEVREQAFPQLQHCYGVVQEA

SEQ ID NO: 11128 - DNA, 816 bp, Burkholderia sp
  CDS (1)..(816): transl_table=11
atgacctatctccaggaatcgagccggcctgccgtcacggtgcccaagctgcaggcaatgcgcgacgccggcgagaagatcgcgatgctcacctgctacgacgcgagcttttccgcactgctcgaccgttcgggcgtcgacgtgctgctgatcggcgattcgctcggcaacgtgctgcaaggccacacgaccacgctgcccgtgtcgctcgacgacatcgcgtatcacaccgcctgtgttgcccgcgcgcagccgcgcgcgctgatcatggccgacctgccgttcggcacgtacggcacgccggccgaggcattcgcaagcagcgtcaagctgatgcgcgccggtgcgcagatggtcaagctcgaaggcggcgaatggctcgccgagacgatccgcttcctcgtcgagcgcgcggtgcccgtatgtgcgcacgtgggcctcacgcctcagtcggtccacgcgttcggcggcttcaaggtacagggcaagaccgaagccggcgccgcgcaactgctgcgcgacgcgcgcgcggtcgaagcggcgggtgcgcaggtcgtgctgctcgaagccgtgccgacgctgatcgggtccgaggtcacgcacatgctgcgcgtgccgacgatcggcatcggcgcgggcgccgactgctcgggccaggtgctcgtgctgcacgacatgctcggcgtgttccccggcaagcggccgcgcttcgtgaaggatttcatgcagggcgagccgaacatccaggcggccgtcgaagcttacgtgcgcgcggtcaaggacggttcgttccccggccccgagcattcgttctga

SEQ ID NO: 11129 - protein, 271 aa, Burkholderia sp
MTYLQESSRPAVTVPKLQAMRDAGEKIAMLTCYDASFSALLDRSGVDVLLIGDSLGNVLQGHTTTLPVSLDDIAYHTACVARAQPRALIMADLPFGTYGTPAEAFASSVKLMRAGAQMVKLEGGEWLAETIRFLVERAVPVCAHVGLTPQSVHAFGGFKVQGKTEAGAAQLLRDARAVEAAGAQVVLLEAVPTLIGSEVTHMLRVPTIGIGAGADCSGQVLVLHDMLGVFPGKRPRFVKDFMQGEPNIQAAVEAYVRAVKDGSFPGPEHSF

SEQ ID NO: 11130 - DNA, 801 bp, Pseudomonas fluorescens
  CDS (1)..(801): transl_table=11
atgccagatatcactctgaccaccctgcaaagcctcaagcagaaaggtgagaaaatcaccatgctgacctgctacgacgccaccttcgcccacacctgctgcgaggcaggcgtcgaagtcctgctggtaggcgactccctgggcatggtgctgcaaggacacgacagcaccctgcccgtcagcaccgctgacatggcctatcacgtcgcggcggtcaagcgcggcaacaacggggcactgatcctggccgacctgccattcatgtcctacgccaccactgaacaggccctgagcagttcggcccagctgatgcaggccggcgcccatatgctcaagatcgaaggcgcagcctggctggccgagccggtgcgcctgctgaacgagcgtggagtgccggtctgcgtgcacatggggctgacgccacagaccgtgaacgttctgggcggctacaaggtccagggccgcaatgaaagccaggcgcggcagatgcgtgccgatgccatcgccctggagcaggccggcgcggcaatgctgctgctggagtgcgtgcccagtgagctggcggcggaaatcacccaggcggtgaagatcccggtaataggtatcggtgccggcaatgctaccgacggtcaggtcctggtgctccacgacatgctggggctgtccctcagcggccgctcgccgaagttcgtgaagaacttcatggcaggcaaggacagtatccaggccgccttgagcgcctatgtcgaagaagtcaaagccgtcaccttccctggcgccgaacacgggttctctgcatga

SEQ ID NO: 11131 - protein, 266 aa, Pseudomonas fluorescens
MPDITLTTLQSLKQKGEKITMLTCYDATFAHTCCEAGVEVLLVGDSLGMVLQGHDSTLPVSTADMAYHVAAVKRGNNGALILADLPFMSYATTEQALSSSAQLMQAGAHMLKIEGAAWLAEPVRLLNERGVPVCVHMGLTPQTVNVLGGYKVQGRNESQARQMRADAIALEQAGAAMLLLECVPSELAAEITQAVKIPVIGIGAGNATDGQVLVLHDMLGLSLSGRSPKFVKNFMAGKDSIQAALSAYVEEVKAVTFPGAEHGFSA

SEQ ID NO: 11132 - DNA, 822 bp, Zymomonas mobilis
  CDS (1)..(822): transl_table=11
atgtcagccatcccttcttctaataagcgccgaactattcccgagcttcgcgcgcgtaaaggcaagtcgccgatcgttgctttaacggcttacagtgctttaaccgcccgttttgttgatccttacgccgatttcattcttgtcggggacagtcttgccatggtcgaacatggtatggcgacgactattggtgcctcgcttgatatgatgattttacatggtcaaagcgtgatgcgcggttccgagaaggccgctgtcgtcatcgacatgccttttggttcttacgaagcgagtccacaggaagcctatcataatgctgtccgtattttgtccgaaacaggatgttcagccgtaaaacttgaaggcggctctcatctcgcgcctgttatcgccttcctcacagcacgaggggtgccggttatggggcatattgggttgacgcctcaatatgttcagactttgggcggtttcaaaatacaaggccatagctcggaacaacaagacaagattaaacaggatgctcttgattttgaggccgccggtgctttttccgtcgtgctagaaggggtgaccgaaccgcttgcccgtgaaattacggataatatcgcgataccaacgattggtatcggtgcctcttcttattgtgatggccaagttttggttttggaagatatgctgggcttcaatgacaaggtgccgcgtttcgtcaaaaaatttgctcatcttggggatgacatcaaaaaagcggtttcagactatgccactgcggtttcaaatcgtagttttccagcagaagacaacatctacaggccaaaatcttaa

SEQ ID NO: 11133 - protein, 273 aa, Zymomonas mobilis
MSAIPSSNKRRTIPELRARKGKSPIVALTAYSALTARFVDPYADFILVGDSLAMVEHGMATTIGASLDMMILHGQSVMRGSEKAAVVIDMPFGSYEASPQEAYHNAVRILSETGCSAVKLEGGSHLAPVIAFLTARGVPVMGHIGLTPQYVQTLGGFKIQGHSSEQQDKIKQDALDFEAAGAFSVVLEGVTEPLAREITDNIAIPTIGIGASSYCDGQVLVLEDMLGFNDKVPRFVKKFAHLGDDIKKAVSDYATAVSNRSFPAEDNIYRPKS

SEQ ID NO: 11134 - DNA, 822 bp, Bradyrhizobium japonicum
  CDS (1)..(822): transl_table=11
atgtccgtccaatccgccatcaggcgcaagaccgcgcccgacctccgcattcgcaagaatggcgagccgatcgtgatgctgacctcctatcacgcgcacaccgccgcgctggtcgacaggcactgcgatgcgatcctggttggcgattcccttggcaatgtcatgcatggcttcgagaccacggtgcccgtgacgcttgagatgatgatcctgcagggctgcgcggtgatgcgcggctccagccaggcgctcgtcgtcgtcgacatgccgttcggttcctacgaaggctcgaaggagcaggccttccagtcggcggtgcggatcatgaaggaaacgctgtgcggcgcggtcaagctcgagggcggcgcgcggatggcggagacggtggcgtttctctccgagcgcggcattcccgtgatgggccatatcgggctgacgccacagtcgatcaacacgcttggctcgttccgcgcacagggccgcgaggaggcgaactgggctccgatcgagaatgacgccagggcgatcgcagaggcgggggccttctctatcgtgatcgaggcggtcgccgagccgctggcgcgcaagatcacgcaatcgatcgcagttcctaccatcggcattggcgcgagcgcagcctgcgacggccagattttggtgctggaagatatgctcggcttgtcgccgcggtcgccgaaattcgtgcgccgctatggcaatctcgggccggcgatcgaggaagccatcgcgggctatgcgcgcgacgtgaagagccgggccttcccgggcccggagcatgtctacgacatgaagaagagctga

SEQ ID NO: 11135 - protein, 273 aa, Bradyrhizobium japonicum
MSVQSAIRRKTAPDLRIRKNGEPIVMLTSYHAHTAALVDRHCDAILVGDSLGNVMHGFETTVPVTLEMMILQGCAVMRGSSQALVVVDMPFGSYEGSKEQAFQSAVRIMKETLCGAVKLEGGARMAETVAFLSERGIPVMGHIGLTPQSINTLGSFRAQGREEANWAPIENDARAIAEAGAFSIVIEAVAEPLARKITQSIAVPTIGIGASAACDGQILVLEDMLGLSPRSPKFVRRYGNLGPAIEEAIAGYARDVKSRAFPGPEHVYDMKKS

SEQ ID NO: 11136 - DNA, 888 bp, Acidobacteria bacterium
  CDS (1)..(888): transl_table=11
atgagcattgccacgggcgacttccgttctaaagtcacgtcgtcgacacttctcgacaagaaatccaagcacgatccaattacttgcctgaccgcctacgactactccactgcgcgcctggtggatgaagccgggattgacatgatcctggtgggcgattcgcttgcccagaccatgctgggctacgagaacacgctgccggtcaccatggacgagatgctgcaccacacgcgggcagttcgacgcgcggtgcgtcatgcgttcctgatcgcagatatgccgtatgcgtcgtaccacgttggtgggcgcgaatcggtgcgcaacgcagcacgcttcatcaaggaaggcggcgcggaggcggtgaagatcgaaggcggcgagaaccgcgctgctttgatcgatcggctgctggacgcggaagttccggtggttgggcacattggcctgacaccgcagtcggtgcatcgcatgggcggctataaggtgcagggcaaaacgattcgggacatcgagcaactcatgcgcgatgcaacggcgcttgatcgtgccggcgttgtcgcgctggtgctcgagggtattccgcgcgaagtagcggcgatgatcacagctgaggtcgagacgccaacgattggcattggcgcagggccggattgcgacggccaggtgctggtgtttcacgacatcctgaacctgacgtttgcacctccggctaagttcgtgcgtcgctacgcggatgcagcggaattgattactggcgcagtgaaagcgtttcgcgacgacgtgaagacgggcagctatcccagcgatgacgagtcgtatcacctgccgaaagaagcgcaggcgacgctggagatggtgcagaatcgcaagcacgcaatgcggaagtag

SEQ ID NO: 11137 - protein, 295 aa, Acidobacteria bacterium
MSIATGDFRSKVTSSTLLDKKSKHDPITCLTAYDYSTARLVDEAGIDMILVGDSLAQTMLGYENTLPVTMDEMLHHTRAVRRAVRHAFLIADMPYASYHVGGRESVRNAARFIKEGGAEAVKIEGGENRAALIDRLLDAEVPVVGHIGLTPQSVHRMGGYKVQGKTIRDIEQLMRDATALDRAGVVALVLEGIPREVAAMITAEVETPTIGIGAGPDCDGQVLVFHDILNLTFAPPAKFVRRYADAAELITGAVKAFRDDVKTGSYPSDDESYHLPKEAQATLEMVQNRKHAMRK

SEQ ID NO: 11138 - DNA, 882 bp, Acidovorax sp
  CDS (1)..(882): transl_table=11
atgaccgactcccccaccgccggcacgccctatggcacgctgccgcccgcgtcgccgctgccccagaggcgccccgtgagcctgccccgcctggcgcagatgcgcgaggcgggcgagaagatcaccatgctcaccgcttacgacgccaccttcgcagccgtggccgatgcggcgggtgtggagtgcatcctggtgggcgattcgctgggcatggtctgtcagggcctgcccagcaccgtgggcgtgacgctggagcacatggcctaccacacggccagcgtggcacgcggcctgcaccgcgtacagggcacggcctggctgatcgccgacctgccctacggcagctatgccgagagccgcgagcaagcgctgcgcagtgcctgccagctcatgcaggcgggcgcccacatggtcaagctcgaaggcggcggctggaccgcgcccacggtgcagttcctcgtggagcgcggcgtgcccgtgtgcgcgcacctgggcctcaccccgcagacggtgcacgccctgggcggctaccgtgtgcagggcaagggcgaccaggccgcccagcagctgcgccgccaggcactggagctgcaggacgccggcgccgccatgctggtgctggagatggtgccgactcccctggcacgcgacctcacgcaggccctgccacgctgccacaccatcggcatcggcgcgggcagcggcacggccggccaggtgctggtgatgcacgacatgctgggcatcaacctgggcaagaacccgaagttcgtgcacgacttcatgcgggatgcgggcagcgtgcgcggcgccatcgaggcttatgtgcaggccgtcaagcaagggcgctttcccgacgacgcactgcacgcctggaactga

SEQ ID NO: 11139 - protein, 293 aa, Acidovorax sp
MTDSPTAGTPYGTLPPASPLPQRRPVSLPRLAQMREAGEKITMLTAYDATFAAVADAAGVECILVGDSLGMVCQGLPSTVGVTLEHMAYHTASVARGLHRVQGTAWLIADLPYGSYAESREQALRSACQLMQAGAHMVKLEGGGWTAPTVQFLVERGVPVCAHLGLTPQTVHALGGYRVQGKGDQAAQQLRRQALELQDAGAAMLVLEMVPTPLARDLTQALPRCHTIGIGAGSGTAGQVLVMHDMLGINLGKNPKFVHDFMRDAGSVRGAIEAYVQAVKQGRFPDDALHAWN

SEQ ID NO: 11140 - DNA, 825 bp, Aeropyrum pernix
  CDS (1)..(825): transl_table=11
atgccaggggataaggttacagctaggaggatattgaagatgaaggggtcgaggccgatagtggctgtgaccgcctacgactacccgacagcctggatagcggatgaggcgggggtggacgttatactggtcggcgacagcctggggatggtagtcctgggctacccctcaaccctccaggtaacgctggatgatatggttagacacaccgcagctgttgcgagagcggccaagaggcctttgatagtggccgacatgcccttcggcagctacgagcccagctcaagcgccgctgtagagagtgccgtggctctcgcgagagtgggggcagaggctgtgaagctcgagggcggtagcgagtacgccgacagggtgaaggccatagtagacgccgggataccggtgatgggccacctcggcctaaccccccagagggccatgaggataggaggctacaggcccagggcccgggggagggatgaggcccgcaggctgctcctagacgcagagtccctcgtcgaggcgggcgtcttcagcatagtgctggagttcgtatccgaggaggcagcagaaatggttaccaggagggtgccggtgccgacgatatgcataggcagcggtaggaggtgtgacggccagataatagtgttccacgatatagtaggcctctcacgacacacaccacccttcgccaaaaagtatgtcgacgccaggaggataatggtggaggctgtcacaagatacgccgaagacgtgagaaacggcaggttcccaggcgaggagcacgtagttcacgcaaaagagcccctcgaagatataagttga

SEQ ID NO: 11141 - protein, 274 aa, Aeropyrum pernix
MPGDKVTARRILKMKGSRPIVAVTAYDYPTAWIADEAGVDVILVGDSLGMVVLGYPSTLQVTLDDMVRHTAAVARAAKRPLIVADMPFGSYEPSSSAAVESAVALARVGAEAVKLEGGSEYADRVKAIVDAGIPVMGHLGLTPQRAMRIGGYRPRARGRDEARRLLLDAESLVEAGVFSIVLEFVSEEAAEMVTRRVPVPTICIGSGRRCDGQIIVFHDIVGLSRHTPPFAKKYVDARRIMVEAVTRYAEDVRNGRFPGEEHVVHAKEPLEDIS

SEQ ID NO: 11142 - DNA, 840 bp, Agrobacterium tumefaciens
  CDS (1)..(840): transl_table=11
atgagcgcccatgcaaaacaaaagcggctgacgacggcctccatccggcagatgaagggcgaggcacgcatcgtctgcctcaccgcctatacgacgccgattgcccggctgctggatccgcattgtgaccttttgctggtgggggattccctcggcatggtgctttacggcatggagacgactgttggtgtgacgctggacatgatgatcgcccatggccgcgccgtcatgcgcggcgtcgaacatgcctgcgtcatcgtcgatcttcccttcggcacctatcaggaatccaaggaacaggccttccgcaacgccgtgcggctgatgcaggagaccggctgcgatggcgtgaagctggaaggcggcgaagaaatggccgagaccatcgcctttctggtggcgcgtggcattcccgtcttcggccatgtcgggctgatgccgcaactcgtccacactgccggtggcttccgctcgctcggccattcggatgcggaaacgcaaaagatctggcgcgatggtattgcggtcgatcaggcgggcgctttcgccatcgtcgtggaaggcaccgtcgaaccacttgcccgcgagttgacggagaagctcgccgccccgaccgtcggcatcggtgcatcgccggcctgtgacgggcaggtgctggtgtccgacgacatgcttggcctgttttcagacttcaaaccgaaattcgtcaaacggtatgccgatctcggcacggctgctacgcaagcggcggcggcttatgccgatgaggtgcgctccggtgcatttccggggccggagcatacgtttcaagtgcgtaagccgtcgccttcggggaagtga

SEQ ID NO: 11143 - protein, 279 aa, Agrobacterium tumefaciens
MSAHAKQKRLTTASIRQMKGEARIVCLTAYTTPIARLLDPHCDLLLVGDSLGMVLYGMETTVGVTLDMMIAHGRAVMRGVEHACVIVDLPFGTYQESKEQAFRNAVRLMQETGCDGVKLEGGEEMAETIAFLVARGIPVFGHVGLMPQLVHTAGGFRSLGHSDAETQKIWRDGIAVDQAGAFAIVVEGTVEPLARELTEKLAAPTVGIGASPACDGQVLVSDDMLGLFSDFKPKFVKRYADLGTAATQAAAAYADEVRSGAFPGPEHTFQVRKPSPSGK

SEQ ID NO: 11144 - DNA, 834 bp, Alkalilimnicola ehrlichei
  CDS (1)..(834): transl_table=11
atgtataccggtgacccgccgcagacccgtcgccccgtcactgtcgggcggctgcagaggatgaaggcggacggccagaaggtcgtcgccctcacggcctacgactacacctttgccgtggcggaggaccaggccggggtggacgtcatcctggtgggcgactccctgggcatggtggtccaggggcgggacaccaccgtgccggtcacagtggaggagatggtctaccacacccgctgcgtcaccgcggcccggccttccgccctggtgatggccgacatgccctttatgagctacgccaccctggaggacggcctgcgcaacgccgcccggttgatgcaggagggcggggcgcagatgatcaagctggagggggccggtgagcaggccgaactggtggcccgactggcccgtgccggcattccggtgtgcgcccacctggggctgcagccgcaactggtgcacaagctgggggggtaccgggtgcaggggcgggagagcgcggccgccgacgccatgctggccgatgcccaggccctcgaggcggcgggcgccgacctgctgctgctggagtgtgtgcccgccgagttgggccggcgcatcagccaggggctggagatcccggtgatcggtatcggcgccgggcccgattgtgacggccagatcctggtcctgcaggacatcctgggggttaccccgggccggatcccgcggttctccaagaacttcatgaacggcgccggcagtatccagtgtgcccttcaggcctatgtgcaggcggtgcgtagcggtgcctttccggatgcggcgcactcgttcggagggcaggggtga

SEQ ID NO: 11145 - protein, 277 aa, Alkalilimnicola ehrlichei
MYTGDPPQTRRPVTVGRLQRMKADGQKVVALTAYDYTFAVAEDQAGVDVILVGDSLGMVVQGRDTTVPVTVEEMVYHTRCVTAARPSALVMADMPFMSYATLEDGLRNAARLMQEGGAQMIKLEGAGEQAELVARLARAGIPVCAHLGLQPQLVHKLGGYRVQGRESAAADAMLADAQALEAAGADLLLLECVPAELGRRISQGLEIPVIGIGAGPDCDGQILVLQDILGVTPGRIPRFSKNFMNGAGSIQCALQAYVQAVRSGAFPDAAHSFGGQG

SEQ ID NO: 11146 - DNA, 834 bp, Anaplasma marginale
  CDS (1)..(834): transl_table=11
gtgcttttgaatatactagacatacaggcgaaaaaggggctggaaaaaatcgcctgcctgaccgcttatactttcccgatggcgcgtattttggatgagcactgcgatcttatcctcgtgggagattccgtcggacagaccgtgtatggcatggagtccacattgtctgtcacgctagatatgatgattgcgcacggcaaggcggttgtaaaggcgcgtagtaaggctttggttgtggtagacatgccatttgccagctattacaccccggagcttgcgtacaagaatgcatctcgtattttgagtgaaaccgggtgcgatgccgtgaagctagaaggcggggtatgtgttgcggaagagatcgcatttttggtagcacgcggaattccggttatgggtcacgtaggcctgatgccccaacatttcaatcagctgggtgggtacaagtgccaaggcaagactgacagctcacgtcagcacattaaggaagacgccaaagcggtgtgcgaagccggtgcgttttgcgttgtgctggagtgcataagcccgtccctggctgcagagctaactcaggagttgccggtacctaccattggcatcggggcttctaacgcatgtgacgggcagattttggttgttgatgatatgttaggccaatcatcacgctatccaaagttcgtaaaacggtttgctgacctcgagcacacgataaaagacgccgtggtcggctatgtgcgcgcagtgaagtgtagtgaatttcccggggatgaacattgctacagcgacgggccgcacttacgtgtgtttcgtgcacaccctcatcacgcccaatga

SEQ ID NO: 11147 - protein, 277 aa, Anaplasma marginale
MLLNILDIQAKKGLEKIACLTAYTFPMARILDEHCDLILVGDSVGQTVYGMESTLSVTLDMMIAHGKAVVKARSKALVVVDMPFASYYTPELAYKNASRILSETGCDAVKLEGGVCVAEEIAFLVARGIPVMGHVGLMPQHFNQLGGYKCQGKTDSSRQHIKEDAKAVCEAGAFCVVLECISPSLAAELTQELPVPTIGIGASNACDGQILVVDDMLGQSSRYPKFVKRFADLEHTIKDAVVGYVRAVKCSEFPGDEHCYSDGPHLRVFRAHPHHAQ

SEQ ID NO: 11148 - DNA, 774 bp, Anabaena sp
  CDS (1)..(774): transl_table=11
atgccagtcactacccagcaattaattcagtggaaacaacaaggtcgttcaattgtggcgttgaccgcttgggattatacgatcgctcaaattctggacggtgctggtgtagacttaatcctcgtgggtgactcgatggcggtaatgttgggctataaaacaacgctgccaattacattagaggagatgctacaccacgctaaagcagtttgccgtggtgtgcaacgggctttagttgtggttgatctaccatttttgacttatcaagagagtatcccacaagcaattaactcggctgggcgcatattaaaggaaacaggcgctcaagcagttaagttggaaggtggctatccggcaatggtagacactattaatcgtttggtacaagctggtataccagttatgggtcatgtaggtttgacaccccaatcagttcatcaattggggttacgtcaacaaggtaagacacaggaaacagcccaaagaattttaaacgaagcgatcgcacttgaacaagcgggtgtattctccatagttttagagcatatacccgcagatttggcaatgcagattacacaaaaagttaatattcccacgattggtattggtgcgggttcccattgcgacggtcaagttttagttacttctgatgtattgggtttatcagaaagacaaccacccttcgccaaggtttatacgaatttgcgcgagacaattaccaaggctgtacaagattacgctgcggaagtacgcgatcgccagttcccagaatag

SEQ ID NO: 11149 - protein, 257 aa, Anabaena sp
MPVTTQQLIQWKQQGRSIVALTAWDYTIAQILDGAGVDLILVGDSMAVMLGYKTTLPITLEEMLHHAKAVCRGVQRALVVVDLPFLTYQESIPQAINSAGRILKETGAQAVKLEGGYPAMVDTINRLVQAGIPVMGHVGLTPQSVHQLGLRQQGKTQETAQRILNEAIALEQAGVFSIVLEHIPADLAMQITQKVNIPTIGIGAGSHCDGQVLVTSDVLGLSERQPPFAKVYTNLRETITKAVQDYAAEVRDRQFPE

SEQ ID NO: 11150 - DNA, 774 bp, Anabaena variabilis
  CDS (1)..(774): transl_table=11
atgccagtcactacccagcaattaatccagtggaaacaacaaggacgctcaattgtggcgttgacggcttgggattatacgatcgcccaaattctcgatgctgctggtgtagacttaattctcgtgggtgactcgatggcggtaatgttgggttataaaaccacgctgccaattacattagaggagatgttacaccacgctaaagcagtttgtcgtggtgtgcagcgggctttagttgtggttgatttaccatttttgacttatcaagaaagtattccacaggcaatcaactcggctgggcgcatattaaaggaaacaggcgctcaggcagttaaattagaaggtggctatccggcaatggtagaaactattacccgtttggtacaagcggggataccagtgatgggtcatgtaggtttgacaccccaatcagttcatcaattggggttgcgtcaacaaggtaagacccaggaaacagctcagagaattttaaacgaagcgatcgcacttgaacaagcgggtgtattttctatagtgttagagcatatccccgcagatttggcaatgcagattacacaaaaacttagtattcccaccatcggtatcggtgcgggttcccattgcgacggtcaagttttagtgacttctgatgtattgggtttatcggaaagacaaccaccctttgctaaggtttatacgaatttgcgcgcaacaattactaaagctgtacaagattacgctgcggaagtacgcgatcgccagttcccagaatag

SEQ ID NO: 11151 - protein, 257 aa, Anabaena variabilis
MPVTTQQLIQWKQQGRSIVALTAWDYTIAQILDAAGVDLILVGDSMAVMLGYKTTLPITLEEMLHHAKAVCRGVQRALVVVDLPFLTYQESIPQAINSAGRILKETGAQAVKLEGGYPAMVETITRLVQAGIPVMGHVGLTPQSVHQLGLRQQGKTQETAQRILNEAIALEQAGVFSIVLEHIPADLAMQITQKLSIPTIGIGAGSHCDGQVLVTSDVLGLSERQPPFAKVYTNLRATITKAVQDYAAEVRDRQFPE

SEQ ID NO: 11152 - DNA, 798 bp, Aquifex aeolicus
  CDS (1)..(798): transl_table=11
atggcgataaacctccagactctcttcaagaagaagagagaagggaaaaagattaccatggtttctacctacgattactggagtgccaaactctgcgacgaggtcgggatagactgcatactcgtcggagactccctcggaactgtcgtaaaaggtgaaggggatacgctttcagttaccttggaagaaatcatttatcacacaaagtgcgttatgagaggagtaaaaaacgccttcgttatagcggacatgccctttatgagttatcaggtttctatggaaaaggcggtggaaaactgcggaagggttataaaagagactaaggcaaaggctgtaaagcttgagggcggggaggagatagcggagctcgtgtacaaattaacgagaataggaatacctgtggtgggtcacgttggctttacaccccagcacataaacgtctttggaaaaccgaaggttgtgggaaagaaaaaagaagaggaggaaaaactaaggagagatttcagagctctggaagaggcgggagcttttatgatcgttcttgaaagcgttcccacacacttggcgaaagaactctggaaaggttcaaactctatagttataggaataggtgcgggaaagtacgttgacggacaagtgctcgtttttcacgatatagtcggtctttttgaggactttaaaccaaagtttgtgagaaggtaccttgaaggagctaaattggtaaaggaagcccttaaaaattttaaaattgacgtggaagggggcaatttcccttcggaagaggaaagttatggataa

SEQ ID NO: 11153 - protein, 265 aa, Aquifex aeolicus
MAINLQTLFKKKREGKKITMVSTYDYWSAKLCDEVGIDCILVGDSLGTVVKGEGDTLSVTLEEIIYHTKCVMRGVKNAFVIADMPFMSYQVSMEKAVENCGRVIKETKAKAVKLEGGEEIAELVYKLTRIGIPVVGHVGFTPQHINVFGKPKVVGKKKEEEEKLRRDFRALEEAGAFMIVLESVPTHLAKELWKGSNSIVIGIGAGKYVDGQVLVFHDIVGLFEDFKPKFVRRYLEGAKLVKEALKNFKIDVEGGNFPSEEESYG

SEQ ID NO: 11154 - DNA, 816 bp, Azoarcus sp
  CDS (1)..(816): transl_table=11
atgagctatcttcaggacgacaagcccgtcacgctcttcgaactcggcaagatgcgcgccgaaggccgcaagatcgccatgctcacctgttacgacgcgagcttcgccgcgctgctcgaacgcaatggcgtcgacgtgctgctggtgggcgattcgctcggcaacgtgttgcagggccagaaatccacgctgccggtcacgctggagcagatggcctatcacaccgaatgcgtggtgcgcggcagctcgcgccccttcgtcgtcaccgacatgcccttcggcagctaccaggaaagccccgagcaggcgatgcgcaacgccgcccggctgatggcggccggtgccgagatggtcaagctcgaaggcggtgccttcatggccgagaccgtgcgcttcctggtcgagcgcggcgtgccggtctgcgcccacatcgggctcacgccgcaatcggtgcatcaactcggcggctatcgcgtgcagggccgcagtgaagaaggcgcagcccggctgaaggccgacgcgctggcgctggaacaggccggcgccgcgctggtcgtgctcgagatggtgcccgcggcagtcgccagcgacatcacccgcagcctgtccacgatggcaacgatcggcatcggcgccggtgccgactgcagcggccaggtgctggtgctgcacgacatgatcggcgtctatcccggcaagaaggcccgcttcgtcaagaatttcatggaaggtgccgccagcatcgacgcggcggtcgcggcctatgtcgccgccgtgaaggacggcagcttccccgccgccgaacactgctactga

SEQ ID NO: 11155 - protein, 271 aa, Azoarcus sp
MSYLQDDKPVTLFELGKMRAEGRKIAMLTCYDASFAALLERNGVDVLLVGDSLGNVLQGQKSTLPVTLEQMAYHTECVVRGSSRPFVVTDMPFGSYQESPEQAMRNAARLMAAGAEMVKLEGGAFMAETVRFLVERGVPVCAHIGLTPQSVHQLGGYRVQGRSEEGAARLKADALALEQAGAALVVLEMVPAAVASDITRSLSTMATIGIGAGADCSGQVLVLHDMIGVYPGKKARFVKNFMEGAASIDAAVAAYVAAVKDGSFPAAEHCY

SEQ ID NO: 11156 - DNA, 816 bp, Azoarcus sp
  CDS (1)..(816): transl_table=11
atgagctacctccaggacgacaaacccgtcaccctgttcgaaattggcaagatgcgcgccgaagggcgcaagatcagcatgctcacctgttatgacgcgagcttcgcgtcgctgctcgagcgcgcgggagtcgacatcctcctcgtcggtgattcgctcggcaacgtcgtgcagggacagaagtccacgctgcccgtgacgctggagcacatgatctaccataccgaatgtgtcgtgcgcggctccacccgcccgttcatcgtcaccgacatgccgttcggtgcgtatcacgagagcccgtcgcaggcgatgcacaacgcagccagcctgctcgccgccggcgcgcagatggtcaagctcgaaggcggcaccttcatggccgaaaccgtccgtttcctcgtcgaacgcggcatcccggtatgcgcccacatcgggctcacgccgcagtccgtgcaccagctgggaggttatcgcgtacagggccgcagcgaggccgcagcggcgcagctgaaaggcgatgcgctggcgctggaacaggccggcgccgcgctgatggtcatggaaatggtccccgccgcgctcgctcgggaagtcaccgcgagcctcgcctcgatggcgacgatcggcatcggcgcgggcccggactgtgacggccaggtgctcgtgctgcacgacatgattggcgtctatccgggcaagaaagcgcgcttcgtcaggaatttcatgaccgggaagactgacatcgacgaagctgtcgcgagctacgtccaggccgtccgggacggcagttttccggccgccgaacactgttattga

SEQ ID NO: 11157 - protein, 271 aa, Azoarcus sp
MSYLQDDKPVTLFEIGKMRAEGRKISMLTCYDASFASLLERAGVDILLVGDSLGNVVQGQKSTLPVTLEHMIYHTECVVRGSTRPFIVTDMPFGAYHESPSQAMHNAASLLAAGAQMVKLEGGTFMAETVRFLVERGIPVCAHIGLTPQSVHQLGGYRVQGRSEAAAAQLKGDALALEQAGAALMVMEMVPAALAREVTASLASMATIGIGAGPDCDGQVLVLHDMIGVYPGKKARFVRNFMTGKTDIDEAVASYVQAVRDGSFPAAEHCY

SEQ ID NO: 11158 - DNA, 837 bp, Bacillus cereus
  CDS (1)..(837): transl_table=11
ttgaaaacaaaaacagattttttgaaaatgaaagagcaaggtgagccgattacaatgctaacggcgtatgattatccatctgctaagttagcagaagaagcggaagttgatatgattctagttggagattcccttgggatggttgtgctcggctatgattcaacagtacctgtaacagtagaggatatgattcatcatacgaaagctgtacgccgaggagcgaaagagacgtttattgtaactgatatgccatttatgtcgtatcatgtgtcgcctcaagatacgatggtgaatgcacgccgcatcgttcaagagagtggtgctcatgcactgaaggtagaaggtgcaggagaagtgatatcaactattcattacttgacgagtgcgggaattcctgtcgtggcacacttaggcttaactcctcaatctgtaggagtgttaggtggctataaagtacaaggaaaagatgctgaaagtgcaaaaaaattaatagaagatgcgaagagatgtgaggaagctggtgcgatagcacttgtattagaatgtgtgccaatgcagctagcagaattcatttcgaagcaactaacaattccaacgattggaattggagcaggacaaaaagtggatgggcaagtactcgtttatcatgatcttatctcatatggcgtaaatcgtgttccgaaatttgtgaagcaatatacgtttgttcaagaggagattgtgcgagggatttcacaatacgtaactgaagtaaagacagggcaatttccggaagaaaaacattcattcacaatgaaagaggaagaatgtttagcgttatacggaggaaaacaataa

SEQ ID NO: 11159 - protein, 278 aa, Bacillus cereus
MKTKTDFLKMKEQGEPITMLTAYDYPSAKLAEEAEVDMILVGDSLGMVVLGYDSTVPVTVEDMIHHTKAVRRGAKETFIVTDMPFMSYHVSPQDTMVNARRIVQESGAHALKVEGAGEVISTIHYLTSAGIPVVAHLGLTPQSVGVLGGYKVQGKDAESAKKLIEDAKRCEEAGAIALVLECVPMQLAEFISKQLTIPTIGIGAGQKVDGQVLVYHDLISYGVNRVPKFVKQYTFVQEEIVRGISQYVTEVKTGQFPEEKHSFTMKEEECLALYGGKQ

SEQ ID NO: 11160 - DNA, 837 bp, Bacillus cereus
  CDS (1)..(837): transl_table=11
ttgaaaacaaaaacagattttttgaagatgaaagagcaaggtgagccgattacaatgctaacggcgtatgattatccatctgctaaattagcagaagaagctgaagttgatatgattctagttggagattctcttggaatggttgtactcggatacgattcaacagtacctgtaacagtagaggatatgattcatcatacgaaagctgtacgccgtggagcgaaagagacgtttattgtaactgatatgccatttatgtcgtatcacgtatcattacaagaaacgatggtgaatgcacgtcgcatcgttcaagagagcggggcacacgcactgaaggtagaaggtgctggagaagttatatcgacgattcaatatttgacgaacgcaggaattcctgttgtagcgcatttaggtttaacccctcaatcggtaggagtgttgggtggatataaagtgcaaggaaaagatgcggagagtgcaaaaaaattaatagaagatgcaaagaaatgtgaagaagctggtgcaatagcgcttgtgttagaatgtgtaccaatgcagttagcagaacttatttcagagcaactaacaataccaacaattgggattggtgcaggacaaaaagtagatggacaagtgcttgtttatcatgatcttatctcatacggcgtaaatcgtgttccgaaatttgtgaagcaatatacgtctgttcaagaggagattgtgcgtgggatttcacaatatgttactgaagtaaagacaaggcaatttcctgaagaaaaacattcgttcacaatgaaagaggaagaatgcttatcgttatacggaggaaaacaataa

SEQ ID NO: 11161 - protein, 278 aa, Bacillus cereus
MKTKTDFLKMKEQGEPITMLTAYDYPSAKLAEEAEVDMILVGDSLGMVVLGYDSTVPVTVEDMIHHTKAVRRGAKETFIVTDMPFMSYHVSLQETMVNARRIVQESGAHALKVEGAGEVISTIQYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYGVNRVPKFVKQYTSVQEEIVRGISQYVTEVKTRQFPEEKHSFTMKEEECLSLYGGKQ

SEQ ID NO: 11162 - DNA, 822 bp, Bacteroides fragilis
  CDS (1)..(822): transl_table=11
atggctggttatatatcagatgacacaagaaaagtgacgactcatcgcctaatcgaaatgaagcaaagaggcgaaaaaatatctatgcttacatcgtatgactacacaatggcacagattgtcgacggtgccggtatcgatgtaattcttgtaggcgattccgcatcgaatgtgatggcaggtaatgtgactacacttcctattaccctggatcagatgatctatcatggaaaatcggttgtacgtggtgtaaagcgtgcaatggtagtagtggatatgccttttggctcttatcagggtaatgaaatggaagggcttgcttcagctatccgcataatgaaggagagtcatgccgatgcattgaaactggaaggtggtgaagagattatagatactgtgaaacgtattctgagtgccggtatccccgtgatgggacatcttggactgatgccacaatctatcaataaatatggtacatacacggttcgtgccaaggatgatgccgaagcagagaaattgattcgtgatgcacatttacttgaggaggccggatgtttcggacttgttcttgaaaagattcctgcagcattggcatcacgtgtcgcaagcgaactgaccattccggtgatcggtatcggtgccggtggagatgtagacggacaggtattggtaattcaggatatgttgggtatgaataacggtttccgcccgcgcttccttcgtcgttatgccgatctttatacggtaatgaccgatgctatcagtcactatgtttcagatgtaaagaactgcgacttcccgaacgagaaagaacaatattaa

SEQ ID NO: 11163 - protein, 273 aa, Bacteroides fragilis
MAGYISDDTRKVTTHRLIEMKQRGEKISMLTSYDYTMAQIVDGAGIDVILVGDSASNVMAGNVTTLPITLDQMIYHGKSVVRGVKRAMVVVDMPFGSYQGNEMEGLASAIRIMKESHADALKLEGGEEIIDTVKRILSAGIPVMGHLGLMPQSINKYGTYTVRAKDDAEAEKLIRDAHLLEEAGCFGLVLEKIPAALASRVASELTIPVIGIGAGGDVDGQVLVIQDMLGMNNGFRPRFLRRYADLYTVMTDAISHYVSDVKNCDFPNEKEQY

SEQ ID NO: 11164 - DNA, 840 bp, Bacillus halodurans
  CDS (1)..(840): transl_table=11
atgaagacgacagcaagctttaaaaaaatgaaacaacaaaaggaaaaaattgcgatgatgactgcttatgatgcaccatcggcaaggctagtagaggacgcagatgttgacatgattcttgtaggtgattcgctcggaatggtcgtgttaggttacgattcaacgattccggtcacattggatgacatgatccaccatacaaaggccgtaaagcggggagcgaaaaacaccttcatcgtaacggatatgccgtacttaacgtatcatggctcatttaatgaaacgttggtaggagcaaaacgactcatgcaggaggctggagctgatgcgcttaagcttgaaggaaatggggacatcattgatacgattgagcgtctaacgttagcaggtgttccgatcgtggcccatttaggtctaaccccgcaaaacgtagcagtggaaggcggctaccgagttcaagcaaaggatgcgaaaagcgcaaagcaactattggccgatgcaaaagcagttgaggcggctggagcgttcgcccttgtgctagagtgtgtgcctgagcaagtcgctacccaaattagcgaagagttaacgatccccgtcatcggaatcggggcaggcgcaggctgtgatggacaagtgctcgtctaccatgatgtgatcgggtatggagcaggtcacgtgccgagctttgtcaagcaatatgtaaacataacaaagccgattgaagaggccatgaagcaatatgttcaagaggttaaggcagggacatttcccgataaagatcacgccttttctcttaaagagaatgtcattcaggaactgtatggaggagcactcacatga

SEQ ID NO: 11165 - protein, 279 aa, Bacillus halodurans
MKTTASFKKMKQQKEKIAMMTAYDAPSARLVEDADVDMILVGDSLGMVVLGYDSTIPVTLDDMIHHTKAVKRGAKNTFIVTDMPYLTYHGSFNETLVGAKRLMQEAGADALKLEGNGDIIDTIERLTLAGVPIVAHLGLTPQNVAVEGGYRVQAKDAKSAKQLLADAKAVEAAGAFALVLECVPEQVATQISEELTIPVIGIGAGAGCDGQVLVYHDVIGYGAGHVPSFVKQYVNITKPIEEAMKQYVQEVKAGTFPDKDHAFSLKENVIQELYGGALT

SEQ ID NO: 11166 - DNA, 834 bp, Bacillus licheniformis
  CDS (1)..(834): transl_table=11
atgaagacaaaaactgactttctaaaaatgaaacaagagggagagccgatcgtcatgctgactgcctacgattatccggcggcaaagcttgccgaacaggccggcgtcgatatgatccttgtcggcgattcactcggcatggttgtactcggccttgactcgaccgtatctgttacggttgctgatatgatccaccatacaaaagctgtcaaacgcggggcaaaagatacgtttgttgtgacggatatgccttttatgtcatatcactgctctttggaaagcgctctgaaaaatgccgcggcgatcgttcaagaaagcggggcagatgctttgaagcttgaaggcggcgacggtgtgtttgagacgatcacggctttaacacgcggcggaatacctgttgtcagccatttaggcttgactcctcaatccgtcggtgttttgggaggctataaagttcaagggaaagatgaagaaagcgccggcaagctgattgaagacagcaggcgctgtgaagaagcaggcgcgatggcgctcgttctggaatgcgtcccggcagcgctcgctgaacggatttcaaaggagctcacaattcctgtcatcggcattggagcaggtgctggcacggacggacaggttctcgtttaccacgatgttgtcggacacggagtaagccggacgcctaaatttgtcaagcagtatgcacaaatcgaccagccgcttgaacaagcgcttcggggatatgttgaggatgtcagaagccgcgtgtttcctgaagatgctcattcgttccgtatagatcagcaagttcttgaaggattatacggagggaaatag

SEQ ID NO: 11167 - protein, 277 aa, Bacillus licheniformis
MKTKTDFLKMKQEGEPIVMLTAYDYPAAKLAEQAGVDMILVGDSLGMVVLGLDSTVSVTVADMIHHTKAVKRGAKDTFVVTDMPFMSYHCSLESALKNAAAIVQESGADALKLEGGDGVFETITALTRGGIPVVSHLGLTPQSVGVLGGYKVQGKDEESAGKLIEDSRRCEEAGAMALVLECVPAALAERISKELTIPVIGIGAGAGTDGQVLVYHDVVGHGVSRTPKFVKQYAQIDQPLEQALRGYVEDVRSRVFPEDAHSFRIDQQVLEGLYGGK

SEQ ID NO: 11168 - DNA, 840 bp, Bacillus clausii
  CDS (1)..(840): transl_table=11
gtgaaaacaacaaaaacgtttaaacaaatgaagcgagatggtgagccgattgcgatgcttacggcttatgatgctccttctgcccgcttggcagaacgagctggcgtagacatgatccttgtcggagattccctcggaatggtagtgcttggttacgactccacggttcctgtaagcgttgatgatatggtgttgcatacgaaagcagtcaaacgtggggcgccgaacacatttgttgtcacggatatgccgtttttaacgtaccatagctccttttctgaaacggctggccatgtgcgcaggctgttgcaagaggcaggagccgatgcggtaaagctggaaggaggcacagacattgccagcactgtgcaacgtctaacggcagcgggtgtgcctgtcgttggacatatcggcttgacgccacaatcagtcggtgttttaggcggctatcgcgtgcaaggaaaggcgcaagaagaaggcgaacaattgcttgctgacgcacaggcattggaacaagcaggcgcgtttgccattgtcgttgagtgtgtgccaaagcagcttggtgccctgttggctaaagaaatcaacgtgccgattattggcattggcgctggagcagagacagatggccaagtccttgtttatcacgacgtgattggctacgagtcggaacgagtggcgaaatttgtcaaacaatatacggctgtatcgccaatcattgaggaagggctcgcttcttatgtcaccgatgtaaaacaacgggcatttcctgaagaagcccatacgtatacaacgaacgacacaggctggttggctgtgtatgggggcgacaaaaaatga

SEQ ID NO: 11169 - protein, 279 aa, Bacillus clausii
MKTTKTFKQMKRDGEPIAMLTAYDAPSARLAERAGVDMILVGDSLGMVVLGYDSTVPVSVDDMVLHTKAVKRGAPNTFVVTDMPFLTYHSSFSETAGHVRRLLQEAGADAVKLEGGTDIASTVQRLTAAGVPVVGHIGLTPQSVGVLGGYRVQGKAQEEGEQLLADAQALEQAGAFAIVVECVPKQLGALLAKEINVPIIGIGAGAETDGQVLVYHDVIGYESERVAKFVKQYTAVSPIIEEGLASYVTDVKQRAFPEEAHTYTTNDTGWLAVYGGDKK

SEQ ID NO: 11170 - DNA, 834 bp, Bacillus subtilis
  CDS (1)..(834): transl_table=11
atgaaaacaaaactggattttctaaaaatgaaggagtctgaagaaccgattgtcatgctgaccgcttatgattatccggcagctaaacttgctgaacaagcgggagttgacatgattttagtcggtgattcacttggaatggtcgtcctcggccttgattcaactgtcggtgtgacagttgcggacatgatccatcatacaaaagccgttaaaaggggtgcgccgaatacctttattgtgacagatatgccgtttatgtcttatcacctgtctaaggaagatacgctgaaaaatgcagcggctatcgttcaggaaagcggagctgacgcactgaagcttgagggcggagaaggcgtgtttgaatccattcgcgcattgacgcttggaggcattccagtagtcagtcacttaggtttgacaccgcagtcagtcggcgtactgggcggctataaagtacagggcaaagacgaacaaagcgccaaaaaattaatagaagacagtataaaatgcgaagaagcaggagctatgatgcttgtgctggaatgtgtgccggcagaactcacagccaaaattgccgagacgctaagcataccggtcattggaatcggggctggtgtgaaagcggacggacaagttctcgtttatcatgatattatcggccacggtgttgagagaacacctaaatttgtaaagcaatatacgcgcattgatgaaaccatcgaaacagcaatcagcggatatgttcaggatgtaagacatcgtgctttccctgaacaaaagcattcctttcaaatgaaccagacagtgcttgacggcttgtacgggggaaaataa

SEQ ID NO: 11171 - protein, 277 aa, Bacillus subtilis
MKTKLDFLKMKESEEPIVMLTAYDYPAAKLAEQAGVDMILVGDSLGMVVLGLDSTVGVTVADMIHHTKAVKRGAPNTFIVTDMPFMSYHLSKEDTLKNAAAIVQESGADALKLEGGEGVFESIRALTLGGIPVVSHLGLTPQSVGVLGGYKVQGKDEQSAKKLIEDSIKCEEAGAMMLVLECVPAELTAKIAETLSIPVIGIGAGVKADGQVLVYHDIIGHGVERTPKFVKQYTRIDETIETAISGYVQDVRHRAFPEQKHSFQMNQTVLDGLYGGK

SEQ ID NO: 11172 - DNA, 822 bp, Bacteroides thetaiotaomicron
  CDS (1)..(822): transl_table=11
atggctggttatatatcagatgacacaagaaaggtgactactcatcgcctggttgaaatgaagcaaagaggcgaaagaatatctatgcttacttcttatgattacacaatggcacagatcgtagatggtgcgggaatggacgtaattttggtaggcgactccgcttccaacgtgatggcaggtaacgtgactacattgcctataactctcgaccagatgatttatcacgctaaatcagtggtacgtggcgtaaaacgcgctatggttgtagtcgatatgcctttcggatcttatcagggtaacgaaatggaaggtcttgcttctgccatccgcattatgaaggaaagccatgccgatgctttgaaactggaaggtggagaagaaatcatcgatacggtgaaacgtatcatcagcgcgggtattccggtgatgggacacttgggactgatgcctcagtccattaataaatacggtacttatacggtacgtgccaaagatgacagcgaagctgaaaagctgattcgtgatgctcatcttctcgaagaggcaggctgctttgccatcgtactcgaaaagataccggctactcttgcagaacgtgtggcttccgaactgacgatacctattataggtattggtgccggtggtcatgttgacggacaagtattggtcattcaggatatgcttggaatgaacaacggattccgtccgcgcttcttacgtcgttatgcagacctgtatacggtgatgactgacgctatcagccgttacgtatccgacgtgaagaattgcgacttccctaacgagaaggaacaatattaa

SEQ ID NO: 11173 - protein, 273 aa, Bacteroides thetaiotaomicron
MAGYISDDTRKVTTHRLVEMKQRGERISMLTSYDYTMAQIVDGAGMDVILVGDSASNVMAGNVTTLPITLDQMIYHAKSVVRGVKRAMVVVDMPFGSYQGNEMEGLASAIRIMKESHADALKLEGGEEIIDTVKRIISAGIPVMGHLGLMPQSINKYGTYTVRAKDDSEAEKLIRDAHLLEEAGCFAIVLEKIPATLAERVASELTIPIIGIGAGGHVDGQVLVIQDMLGMNNGFRPRFLRRYADLYTVMTDAISRYVSDVKNCDFPNEKEQY

SEQ ID NO: 11174 - DNA, 828 bp, Bartonella henselae
  CDS (1)..(828): transl_table=11
atgactattcataaggctgtaaagcgtattactgcttctgaaatacgatcaagaaaaggacaagaaccgattgtttctctaactgcttatcaggcttatagtgcgcggattgctgatccttactgtgatttgctattagttggtgatagcgttggtatggttgtgcatgggtttgagacaacgttgccagtgagtttggatatgatgattttgcatgggcaggctgttatgcgtggatctaagagggctcttgtggttgtagatatgccttttggatcttatgaagaaagcccagaacaagctttttccaatgcatcgcgtattcttgcagaaacagggtgtagtgcagttaagcttgaaggtggtgtttatatagcggaaacaattgattttttgtgtaaacgcggtatcccagttatgagtcatgttggtctgacaccacaggcagtgaatcgttttggtggttttaagacgcaaggacgcaatgaaagtaattggcaacagattgaagctgatgcagcagcaattgaaaaggcaggtgcctttgctgttgttgtggaaggagttgtagaaccattagcagtaaaacttacacagatgctttctatccctaccattggcattggtgcatctagtcagtgtgatgggcagatattggtgatggaagatatgttaggttacggtacatgggtccctaaatttgtacgccgttatggtgttctcgaacaggagatggagaaggcgattaagagttatgcggatgatgttaaatcacgtacttttccaagtgatgaagaaatttataagctcaaacaaaagtcaggttaa

SEQ ID NO: 11175 - protein, 275 aa, Bartonella henselae
MTIHKAVKRITASEIRSRKGQEPIVSLTAYQAYSARIADPYCDLLLVGDSVGMVVHGFETTLPVSLDMMILHGQAVMRGSKRALVVVDMPFGSYEESPEQAFSNASRILAETGCSAVKLEGGVYIAETIDFLCKRGIPVMSHVGLTPQAVNRFGGFKTQGRNESNWQQIEADAAAIEKAGAFAVVVEGVVEPLAVKLTQMLSIPTIGIGASSQCDGQILVMEDMLGYGTWVPKFVRRYGVLEQEMEKAIKSYADDVKSRTFPSDEEIYKLKQKSG

SEQ ID NO: 11176 - DNA, 828 bp, Bartonella quintana
  CDS (1)..(828): transl_table=11
atgagtatccatcaaaccataaagcgtattactgctgctgaaatacgatcaagaaaagggcaagaaccgattgtttctctaacggcttatcaggcttacagtgcgcggattgctgatccttattgcgattttcttttggttggtgatagcgttggtatggttgtgcatggctttgagacaacgcttccagtgagtttggatatgatgattttgcatgggcaggcggttatgcgtggggctaagaaggcattggttgttattgatatgccttttggttcttatgaagaaagtccagaacaggctttttccaatgcgtcccgtattcttgcggaaacagggtgtggtgcagtgaaattggaaggtggtgtttatatagcggaaacgattgattttttgtgtaagcgcggtatcccagttatggggcatattggccttacaccacaggcagtaaatcgttttggtggttttaagacgcaagggcgcaatgaaagtaattggcaacagatcgaagctgatgcagcagcaattgaagaggcaggtgcctttgctgttgttgtggaaggggttgtagaaccattagcagtaagacttacagagatgctttctattcctaccattggcattggtgcatctagtcagtgtgatgggcagatattggtgatggaagatatgttaggttatggtacttgggttcctaaatttgtacgtcgttatggtgctctcgaacaggagatggagaaggcgatcaagagctatgcggatgatgttaaatcacgtgcttttccatctgaagcagaaatttataagctcaaacaaaagtcaggttaa

SEQ ID NO: 11177 - protein, 275 aa, Bartonella quintana
MSIHQTIKRITAAEIRSRKGQEPIVSLTAYQAYSARIADPYCDFLLVGDSVGMVVHGFETTLPVSLDMMILHGQAVMRGAKKALVVIDMPFGSYEESPEQAFSNASRILAETGCGAVKLEGGVYIAETIDFLCKRGIPVMGHIGLTPQAVNRFGGFKTQGRNESNWQQIEADAAAIEEAGAFAVVVEGVVEPLAVRLTEMLSIPTIGIGASSQCDGQILVMEDMLGYGTWVPKFVRRYGALEQEMEKAIKSYADDVKSRAFPSEAEIYKLKQKSG

SEQ ID NO: 11178 - DNA, 792 bp, Bdellovibrio bacteriovorus
  CDS (1)..(792): transl_table=11
gtgaaaaccatcctcgatttccacgacaagaaaagcaaaaagcaaaagatctcgatgatcacttgctatgactattccttcgcccgcattgtggccgacagtgatatcgactgcattctggtcggagactctttggcgatggtgatgctgggtcattccaccacgctggatgtttccgccagtgtcatggctcatcacacagccgccgttgtgcgcggggcgggtgataagtttgtgatcgcggatctgccattcatgagttaccgcaaaggcctgaccgccaatatgacggctgttgaaaaagtgatgaaggccggtgctcacgccgtgaagctggaaggcgctgccggaaatttgaaactggtccgccatctggtggattcaggtgtgccggtgatgggacatctgggcctgactccgcaatcagtcaatcaactgggtggattcaaggttcagggccgtgatgaaaaagcccaaaagaaaattctggaagccgctctgcaactgcaggacgccggggctttttccgtggttcttgaatgtgtcccttcgaaactggccaaagaaatcaccgcagccctggagattccaactatcggaatcggtgcgggcgtggattgcgacggacaggtgctggtactgcaagatatgctcggcatgaaccaaggcttcaaaccgaagttcgtgaaaacataccttgatggctttaacaccattaaaggtgccttgaaccagtatcatcaggaagtcagcaccgaaatcttcccgtccgagaaagagagctattcatga

SEQ ID NO: 11179 - protein, 263 aa, Bdellovibrio bacteriovorus
MKTILDFHDKKSKKQKISMITCYDYSFARIVADSDIDCILVGDSLAMVMLGHSTTLDVSASVMAHHTAAVVRGAGDKFVIADLPFMSYRKGLTANMTAVEKVMKAGAHAVKLEGAAGNLKLVRHLVDSGVPVMGHLGLTPQSVNQLGGFKVQGRDEKAQKKILEAALQLQDAGAFSVVLECVPSKLAKEITAALEIPTIGIGAGVDCDGQVLVLQDMLGMNQGFKPKFVKTYLDGFNTIKGALNQYHQEVSTEIFPSEKESYS

SEQ ID NO: 11180 - DNA, 837 bp, Bordetella bronchiseptica
  CDS (1)..(837): transl_table=11
atgagcgtgcccaccgccgccaaacgcatcaccacccgccaattgcgcatgcgcacgccggacgagcccatcgtggcgctgaccgcctacacggctcccatcgccggcctgctggatgcgcactgcgacctgctgctggtgggcgactcgctgggcatggtcatctacggcatggaaaccaccctgccggttaccgtggacatgatgatccagcacggccgcgccgtgatgcgcggttcgcagcgtgcctgcgtggcggtggacatgccgttcggcagctaccaggaagacgagcgccaggcctatcgcaacgccgcccgcatcatggccgagaccggcgcaagctgcgtcaagctggagggcggcgcggaaatggcctcgaccgtggcgttcctggtcgagcgcggcattcccgtgatgggccacgtcgggctcaagccccaatcggtgcacggccatggcggcttccgtaccgtcggccgcggcgccgaggccgagcaggtcatggccgacgcacaggccatcgccgcggcgggcgcctttacggtggtcatcgaaggcacgcttgaacccgtggcgcgcgccatcaccgaggccttgcccgttcccaccatcggcatcggcgcctcgcccgcctgcggcggacagatcctggtgtcggacgacgtgctgggcctgttctcggatttcacgccgcgctttgtcaagcgctacgcgcagctgggccccatcatcgaacaggccgccgcggcctacgccagcgaggtccgcgcgcgcacgttcccggcgccggaacactgcaccggcatgccggcgcccgacggccgcccggcctga

SEQ ID NO: 11181 - protein, 278 aa, Bordetella bronchiseptica
MSVPTAAKRITTRQLRMRTPDEPIVALTAYTAPIAGLLDAHCDLLLVGDSLGMVIYGMETTLPVTVDMMIQHGRAVMRGSQRACVAVDMPFGSYQEDERQAYRNAARIMAETGASCVKLEGGAEMASTVAFLVERGIPVMGHVGLKPQSVHGHGGFRTVGRGAEAEQVMADAQAIAAAGAFTVVIEGTLEPVARAITEALPVPTIGIGASPACGGQILVSDDVLGLFSDFTPRFVKRYAQLGPIIEQAAAAYASEVRARTFPAPEHCTGMPAPDGRPA

SEQ ID NO: 11182 - DNA, 792 bp, Buchnera aphidicola subsp
  CDS (1)..(792): transl_table=11
atggagtccattacaatctctcaattaaagaattggaaaataaataaaaaaaaatttgcagctattacagcttatgattttagtttttctagattgttttctaattgtggcattcctgtcatacttataggagactctcttggaatgactatacaaggtcacacttctactttaccagtgaagattgaagatattgcatatcatacaaaagctgtcagaaaaggagctcctaatacgttcttaatatctgatttaccttttatgtcttattatgacactaaacaggctcttaaaaacacagcaaaaattataagatctggtgcaaatatgataaaaatggaaggtggaaaatggctaattgaaattattagagaactatctaatagattaatattaatttgcggtcatattggtttaatacctcaatcttttcattatttaggtggctataaagttcaaggacgaaaagaaaatgacgctaataaattaatagatgaagcattattattagaagaatctggaattaatatgcttatattagaatgtattccagaaaaactagcaaaaaagattactgaaagtttatcaattccagttattggaataggatcaggtaaaaatactgatggacaaattcttgtgatgcatgacttattaggtattactgaaggaaaaacacctagttttacaaaaaattttctctcagagagcgatagcattcaaaaagcaattcaaaagtatatatatgaagtggaacatagtatttatcctagcaaaaaacatagtttttaa

SEQ ID NO: 11183 - protein, 263 aa, Buchnera aphidicola subsp
MESITISQLKNWKINKKKFAAITAYDFSFSRLFSNCGIPVILIGDSLGMTIQGHTSTLPVKIEDIAYHTKAVRKGAPNTFLISDLPFMSYYDTKQALKNTAKIIRSGANMIKMEGGKWLIEIIRELSNRLILICGHIGLIPQSFHYLGGYKVQGRKENDANKLIDEALLLEESGINMLILECIPEKLAKKITESLSIPVIGIGSGKNTDGQILVMHDLLGITEGKTPSFTKNFLSESDSIQKAIQKYIYEVEHSIYPSKKHSF

SEQ ID NO: 11184 - DNA, 792 bp, Buchnera aphidicola subsp
  CDS (1)..(792): transl_table=11
atggaatctattactatatcaaaaatacaaaactggaaaaaaaatcaaataaaatttgctgctattacagcttatgatttcagtttttctagactttttgaaaaggaaggtattcctattatgcttgtaggtgattctctaggtatgactattcaaggtcataattctacactacctgtaaaaattcaagatattaaatatcatacaaaagcagtgagaagaggtgcaccaaattcctttttattgtctgatttaccatttatgtcgtattatagtatcgaagaaactttaaaaaacacagctaaaattatacaatctggtgctaatatgataaaaatagaaggtggaaaatggttagttgaaactgtcaaagaactatcaaaaagatcaatattagtgtgtggtcatataggattaaccccacaatctataaattttttaagcgggtataaaattcaaggaaaagaaaaaaatgatgcacaacgaataatagatgaagcctttattctagaagaagcaggaattaaaatgctagttttagaatgtattccttcacttttagctaaaaaaataactgaaaacttatctattccagtaattggtataggatcaggtcatcatactgacggacaaatacttgttatgcaagatttattaggaataacggatggaaaaaaactaaaatttgtaaaaaatttcctttgtcacaatggaagcattcaaaatgctattaaacaatatatcaatgaagttaaaaatggaaatttccccagtgaaaaatatagtttttaa

SEQ ID NO: 11185 - protein, 263 aa, Buchnera aphidicola subsp
MESITISKIQNWKKNQIKFAAITAYDFSFSRLFEKEGIPIMLVGDSLGMTIQGHNSTLPVKIQDIKYHTKAVRRGAPNSFLLSDLPFMSYYSIEETLKNTAKIIQSGANMIKIEGGKWLVETVKELSKRSILVCGHIGLTPQSINFLSGYKIQGKEKNDAQRIIDEAFILEEAGIKMLVLECIPSLLAKKITENLSIPVIGIGSGHHTDGQILVMQDLLGITDGKKLKFVKNFLCHNGSIQNAIKQYINEVKNGNFPSEKYSF

SEQ ID NO: 11186 - DNA, 816 bp, Burkholderia thailandensis
  CDS (1)..(816): transl_table=11
atgacctaccttcaggaatccagccgaccggccgtgacggtgcccaagctgcaggcgatgcgtgaagccggcgagaagatcgccatgctcacctgctacgacgcgagcttcgccgccctcctcgatcgcgcgaacgtcgacgtgcaactgatcggcgattcgctcggcaacgtgctgcaaggccagacgacgacgctgcccgtcacgctcgacgacatcgcgtaccacaccgcctgcgtcgcgcgcgcgcagccgcgcgcgctcatcgtcgcggacctgccgttcggcacctacggcacgcccgccgacgcgttcgcgagcgcggtgaagctgatgcgcgcgggcgcgcagatggtcaagttcgaaggcggcgaatggctcgccgaaacggtgcgcttcctcgtcgagcgagcggtgcccgtgtgcgcgcacgtcggcctcacgccgcaatcggtgcacgcgttcggcggcttcaaggtacagggaaagacggaagcgggcgccgcgcaattgctgcgcgacgcgcgcgcggtcgaagaagcgggcgcgcagctcatcgtgctcgaggccgtgccgacgctcgtcgcggcggaagtcacgcgcgagctgtcgatcccgacgatcggcatcggcgcgggtgcggaatgttccggccaggtcctcgtgctgcacgacatgctcggcgtgttccccggcaaacgccctcgcttcgtcaaggatttcatgcagggacagccgagcatcttcgcggccgtcgaggcttacgtgcgcgcggtgaaggacggcagcttccccgggcccgagcattcgttctga

SEQ ID NO: 11187 - protein, 271 aa, Burkholderia thailandensis
MTYLQESSRPAVTVPKLQAMREAGEKIAMLTCYDASFAALLDRANVDVQLIGDSLGNVLQGQTTTLPVTLDDIAYHTACVARAQPRALIVADLPFGTYGTPADAFASAVKLMRAGAQMVKFEGGEWLAETVRFLVERAVPVCAHVGLTPQSVHAFGGFKVQGKTEAGAAQLLRDARAVEEAGAQLIVLEAVPTLVAAEVTRELSIPTIGIGAGAECSGQVLVLHDMLGVFPGKRPRFVKDFMQGQPSIFAAVEAYVRAVKDGSFPGPEHSF

SEQ ID NO: 11188 - DNA, 816 bp, Burkholderia vietnamiensis
  CDS (1)..(816): transl_table=11
atgacctatctccaggaatcgagccggcctgcgatcacggtgccgaagctgcaggcaatgcgcgaagccggcgagaagatcgcgatgctgacctgctacgacgcgagcttcgccgcgctgctcgatcgcgccggcaccgacgtgctgctgatcggcgactcgctcggcaacgtgctgcaaggccacacgaccacgctgcccgtgtcgctcgacgacatcgcgtaccacaccgcgtgcgtcgcgcgcgtgcagccgcgcgcgctggtcgtcgccgatctgccgttcggcacctacggcacgcccgcggaagcgttcgcccattcggtcgcgctgatgcgcgcgggcgcgcagatggtcaagctcgaaggcggcgaatggctcgccgacacgatccgctttctcgtcgaacgctcggtgccggtgtgcgcgcatctcggcctcacgccgcagtcggtgcatgcgttcggcggcttcaaggttcagggccgcaccgaagccggcgccgcgcagttgctgcgcgacgcgcgcgcgatcgaggacgccggcgcgcagctcgtcgtgctcgaagcggtgccgacgctcgtggccgccgaagtcacgcacatgctgaagatcccgacgatcgggatcggcgcggggctcgattgctcgggccaggtgctggtgctgcacgacatgctgggcatcttccccggcaagcggccgcgcttcgtgaaagatttcatgcaaggccagccgagcatccaggccgccgtcgaagcgtacgtcagcgcggtgaaggagtgcacgttccccggccccgagcattcgttctga

SEQ ID NO: 11189 - protein, 271 aa, Burkholderia vietnamiensis
MTYLQESSRPAITVPKLQAMREAGEKIAMLTCYDASFAALLDRAGTDVLLIGDSLGNVLQGHTTTLPVSLDDIAYHTACVARVQPRALVVADLPFGTYGTPAEAFAHSVALMRAGAQMVKLEGGEWLADTIRFLVERSVPVCAHLGLTPQSVHAFGGFKVQGRTEAGAAQLLRDARAIEDAGAQLVVLEAVPTLVAAEVTHMLKIPTIGIGAGLDCSGQVLVLHDMLGIFPGKRPRFVKDFMQGQPSIQAAVEAYVSAVKECTFPGPEHSF

SEQ ID NO: 11190 - DNA, 816 bp, Burkholderia xenovorans
  CDS (1)..(816): transl_table=11
atgacctatttgcaggaagcgagccggaacgccgtcaccgtgccgaaactgcaggcaatgcgcgacgccggcgaaaaaatcgccatgctcacctgttacgacgcgagcttcgccgcgctgctggatcgcgcgggtgtcgacgtgctgttgatcggcgactcgctcggcaacgtgctgcaaggccagaccactaccctgcccgtgtcgcttgccgacatcgcttatcacacggctagtgtagcgcgcgcgcggcccgcggcgctgatcgtggccgacttgccgttcggcacttacggcacgccggaagatgctttcagaagctcggtcgagttgatgcgggccggcgcgcagatggtgaagctcgaaggcggcgaatggctcgcggacacggtgcgcttcctggtggagcgctcgattcccgtgtgcgcgcacgtcggcctgacgccgcaatccgtgcacgcattcggcggcttcaaggtgcaaggcaagaccgaggcgggcgcgacgcagttgctgcgcgactcgctcgccgtgcaggcggccggcgcgcaactgatcgtgatggaagcgattccgacgctgctcgccagcgacgccacgaagcaattgcgcattccgacgatcggcattggcgcgggtctggattgctcgggtcaggtgctggtgctgcacgacatgctaggcattttccccggcaaacggccgcgcttcgtcaaggatttcatgcaggggcagccgagtattctggcggccgtggaagcgtatgtcgccgcagtgaaggacggttcgtttcctggaccggagcacacgttctga

SEQ ID NO: 11191 - protein, 271 aa, Burkholderia xenovorans
MTYLQEASRNAVTVPKLQAMRDAGEKIAMLTCYDASFAALLDRAGVDVLLIGDSLGNVLQGQTTTLPVSLADIAYHTASVARARPAALIVADLPFGTYGTPEDAFRSSVELMRAGAQMVKLEGGEWLADTVRFLVERSIPVCAHVGLTPQSVHAFGGFKVQGKTEAGATQLLRDSLAVQAAGAQLIVMEAIPTLLASDATKQLRIPTIGIGAGLDCSGQVLVLHDMLGIFPGKRPRFVKDFMQGQPSILAAVEAYVAAVKDGSFPGPEHTF

SEQ ID NO: 11192 - DNA, 825 bp, Campylobacter jejuni
  CDS (1)..(825): transl_table=11
atgagaaaaagtattcttagttttttggaaaaaaaaggtaaaaatgaaaaaataaccatggtaagtgcctatgactaccatagtgcaaaaattctagataattgcgatatagatatcatattggttggagattcattagctatgacagtgcttggcatgcaagatactttaagtgtgaccatggatgaaatgttgatctttaccaaagctgtttctcgcggagctaaaaagtctttcgtacttgcggatatgcctttcatgtcttatcaaagctcggatcgtgacgctatcttaaatgcctcaagatttatcaaagaaagccatgcaaatggggtaaaagtggaagggggtatagaaatcgcaagcaagattaaattaatttcccaatcaggaatacccgtcgttgctcacctaggactaaccccacaagctgtaaatatgctaggtggatatagagttcaaggtaaagatttacaatcggctcaaaaaatcatagatgatgcaaaagctgtgcaagatgcgggtgcttgtatgttggttttagaatgcgtacctgtaaaattagcacaaaaaataagctctattttagaaattccaacaatcggcataggttcaggtaaatactgcgatggacaagttttagtttatcatgatcttttaggtttaaataaagattttaaagcaaaatttgtaaagcattttgataaaattgaccctcaagtaggagttgaaaaatatagagatgaagttaaaagcggtatttttccttccgaagagcacagctttgattatttagatgatgaattattagataaattatactaa

SEQ ID NO: 11193 - protein, 274 aa, Campylobacter jejuni
MRKSILSFLEKKGKNEKITMVSAYDYHSAKILDNCDIDIILVGDSLAMTVLGMQDTLSVTMDEMLIFTKAVSRGAKKSFVLADMPFMSYQSSDRDAILNASRFIKESHANGVKVEGGIEIASKIKLISQSGIPVVAHLGLTPQAVNMLGGYRVQGKDLQSAQKIIDDAKAVQDAGACMLVLECVPVKLAQKISSILEIPTIGIGSGKYCDGQVLVYHDLLGLNKDFKAKFVKHFDKIDPQVGVEKYRDEVKSGIFPSEEHSFDYLDDELLDKLY

SEQ ID NO: 11194 - DNA, 831 bp, Carboxydothermus hydrogenoformans
  CDS (1)..(831): transl_table=11
atggatagggttaccgttagcagtttaaaagagatgaaagaagcgggtcagaagattgccatgataacggcttatgattatccttccgccctctttgccgaggaagctggcgcggaagtgcttttagtaggggattcgttagggatggtggttttgggttacgacagtactgtccccgttaccatggaggagatgctccatcacgtcaaggcggtggtacgggggagcaaaaggagcatggtagttgcagacatgcctttcatgtcttatcaggcaagttacaccgatgccctttataatgccggccgctttttaaaagaaggaggagctcaggcggtaaaacttgaagggggcggtgaaatagctgaactggtggcgaagcttgtaactgcaggaataccggtaatgggacatattggcctaactccccagtcggttaatgcccttgggggttataaagttcaaggtaaggacttaaagactgcccaaaaacttttggatgatgctaaagctttggcagatgcgggggcatttgccatagttttggaatgcgtgccggcggctttagcggcaaaaataaccgaaagcataccaattccaacaataggaattggctcgggagtaaactgcgatggacaggttctggtttaccacgatgttttggggatgtatccccggatgttacctaagtttgtaaaaagatatgccgatctttcaagcttaattaaagaagcaataagacaatatgtgcaggaagtgaaggagcaacaattcccggaagaaaaacacagttttaccatggctccggagatattagaaagaatctattag

SEQ ID NO: 11195 - protein, 276 aa, Carboxydothermus hydrogenoformans
MDRVTVSSLKEMKEAGQKIAMITAYDYPSALFAEEAGAEVLLVGDSLGMVVLGYDSTVPVTMEEMLHHVKAVVRGSKRSMVVADMPFMSYQASYTDALYNAGRFLKEGGAQAVKLEGGGEIAELVAKLVTAGIPVMGHIGLTPQSVNALGGYKVQGKDLKTAQKLLDDAKALADAGAFAIVLECVPAALAAKITESIPIPTIGIGSGVNCDGQVLVYHDVLGMYPRMLPKFVKRYADLSSLIKEAIRQYVQEVKEQQFPEEKHSFTMAPEILERIY

SEQ ID NO: 11196 - DNA, 789 bp, Cenarchaeum symbiosum
  CDS (1)..(789): transl_table=11
atgaaggggtcggagaaaatcacggtggtcgcctgctatgactattcgatggctgcactgtgcgacggggcggacatgctgctagtcggcgatagcgccggcatggtcgtgctcgggtatgacagcaccaccagggtgacaatggacgagatgtgcctgtttacgggtgctgtatcccggggccggaaggattcaatggtggtcggagacctgccgttcatgtcgtaccaggcgtgcacggcagatgcgataaggaactcgggcaggctggtgagggccggggccgacgcggtaaagctcgagggcggggccgctgtagcggatgcagtgcgcggcgtaaccggggcgggcatccccgtgatgggccacatagggctgctgccccagacggcggcgctatccggcgggtacagggtgcagggcaggaccagggagtcggcgctgcggctcgccgaagacgccaaggccctcgaggaggcgggcgcctttgcgatagtgctcgagatggtagcagaggaggcggcccgcatggtgacaaaatcggtgggtgttcccaccatcgggataggctccggcgcgggctgcgacggccaggtgctggtattgcacgatatgctgggcctgtacggcaggttcaggccaaagttcgccaaggtgtacgcggatctctccggtgaggtggccggggcggtggccgggttcaaggcggaggtggaatcttcacagtttccgcgccctgagaactcgttttacatggacgcaggcgaggcggacgggcttgacaggtag

SEQ ID NO: 11197 - protein, 262 aa, Cenarchaeum symbiosum
MKGSEKITVVACYDYSMAALCDGADMLLVGDSAGMVVLGYDSTTRVTMDEMCLFTGAVSRGRKDSMVVGDLPFMSYQACTADAIRNSGRLVRAGADAVKLEGGAAVADAVRGVTGAGIPVMGHIGLLPQTAALSGGYRVQGRTRESALRLAEDAKALEEAGAFAIVLEMVAEEAARMVTKSVGVPTIGIGSGAGCDGQVLVLHDMLGLYGRFRPKFAKVYADLSGEVAGAVAGFKAEVESSQFPRPENSFYMDAGEADGLDR

SEQ ID NO: 11198 - DNA, 834 bp, Chlorobium tepidum
  CDS (1)..(834): transl_table=11
atgaaccagccctctggcaataaattgccccacgtcacaacccgccggatgctcgatatgaaagagcgcggcgagaagatcgccatgctgaccgcctatgactacacgatggcgcggattctggaccgctcgggcgttgacgcgattcttgtcggcgattcggcgagcaacgtcttcgccgggcacagcaccacgctgccgatgaccgttgacgagatgatctaccacgccaaggcggtggtgcgtggcgtgcaggcagagacgcgacgggcgatggtgattgtcgatatgcccttcatgagctaccagctctcgccggaagatgcggtgcgcaacgccgggaaaatcatgaaagagcacgagtgcgacgcggtgaaaatggaggggggcaaggtgatcgccgaagcggtcaagcggatcaccgatatcggcattccggtgatgggccacctcggcctcatgccgcagtcgatctacaaatatggcagctacaaggtgcgcgcgatggaggaggaggaggcccggcagctcatcgaggatgcgaagatcatcgaggaggctggagcgttcgccatcgtgctcgaaaagattccatcgaagctcgccggtgaggtgagccgcttgctgaccattccgactatcggcatcggcgcggggccggagtgcgacggccaggttctggtcatcaacgacatgcttggcctcagcaccgacttccgccctcgcttcgtccgccgctacgctgacctctcctcggtgatcgagcaagcggtcaaaagctacgtcgaggatgtgcggagcaacagcttcccgtcggaggatgagagttactga

SEQ ID NO: 11199 - protein, 277 aa, Chlorobium tepidum
MNQPSGNKLPHVTTRRMLDMKERGEKIAMLTAYDYTMARILDRSGVDAILVGDSASNVFAGHSTTLPMTVDEMIYHAKAVVRGVQAETRRAMVIVDMPFMSYQLSPEDAVRNAGKIMKEHECDAVKMEGGKVIAEAVKRITDIGIPVMGHLGLMPQSIYKYGSYKVRAMEEEEARQLIEDAKIIEEAGAFAIVLEKIPSKLAGEVSRLLTIPTIGIGAGPECDGQVLVINDMLGLSTDFRPRFVRRYADLSSVIEQAVKSYVEDVRSNSFPSEDESY

SEQ ID NO: 11200 - DNA, 789 bp, Chromobacterium violaceum
  CDS (1)..(789): transl_table=11
atgaaaataaccgtcaataccctgcacaagctggccgaggaaggccggaagatcaccatgctgacctgctacgacgccagcttcgccagcctgctggacgaggccggcgtggaaatcctgctggtcggcgactcgctgggcccggtgatgcagggcgtggactccacgctgccggtcagcgaagaggacatgctctaccacatccgctgcgtggcccgcggcgccaagaacgcgctgatcctcggcgacatgaccttcggcgcctaccaggagagcccgcaacaggccttcgcccatgccgcgcgcctgctgcaggccggcgcccacatggtgaagctggaaggcggcgcctacatggccgagaccacccgcttcctggtggagcgcggcattccggtgtgctcccacatcggcctgacgccgcaatacgtcaacatgttcggcggctaccgcgtgcagggcaggggcgaagacgcgcagcgcatcctgaacgacgccaaggtcctggccgaggccggcgccagcctggtgctgatggagtgcgtgccggcgccgctggccaaggagatcaccgaaaccgtcaaggcgccgaccataggcataggcgcgggcgcggacacgtccggccaggtgctggtgctgcacgacatgctgggcgtgtatccgggcaagaaggccaagttcgtcaagaacttcatggaagaggccggcagcatccagggcgctgtccaggcttacatcaaggcggtgaaggacaagaccttcccggccgaagagcacacttactaa

SEQ ID NO: 11201 - protein, 262 aa, Chromobacterium violaceum
MKITVNTLHKLAEEGRKITMLTCYDASFASLLDEAGVEILLVGDSLGPVMQGVDSTLPVSEEDMLYHIRCVARGAKNALILGDMTFGAYQESPQQAFAHAARLLQAGAHMVKLEGGAYMAETTRFLVERGIPVCSHIGLTPQYVNMFGGYRVQGRGEDAQRILNDAKVLAEAGASLVLMECVPAPLAKEITETVKAPTIGIGAGADTSGQVLVLHDMLGVYPGKKAKFVKNFMEEAGSIQGAVQAYIKAVKDKTFPAEEHTY

SEQ ID NO: 11202 - DNA, 831 bp, Clostridium acetobutylicum
  CDS (1)..(831): transl_table=11
atgaaaaataccactgaaacatttaaaaattctaaatttaaaaaagagaagctcgttatgttaacagcctatgattactcaactgcaaagataattgattcctgcgacatcaatggaattctcgttggagattctcttggcatggtatgtctcggatacgaaaataccttaagtgtaacaatggaagacatgattcatcatacaaaagctgtagtacgtggtgcaaaaagcacccttattgtagctgacttaccttttatgtcatatcaaacttcagtttacgatgctgtttttaacgccggtaggcttgtcaaagaagctggtgctactgccattaaacttgagggcggtgctttagtctgcgatagaataaaagcaatcgtggatgctcaaattcctgtaatgggccatattggtcttactccccaatctgtaaatgcctttggcggttttaaaattcagggaaaaaatatctctaaagcaaaagaactaattgaagatgctaaaaagatagaagcagctggagcctttgctattactttagagggtattcctgagaaacttgctaaaattataactgaaagcattacaataccaactataggaattggtgctggtaaacattgtgatggtcaaatacttgtttatcaagatatgcttggaatgttttctgatttggcgcctaaatttgttaaaagatatggtaatataggtgacgacatgaaagaagcttttaatagttatgcaaaagaagtacgagaaggcacatttcctgacgaagctcactcatttaagattgatcagagcattatagacgaaattaccaaataa

SEQ ID NO: 11203 - protein, 276 aa, Clostridium acetobutylicum
MKNTTETFKNSKFKKEKLVMLTAYDYSTAKIIDSCDINGILVGDSLGMVCLGYENTLSVTMEDMIHHTKAVVRGAKSTLIVADLPFMSYQTSVYDAVFNAGRLVKEAGATAIKLEGGALVCDRIKAIVDAQIPVMGHIGLTPQSVNAFGGFKIQGKNISKAKELIEDAKKIEAAGAFAITLEGIPEKLAKIITESITIPTIGIGAGKHCDGQILVYQDMLGMFSDLAPKFVKRYGNIGDDMKEAFNSYAKEVREGTFPDEAHSFKIDQSIIDEITK

SEQ ID NO: 11204 - DNA, 828 bp, Clostridium difficile
  CDS (1)..(828): transl_table=11
atgaaaaataccatacagacttttaagaatgctaaatatgaaggaaaaaaactatctatgcttactgcttatgactactcaattgcaaaaataatggatgagtgtgatataaatggtattttaataggagattcattaggaatggtcataaaaggtgaagaaaacactctatctgttaccatagacgaaattatatatcatacaaaagctgtaaaaaatggtgtaaaaaatgccttaatcgtaagtgatatgccttttctatcttaccatgtttctatagaagatgcagttaaaaacgctggtagacttataaaggaaggaggagctcatgctgtaaagttagaaggtggctcaaacgttataaagcaaatagaaagcattgtaaatgctcaaatacctgtaatggggcatttaggattaactcctcaatcagtaaattcatttggtgggtttaaggttcaaggaaataccagtgaaacagcaagacaacttattgaagatgctaaattaatagaaaaagcaggtgcattctctattgtccttgaaggagtgcctacgaaaatagctgagatggtaactaattctatttcaattcctacaataggtataggggcaggaattaactgtgatggacaaattttagtttatcaagatatgttgggaatgtttggagattttgttcctaagtttgtaaagcagtatgcaaatataggagatataatgaaagattcaattaaaaattacatcctagaagttaatacaggtgcatttccacaagaaaaacacagcttttcaataaatgaatctgagttagaaaaattatactaa

SEQ ID NO: 11205 - protein, 275 aa, Clostridium difficile
MKNTIQTFKNAKYEGKKLSMLTAYDYSIAKIMDECDINGILIGDSLGMVIKGEENTLSVTIDEIIYHTKAVKNGVKNALIVSDMPFLSYHVSIEDAVKNAGRLIKEGGAHAVKLEGGSNVIKQIESIVNAQIPVMGHLGLTPQSVNSFGGFKVQGNTSETARQLIEDAKLIEKAGAFSIVLEGVPTKIAEMVTNSISIPTIGIGAGINCDGQILVYQDMLGMFGDFVPKFVKQYANIGDIMKDSIKNYILEVNTGAFPQEKHSFSINESELEKLY

SEQ ID NO: 11206 - DNA, 852 bp, Clostridium thermocellum
  CDS (1)..(852): transl_table=11
atgaacgacaaatttacaacggcaagctttttggaatcaaaaaaacaaggtagaaaaattacaatgcttacagcctatgactacccaacggctaaaattttggatgaagcaggagtggactcaatactggtcggggattctcttggaatggtagtcctgggatatgaggatactacgcgggtgacgatggatgacatggttcatcacacaaaagctgttgtgcggggagtaaaaagggcaatggttgttgcagacatgccgtttttatcctaccatacaggaaaaaacgacagtgtaagaaatgccggaagacttgtgtccgaagggggctgcaaggctgtaaaacttgaaggcggcgaggatataattgaaaacgtgaaggccatcatcagtgccggaatacccgtagtcggacatcttggatatacaccccagtcaataaatgttttcggaggacacaaggctcagggaaaaactattgacacagcaaagaaaatataccgggatgcacttttgttgcaaaaagcaggggtttttgccgtggttttggagtgtgtgccgtataaacttgcggcttttatttcaaagagattggatatacccacaataggaattgggtccggtccggactgtgacggacaggttcttgtcatacatgatttgacaggtatgtttaaggattttactccaaagcatgttaaaaagtacgctgagattggagaaactgtatccacggcggtaaaaagctatatagacgaagtgaaaaacggagtatttccaacagaaaaaaattcttttaaagtggatgattggattattgatgagcttgataaagttaggtttgacatttag

SEQ ID NO: 11207 - protein, 283 aa, Clostridium thermocellum
MNDKFTTASFLESKKQGRKITMLTAYDYPTAKILDEAGVDSILVGDSLGMVVLGYEDTTRVTMDDMVHHTKAVVRGVKRAMVVADMPFLSYHTGKNDSVRNAGRLVSEGGCKAVKLEGGEDIIENVKAIISAGIPVVGHLGYTPQSINVFGGHKAQGKTIDTAKKIYRDALLLQKAGVFAVVLECVPYKLAAFISKRLDIPTIGIGSGPDCDGQVLVIHDLTGMFKDFTPKHVKKYAEIGETVSTAVKSYIDEVKNGVFPTEKNSFKVDDWIIDELDKVRFDI

SEQ ID NO: 11208 - DNA, 795 bp, Colwellia psychrerythraea
  CDS (1)..(795): transl_table=11
atggctaaaatcactactgcaagcttgcttaacatgaaacaacaaggcaaaaagatatcaactattactgcctatgatgccagctttgcaaaattatttgatcaagcaggcatacacgccatacttattggcgactctttaggtatggtattacaggggcaagacagcacattacctgtgacaatcgaagatatggcttatcatacacgttgtgtaaaacgtggcgttgaagagacccttattatcgccgatatgccttttatgagctatgccaacgaagagcaagctctagcaaatgcagcgctgttaatgcaagcaggcgctagtatggtaaaaatagaaggtggtgcttggcttaacggcactatttctgcccttgttgaacgcggtgttcccgtttgtgctcatttaggtttaacaccgcaatcagttaatattttcggtggctttaaagtgcaaggccgtgacgatgacaaagcccaacaaatgatcgctgatgcaaaagcacttgaagcagctggcgctcaactattggtacttgaatgtattccagcgattttaggtgaagccatcacgcaagcgcttactattccaactattggtataggcgcaggtaaagacactgatggacaaattttagttatgcacgatgccttaggtattgcgtgtaattatatgcctaagttttcgcgcaacttcttaaaagatactggtgatattaaaaaagccgttgagctctatatcagtgaagtgagtgaaggtaacttcccaggtgatgagcatatattcaagtaa

SEQ ID NO: 11209 - protein, 264 aa, Colwellia psychrerythraea
MAKITTASLLNMKQQGKKISTITAYDASFAKLFDQAGIHAILIGDSLGMVLQGQDSTLPVTIEDMAYHTRCVKRGVEETLIIADMPFMSYANEEQALANAALLMQAGASMVKIEGGAWLNGTISALVERGVPVCAHLGLTPQSVNIFGGFKVQGRDDDKAQQMIADAKALEAAGAQLLVLECIPAILGEAITQALTIPTIGIGAGKDTDGQILVMHDALGIACNYMPKFSRNFLKDTGDIKKAVELYISEVSEGNFPGDEHIFK

SEQ ID NO: 11210 - DNA, 792 bp, Corynebacterium diphtheriae
  CDS (1)..(792): transl_table=11
gtgacccgtcccgtccgactgcaagacttgcgcgactacaaaaagaacaaccgtccgtgggccatgctgaccacctacgactactccaccactcgcgcatttgtggacgcgggtatcgaggttttcctcgtaggagattctgcggccaacacaatgctgggatattccggaactaaccaggtgagctttgaggagatggtcatgctcacggcggcggtggtgcgcggtgcgggtcctgcgatggtggtggctgaccttccgttcggcacctacgaggcgagtgacgagcaggcggtgcgcagtgccacggagatggttcgtcgaactggtgctcacgtggtcaagcttgaaggtggcgttcggatggcgtcgcggattcgcgctattacagatgcaggggttccggtgtgcgcacacctaggttttactccgcagtcgatgaatcagctttctggttttaaggtgcagcgaggcgcggagaagctgacggctgatgtggatgctgtcgtggaggcgggtgcagagatggtggtgtttgagatggttccggcggatcttgccgcggagcttactgcccgctgcccgattccggtgattggaattggcgccggcaatgctaccgacgcccaggtgttggtgtggcacgatatcgcgaatcttcctaaaggtgatcatcgtgcccgttttgttaagacgtatgcagaggttggttcgcagcttacttgcgcggcgcggttctatcgaaaggatgtggaggcacgtcgcttccccgctgaggagcacacgttctaa

SEQ ID NO: 11211 - protein, 263 aa, Corynebacterium diphtheriae
MTRPVRLQDLRDYKKNNRPWAMLTTYDYSTTRAFVDAGIEVFLVGDSAANTMLGYSGTNQVSFEEMVMLTAAVVRGAGPAMVVADLPFGTYEASDEQAVRSATEMVRRTGAHVVKLEGGVRMASRIRAITDAGVPVCAHLGFTPQSMNQLSGFKVQRGAEKLTADVDAVVEAGAEMVVFEMVPADLAAELTARCPIPVIGIGAGNATDAQVLVWHDIANLPKGDHRARFVKTYAEVGSQLTCAARFYRKDVEARRFPAEEHTF

SEQ ID NO: 11212 - DNA, 810 bp, Corynebacterium glutamicum
  CDS (1)..(810): transl_table=11
atgtcaggcattgatgcaaagaaaatccgcacccgtcatttccgcgaagctaaagtaaacggccagaaagtttcggttctcaccagctatgatgcgctttcggcgcgcatttttgatgaggctggcgtcgatatgctccttgttggtgattccgctgccaacgttgtgctgggtcgcgataccaccttgtcgatcaccttggatgagatgattgtgctggccaaggcggtgacgatcgctacgaagcgtgcgcttgtggtggttgatctgccgtttggtacctatgaggtgagcccaaatcaggcggtggagtccgcgatccgggtcatgcgtgaaacgggtgcggctgcggtgaagatcgagggtggcgtggagatcgcgcagacgattcgacgcattgttgatgctggaattccggttgtcggccacatcgggtacaccccgcagtccgagcattccttgggcggccacgtggttcagggtcgtggcgcgagttctggaaagctcatcgccgatgcccgcgcgttggagcaggcgggtgcgtttgcggttgtgttggagatggttccagcagaggcagcgcgcgaggttaccgaggatctttccatcaccactatcggaatcggtgccggcaatggcacagatgggcaggttttggtgtggcaggatgccttcggcctcaaccgcggcaagaagccacgcttcgtccgcgagtacgccaccttgggcgattccttgcacgacgccgcgcaggcctacatcgccgatatccacgcgggtaccttcccaggcgaagcggagtccttttaa

SEQ ID NO: 11213 - protein, 269 aa, Corynebacterium glutamicum
MSGIDAKKIRTRHFREAKVNGQKVSVLTSYDALSARIFDEAGVDMLLVGDSAANVVLGRDTTLSITLDEMIVLAKAVTIATKRALVVVDLPFGTYEVSPNQAVESAIRVMRETGAAAVKIEGGVEIAQTIRRIVDAGIPVVGHIGYTPQSEHSLGGHVVQGRGASSGKLIADARALEQAGAFAVVLEMVPAEAAREVTEDLSITTIGIGAGNGTDGQVLVWQDAFGLNRGKKPRFVREYATLGDSLHDAAQAYIADIHAGTFPGEAESF

SEQ ID NO: 11214 - DNA, 801 bp, Coxiella burnetii
  CDS (1)..(801): transl_table=11
gtgattgctatgaatacccctgatttccaacgaatgaaaaaagacaataaaaaaatcagcatggtgacctgctacgattattggtcggcttgtattatctcccaaagtaacgtggactgtattttagtgggcgacagtttggcgatggtgatgtatggtcattcaacgacactacctgcgaccgtggagataatggcgcaacacattcaagcggtatcccgaggcgctcccaataaatttattatcggcgatatgccgttttgctcctatcgaaaagatttaacgacgagtatgaatgcggttgaacgactcatgcaagcgggcgcacaggcgattaaattagaaggcgctgacgcgcataatttaaaattcattcatcacgtcgtgaaatctggtattcctgtgataggacatctgggattaacgcctcagtctatttacactctcggtggttttaaagttcaaggcaaagaaccctctgcggctaaaaaattaatggcggatgcgaaggcattggctgagactggctgctttgcggtggtattagaatgtgtgccaagcgaattagcagaattaattacccactcgatttccattcccactatcggaattggtgcgggtcctgcgacttcagggcaagtgcttgtcttacaagatttgcttggcacgaataatcaatttcagcctaaataccttaaaaaatttttgaatggttttgaactgataaaaaaagccttagatgattttgatcaggaagtgaaaacctccacttatccacatctcgaaacacattgttattga

SEQ ID NO: 11215 - protein, 266 aa, Coxiella burnetii
MIAMNTPDFQRMKKDNKKISMVTCYDYWSACIISQSNVDCILVGDSLAMVMYGHSTTLPATVEIMAQHIQAVSRGAPNKFIIGDMPFCSYRKDLTTSMNAVERLMQAGAQAIKLEGADAHNLKFIHHVVKSGIPVIGHLGLTPQSIYTLGGFKVQGKEPSAAKKLMADAKALAETGCFAVVLECVPSELAELITHSISIPTIGIGAGPATSGQVLVLQDLLGTNNQFQPKYLKKFLNGFELIKKALDDFDQEVKTSTYPHLETHCY

SEQ ID NO: 11216 - DNA, 819 bp, Cytophaga hutchinsonii
  CDS (1)..(819): transl_table=11
atgtcaactgcaaaaagtgatattaaaaaagtaacaacacaccagcttcaggaaatgaagaaccgtggtgaaaaaatatccatgctcacagcctatgattattcgatggcaaaaattttagatgctgccggagttgatgttattttagttggtgactctgcttcaaatgtaatggcaggccatgaaacaacattgccgataacgcttgatcaaatgatctatcacgcatcttctgtgattcgtgctattaacagggcgttagttgttgttgatcttccttttggttcctatcagggaaattcatcagaagccttacgcagtgccatacgcattatgaaggagtctggtgcgcatgctgtgaaaatggaaggcggaattgaaattaaagaatctgtactgtgtatcattagtgctggtatacctgtgatggggcacttaggcttaatgcctcaatctatttataagtttggcacctatgtggtacgtgcacgtgaagaagaagaagcaaacaaacttattgctgatgcaaaaattttagaagaaagcggctgcttcggtttagtacttgaaaaaatacctgcctctctttcaaaaactgttacacatcaattacagattcctaccataggcattggtgccggccctgacgtagatggacaggtattggtcacacatgatctgttgggaattaataatgaattccacccgagattcctgcgtacctatgcgaacctgcaggccacaatcagcacggctgttacatcgtatattgatgatgtaaagtctaagaactttccgaacgaaaacgaatgttactag

SEQ ID NO: 11217 - protein, 272 aa, Cytophaga hutchinsonii
MSTAKSDIKKVTTHQLQEMKNRGEKISMLTAYDYSMAKILDAAGVDVILVGDSASNVMAGHETTLPITLDQMIYHASSVIRAINRALVVVDLPFGSYQGNSSEALRSAIRIMKESGAHAVKMEGGIEIKESVLCIISAGIPVMGHLGLMPQSIYKFGTYVVRAREEEEANKLIADAKILEESGCFGLVLEKIPASLSKTVTHQLQIPTIGIGAGPDVDGQVLVTHDLLGINNEFHPRFLRTYANLQATISTAVTSYIDDVKSKNFPNENECY

SEQ ID NO: 11218 - DNA, 819 bp, Dechloromonas aromatica
  CDS (1)..(819): transl_table=11
atgtctgctcaagtcgcaacccgccgcctgacccaggccgatctcgccaagctctaccaagctggtgagaaaatcgcccagttcacctgctatgacgccagctttgcccgtctgctcgacggcgccggggtcgattcgatcctgatcggcgattcgctgggtaacgtcatccagggccacgacaccacgctgccggtcaccgtcgccgacatcgcctatcacaccgccgccgtcaaacgcggctgcgaccgcgccttcattgttgccgacatgcctttcggcagttatcaggaatcgccggaacaggccttccgtaacgccgcgacactgatggccgccggcgcccagatggtcaagcttgaaggcggtgccgacatggcaccgaccgtacgtttcatggtcagccgcggcattccggtctgcggccatatcggcctgacaccacaatccgtgcatgtgctgggcggctacaaggtgcaaggcaagggcgaagctgcggcgcagcgcctgaaggacgatgccatggcgctcaaggcggccggtgccaccatgctgctgctcgaggccattccggccacgttggcagccgaagtcacggcgatgaccggcgtcatcaccatcggtatcggcgccggcaaggattgctccggccaggtcatggtgttgcacgatgcctttgatatcccgcccggcaagaaagccaagttcgtcaagaatttcatggaaggcgccagcagcattcacgacgccgcctgccgcgccatcgccgccgtcaaggacggcagctaccctggccccgaacacacctattccgcttaa

SEQ ID NO: 11219 - protein, 272 aa, Dechloromonas aromatica
MSAQVATRRLTQADLAKLYQAGEKIAQFTCYDASFARLLDGAGVDSILIGDSLGNVIQGHDTTLPVTVADIAYHTAAVKRGCDRAFIVADMPFGSYQESPEQAFRNAATLMAAGAQMVKLEGGADMAPTVRFMVSRGIPVCGHIGLTPQSVHVLGGYKVQGKGEAAAQRLKDDAMALKAAGATMLLLEAIPATLAAEVTAMTGVITIGIGAGKDCSGQVMVLHDAFDIPPGKKAKFVKNFMEGASSIHDAACRAIAAVKDGSYPGPEHTYSA

SEQ ID NO: 11220 - DNA, 849 bp, Dehalococcoides ethenogenes
  CDS (1)..(849): transl_table=11
atgcgcaccaccatcagccagctaaaggaaatgaaacagaacaagcagaagatagccatgctgactgcatatgactatcccactgcccaaatactggataaagccggtataccggccatactggtgggagacagtttgggtatggtggtgcttgggtatgattccaccgtaagcgtgaccatggaagatatgctgcaccatctgaaagccgtagtcaggggcagccaaaaggccatggtcatagccgatatgccctttatgacctatcacctaagcccggaacaggcactcctgaacgcagggcgttttatgcaggaaggcggcgctcaggcagtcaaactggagggcggggtaaatgtggctgacaaggttaaacgtatagttgactgcggcattcccgttatggggcatatagggctgactccccagtctgttaaccagctaagcgggtttaaagtccaggggaaaactctgacagctgctttagccctgctagaagatgccagggctctggaaaaagccggggcgtttgctatagtgctggagactatgccggctgagctggcggccatgattaccgctgccgtttccatacctaccataggcataggggcaggtgaaaattgtgatggccaggtgcaggtggtatccgatatgctgggtatgtttactgattttgtacctaaacataccaaaaaatacgctgatttaaacggtattatctcaaaagctgtatccggatatgtaactgaggttgcaaaaggtgaatttcccactttgaaagaaagcttcacccttgataaaaaggtattggaggaactgaaaaagtgcgtatcatcagaacagtag

SEQ ID NO: 11221 - protein, 282 aa, Dehalococcoides ethenogenes
MRTTISQLKEMKQNKQKIAMLTAYDYPTAQILDKAGIPAILVGDSLGMVVLGYDSTVSVTMEDMLHHLKAVVRGSQKAMVIADMPFMTYHLSPEQALLNAGRFMQEGGAQAVKLEGGVNVADKVKRIVDCGIPVMGHIGLTPQSVNQLSGFKVQGKTLTAALALLEDARALEKAGAFAIVLETMPAELAAMITAAVSIPTIGIGAGENCDGQVQVVSDMLGMFTDFVPKHTKKYADLNGIISKAVSGYVTEVAKGEFPTLKESFTLDKKVLEELKKCVSSEQ

SEQ ID NO: 11222 - DNA, 840 bp, Dehalococcoides sp
  CDS (1)..(840): transl_table=11
atgcgtaccactatcagccaacttaaagaaatgaaacaaaacaaacagaagatagccattttgactgcttatgactatcccactgcccaaatactggataaagccggtatcccggccatactggtaggagacagtctgggtatggtagtgctggggtatgattctaccgtaagcgttactatggaagatatgctgcaccatctgaaagccgtagtcaggggcagtcaaaaagccctgattatagcagatatgccatttatgacctaccatctgagtccggaacaggcgctgttaaatgccggtcgttttattcaggagggcggtgctcaggcagtcaagctggagggtggagtaaatgtggctgacaaggttaaaagaatagtagactgcggtatacctgttatggggcatatcggacttaccccccaatctgtaaaccagttaagcggatttaaggtgcaggggaaaactctggcaactgccctatcccttatagaagatgccaaggctctggaaaaagccggggcctttgcaatagtgctggagactatgccggctgaactggcggctattattacagccggtatttccatacctaccataggtataggtgccggagaagaatgtgacgggcaggtacaggtgatatcagatatgctgggtatgtttactgattttgtacccaagcacaccaaacggtatgctgatttaaatggcagtattacaaaagctgtatctgaatatgccgctgaagtcactaaaggtgcgtttcccactttaaaggagagcttcacccttgataaaaaggtactggaggaactgaaaaagtgcgtattataa

SEQ ID NO: 11223 - protein, 279 aa, Dehalococcoides sp
MRTTISQLKEMKQNKQKIAILTAYDYPTAQILDKAGIPAILVGDSLGMVVLGYDSTVSVTMEDMLHHLKAVVRGSQKALIIADMPFMTYHLSPEQALLNAGRFIQEGGAQAVKLEGGVNVADKVKRIVDCGIPVMGHIGLTPQSVNQLSGFKVQGKTLATALSLIEDAKALEKAGAFAIVLETMPAELAAIITAGISIPTIGIGAGEECDGQVQVISDMLGMFTDFVPKHTKRYADLNGSITKAVSEYAAEVTKGAFPTLKESFTLDKKVLEELKKCVL

SEQ ID NO: 11224 - DNA, 870 bp, Desulfovibrio desulfuricans
  CDS (1)..(870): transl_table=11
atgagcacacatgccgaaacccgcgccataaccgcggcggacatacgggcggcaaaaaacacaagacgtctggccatgctgacggcatacgactaccccacggcatccattgccgatgaaggcggcatggacatgctgctggtaggcgattcgctggccatggtggtgctggggcatgaggacacgctgtccgtgacactggacgagatgatccaccactgccgggccgtcacgcggggcgcctcacgcgcgctggtggtgggcgacctgccctttatgacctatgaacaggggccggatcaggccatgcacagcgcggcgcgactgttccgcgaaggcggtgtgcgcgctgtaaagctggaagggggcaaagaagtcgctccgcaggtggaggctcttgtgaaggcggggattcccgtcatggggcacatcgggcttactccgcagcgtgtagcggcgctgggcggctttaaagtgcaggggcgttcggcagccgccgcccgcagtctggcggaagatgcgcgcatactggaagatgcgggctgttttgcactggtactggaagccatacccgcccctgtggccgcgcacattacccgcacgtcaggcattcccaccatcggcataggggccggagcgcagtgcgacggacaggtgctggtggtgcacgatatgctgggcctgttcgaccgctttaccccgaagtttgtgaaacgctatgcagagctgcgcgggcatgccgtaaaagccgtgcagcagtatggtgatgaagtgcgtcagggagaatttcccgcggcgcagcactccttcggcatgccggaagacgaacagcgccgctgggaagaaaatgtcagcggcgcggacgactga

SEQ ID NO: 11225 - protein, 289 aa, Desulfovibrio desulfuricans
MSTHAETRAITAADIRAAKNTRRLAMLTAYDYPTASIADEGGMDMLLVGDSLAMVVLGHEDTLSVTLDEMIHHCRAVTRGASRALVVGDLPFMTYEQGPDQAMHSAARLFREGGVRAVKLEGGKEVAPQVEALVKAGIPVMGHIGLTPQRVAALGGFKVQGRSAAAARSLAEDARILEDAGCFALVLEAIPAPVAAHITRTSGIPTIGIGAGAQCDGQVLVVHDMLGLFDRFTPKFVKRYAELRGHAVKAVQQYGDEVRQGEFPAAQHSFGMPEDEQRRWEENVSGADD

SEQ ID NO: 11226 - DNA, 837 bp, Desulfitobacterium hafniense
  CDS (1)..(837): transl_table=11
ttgaaaacaacaaaagacttctgggtgatgaaaaatgaggggaaaaagattgtcatgattaccgcctacgattacccctcagccaagcaggccgaacaagcgggtgcggacataattctagtgggggattctctgggcaatgtggtgctgggctacgactctacggtttatgtcaccatggaagacatgatccatcatgggaaagcagctaagcgcggggctcccaatacgtttatcgtggcggacatgccttttatgagctgccatctgtccatcagggatactttgctcaatggagcaaggcttattcaggagacgggggcccaggctgtgaaagtggaaggggcggatgaaatgatccctcatatcagagctcttgtccgcgcgggaatacctgtagtctcccatcttggtctgacacctcagactgcggcagttctcggtggctttaaagttcggggtaaagatggggaggccgcccgcaaaatgctggaggatgtgaaggaatgccaggaggcaggggcttttgccctggtcctggagtgtattcccaagcagctggcccaggaaatttccacgaacttgacaattcccaccattggcatcggcgcaggtgttcataccgatggacaagtgctcgtctaccatgacatactcacctatggggtgaaccgggctcccaagtttgtcaaagcttatgccaatgctgatcaactcatgctcaaaggattgcaggactatgcggatgaggtaagaagtatgaatttccccgatgatgagcacagctttaccatgaaggaagaggaattaaaaaccttgtatggaggcaggggctaa

SEQ ID NO: 11227 - protein, 278 aa, Desulfitobacterium hafniense
MKTTKDFWVMKNEGKKIVMITAYDYPSAKQAEQAGADIILVGDSLGNVVLGYDSTVYVTMEDMIHHGKAAKRGAPNTFIVADMPFMSCHLSIRDTLLNGARLIQETGAQAVKVEGADEMIPHIRALVRAGIPVVSHLGLTPQTAAVLGGFKVRGKDGEAARKMLEDVKECQEAGAFALVLECIPKQLAQEISTNLTIPTIGIGAGVHTDGQVLVYHDILTYGVNRAPKFVKAYANADQLMLKGLQDYADEVRSMNFPDDEHSFTMKEEELKTLYGGRG

SEQ ID NO: 11228 - DNA, 855 bp, Desulfotalea psychrophila; identical to SEQ ID NO: 11008
  CDS (16)..(855): transl_table=11

SEQ ID NO: 11229 - protein, 279 aa, Desulfotalea psychrophila
MRKTVVDIIAMKAAGQKISMLTAYDASMSALLDQAGIDILLVGDSLGMTVLGYDSTVPVTMADMVHHMAAVRRGAPDAFVVGDMPFGSYQTGARDAVLNAMRLLKEGGCDVVKLEGGEVVCPVVKAIVDAGIPVMGHLGLTPQTAAVLGGYKVQGRDMEAARKLFADAKRLEEAGVCGLVLECIPAGLAEVVTASIAVPTVGIGAGKGCDGQVLVINDMLGLFEKFTPKFVKHYAQLAPLVRQGVENYIGEVRAGAFPEAEHTFTSSCDYKVLLSGDDQ

SEQ ID NO: 11230 - DNA, 924 bp, Desulfovibrio vulgaris
  CDS (1)..(924): transl_table=11
atgagcacacatacgcccccctcttcagccacgccgacatccgggcaaggcgtacggccactcaccaccgccgacatccgcaaggccaagggacggcagcgtctggccatgctcacagcctacgactacacttcagcccgtatcgtggatggtgccggggccgacctcattctcgtgggcgactcgctgggcatggtcatgcttgggcgtgaagacaccctctcggtcaccctcgacgagatgctgcaccactgccgcgcggtggtacgtggtacgcggcacgcgatggtcgtggcggacatgcccttcatgacctacgagaccggcgtgcgtgacgcactcctcaacggtgcgcgtctcttccgggagagtggcgtgcgtgcggtgaaactcgaaggtgccggcccggtgctaccgcaggtacgggcactggtcgacgcgggcatcccggtcatgggacatctgggcctcaccccgcaacgggtggcggagatgggaggcttcaaggttcagggaagacaggcggaagcggccctgcgcctcttcgacgacgcgcttgccttgcaggaagcgggctgtttcagccttgtgctcgaatgtgttccggcaccggtcgccgaacaggtcacggcccggctgcacatccccaccatcggcataggcgcgggcgcgggttgcgacgggcaagtgctcgttctacacgacatgctggggctgtacggcgagctttcaccgcgattcgtcaaacgctacgccgacctcgccggcatggcgggtgaagctgtggcccgctatgcgcatgaagtacgcgaggggtcattccctgctgcggaacacaccttcggtatcgacgacgggcagtttgaggccttcatggctgcactggacaaacgcggatgccgccagacaccgacaggagaatga

SEQ ID NO: 11231 - protein, 307 aa, Desulfovibrio vulgaris
MSTHTPPSSATPTSGQGVRPLTTADIRKAKGRQRLAMLTAYDYTSARIVDGAGADLILVGDSLGMVMLGREDTLSVTLDEMLHHCRAVVRGTRHAMVVADMPFMTYETGVRDALLNGARLFRESGVRAVKLEGAGPVLPQVRALVDAGIPVMGHLGLTPQRVAEMGGFKVQGRQAEAALRLFDDALALQEAGCFSLVLECVPAPVAEQVTARLHIPTIGIGAGAGCDGQVLVLHDMLGLYGELSPRFVKRYADLAGMAGEAVARYAHEVREGSFPAAEHTFGIDDGQFEAFMAALDKRGCRQTPTGE

SEQ ID NO: 11232 - DNA, 795 bp, Escherichia coli O157
  CDS (1)..(795): transl_table=11
atgaaaccgaccaccattgcttcattgcagaaatgtaagcaggaaaaaaaacgcttcgccaccatcaccgcctacgactacagcttcgcaaaactgtttgccgaggaagggctgaacgtgatgctggtgggcgactcgctggggatgaccgttcaggggcatgaatctacccttcccgttaccgttgaagatatcgcctaccacactaccgcagtacgtcgtggcgcgccaaactgcctgctgttggctgacctgccgtttatggcgtatgccacgccggaacaagcctttgaaaacgccgcaacggttatgcgtgccggtgctaacatggtcaaaattgaaggcggtgagtggctggtcgaaaccgtaaaaatgctgaccgaacgtgccgttcctgtatgtggtcacttaggtttaaccccacagtcagtgaatattttcggtggctacaaagttcaggggcgcggcgatgaagcgagcgatcgactgcttagcgatgcattagccttagaagccgctggtgcacagttgctggtgctggaatgcgtgccggttgaactggcaaaacgtattaccgaagcgctggcgatcccggttatcggtattggcgcaggcaacgttaccgatgggcagatcctcgtgatgcacgatgcgttcggcattaccggcggtcatatccctaaatttgccaaaaatttcctcgctgaaacgggcgacatccgcgctgcggtgcggcagtatatggctgaagtggagtccggcgtttatccgggcgaagaacacagtttccattaa

SEQ ID NO: 11233 - protein, 264 aa, Escherichia coli O157
MKPTTIASLQKCKQEKKRFATITAYDYSFAKLFAEEGLNVMLVGDSLGMTVQGHESTLPVTVEDIAYHTTAVRRGAPNCLLLADLPFMAYATPEQAFENAATVMRAGANMVKIEGGEWLVETVKMLTERAVPVCGHLGLTPQSVNIFGGYKVQGRGDEASDRLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 11234 - DNA, 795 bp, Escherichia coli
  CDS (1)..(795): transl_table=11
atgaaaccgaccaccatctccttactgcagaagtacaaacaggaaaaaaaacgtttcgcgaccatcaccgcttatgactatagcttcgccaaactctttgctgatgaagggcttaacgtcatgctggtgggcgattcgctgggcatgacggttcaggggcacgactccaccctgccagttaccgttgccgatatcgcctaccacactgccgccgtacgtcgcggcgcaccaaactgcctgctgctggctgacctgccgtttatggcgtatgccacgccggaacaagccttcgaaaacgccgcaacggttatgcgtgccggtgctaacatggtcaaaattgaaggcggtgagtggctggtagaaaccgtacaaatgctgaccgaacgtgccgttcctgtatgtggtcacttaggtttaacaccacagtcagtgaatattttcggtggctacaaagttcaggggcgcggcgatgaagcgggcgatcaactgctcagcgatgcattagccttagaagctgctggggcacagctgctggtgctggaatgcgtgccggttgaactggcaaaacgtattaccgaagcactggcgatcccggttattggcattggcgcaggcaacgtcactgacgggcagatcctcgtgatgcacgacgcctttggtattaccggcggtcacattcctaaattcgctaaaaatttcctcgccgaaacgggcgacatccgcgcggctgtgcggcagtatatggctgaagtggagtccggcgtttatccgggcgaagaacacagtttccattaa

SEQ ID NO: 11235 - protein, 264 aa, Escherichia coli
MKPTTISLLQKYKQEKKRFATITAYDYSFAKLFADEGLNVMLVGDSLGMTVQGHDSTLPVTVADIAYHTAAVRRGAPNCLLLADLPFMAYATPEQAFENAATVMRAGANMVKIEGGEWLVETVQMLTERAVPVCGHLGLTPQSVNIFGGYKVQGRGDEAGDQLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 11236 - DNA, 1050 bp, Emericella nidulans
  CDS (1)..(1050)
atgactttcttaagaatagcgacaaagcgggccatatacctgcatcgtcctgctaatccggctcttcctacctcgtctatactccctgtcctgcacagcaccaacgtcgccactcgtgtaccctcaccatgcgccatccgtcatagctcccactcgccgttgggagcagcccaagccaatcccagaaagaaagttaccatgcagaccttacgaaatttatacaagaagggcgagcctattacaatgttgactgcgcacgattttccgagcgcgcatgtcgccgacgcagccggaatggacatgattctcgtgggtgatagcttggcaatggtcgctctgggcatgcaggatacgagcgaagtgactctagatgacatgttagtgcactgtcgcagtgttgcccgagctgctcagagcgcctttacagtttcagatttacctatgggttcgtacgaggtgtcgccagaacaagctcttcagtcggctattcgaatcgtgaaagagggtcgggtgcagggggttaagcttgaaggtggggaggagatggctccagccatcaagcgcatcacaactgctggtattcccgttgttggacatatcggtctcacgcctcagcgtcaaaacgcgcttggagggtttcgagttcaaggaaagtcaacgacggacgcactgaaactgttaaaggacgcacttgcggtacaagaagcaggtgcgttcatgatagttatcgaggccgtaccgccagagatcgcaagtattgtcacacaaaagctcagtgttcctaccattggtattggtgccgggaacggttgctctggacaagtactcgtccagattgacatgaccgggaacttcccgcctggtcgcttcttacccaaatttgttaagcagtatgccaacgtctggaacgaggcactccaaggcatccaacagtatcgtgaggaggttaagagccgagcgtatcccgcagagcagcacacataccctataccgaaagaggaactggttgaattccagaaggctgttgatgaattacctgaagagaaatga

SEQ ID NO: 11237 - protein, 349 aa, Emericella nidulans
MTFLRIATKRAIYLHRPANPALPTSSILPVLHSTNVATRVPSPCAIRHSSHSPLGAAQANPRKKVTMQTLRNLYKKGEPITMLTAHDFPSAHVADAAGMDMILVGDSLAMVALGMQDTSEVTLDDMLVHCRSVARAAQSAFTVSDLPMGSYEVSPEQALQSAIRIVKEGRVQGVKLEGGEEMAPAIKRITTAGIPVVGHIGLTPQRQNALGGFRVQGKSTTDALKLLKDALAVQEAGAFMIVIEAVPPEIASIVTQKLSVPTIGIGAGNGCSGQVLVQIDMTGNFPPGRFLPKFVKQYANVWNEALQGIQQYREEVKSRAYPAEQHTYPIPKEELVEFQKAVDELPEEK

SEQ ID NO: 11238 - DNA, 828 bp, Enterococcus faecalis
  CDS (1)..(828): transl_table=11
atgaaaaatacagcagttacatttaaagaatctaaattaagaaatgaaaaattaacaatgcttacagcttatgactattcaacagcaaaaataattgatgaagctgggataaatggaatattagtaggagattctcttggtatggtatgtctaggacatgaagatacactttcagtaacaatggaagacatgattcatcatactagagcagttacaagaggagctaagaacactttagttgttgcagatatgccatttatgtcttatcaaacttcagtatatgattcagtagttaatgcaggaagattaataaaagaaggacgagctcaggttgttaaattagaaggagggatagaagtatgcgataaaatagaggctatagtaaaggcttctatacctgttatggcgcatataggtttaacacctcaatctgttaatgcatttggaggatttaaggtacaaggaaaggacaaggaagctgctaaagaattaataagagctgctaaagctgtagaaaaagcaggagcattcgctgtagtgttagaatgtgttccaactaagcttgcagagttaatttctaaagagatatcaatacctacaattggtattggagcaggtgcagggtgtgatggacaaattcttgtatatcaagatatgttggggatgtatagtgattttacccctaaatttgtgaagaaatatgctaatttatcagaagagatgaataaagcatttacaaaatatatagaggaagtaaaagatggagtttttccaggtccagaacatgggtttaaaataagtgatgatgttttagaaaaattatattaa

SEQ ID NO: 11239 - protein, 275 aa, Enterococcus faecalis
MKNTAVTFKESKLRNEKLTMLTAYDYSTAKIIDEAGINGILVGDSLGMVCLGHEDTLSVTMEDMIHHTRAVTRGAKNTLVVADMPFMSYQTSVYDSVVNAGRLIKEGRAQVVKLEGGIEVCDKIEAIVKASIPVMAHIGLTPQSVNAFGGFKVQGKDKEAAKELIRAAKAVEKAGAFAVVLECVPTKLAELISKEISIPTIGIGAGAGCDGQILVYQDMLGMYSDFTPKFVKKYANLSEEMNKAFTKYIEEVKDGVFPGPEHGFKISDDVLEKLY

SEQ ID NO: 11240 - DNA, 795 bp, Erwinia carotovora subsp
  CDS (1)..(795): transl_table=11
atgaaaccgacgactatctcccacttgcgccaatggaaacaagagcagcgaaaattcgctacgataacggcttacgatgccagcttctctcgtttgttttttgaacaaggcattcgcgtgatgctggtgggtgactctctgggaatgaccgtgcaaggtcacgactccacactgcccgtgaccacacacgacatcgtttaccatacacagtgtgtccgccgtggcgcaccgctggcactggttctctccgatatgccttttatgacctacgccacgccggaacaaacattcagccaggcagcagaactgatgcgcgctggggcgaatatggtgaagctggaaggcggaagctggcttgccccaacggtaaaaatgctgactgaacgtgccgtgccggtttgcggtcatctgggtctgactccgcagtccgttaacatcttcggtggctataaaattcagggccgcagcgaaagcgatgccaatcagctgctggccgatgctcttgcgcttgaagaagcaggtgctcagttgctcgtgctggaatgcgtgcctgtcgcgctggccaaacgtgtaacagaagcgctgtctattcccgtgatcggcattggcgcaggcaacgtcaccgacgggcagattctggtcatgcatgatgctttaggcattaccggcgacagcacgcctaagtttgccaagaattttctggcgcaaagcggtgatattcgcacggcggtacgcctgtattcacaagaagtcgaacagggtatctacccagccgaagaacattcatttcattaa

SEQ ID NO: 11241 - protein, 264 aa, Erwinia carotovora subsp
MKPTTISHLRQWKQEQRKFATITAYDASFSRLFFEQGIRVMLVGDSLGMTVQGHDSTLPVTTHDIVYHTQCVRRGAPLALVLSDMPFMTYATPEQTFSQAAELMRAGANMVKLEGGSWLAPTVKMLTERAVPVCGHLGLTPQSVNIFGGYKIQGRSESDANQLLADALALEEAGAQLLVLECVPVALAKRVTEALSIPVIGIGAGNVTDGQILVMHDALGITGDSTPKFAKNFLAQSGDIRTAVRLYSQEVEQGIYPAEEHSFH

SEQ ID NO: 11242 - DNA, 891 bp, Frankia sp
  CDS (1)..(891): transl_table=11
atggatgcttcagacacacccacccacccggcgccccacccggcggacccggcggcgacgccctacggcgcgccgaccacgccgccgcggccactccggtcccgtttcacagtgcgcgacgtcgccgcggcgaagaaccggggcgagaagtggtcgatgctgaccgcgtacgacgccaccaccgccgccgtcttcgacgaggcggagatccccgtcctgctggtcggggactcggccgccaacgtcgtctacggctacgacacgaccgtgccgatcaccgtcgatgagctgctgccgctggtccgggcggtggtccgcggagcaccgcacgcgatggtcgtcgccgatctgcccttcgggtcgtaccagggggggcctgccgaggcactggcgagcgctacccgcttcctcaaggagggcggggcgcacgcggtgaaactcgagggcggttcccgggtggtccgggcggtggacgccctggtcggcgccggcatccccgttatcgggcatctggggctgaccccgcagagcatccacaccatcgggggctaccgggtccagggccgcgacgaggccggcgagatcctgctggccgacgcgctggcgctcgaggcggccggcgcgttcgcggtcgtgctcgaggtggttcccgccgatctggccacccgggtgacgaaggagttgcgcatcgccaccgtgggtatcggagccggctcgggatgcgatgcccaggtgctggtctggcaggacatggccgggctgagcggcggccgcacgccacggttcgtcaagcggtacgcggatctgcgcacgattctcgcggacgccgcccgagcctaccgcgcggacgtccgggacggcaggtacccgacgatcgagcacagctactga

SEQ ID NO: 11243 - protein, 296 aa, Frankia sp
MDASDTPTHPAPHPADPAATPYGAPTTPPRPLRSRFTVRDVAAAKNRGEKWSMLTAYDATTAAVFDEAEIPVLLVGDSAANVVYGYDTTVPITVDELLPLVRAVVRGAPHAMVVADLPFGSYQGGPAEALASATRFLKEGGAHAVKLEGGSRVVRAVDALVGAGIPVIGHLGLTPQSIHTIGGYRVQGRDEAGEILLADALALEAAGAFAVVLEVVPADLATRVTKELRIATVGIGAGSGCDAQVLVWQDMAGLSGGRTPRFVKRYADLRTILADAARAYRADVRDGRYPTIEHSY

SEQ ID NO: 11244 - DNA, 840 bp, Geobacillus kaustophilus
  CDS (1)..(840): transl_table=11
atgaaagcgaaaaccgattttttccacatgaagcaggcgggtgagccgatcgtgatggtgaccgcctacgattttccgtccgcgaagcttgccgagcaagccggcgtcgacatgattttggtcggcgattcgctcggcatggttgtgctcgggtatgattcaacgatcccggtgacggtcgatgatatgatccaccatacgaaggcggttcgccgcggtgcgccgaacacgtttattgtcaccgatatgccgtttatgtcgtaccatgcgtccaaagaagaggcgctgcaaaacgcccgccgcatcatgcaagagtcaggggcgaacgccgttaaagtcgaaggagcggatgaagtcgtcgatatgattgccgcgctgacgaaagccggcgtgccggtcgttgcccatctcgggttgacgccgcaatcggtcggcgttcttggcggctataaagtgcaaggcaaagatgccgaaagtgcgaaaaagctgctcgatgatgcgaaacaatgcgagcaggcgggagcgatcgcccttgtcttagagtgtgttccgaagcagctcggggcggccatggcccgggaactcaccattcccgtcatcggcatcggcgccggggcggaagtcgacggccaagtgctcgtgtatcacgatttgcttggctacggtgtcacccgcgtgccgaagtttgtgaaacaatacgcgtccatccaagagacgatcgttgaggcgttagccaactacgtcgctgatgtcaaactgcgccagttcccggagccggcgcacacgtttacgatgaaggaagaagaatgggtggcgctttacggaggaaagcaaggatga

SEQ ID NO: 11245 - protein, 279 aa, Geobacillus kaustophilus
MKAKTDFFHMKQAGEPIVMVTAYDFPSAKLAEQAGVDMILVGDSLGMVVLGYDSTIPVTVDDMIHHTKAVRRGAPNTFIVTDMPFMSYHASKEEALQNARRIMQESGANAVKVEGADEVVDMIAALTKAGVPVVAHLGLTPQSVGVLGGYKVQGKDAESAKKLLDDAKQCEQAGAIALVLECVPKQLGAAMARELTIPVIGIGAGAEVDGQVLVYHDLLGYGVTRVPKFVKQYASIQETIVEALANYVADVKLRQFPEPAHTFTMKEEEWVALYGGKQG

SEQ ID NO: 11246 - DNA, 804 bp, Geobacter metallireducens
  CDS (1)..(804): transl_table=11
gtgaaccgcaagaagacaattattgacatccagaagatgaaggcagccggcgagaagataaccgtcctcaccagctatgattacccctttacccgcgtaatggatgaatgcggcattgacatgatcctcatcggcgattccgtgggcgttgtcttcagtgggtatgacaacaccctgccggtcacgatggacgagatgatctatcacacccgggcggtggtgcgggcccggcccaaggccctggttgtggccgacatgccgttcctctcctaccagaccgacctgcgggacgcccgtctcaatgccggccgtctcgtgaaggatgggggggcggaagccgtcaagctggaaggtgggagccatgtggccgataccatccgcgccattgtcgacatggatattccggttatggcccatatcggtctcaccccccagtcgattcaccggatgggggggtacaaggtccaggggaaaaaggaagagcagtcccagcggcttctggatgatgccaaggccattgaagaagccggcgcctttgccgtggttctggaggggatcccgctgaaactggcggaaaagatcaccgaagagctttccattcccacaatcggcattggcgcggggccccactgcgacggtcaggtgcttgtgatccatgacatcctgggactgtgcgagaaatactctccaaagttcgtgaaacgttacggggacgccaatgcgctgataaccagcgcggtttcctcatacatcgccgaagtgaagaaaggagaattccccgacgaggggcattcattcagctga

SEQ ID NO: 11247 - protein, 267 aa, Geobacter metallireducens
MNRKKTIIDIQKMKAAGEKITVLTSYDYPFTRVMDECGIDMILIGDSVGVVFSGYDNTLPVTMDEMIYHTRAVVRARPKALVVADMPFLSYQTDLRDARLNAGRLVKDGGAEAVKLEGGSHVADTIRAIVDMDIPVMAHIGLTPQSIHRMGGYKVQGKKEEQSQRLLDDAKAIEEAGAFAVVLEGIPLKLAEKITEELSIPTIGIGAGPHCDGQVLVIHDILGLCEKYSPKFVKRYGDANALITSAVSSYIAEVKKGEFPDEGHSFS

SEQ ID NO: 11248 - DNA, 804 bp, Geobacter sulfurreducens
  CDS (1)..(804): transl_table=11
gtgaaccgcgcgaaaaccatcctcgatatccagaaaatgaaggcgacgggcgagaagataaccgtccttaccagctacgactatccctttacccgcattatggatgaatgcggcatcgacatgattctggtcggagactcggtcggtgttgtctttgccggtcacgacaacaccctgccggttaccgtggacgatatgctctatcacacccgcgccgttacccgggccagaccaaaggctctggtggttacggacatgccgtttctttcctaccagaccgatttgcgcgatgcccgcatcaacgccggacgcctggtcaaggagggtggagccgaagcggtgaagctggaggggggagcccacgtgacggacaccatcagggccatcgtcgatatggacatcccggtcatggcccacatcggacttaccccccaatcgatccaccggatggggggctacaaggtgcagggcaaaaaggacgagcaggctcagcggttgctggaggatgccctcgcggtccaggaggcgggagcctttgccgtggtcctggaagggattccgctcaagcttgccggccgcatcaccgcagaactctccattcccaccattggcatcggtgccggtccccactgcgacggccaggttctcgttatccacgacatcctcggcctgtgcgagaagtactctcccaaattcgtcaagcgctacggcgatgctcgtacgctcatttccgacgcggtagcgtcctacatctcagaagtcaagaaaggagaattccccaccgaggggcattcgttcagctga

SEQ ID NO: 11249 - protein, 267 aa, Geobacter sulfurreducens
MNRAKTILDIQKMKATGEKITVLTSYDYPFTRIMDECGIDMILVGDSVGVVFAGHDNTLPVTVDDMLYHTRAVTRARPKALVVTDMPFLSYQTDLRDARINAGRLVKEGGAEAVKLEGGAHVTDTIRAIVDMDIPVMAHIGLTPQSIHRMGGYKVQGKKDEQAQRLLEDALAVQEAGAFAVVLEGIPLKLAGRITAELSIPTIGIGAGPHCDGQVLVIHDILGLCEKYSPKFVKRYGDARTLISDAVASYISEVKKGEFPTEGHSFS

SEQ ID NO: 11250 - DNA, 789 bp, Gloeobacter violaceus; identical to SEQ ID NO: 10962
  CDS (7)..(789): transl_table=11

SEQ ID NO: 11251 - protein, 260 aa, Gloeobacter violaceus
MGLSIHSLRKLKERAQPIVALTATEYAMARILDQAGVDLLLVGDSLSMVALGHTSTLPVTVDELLHHCRAVRRGVERALLVADLPFGSYEQSPQQAFSTATRFLKEAGVQAVKLEGGYPRMTETVAFLTESGIPVLGHLGLTPQAVHQLGGYRVQGKTAQAAERLIDQALALEGAGAFALVLEHIPYDLAGEISGKLVIPTVGIGAGPHCNGQILVTHDLLGLTENPPPFVNPYADLRALISKAVGRYSADVRAHGSREE

SEQ ID NO: 11252 - DNA, 810 bp, Haloarcula marismortui
  CDS (1)..(810): transl_table=11
atgccaactgtccgggacctgcaggcgatggctggtgaggagccgatcacgatgctgacagcgtacgacgccgttaccgcgagcatcgttgacgacaccggcgtggacgtcattcttgtcggcgacagcatggggaacgccgtgctcggccacgacgacacgctcccggtcacgctcgatgagatggcctcccgggtcggcgcggtcgcacgcggcgcggacgacgcgctggtcgtcgccgatatgccgtttctctccttcggcgcgcacgaaagcgagagcatccagaactgtgggcgaatgctgaaagaagagggcgcaaacgcgatcaagctcgaatctggaccacatacagtcgaactgaccgagcggctgaccgagctcggaatcccaacaatggcccacctcgggctcacgccacagagcgtgaaccagaccggctacacgagacaggcgacgggccgtgaggaggccgaggaaatcctcgacctcgcgcgagagcacgaggccgccggcgcgttcgcgctggtgctcgaacacatcccggccaacctcgcggccaaggtcaccgaggccgttgatatcccaacaatcggtattggggccggcggtgactgcgacggtcaggtgctcgttttcaccgacgtggtcggcctctcggagtccagcccgccgttcgccgagcagttcggcgacgttcgcggtgaggtggccgacgctgtcgacgagtacatcgacgccgttgagtccggcgagttcccgcgcgagtcacacagccacaccgaagacgaactcgacgacctgtactga

SEQ ID NO: 11253 - protein, 269 aa, Haloarcula marismortui
MPTVRDLQAMAGEEPITMLTAYDAVTASIVDDTGVDVILVGDSMGNAVLGHDDTLPVTLDEMASRVGAVARGADDALVVADMPFLSFGAHESESIQNCGRMLKEEGANAIKLESGPHTVELTERLTELGIPTMAHLGLTPQSVNQTGYTRQATGREEAEEILDLAREHEAAGAFALVLEHIPANLAAKVTEAVDIPTIGIGAGGDCDGQVLVFTDVVGLSESSPPFAEQFGDVRGEVADAVDEYIDAVESGEFPRESHSHTEDELDDLY

SEQ ID NO: 11254 - DNA, 825 bp, Halobacterium salinarium
  CDS (1)..(825): transl_table=11
atgccaacggtgaattcagtgcggcgtgcgggcaacaccgacgaggaaaccgacccggtgacgatgctgaccgcgtacgacgcccccacggcgtcggtggtcgacgacgccggcgtcgacatgatcctggtcggggacagcgtcgggaacgcgaagctcggatacgacacgacgctgcccgtctccgtcgacgagatcgcgtcggcgaccggcgcggtcgcacgcgccaccgcggacgcggtcgtcgtcgcggacatgccgtttctgagcttcggcgccgacgagaccgagagcgtgcgaaacgccggtcgcatgctcaaagaggaggacgccgacgcggtgaaactcgaatccgggccgcacacggtgtcgctgaccgagacgctcacgtcgctggggattcccgtgatggcgcacctcgggttgaccccccagcacgtcaaccagctcggggggtatttccggcagggcaccgaccaggacagcgccgagcgcatgctggatctggcgcgcgaccacgaggccgccggcgcgttcgcgctcgtgctcgaacacgtgccggcgaacgtcgccgccgacatcaccgacgccatcgacatcccgaccatcggtatcggcgcggggccggacaccgacggccaggtgctcgtgatctcggacgtgatcgggatgtcagaacgcagcccgccgttctccaagcagttcggggacgtgaaccgagaaatggcggccgcggtcgacgactacgtcgacgcggtcgaatccggatcgttcccggcggccgagcacagccacgtcgccgacgacgtcgacgacgtgtactga

SEQ ID NO: 11255 - protein, 274 aa, Halobacterium salinarium
MPTVNSVRRAGNTDEETDPVTMLTAYDAPTASVVDDAGVDMILVGDSVGNAKLGYDTTLPVSVDEIASATGAVARATADAVVVADMPFLSFGADETESVRNAGRMLKEEDADAVKLESGPHTVSLTETLTSLGIPVMAHLGLTPQHVNQLGGYFRQGTDQDSAERMLDLARDHEAAGAFALVLEHVPANVAADITDAIDIPTIGIGAGPDTDGQVLVISDVIGMSERSPPFSKQFGDVNREMAAAVDDYVDAVESGSFPAAEHSHVADDVDDVY

SEQ ID NO: 11256 - DNA, 795 bp, Helicobacter hepaticus
  CDS (1)..(795): transl_table=11
atgttggataaaaaaatgagtatagctacactcaaggcaaaaaaagggattgaaaaaattacagcaattactgcgtatgatgcgcttatggcacgcatttttgatggtgaagttgatgtgattttggtaggtgatagcttgaaaatgagttttggtggagagaatgaaacattaggtgcaagtatgcaagagatgatttatcatacaaaggcagtgtgcaaaggcgctaagcattctttcatcattgcagatatgccttttggtagctatgctacaccaaatatggcattaaaaaatgcgcttagattctataaaaacactgcagcagatgcacttaagcttgaagtaggcattgataaattacctgtggtgaaagtactatgtgaagaagggattgctgtaatggcacatattggcttgaaaccccaatttatgcgctttgatggaggatttaaaataaagggcaaagatgaggttgaatctcaagaattgatagaagccgctgttgcattccaagaagctggggtttttgggattttgatagagggagtgaaatcggaatctggtgcacgcattacacaagctttagagattccaacgattggcattggtgcaggtgtggagtgtgatgggcagattcttgtatggagcgatgcttttggcttttttgatgagtttaagccaaaatttgtgcgccgctattgtgatggtaaagcgatacttaaagatgccataagagcgtatgccaaagatgtaaaatctcaagcatttccacaagcccaagagagctattaa

SEQ ID NO: 11257 - protein, 264 aa, Helicobacter hepaticus
MLDKKMSIATLKAKKGIEKITAITAYDALMARIFDGEVDVILVGDSLKMSFGGENETLGASMQEMIYHTKAVCKGAKHSFIIADMPFGSYATPNMALKNALRFYKNTAADALKLEVGIDKLPVVKVLCEEGIAVMAHIGLKPQFMRFDGGFKIKGKDEVESQELIEAAVAFQEAGVFGILIEGVKSESGARITQALEIPTIGIGAGVECDGQILVWSDAFGFFDEFKPKFVRRYCDGKAILKDAIRAYAKDVKSQAFPQAQESY

SEQ ID NO: 11258 - DNA, 813 bp, Helicobacter pylori J99
  CDS (1)..(813): transl_table=11
atgagcatgcaaaccgccccaattaaaaaaatcacccttagtcacctccaagctaaaaaaaatcaagaaaaaatcatcgccattaccgcttatgacgccctattcgctcaaatatttgatccgctagtggatgtgattttagtgggcgatagtttgaatatgagttttttcaatcaaaacgacactttaagcgcgagtgtaaaaatgatgctctatcacactaaagccgtgtgcgcgggcgctaagactccttttatcatcacagacatgccctttggaagctataaagatgaaaaaacagccctaaaaaacgccatcagggtttataaagaaacccaagcgagcgcgatcaaactagagggggggaaagaaaaagcgaaactggttaaaacgctcactgatgagggcgttatcgtggtagggcatattggcttgatgcctcaattcgtgcgtcttgatggaggctataagattaagggcaaaaatgaagagcaacaaaaaaagcttttagaagacgcgttgagtttagaagaagctggagtgggtttgttggttttagagggtataaccacccctatcgctcaaacaatcacgcaaaaaatcaaaatccccacgatcggcatagggagcggcaaggattgcgacgggcagattttagtgtggagcgatatgttaggcttttttgatagttttaagcctaaattcgtgcgagaataccttaaagggaaagaattgattcaaaacgcgattcaacaatacgctgacgatgtgaaaaagggaaacttccctaacgaattagaaagttatcattaa

SEQ ID NO: 11259 - protein, 270 aa, Helicobacter pylori J99
MSMQTAPIKKITLSHLQAKKNQEKIIAITAYDALFAQIFDPLVDVILVGDSLNMSFFNQNDTLSASVKMMLYHTKAVCAGAKTPFIITDMPFGSYKDEKTALKNAIRVYKETQASAIKLEGGKEKAKLVKTLTDEGVIVVGHIGLMPQFVRLDGGYKIKGKNEEQQKKLLEDALSLEEAGVGLLVLEGITTPIAQTITQKIKIPTIGIGSGKDCDGQILVWSDMLGFFDSFKPKFVREYLKGKELIQNAIQQYADDVKKGNFPNELESYH

SEQ ID NO: 11260 - DNA, 813 bp, Helicobacter pylori
  CDS (1)..(813): transl_table=11
atgagcatgcaaaccgccccaattaaaaagatcactctcaaccacctccaagctaaaaaaaatcaagaaaaaatcatcgctattaccgcttatgatgcgctgttcgctcaaatatttgatccgctagtggatgtgattttagtgggcgatagtttgaatatgagttttttcaatcaaaacgacactttaagcgcgagtgtggaaatgatgctctatcacaccaaagccgtgtgcgcgggcgctaagactccttttatcatcacagacatgccttttggaagctataaagatgaaaaaacagccctaaaaaacgccattagggtttataaagaaacccaagcgagcgcaatcaaattagagggggggaaagaaaaagcgaaactggttaaaacgctcactaatgagggcgttattgtggtagggcatattggcttgatgccccaattcgtgcgccttgatggaggttataagattaagggcaaaaatgaagaacaacaaaaaaagcttttagaagacgccttgagtttagaagaagctggggtgggtttgttggttttagagggtataaccacccctatcgctcaaaaaatcacgcaaaaaatcaaaatccccacgatcggcatagggagcggtaaagattgcgatgggcagattttagtgtggagcgatatgttaggcttttttgatagctttaagcctaaattcgtgcgagaataccttaaggggaaagaattgattcaaaacgctatcaaacaatacgctgatgatgtgaaaaagggaaacttccctaacgaattagaaagttatcattaa

SEQ ID NO: 11261 - protein, 270 aa, Helicobacter pylori
MSMQTAPIKKITLNHLQAKKNQEKIIAITAYDALFAQIFDPLVDVILVGDSLNMSFFNQNDTLSASVEMMLYHTKAVCAGAKTPFIITDMPFGSYKDEKTALKNAIRVYKETQASAIKLEGGKEKAKLVKTLTNEGVIVVGHIGLMPQFVRLDGGYKIKGKNEEQQKKLLEDALSLEEAGVGLLVLEGITTPIAQKITQKIKIPTIGIGSGKDCDGQILVWSDMLGFFDSFKPKFVREYLKGKELIQNAIKQYADDVKKGNFPNELESYH

SEQ ID NO: 11262 - DNA, 828 bp, Hyphomonas neptunium
  CDS (1)..(828): transl_table=11
atgtcaaaacagacccagacgacccgcaagaccgtcaaggacatcgccgctgccaaaggggcaacgccacttgtcatgttgacggcctatgacgccccgaccgccgcgatccttgatccccattgtgacatcctgctggtgggcgacagcctcggcatggtggtccatggcctgccgtccacggttggcgtcacgatggaaatgatgatcctccacggccaggccgtcatgcgcggcgcgtcccaggcgatggtcgtggtcgatatgcccttcggctcgtatgaaaccaacgctgatcaggccttcctgaacgcggtgcggatcatgaaggaaaccggctgccaggccatcaagatcgaaagcggcgcctatgctgccggccagatcgcccatctcgtcgagcgcggcattccggtcatggggcatatcggcctgcgcccgcaggcaatcaacgtcgatggcggcttccgcgccaagggccgcaccgaagatgaacgcgaccgcgtcatcgccgaggcccgcgccgcggccgatgccggcgccttctgcatcgtcatcgaaggcgtcgccgaggatcttgccgccgccatcaccgccgaagtcagctgcccgaccatcgggatcggcgcctcggcggcctgtgacggccaggttctcgtcacccaggacatgctcggcctgttcgactggacgcccaaattcgtccgccgctacgccgatctgcgcgaagtggtcgataaagccgccgctgaatacgctgcagatgtgcgcgcccggcgcttccccggcacggctgaaacctacagcctgcgaaaacaagggtcttaa

SEQ ID NO: 11263 - protein, 275 aa, Hyphomonas neptunium
MSKQTQTTRKTVKDIAAAKGATPLVMLTAYDAPTAAILDPHCDILLVGDSLGMVVHGLPSTVGVTMEMMILHGQAVMRGASQAMVVVDMPFGSYETNADQAFLNAVRIMKETGCQAIKIESGAYAAGQIAHLVERGIPVMGHIGLRPQAINVDGGFRAKGRTEDERDRVIAEARAAADAGAFCIVIEGVAEDLAAAITAEVSCPTIGIGASAACDGQVLVTQDMLGLFDWTPKFVRRYADLREVVDKAAAEYAADVRARRFPGTAETYSLRKQGS

SEQ ID NO: 11264 - DNA, 801 bp, Idiomarina loihiensis
  CDS (1)..(801): transl_table=11
atggcaacaaccaaaaccagcattgcaacgttacaaaaaatgaaacgggaaggaaccaaaatcagttccctcaccgcctatgattcaagttttgctaaactcatgaccgagcaaggcgtcgactttattctggtgggcgattcactgggtaatgttgtgcagggacgcgactcaactgtaccggtaactgtcgatgatatgatttaccacactcagtgtgtgcgtcgaggtgccagcaatgcctttgttatagcagacatgccatttatgacttacagcacacccgagcaagcctatgatgtggcggcagctttaatgcaggcaggtgccaacatggtcaaactggaaggtggtcactggctggttgaaaccattgaaggcttgaaaacccggggcattccggtgtgcgctcaccttggtttactgccgcaatcggttaatgttcttggtggttataaagtacagggcaaagagcagcaacaggccgacgacacactgaaccaggctttggctctcgaacaggccggcgcgcaattacttgttctggaatgcgtacccgcgtctctgggtaaacgtattaccgagcagctatctattcctactattggtattggcgcaggtgcagacaccgacggacaaattttggttatgcacgatatgctcggcatgaacagtgactatctgcctaaatttgccaaagactttttggctcagggcggctcgcttgctgatgcattccgtttatattcggaacaggtgcgctcaggcgagttcccgacagcagagcatagctacaaatga

SEQ ID NO: 11265 - protein, 266 aa, Idiomarina loihiensis
MATTKTSIATLQKMKREGTKISSLTAYDSSFAKLMTEQGVDFILVGDSLGNVVQGRDSTVPVTVDDMIYHTQCVRRGASNAFVIADMPFMTYSTPEQAYDVAAALMQAGANMVKLEGGHWLVETIEGLKTRGIPVCAHLGLLPQSVNVLGGYKVQGKEQQQADDTLNQALALEQAGAQLLVLECVPASLGKRITEQLSIPTIGIGAGADTDGQILVMHDMLGMNSDYLPKFAKDFLAQGGSLADAFRLYSEQVRSGEFPTAEHSYK

SEQ ID NO: 11266 - DNA, 792 bp, Klebsiella pneumoniae subsp
  CDS (1)..(792): transl_table=11
atgaaaccgaccaccattgccctgctgcagaaatgcaaacaggaaaagaagcgctttgccaccattaccgcctacgatcacagcttcgcgaagctgttcgccgatgaaggcataaatgtgctgctggtaggcgactcgctgggaatgacggtgcagggtcacgactccaccctgccggttaccgtggaagatatcgcctatcacacccgcgccgtccgccgcggcgcgccaaacagcctgctgcttgccgacctgccgttcatggcctatgccacccccgagcagacctttgcaaatgccgccatcgtgatgcgcgctggcgccaatatggtcaaactcgagggcggcgcctggctggccgacaccgtgaggatgctggcggagcgcgcggtgccggtttgcggccatcttggcctgacgccgcagtcggtgaacgtattcggtgggtataaagtgcagggtcgcggcgatgcggcgcagaccctgtttgaagacgcgttagcgctggaggcggcgggtgcgcagctgttggtcctggagtgcgtgccggttgaactggcgaagcgcatcaccgacgctctgaccattccagtgatcggcatcggcgcgggcaacgtcaccgacgggcaaatcctcgtgatgcatgacgctttcggcattaccggcggccacattcctaaatttgccaagaatttccttgccgaagcgggcgacatccgcgccgcggtgcggcagtatattgccgaagtagaatccggagtctatccgggtgaagaacacagtttccattaa

SEQ ID NO: 11267 - protein, 263 aa, Klebsiella pneumoniae subsp
MKPTTIALLQKCKQEKKRFATITAYDHSFAKLFADEGINVLLVGDSLGMTVQGHDSTLPVTVEDIAYHTRAVRRGAPNSLLLADLPFMAYATPEQTFANAAIVMRAGANMVKLEGGAWLADTVRMLAERAVPVCGHLGLTPQSVNVFGGYKVQGRGDAAQTLFEDALALEAAGAQLLVLECVPVELAKRITDALTIPVIGIGAGNVTDGQILVMHDAFGITGGHIPKFAKNFLAEAGDIRAAVRQYIAEVESGVYPGEEHSFH

SEQ ID NO: 11268 - DNA, 867 bp, Legionella pneumophila subsp; identical to SEQ ID NO: 11012
  CDS (79)..(867): transl_table=11

SEQ ID NO: 11269 - protein, 262 aa, Legionella pneumophila subsp
MKIHDFKIKKQEQKKISMLTCYDYPSACIVAESNIDCVLVGDSVAMAVHGHPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKVQGKNSEQAETLLQQAATLEQAGCFAVVIECVPQELAKTITDSLVIPTIGIGAGPGTDGQVLVWHDMLGLQTSFNPKFVKKYFRAKDHFIEALNSYVQQVQQMHFPANEHSF

SEQ ID NO: 11270 - DNA, 834 bp, Leifsonia xyli subsp
  CDS (1)..(834): transl_table=11
gtgccctccgtcccttccgaagccccggcgtcgccgtcgccgaaacgcgtgcggacccgtcatttccaggcggcgaaggaagaaggctcccgtttcacggggctcaccagctacgacacgctgacggcacagatcttcgacgaggccgggatcgattttctcctcgtcggcgactcggccgcgaacacggtgctcggctacgacaccaccctccccatgacggtcgacgagctaatccccctcacacgcgccgtggcacgggcggcgaaacgcgcgttcgtcgtggcggacctgccgttcggatcgtacgagaccggcccccaggaggcgctgcgcacagccgtgcgcttcatgaaggagaccggtgcgcacgccgtcaaattggaaggcggcgagcgcagcgccgagcagatccgccgcatcgtggacgcgggcgttccggtcatggggcacatcggcttcacaccgcagagcgagcatgggctcggcgggcacctcgtgcagggccgcggccagggagccgagcaggtggtcgacgacgcgcacgcggtcgaggaggccggggcgttcgccgtcgtgctggagatggtgcccgcggacgtcgcacagcgcgtgacacaggagctgcgcatcccgacgatcggtgtgggcgcggggccgcacgtcgatggccagctgctggtttggacggactgggccgggttcacgacgggacgcgtcccgcgcttcgccaaacagtacgccgatctgaaggacgtgctcacggaggcggcacggatgtacagagacgaggtgggctccggggtgttccccggtcccgagcacagtttctaa

SEQ ID NO: 11271 - protein, 277 aa, Leifsonia xyli subsp
MPSVPSEAPASPSPKRVRTRHFQAAKEEGSRFTGLTSYDTLTAQIFDEAGIDFLLVGDSAANTVLGYDTTLPMTVDELIPLTRAVARAAKRAFVVADLPFGSYETGPQEALRTAVRFMKETGAHAVKLEGGERSAEQIRRIVDAGVPVMGHIGFTPQSEHGLGGHLVQGRGQGAEQVVDDAHAVEEAGAFAVVLEMVPADVAQRVTQELRIPTIGVGAGPHVDGQLLVWTDWAGFTTGRVPRFAKQYADLKDVLTEAARMYRDEVGSGVFPGPEHSF

SEQ ID NO: 11272 - DNA, 798 bp, Leptospira interrogans serogroup Icterohaemorrhagiae serovar
  CDS (1)..(798): transl_table=11
atgaaaaacatacataaaattttttctcctgaaaagaaagggaaagaaaaaatttccgtagttacatgttacgattttagttttgctaggattttaaacgaaactgaaatcgattctatccttgtaggggattcactgggaatggtttttcaaggaaatacgagtactctccccgtcactttagaagaaatgatctatcatacgaaggcggtccgtcgtggtgcgcccgataagtttctgatcgccgatctaccttttttaagttatcagacttctatcgaagaaggaattcgctccgccggaaaaatcatgaaggaaagcgattgcgacgcggttaaaatagaaggtggttccgaatttatctgtgagctggtttctattctcaaacaaattggagttcctgtgatggggcatttggggctgacacctcagagtgttcatgtgtttggcggtcatcgagttcaaggcaaaggagaagaatcgagttctaaactactaaaagaatcgatttctctttttgagtcaggtgttttctcaatggttctggagatgattcccgctgaactaggaaaaaaagtaagtcaagaagtaggtgttcctacaatcggaatcggagctggttcggattgtgacggacaggttttggttttaaacgatttacttggattggatataaactttcaacctaagtttttaaagaaattttccaatctgcattctatcgtaaaggaagcgatcgcggattatgataaagaagtaaaatccggagagtttccagggaaagatcatagtttctga

SEQ ID NO: 11273 - protein, 265 aa, Leptospira interrogans serogroup Icterohaemorrhagiae serovar
MKNIHKIFSPEKKGKEKISVVTCYDFSFARILNETEIDSILVGDSLGMVFQGNTSTLPVTLEEMIYHTKAVRRGAPDKFLIADLPFLSYQTSIEEGIRSAGKIMKESDCDAVKIEGGSEFICELVSILKQIGVPVMGHLGLTPQSVHVFGGHRVQGKGEESSSKLLKESISLFESGVFSMVLEMIPAELGKKVSQEVGVPTIGIGAGSDCDGQVLVLNDLLGLDINFQPKFLKKFSNLHSIVKEAIADYDKEVKSGEFPGKDHSF

SEQ ID NO: 11274 - DNA, 834 bp, Listeria innocua
  CDS (1)..(834): transl_table=11
atgaaaaaaccagtagacttttttgctatgaaggaaaacggagaaaaaatcacgatgattaccgcttacgattatccttctgctaagaatgtagaacaagcagaagcagatatgattttagttggtgattcacttggaatggtagtattaggctacgattcaactgtaccagtaacaatgaatgatatgattcatcatacgaaagctgtgaaacgaggggcgccaaatacttttgttgtaacggatatgccttttatgacttatcacggctcagtagatgaaactattcaaaacgcacgtaagattattcaagagagcggcgcacatgctgtaaaactagaaggcgcaggagaagttgttaacaaaattgctcgtttgacagaagccggtgcaccagttgtcgctcatcttggcttaacgccacaaagtgttggcttaacgggaagctataaagttcgcgctaaatcagttcaagaagcgcaagagttgattgacaatgcgttagcggttgaggcagcaggagctattgctattgttcttgaggcaattcctcgtcagctagctgaaaaagtaactaaggcacttactattccaactattggtattggagctggtttagaaacagacggtcaagtacttgtataccacgatataatcggttatggtatcaatcgccgagcaaaatttgtgaaagcttatgcggatattgacgaaactattgaaccagcacttaaaaactatgtgaatgacgtaaaagaactagcgtttccagaagtgaaacatagctttacaatggccgaagaagacttaaaaggcctttatggaagggaatag

SEQ ID NO: 11275 - protein, 277 aa, Listeria innocua
MKKPVDFFAMKENGEKITMITAYDYPSAKNVEQAEADMILVGDSLGMVVLGYDSTVPVTMNDMIHHTKAVKRGAPNTFVVTDMPFMTYHGSVDETIQNARKIIQESGAHAVKLEGAGEVVNKIARLTEAGAPVVAHLGLTPQSVGLTGSYKVRAKSVQEAQELIDNALAVEAAGAIAIVLEAIPRQLAEKVTKALTIPTIGIGAGLETDGQVLVYHDIIGYGINRRAKFVKAYADIDETIEPALKNYVNDVKELAFPEVKHSFTMAEEDLKGLYGRE

SEQ ID NO: 11276 - DNA, 834 bp, Listeria monocytogenes
  CDS (1)..(834): transl_table=11
atgaaaagaccagtagacttttttgctatgaaggaaaacggagagaaaatcacgatgatcaccgcttatgactatccttctgctaagaatgtagaacaagcagaagcagatatgattttagtcggagattcactcggaatggtagtattaggctacgattcaaccgtaccagttacaatcgatgatatgattcatcatacaaaagccgttaagcgaggtgccacagacacatttattgtcactgacatgccgtttatgacttaccatggttcagtgaatgaaacaatccaaaatgcacgtaaaattattcaagaaagtggcgctcatgcagtgaaattagaaggagcaggagaagtcgttaacaaaattgctcgtttaaccgaagcaggtgctccagttgtcgctcatcttggcttaacaccccaaagtgttggtttaactggaagctataaagtacgcgctaaatctgcccaagaagcacaagagttaatggataatgcattagctgtagaagcagctggagctattgcaatcgtgctcgaagcaatacctcgccaattagctgaaaaggtaagtaaagcactttcaattcctacaattggtattggagcaggtttagaaacagatggacaagtactcgtttaccacgatattatcggttatggaatcagccgccgtgcaaaatttgtaaaagcttatgcagatattgacgagacaatcgaaccagcactcgcaagctatgtaaaagaagtgaaagccgagacatttccagaagtgaaacatagctttacaatggccgaagaagacttaaaaggcctctatggaagggaatag

SEQ ID NO: 11277 - protein, 277 aa, Listeria monocytogenes
MKRPVDFFAMKENGEKITMITAYDYPSAKNVEQAEADMILVGDSLGMVVLGYDSTVPVTIDDMIHHTKAVKRGATDTFIVTDMPFMTYHGSVNETIQNARKIIQESGAHAVKLEGAGEVVNKIARLTEAGAPVVAHLGLTPQSVGLTGSYKVRAKSAQEAQELMDNALAVEAAGAIAIVLEAIPRQLAEKVSKALSIPTIGIGAGLETDGQVLVYHDIIGYGISRRAKFVKAYADIDETIEPALASYVKEVKAETFPEVKHSFTMAEEDLKGLYGRE

SEQ ID NO: 11278 - DNA, 807 bp, Magnetococcus sp
  CDS (1)..(807): transl_table=11
atgaaaaaacgcgtgcgggtaccggatctggtacgcatgaaacagcagggcgagcccattgtggccctgaccgcctatgattacaccctggcccgcttggtggacgccgccgatgtggatctggtactggtaggggattcgctgggtatggtggtacaggggcacgaaaccaccctgcccgtcaccctggatgagatgatctatcacacccgcgccgttgcgcggggttgccaacgcgccttggtggtgctggatatgccctttggctcgacccaaaacggcccagagcgcacctttgaacaggccgcacgggctatgaaagagagcggtgccgccgccattaagctggagggggggcaggctatggccgccacggtggcctatttgactgaacgcgccatccccgtcattggccatttgggactcaccccccaatcggtccacgcctttggtggctttaagatccaggggcgtgaccaagccgccgcccagcgcatcgccgacgacgccctcgccctacaacaggccggggcaggagccattattctggagggcatacctgcggcactggcccaacaggtaagccaatccctgaccattcccaccattggtatcggtgccggggtggggtgcgatgggcaggttttggttatctatgatatgctgggactgtatggcgatctggcccccaaatttgtcaaacgctatcttgatggggtacccgtcatagggggtgccattggggcctatgtgcaagaggtccgcaaccgccaattccccaccccagaccatagctttgagaagtag

SEQ ID NO: 11279 - protein, 268 aa, Magnetococcus sp
MKKRVRVPDLVRMKQQGEPIVALTAYDYTLARLVDAADVDLVLVGDSLGMVVQGHETTLPVTLDEMIYHTRAVARGCQRALVVLDMPFGSTQNGPERTFEQAARAMKESGAAAIKLEGGQAMAATVAYLTERAIPVIGHLGLTPQSVHAFGGFKIQGRDQAAAQRIADDALALQQAGAGAIILEGIPAALAQQVSQSLTIPTIGIGAGVGCDGQVLVIYDMLGLYGDLAPKFVKRYLDGVPVIGGAIGAYVQEVRNRQFPTPDHSFEK

SEQ ID NO: 11280 - DNA, 846 bp, Mesorhizobium sp
  CDS (1)..(846): transl_table=11
atgagtgcaaccggaggagcgaaatccttcaccccgccggacatcgccaaggccaaaggcaaggcgccgatcgtttgtctcactgcctacacgacgcccattgcgcgccttctcgatccgcattgcgacgtggttctcgtgggcgacagcgtgggcatggtgatgcacgggctgccctccacgctgggcgtgacgctggacatgatgatcatgcatgggaaagcggtgcgccgaggcctggaaagggccttgatggtcgtcgacatgcccttcggcagctatgaggaagggccggaacaggcttttcgcaatgcagcacgcgtgatggcggagaccggctgcgcggctgtcaagctcgaaggcggagagagcatggccgagacgatccgcttcctgaccggccgtggcataccggtgatggcccatgtgggtctgacgccacaggccgtgaacgctttcggcggttatcaggtccaaggacggggcgaagacggcgaccgcgtgatgcgtgacgcgcaagcagtggccaaggccggcgccttctccgtggtcctggaaaaggtgcccgagccgctcgcccgccggatcaccaaggaaatccctatccccaccatcggcatcggggcttcccccgcctgcgacgggcaggttttggtggtagacgacatgctcgggatgttcaccgatttccgcccgaaattcgtcaagcgctatgcggaactggcggaagccgccgaggccggaatcgccgcctatgcaaaagatgtgcggcagcgccgttttccggcgccggaacatgtattcagcgatatgcccaagccggtgaagggaggcgaggcagcgtga

SEQ ID NO: 11281 - protein, 281 aa, Mesorhizobium sp
MSATGGAKSFTPPDIAKAKGKAPIVCLTAYTTPIARLLDPHCDVVLVGDSVGMVMHGLPSTLGVTLDMMIMHGKAVRRGLERALMVVDMPFGSYEEGPEQAFRNAARVMAETGCAAVKLEGGESMAETIRFLTGRGIPVMAHVGLTPQAVNAFGGYQVQGRGEDGDRVMRDAQAVAKAGAFSVVLEKVPEPLARRITKEIPIPTIGIGASPACDGQVLVVDDMLGMFTDFRPKFVKRYAELAEAAEAGIAAYAKDVRQRRFPAPEHVFSDMPKPVKGGEAA

SEQ ID NO: 11282 - DNA, 810 bp, Methylococcus capsulatus
  CDS (1)..(810): transl_table=11
atgactgatccggtgactctgcccgacctgctcgccatgaagcggcgcggcgaaaaaatcgcctgcctcactgcctacgacgcctcgtccgcagccttgcaggacgaagccggcatcgaggtcatcctggtgggcgattcgctcggcaacgtcatccagggccagcccaccaccttgagtgtcacgctcgaccacatggtgtaccacaccgcctgcgtgcagcgagccgcgcgccgtgcactggtactggccgacctccctttcctgagctattgcactccggaacaggcggtccgcagcgccgcccggctgatccgcgacggcggggcgcaggtggtcaagttggaaggcggacgggaacggctcgacgtggtccggttcctgacggaacagaatgtcccggtatgcggccatctgggcctgcagccgcaagccatccaccggctgggccgttacgcgctgcagggtcgcgacgccgaatcggcatgccgcatggtcgaagatgcccgccagttggccgaggccggcgcaatgctcctggtgctcgaatgcatcccctgggagctggcgcaggaaatcaccgccgcggtcgacatccccaccattggcatcggcgccgggcggcattgcgacggccaggtcttggtctggcaggacatgctgggcatgagcgcacgactcccgcgtttctgcaaagacttcctcgccggcaatgcaggggttcgtgaggccgtctcggcctacgtgcgcgaggtcaaggccggcatcttcccgggcgacaggcacagcttcggccgcgacggtccatga

SEQ ID NO: 11283 - protein, 269 aa, Methylococcus capsulatus
MTDPVTLPDLLAMKRRGEKIACLTAYDASSAALQDEAGIEVILVGDSLGNVIQGQPTTLSVTLDHMVYHTACVQRAARRALVLADLPFLSYCTPEQAVRSAARLIRDGGAQVVKLEGGRERLDVVRFLTEQNVPVCGHLGLQPQAIHRLGRYALQGRDAESACRMVEDARQLAEAGAMLLVLECIPWELAQEITAAVDIPTIGIGAGRHCDGQVLVWQDMLGMSARLPRFCKDFLAGNAGVREAVSAYVREVKAGIFPGDRHSFGRDGP

SEQ ID NO: 11284 - DNA, 789 bp, Methylobacillus flagellatus
  CDS (1)..(789): transl_table=11
atgaacctcctgacactgcagcaaatgaaggagcgcggcgaaaaaatcgctgtactcaccagctacgatgcgagctttgcagcgctcagcgacaaggcaggcgtcgacgtactgctggtcggcgattcgctgggcatgaccatgcaaggccatgccaacaccctggcggtatcgctgcgcgacatggaataccatacccggtgcgttgccaacggcacacagcatgccttcatcgttaccgacatgccgttcggcagcttccagaaaacccctgagcaggcattcgagaatgccgtcctgctcatggcagcaggtgcgcagatggtcaaggttgaaggtggcgccatcatgctggaaaccgtgcgcttcttggtagagcgcggcatccctgtctgtgggcacctcgggttgaccccgcaatcagtgcaccagtttggcggctacagagtccaagcccgggatgaagccgccgcacgtcaactgctagacgatgccaaggcgctggccgccgccggggcaggcatgttggtactggaaatggtgcccgcagcactcgcggccgcggtaagccaggccgtgcatatccccgtgatcggcatcggcgcgggcaaatactgcgacggccaagtattggtgctgcaggacatgctgggcatttacgcaggcaagtcgccgcgcttcgttcgcaacttcatgcaaggcgccggcagcatagagcaggccatttgcgattatgttgccgcagtgaaagcacaaaccttccccggcattgaacacactttcgagtaa

SEQ ID NO: 11285 - protein, 262 aa, Methylobacillus flagellatus
MNLLTLQQMKERGEKIAVLTSYDASFAALSDKAGVDVLLVGDSLGMTMQGHANTLAVSLRDMEYHTRCVANGTQHAFIVTDMPFGSFQKTPEQAFENAVLLMAAGAQMVKVEGGAIMLETVRFLVERGIPVCGHLGLTPQSVHQFGGYRVQARDEAAARQLLDDAKALAAAGAGMLVLEMVPAALAAAVSQAVHIPVIGIGAGKYCDGQVLVLQDMLGIYAGKSPRFVRNFMQGAGSIEQAICDYVAAVKAQTFPGIEHTFE

SEQ ID NO: 11286 - DNA, 810 bp, Moorella thermoacetica
  CDS (1)..(810): transl_table=11
atggcgcaacgctccagggtaaccctgccccagctccaggccatgaaggagcggggcgagaggattaccatggtaactgcctacgactacccatcctctttactggccgatagggccggtatggatatgatcctggtgggggattccctgggaatggtagtcctgggctattcaagcactgtacctgtaactatggacgagatgatccaccacaccaaagcagtggtgcgggccaatcctgctgccctggtggtggccgatctgcccttcctatcctaccagaccagcgtacccgatgccgtctataacgccggccggttgatcaaggagggcggagccgacgccgtaaaactggaagggggacaggccgtggtgcctacggtccgggccatagtgaacgccggaatcccggttatgggacacctgggtctgacaccccagtcggctgtccagctgggtggtttccgggtccagggacggagcgaggccgaaggggagaagattgccgccgatgcggctgccctggtggaggcaggggtttttgccctggtcctggagtgtgtcccggccgacctggcccgccggataacggccgctttaccggtgccgaccatcggcattggcgccgggccggattgtgacggccaggtgcttgtttaccacgacctcctgggcctctttgaccgttttcgccccaaattcgtcaaacagtacgccaatctcgctgaagcgacagtcgccgccctggaaaaataccgggacgaggtgcgccagggtaaattcccggatcaggagcacagctttaagtaa

SEQ ID NO: 11287 - protein, 269 aa, Moorella thermoacetica
MAQRSRVTLPQLQAMKERGERITMVTAYDYPSSLLADRAGMDMILVGDSLGMVVLGYSSTVPVTMDEMIHHTKAVVRANPAALVVADLPFLSYQTSVPDAVYNAGRLIKEGGADAVKLEGGQAVVPTVRAIVNAGIPVMGHLGLTPQSAVQLGGFRVQGRSEAEGEKIAADAAALVEAGVFALVLECVPADLARRITAALPVPTIGIGAGPDCDGQVLVYHDLLGLFDRFRPKFVKQYANLAEATVAALEKYRDEVRQGKFPDQEHSFK

SEQ ID NO: 11288 - DNA, 858 bp, Mycobacterium avium
  CDS (1)..(858): transl_table=11
atgtctgagcacaatgtttacggtgccgcccagccggcccagcccgcccaacctgcccagccgcgcaccaggattcgcacccaccatctgcagaagatgaaggccgagggccacaagtgggccatgctgacggcgtacgactattccaccgcccgcatcttcgacgaggccggcatcccggtgctgctggtgggcgactcggcggccaacgtcgtctacggctacgacaccacggtgccggtgtcgatcgacgagctgatcccgctggtccgcggcgtggtgcggggggcaccgcacgccctggtggtcgccgatctgccgttcggcagctacgaggccgggccggccgccgcgctggccgccgccacccggttcatgaaggagggcggcgcgcacgcggtgaagctggagggcggcgaacgggtggccgagcagatcgctcacctgaccgcggccggcatcccggtgatggcgcacatcggcttcaccccgcagagcgtgaacagcctgggcggtttccgggtgcagggccgcggcgacgcggccgaacagaccatcgccgacgcgatcgccgtcgccgaagccggagcgttctcggtggtgatggagatggtgccggccgggctggccacccagatcaccggcaagctcaccatcccgaccatcgggatcggcgccggccccaactgcgacggccaggttctggtttggcaggacatggccggcatgagcagcggcaagtccgcccgcttcgtcaagcgcttcgccgacatcggcggcgaattgcgccgcgccgcaacgcagtatgcgcacgaggtggccgccggggtcttcccggccgacgaacactgcttctga

SEQ ID NO: 11289 - protein, 285 aa, Mycobacterium avium
MSEHNVYGAAQPAQPAQPAQPRTRIRTHHLQKMKAEGHKWAMLTAYDYSTARIFDEAGIPVLLVGDSAANVVYGYDTTVPVSIDELIPLVRGVVRGAPHALVVADLPFGSYEAGPAAALAAATRFMKEGGAHAVKLEGGERVAEQIAHLTAAGIPVMAHIGFTPQSVNSLGGFRVQGRGDAAEQTIADAIAVAEAGAFSVVMEMVPAGLATQITGKLTIPTIGIGAGPNCDGQVLVWQDMAGMSSGKSARFVKRFADIGGELRRAATQYAHEVAAGVFPADEHCF

SEQ ID NO: 11290 - DNA, 846 bp, Mycobacterium bovis
  CDS (1)..(846): transl_table=11
atgtctgagcagactatctatggggccaatacccccggaggctccgggccgcggaccaagatccgcacccaccacctacagagatggaaggccgacggccacaagtgggccatgctgacggcctacgactattcgacggcccggatcttcgacgaggccggcatcccggtgctgctggtcggtgattcggcggccaacgtcgtgtacggctacgacaccaccgtgccgatctccatcgacgagctgatcccgctggtccgtggcgtggtgcggggtgccccgcacgcactggtcgtcgccgacctgccgttcggcagctacgaggcggggcccaccgccgcgttggccgccgccacccggttcctcaaggacggcggcgcacatgcggtcaagctcgagggcggtgagcgggtggccgagcaaatcgcctgtctgaccgcggcgggcatcccggtgatggcacacatcggcttcaccccgcaaagcgtcaacaccttgggcggcttccgggtgcagggccgcggcgacgccgccgaacaaaccatcgccgacgcgatcgccgtcgccgaagccggagcgtttgccgtcgtgatggagatggtgcccgccgagttggccacccagatcaccggcaagcttaccattccgacggtcgggatcggcgctgggcccaactgcgacggccaggtcctggtatggcaggacatggccgggttcagcggcgccaagaccgcccgcttcgtcaaacggtatgccgatgtcggtggtgaactacgccgtgctgcaatgcaatacgcccaagaggtggccggcggggtattccccgctgacgaacacagtttctga

SEQ ID NO: 11291 - protein, 281 aa, Mycobacterium bovis
MSEQTIYGANTPGGSGPRTKIRTHHLQRWKADGHKWAMLTAYDYSTARIFDEAGIPVLLVGDSAANVVYGYDTTVPISIDELIPLVRGVVRGAPHALVVADLPFGSYEAGPTAALAAATRFLKDGGAHAVKLEGGERVAEQIACLTAAGIPVMAHIGFTPQSVNTLGGFRVQGRGDAAEQTIADAIAVAEAGAFAVVMEMVPAELATQITGKLTIPTVGIGAGPNCDGQVLVWQDMAGFSGAKTARFVKRYADVGGELRRAAMQYAQEVAGGVFPADEHSF

SEQ ID NO: 11292 - DNA, 861 bp, Mycobacterium leprae
  CDS (1)..(861): transl_table=11
atgtctgagcagaatgttaatgtttatggggctgatccttctacatcctccattcaatcaatacagcgcaccaaaatacgcaccaagcatctccaaaaaatgaaggccgaaggccacaagtgggccatgctgacagcctatgattattcgactgctcgggttttcgacgaagccggtatcccggtgttgctggtgggtgattcagcggccaacgtggtgtacggctacgacaccacggtgccggtttcggccgacgaactactcccgctggttcgcggcgtggtgcggggtgcggggcacgctctggtcgtcgccgacctgccattcggcagctacgaacccggacccactgccgcgctggctgtcgccacccgatttatgaaggagggcggtgcacacgccgtaaaactcgaaggcggccagcgggtagctgaacaaatcgcgtgcctgaccgcagcaggcattccggtaatggcgcacatcggattcacaccgcaaagcgtcaacagcctcggcggtttccgggtacagggccgcggcggcgacgccgaacaaaccgtcgctgatgccgttgccgttgctgaagccggagcattttccgtcgtaatggaaatggtgccgaccgagttagccacccagatcaccggcaaattaaccattccgacaatcgggatcggtgcgggtcttaactgcgacgcccaggtcttagtttggcaagatatggccggtttaagcagcggtaaggtggcacgtttcgtcaagcagtatgctgatatcgctggcgagttgcggcgtgccgcaatgcagtacgcagaggaagtggccagcgcggttttccctgctgaggagcactgcttctga

SEQ ID NO: 11293 - protein, 286 aa, Mycobacterium leprae
MSEQNVNVYGADPSTSSIQSIQRTKIRTKHLQKMKAEGHKWAMLTAYDYSTARVFDEAGIPVLLVGDSAANVVYGYDTTVPVSADELLPLVRGVVRGAGHALVVADLPFGSYEPGPTAALAVATRFMKEGGAHAVKLEGGQRVAEQIACLTAAGIPVMAHIGFTPQSVNSLGGFRVQGRGGDAEQTVADAVAVAEAGAFSVVMEMVPTELATQITGKLTIPTIGIGAGLNCDAQVLVWQDMAGLSSGKVARFVKQYADIAGELRRAAMQYAEEVASAVFPAEEHCF

SEQ ID NO: 11294 - DNA, 858 bp, Mycobacterium paratuberculosis
  CDS (1)..(858): transl_table=11
atgtctgagcacaatgtttacggtgccgcccagccggcccaaccgggccagcccgcccagccgcgcaccaggattcgcacccaccatctgcaaaagatgaaggccgagggccacaagtgggccatgctgacggcgtacgactattccaccgcccgcatcttcgacgaggccggcatcccggtgctgctggtgggcgactcggcggccaacgtcgtctacggctacgacaccaccgtgccggtgtcgatcgacgagctgatcccgctggtccgcggcgtggtgcggggggcgccgcacgccctggtggtcgccgacctgccgttcggcagctacgaggccgggccggccgccgctctggccgccgccacccggttcatgaaggagggcggcgcgcacgcggtgaagctggagggcggtgaacgggtggccgagcagatcgctcacctgaccgccgcgggcatcccggtgatggcgcacatcggcttcaccccgcagagcgtgaacagcctgggcggtttccgggtgcagggccgcggcgacgcggccgaacagaccatcgccgacgcgatcgccgtcgccgaggccggagcgttctcggtggtgatggagatggtgccggccgagctggccacccagatcaccggcaagctcaccatcccgaccatcgggatcggcgccggccccaactgcgacggccaggttctggtttggcaggacatggccggcatgagcagcggcaagtccgcccgcttcgtcaagcgcttcgccgacatcggcggcgaattgcgccgcgccgcaacgcagtatgcgcacgaggtggccgccggggtcttcccggccgacgagcactgcttctga

SEQ ID NO: 11295 - protein, 285 aa, Mycobacterium paratuberculosis
MSEHNVYGAAQPAQPGQPAQPRTRIRTHHLQKMKAEGHKWAMLTAYDYSTARIFDEAGIPVLLVGDSAANVVYGYDTTVPVSIDELIPLVRGVVRGAPHALVVADLPFGSYEAGPAAALAAATRFMKEGGAHAVKLEGGERVAEQIAHLTAAGIPVMAHIGFTPQSVNSLGGFRVQGRGDAAEQTIADAIAVAEAGAFSVVMEMVPAELATQITGKLTIPTIGIGAGPNCDGQVLVWQDMAGMSSGKSARFVKRFADIGGELRRAATQYAHEVAAGVFPADEHCF

SEQ ID NO: 11296 - DNA, 849 bp, Mycobacterium sp
  CDS (1)..(849): transl_table=11
atgtctgagcagactgtctacggtgctgcgagcgatcagcccacccccaagccgcgcgtcaaggtccgcaccacccacctgcagaagtggaaggccgaagggcacaagtgggcgatgctcaccgcctacgacttctccaccgcccgggcattcgacgacgccggcattccggtgttgctcgtgggcgactcggccgccaacgtcgtctacggctacgacaccacggtgccgatcacgatcgacgagttgatcccactggtgcgcggcgtggtgcggggcgcaccgcatgcgttggtggtggcggatctgccgttcggcagctacgaggaaggccctcgccaagccctggccacggccacccggttcctcaaggagaccggtgcgcacgcggtcaaactcgagggcggcgaacgcgtcgccgagcagatcgccacgctgtccgcggcgggcatcccggtcatggcgcacatcggcttcaccccgcagagcgtcaacggcctgggcggcttcaaggtccagggccgtggcgacgccgccgagcagaccatccacgacgcgatcgcggtccaggaggccggcgcgttctcggtggtgatggagatggtgcccgccgaactggccacccagatcaccggcaagctgaccatcccgacggtcggcatcggcgccgggccgaattgcgatgcgcaggtgctggtctggcaggacatggccggactgacgtcgggcaggacggcgaagttcgtgaagcgcttcggcgatgtcggcgccgaattgcgccgtgcggcaagccagtacgccgacgaggtggcggccggggtgttcccggccgaggagcacagcttctag

SEQ ID NO: 11297 - protein, 282 aa, Mycobacterium sp
MSEQTVYGAASDQPTPKPRVKVRTTHLQKWKAEGHKWAMLTAYDFSTARAFDDAGIPVLLVGDSAANVVYGYDTTVPITIDELIPLVRGVVRGAPHALVVADLPFGSYEEGPRQALATATRFLKETGAHAVKLEGGERVAEQIATLSAAGIPVMAHIGFTPQSVNGLGGFKVQGRGDAAEQTIHDAIAVQEAGAFSVVMEMVPAELATQITGKLTIPTVGIGAGPNCDAQVLVWQDMAGLTSGRTAKFVKRFGDVGAELRRAASQYADEVAAGVFPAEEHSF

SEQ ID NO: 11298 - DNA, 918 bp, Myxococcus xanthus
  CDS (1)..(918): transl_table=11
gtgaaggacaaggtcaccatccacacactgaagcgcttcaagcagatcggtcagaagatctgcatggtcaccgcttacgacgccacgttcgcccacatcctcgaagaggcaggcgcggatgtgctgctgataggcgactcgctgggcatggtcatccaggggcatgactccacgctgccggtgacgatggaccagatggtctaccacacggccgcggtggcccgtggcgcgcgccgggcgcacgtcgtggccgacctgccgttcatgagctaccaggtgtcgaaccaggaggcggtccgcaacgcgggccggctggtggcggaaggcggcgcgggcagcatcaagctggagggcggcgctgagttcgcggacacggtgcgggccatcgtccgcgcgagcatccccgtcatgggacacctggggctgacgccgcagtccgtccacaagatgggcggctacgtcgtccagggccgcggcgaggaccaggcgcggcagattctggacgacgcgctggcgctggagcaggccggggcctacgcgctggtgctggaaggcgtgcccatggacctggcgcgcacggtgacgcagcgcctgtccatccccaccatcggcattggcgccggcgtggactgtgatggccaggtgctcgtctgctacgacctgctgggcatgaacccggacttcaagccgaagttcgtgaagcgctacgccaacctccacggctcgattaccgaggccgcgggcgcgtacttcgcggaggtccgcaagggcgcgttcccggacgaggagcactccttcaaggcgaccaagaacatccggctggcgccgggggctccggctccggcggcccgggtggagccgtccgcgcccgccgaggctggcgagaagctgggccccgtctacgggagacccgcctag

SEQ ID NO: 11299 - protein, 305 aa, Myxococcus xanthus
MKDKVTIHTLKRFKQIGQKICMVTAYDATFAHILEEAGADVLLIGDSLGMVIQGHDSTLPVTMDQMVYHTAAVARGARRAHVVADLPFMSYQVSNQEAVRNAGRLVAEGGAGSIKLEGGAEFADTVRAIVRASIPVMGHLGLTPQSVHKMGGYVVQGRGEDQARQILDDALALEQAGAYALVLEGVPMDLARTVTQRLSIPTIGIGAGVDCDGQVLVCYDLLGMNPDFKPKFVKRYANLHGSITEAAGAYFAEVRKGAFPDEEHSFKATKNIRLAPGAPAPAARVEPSAPAEAGEKLGPVYGRPA

SEQ ID NO: 11300 - DNA, 792 bp, Neisseria meningitidis serogroup A
  CDS (1)..(792): transl_table=11
atgattactgtgaacacactgcaaaaaatgaaggcggcgggcgagaaaatcgctatgctgaccgcttacgaatccagttttgccgcgctgatggacgatgccggcgtggatgtgctgctggttggggattctttgggaatggcggttcaagggcggcagtcgacgctgcccgtcagcctgcgcgatatgtgttatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggtcaaactcgaaggcggtgtgtggatggcggaaacgaccgaatttctgcaaatgcgcggtattccggtctgtgcccacatcggtctgaccccgcaatccgtgtttgccttcggcggatacaaggttcaggggcgcggcggcaaggcgcaggcgttgcttaacgatgccaaggcgcatgatgatgcgggggcggcggtcgtgctgatggagtgtgttcctgcggaactggcaaaaaaggtaactgaatccgtttcctgtccgaccatcggcatcggcgcgggtgtcgattgcgacgggcaggttttggtgatgcacgatatgctcggcattttcccgggtaagacggcgaaattcgtcaaaaactttatgcaggggcaaagcagcattcaggcggcggttcgggcgtatgttgccgaagtcaaagccaaaaccttccctgctgcggaacatatttttgcagactga

SEQ ID NO: 11301 - protein, 263 aa, Neisseria meningitidis serogroup A
MITVNTLQKMKAAGEKIAMLTAYESSFAALMDDAGVDVLLVGDSLGMAVQGRQSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDDAGAAVVLMECVPAELAKKVTESVSCPTIGIGAGVDCDGQVLVMHDMLGIFPGKTAKFVKNFMQGQSSIQAAVRAYVAEVKAKTFPAAEHIFAD

SEQ ID NO: 11302 - DNA, 792 bp, Neisseria meningitidis serogroup B
  CDS (1)..(792): transl_table=11
atgattactgtgaacacactgcaaaaaatgaaggcggcgggcgaaaaaatcgctatgctgaccgcttacgaatccagttttgccgcgctgatggacgatgccggcgtggaaatgctgctggtcggcgattctttggggatggcggttcaggggcggaaatcgacgctgcccgtcagcctgcgcgatatgtgttatcacaccgaatgtgtagcacgcggtgcaaaaaatgcgatgattgtcagcgatttgccgtttggtgcatatcagcagagtaaggagcaggcgtttgccgccgccgccgaactgatggctgccggcgcgcatatggttaaactcgaaggcggcgtgtggatggcggaaacgactgaatttttgcaaatgcgcggtattccggtttgtgcgcacatcggtctgaccccgcaatccgtgtttgccttcggcggatataaagttcaggggcgcggcggcaaggcgcaggcgttgcttaacgatgccaaggcgcatgacgatgcgggggcggcggtcgtgctgatggagtgcgtactggcggaactggcaaaaaaggtaactgaaactgtttcctgtccgaccatcggcatcggcgcgggtgcggattgcgacgggcaggttttggtgatgcacgatatgctcggcattttcccgggtaagacggcgaaattcgtcaaaaactttatgcaggggcatgatagtgttcaagcggcggttcgggcgtatgttgccgaagtcaaagccaaaaccttccctgctgcggaacatatttttgcagattga

SEQ ID NO: 11303 - protein, 263 aa, Neisseria meningitidis serogroup B
MITVNTLQKMKAAGEKIAMLTAYESSFAALMDDAGVEMLLVGDSLGMAVQGRKSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDDAGAAVVLMECVLAELAKKVTETVSCPTIGIGAGADCDGQVLVMHDMLGIFPGKTAKFVKNFMQGHDSVQAAVRAYVAEVKAKTFPAAEHIFAD

SEQ ID NO: 11304 - DNA, 792 bp, Neisseria meningitidis serogroup C
  CDS (1)..(792): transl_table=11
atgattactgtgaacacactgcaaaaaatgaaggcggcgggcgaaaaaatcgctatgctgaccgcttacgaatccagttttgccgcgctgatggacgatgccggcgtggaaatgctgctggtcggcgattctttggggatggcggttcaggggcggaaatcgacgctgcccgtcagcctgcgcgatatgtgctatcacaccgaatgtgtagcacgcggtgcaaaaaatgcgatgattgtcagcgatttgccgtttggtgcatatcagcagagtaaggagcaggcgtttgccgccgccgccgaactgatggcggccggcgcgcatatggtcaaactcgaaggcggcgtgtggatggcggaaacgactgaatttctgcaaatgcgcggcattccggtctgtgcccacatcggtctgaccccgcaatccgtgtttgccttcggcggatacaaggttcagggccgcggaagtaaggcgcaggcgttgcttaacgatgccaaggcgcatgacgatgcgggggcggcggtcgtgttgatggagtgtgttcctgcggaactggcaaaaaaggtaactgaatccgtttcctgtccgaccatcggcatcggcgcgggcgcggattgcgacggtcaggttttggtgatgcacgatatgctcggtattttcccaggcaaaacggcgaaattcgtcaaaaactttatgcacgggcaaagcagcattcaggcggcggttcgggcgtatgttgccgaagtcaaagccaaaactttccctgctgcggaacatatttttgcagactga

SEQ ID NO: 11305 - protein, 263 aa, Neisseria meningitidis serogroup C
MITVNTLQKMKAAGEKIAMLTAYESSFAALMDDAGVEMLLVGDSLGMAVQGRKSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGSKAQALLNDAKAHDDAGAAVVLMECVPAELAKKVTESVSCPTIGIGAGADCDGQVLVMHDMLGIFPGKTAKFVKNFMHGQSSIQAAVRAYVAEVKAKTFPAAEHIFAD

SEQ ID NO: 11306 - DNA, 810 bp, Nitrosomonas europaea
  CDS (1)..(810): transl_table=11
atggatcagtcagctgcgaaacggatgacgattacaacgctgcagaatgcttgcgagcagggagagaaaatagcggtactgacctgctatgacgcaacgtttgctgcggtactggaagaggcgggggtcgatattctgctggtgggagattcgctcgggaatgtggtgcaggggaaatccagcaccttgccggttacattggatgagatgatttatcacgtccggtgcgtggaacgcggtacccacagggtatttatcatggccgatatgccttttggcacgttccaggtgtctccgcaggaggcgttcgggaatgctgtccggttgatggctgctggtgcgcagatggtcaagatcgagggagggcagcatatggccgaaaccgtagagtttttatcctgccgcggaattccggtctgtgcccatatcggattgatgccccagtttgttcaccagttgggcggttacagggttcaggggaaaacgccgaatgatgccagacaattgcgtgaagatgcactcctgttacaagaggcaggagcagccatgctgctgatggaactgattccggctgtattgggtgaggaaattacccggttgctttccattcccaccatcggtattggtgctggtgcagcgtgttccgggcaggtactggtgttgcacgacatgttgggtatcagctctggtactttgccgcgtttcgtcagaaatttcatgatggacgcagacagtattcaaaccgctgtcagcaattatgtcgaagcagtcaagcttggggcatttcccgcatatgaacatacgttctga

SEQ ID NO: 11307 - protein, 269 aa, Nitrosomonas europaea
MDQSAAKRMTITTLQNACEQGEKIAVLTCYDATFAAVLEEAGVDILLVGDSLGNVVQGKSSTLPVTLDEMIYHVRCVERGTHRVFIMADMPFGTFQVSPQEAFGNAVRLMAAGAQMVKIEGGQHMAETVEFLSCRGIPVCAHIGLMPQFVHQLGGYRVQGKTPNDARQLREDALLLQEAGAAMLLMELIPAVLGEEITRLLSIPTIGIGAGAACSGQVLVLHDMLGISSGTLPRFVRNFMMDADSIQTAVSNYVEAVKLGAFPAYEHTF

SEQ ID NO: 11308 - DNA, 852 bp, Nocardia farcinica
  CDS (1)..(852): transl_table=11
atgtccgtatccgattcggaaacccctgcctacggtgcggcgcagccggctcagccgcggcgcaagacgcgcatcccgcacctgcggcagatgaaggccgacggtgagcgctgggcgatgctcaccgcctacgactactcctcggcgcgactgttcgaggaggcgggcatcccggtcctgctggtcggcgactccgccgccaacgtcgtctacggctacgacaccaccgtgccgatcaccgtcgacgaactgatcccgctggtgcgcggcgtggtgcgcggcgcaccgcacgccttggtggtcgccgacctgccgttcggcacctacgagggctcggcgcagcaggcgctggcggccgccacccgtttcatgaaggagggcggcgcgcacgcggtgaaactggagggtggcgagcgcgtggccgagcagatcgcgctgctcaccgccgcgggcattcccgtgatggcgcatatcggtttcaccccgcagagcgtgaacaccctcggcgggttccgggtgcagggccgcggcgacggcgccgaacagctcatcgccgacgcgatcgcggtgcaggaggcgggcgcgttctcggtggtgatggagatggtgcccgcggagctggccggacaggtcacccgcaagctcaccatcccgacgatcggcatcggcgccggtcccgactgcgacgcgcaggtgttggtgtggcaggacatggccgggtacaccagcggcaagaccgccaagttcgtcaagcgcttcggcgacatcggcgaccagctgcgcgcggcggcggccgcctacgccgccgaggtccgcgagggcaccttccccgggcccgagcacagcttctga

SEQ ID NO: 11309 - protein, 283 aa, Nocardia farcinica
MSVSDSETPAYGAAQPAQPRRKTRIPHLRQMKADGERWAMLTAYDYSSARLFEEAGIPVLLVGDSAANVVYGYDTTVPITVDELIPLVRGVVRGAPHALVVADLPFGTYEGSAQQALAAATRFMKEGGAHAVKLEGGERVAEQIALLTAAGIPVMAHIGFTPQSVNTLGGFRVQGRGDGAEQLIADAIAVQEAGAFSVVMEMVPAELAGQVTRKLTIPTIGIGAGPDCDAQVLVWQDMAGYTSGKTAKFVKRFGDIGDQLRAAAAAYAAEVREGTFPGPEHSF

SEQ ID NO: 11310 - DNA, 888 bp, Nocardioides sp
  CDS (1)..(888): transl_table=11
atgacgtcagggagagccatgagccccgaggagacggcgccgtacggcaccggtccggcccgtgcggagagcgcgccggacgcacccgcaccgatcaagcggatccgcacccaccacctgcgcgagatgaagcagcgcggcgagaagttcgcgatgctcaccgcctacgagcagtacgccgcgcagaccttcgacgaggccggcatcgaggtgctgctggtcggcgacagcgcgtcgaacaacgtgttcgcgaacgagacgtcgctgccggtgaccgtcgacgagctgatcccgctggcgcgggccgtcagccggtcggtacgccgggcactggtggtcgccgacctgccgttcggctcctaccaggcctccccggagcaggcctacctgaccgccgtgcggttcatgaaggaggcgaacgcgcacgcggtcaagctcgagggcgggatcgagatggccccccaggtccgcaagctcaccgagggcggcatcccggtgatggcccacatcggcttcaccccccagtccgagcacaacctgggtggctaccgggtccagggccgcggcgaggcggcggcccgggtcgtcgcggaggcggtggcgatggagcaggccggtgccttcgccgtcgtgatggagatggtccccggcgacgtcgccgcggaggtgaccaagtcggtgtcgatccccacgatcgggatcggcgccgggctcgactgcgacgggcaggtgctggtctggcaggacgccttcggcctgcgcaccggccggatgccgcgcttcgtcaagcagtacgccgacctgcacggcgtactcctccaggccgcccgcgactacgccgccgacgtcaaggccggcaccttccccggccccgagcacaccttctga

SEQ ID NO: 11311 - protein, 295 aa, Nocardioides sp
MTSGRAMSPEETAPYGTGPARAESAPDAPAPIKRIRTHHLREMKQRGEKFAMLTAYEQYAAQTFDEAGIEVLLVGDSASNNVFANETSLPVTVDELIPLARAVSRSVRRALVVADLPFGSYQASPEQAYLTAVRFMKEANAHAVKLEGGIEMAPQVRKLTEGGIPVMAHIGFTPQSEHNLGGYRVQGRGEAAARVVAEAVAMEQAGAFAVVMEMVPGDVAAEVTKSVSIPTIGIGAGLDCDGQVLVWQDAFGLRTGRMPRFVKQYADLHGVLLQAARDYAADVKAGTFPGPEHTF

SEQ ID NO: 11312 - DNA, 870 bp, Novosphingobium aromaticivorans
  CDS (1)..(870): transl_table=11
atgtccacgaccttccagctcgatacctcgacaagccgtgccaaccccaccccggcaccgatgaagcgcctgacgatccccgcgatccgccagcgcaagaaggacggcgtgacggcacaaccggtcgtgatgctcaccgcctataccgcccgtcaggcgcaattgctcgacgcccattgcgatctgctgctggtcggggattcccttggccaggtgatctatggcctgccttccagcgttccggtcacgctcgacatgatggcagcccatggcgcggcggtcgtgcgtggatcgtatcacgcggcggtcgtggtcgacatgccgttcggcagctacgaagcatcgccgcagcaggccttcgaaagcgcctcgcggctgctgaaggaaaccggttgcgcggcagtgaagctcgaagggggcgaggccatggccgaaacggtcgcgttcctcaccaaccggggcatcccggtcatgggccacgtcggcctcaccccgcaggcggtcaatgtgctgggcggctacaacgcgcgcggccgcagcgaggccgaagcggccaagatcgtcggagacgcacggtcgcttgccgatgccggtgccttcgccatcgtgatcgaaggcgtggtcgagcccatcgcgattgccatcacccaggccgtggcgtgcccgacaatcggcatcggcgcctcggctcaatgcgacgggcaggttctggtcaccgaagacatgctcggcatgttcgagcgcgttccgcggttcgtgaagatctacgaggatctcgccgggaccatctccggggctgcggcgcgttatgccgacgaagtgcgcgcgcgcaccttccccggtattgaacagacgtaccagcccaagtaa

SEQ ID NO: 11313 - protein, 289 aa, Novosphingobium aromaticivorans
MSTTFQLDTSTSRANPTPAPMKRLTIPAIRQRKKDGVTAQPVVMLTAYTARQAQLLDAHCDLLLVGDSLGQVIYGLPSSVPVTLDMMAAHGAAVVRGSYHAAVVVDMPFGSYEASPQQAFESASRLLKETGCAAVKLEGGEAMAETVAFLTNRGIPVMGHVGLTPQAVNVLGGYNARGRSEAEAAKIVGDARSLADAGAFAIVIEGVVEPIAIAITQAVACPTIGIGASAQCDGQVLVTEDMLGMFERVPRFVKIYEDLAGTISGAAARYADEVRARTFPGIEQTYQPK

SEQ ID NO: 11314 - DNA, 813 bp, Oceanobacillus iheyensis
  CDS (1)..(813): transl_table=11
atgaaggccttgaaagatttcatgcggatgaagcatgaaggagaaaaaatttcgatgttgactgcttatgattatccgagtgcaaagcaagcggaagctgctgaaatagatatgattcttgtcggtgattccctagggatgacggtacttggctacgaaagcactgtcgatgtaactctcgacgatatgaagcatcacgcgcgtgcagtgcgccgtggcgcaaaggatacgtatgttgtcgttgatatgccttttggtaccatcggcattgatgcaagtaccgatacagcttttgccattgaattataccgagacactcatgcaaacgctataaaaatcgaaggcgcacatgccgctcctgttattaaaaaatgccatgatatcggtattcctgtcgttgcccatcttgggttgacgccgcagagttacggcatcacaggctatcaactacaagcaacctctaaagaagcagccaaacagctgattgaggatgctaaacttgttgaaaaaagtggtgcgattatgcttgtcttagaagcaataccaagtgaccttgcccatgtaattaccgagtcgcttacgattccggttatcgggataggcgcaggtgtaggaacgaatggacaagtccttgtgtatcatgacgtacttaattatggtgtcgagcataagccaaaatttgtaaagcgttatggtgatttttctattggtgtagaatccataaaaaactttcatgacgaggtgaagcgacaagcgtttcctactgaagaatacacatacaagaaacaaattatgaacgaggtagacgaatga

SEQ ID NO: 11315 - protein, 270 aa, Oceanobacillus iheyensis
MKALKDFMRMKHEGEKISMLTAYDYPSAKQAEAAEIDMILVGDSLGMTVLGYESTVDVTLDDMKHHARAVRRGAKDTYVVVDMPFGTIGIDASTDTAFAIELYRDTHANAIKIEGAHAAPVIKKCHDIGIPVVAHLGLTPQSYGITGYQLQATSKEAAKQLIEDAKLVEKSGAIMLVLEAIPSDLAHVITESLTIPVIGIGAGVGTNGQVLVYHDVLNYGVEHKPKFVKRYGDFSIGVESIKNFHDEVKRQAFPTEEYTYKKQIMNEVDE

SEQ ID NO: 11316 - DNA, 792 bp, Photorhabdus luminescens subsp
  CDS (1)..(792): transl_table=11
atgaaaccaatgaccatgactgatctgaatcagctcaagaaagaaaaacgtaaattcgcgactattaccgcttatgacgccagctttgcccacctgtttgccgagcaaggtatcgatgtcatgctggttggtgactcactgggtatgactgtgcaaggggctgataccaccattccagtgacggttgaagatattgtctatcatactcgctgtgtccgtgccggaacaccttatacttttatcattgccgatatgcccttcatgagttatgccacgccagagcaaagttgtgaaaacgctgccaagcttatgcgtgctggcgctaacatggtgaaacttgaaggcggtagctggttatacgataccattaacatgcttaccgagcgttctgtacccgtttgcgcccatttagggctaactcctcaatcagtccatattcttggcggttataaagttcagggacgtgatgaagtatcagcgaatcaattgataaaagatgccattaccttagaaaaggcaggcatacaactgctagtactagaatgcgtacccgttgatttagctaaacgtatcaccgatgaattacagatcccggtaattggtattggtgccggtaatgtgactgatgggcaagttttagtgatgcatgacacactgggcattaccgtaagcccccctaaatttgtgaaaaacttccttgaagaagcagggaatatacgtgatgccattcgcctatataaagaacaggtggaaagtggtatttaccctggtaaagaacactcattttattaa

SEQ ID NO: 11317 - protein, 263 aa, Photorhabdus luminescens subsp
MKPMTMTDLNQLKKEKRKFATITAYDASFAHLFAEQGIDVMLVGDSLGMTVQGADTTIPVTVEDIVYHTRCVRAGTPYTFIIADMPFMSYATPEQSCENAAKLMRAGANMVKLEGGSWLYDTINMLTERSVPVCAHLGLTPQSVHILGGYKVQGRDEVSANQLIKDAITLEKAGIQLLVLECVPVDLAKRITDELQIPVIGIGAGNVTDGQVLVMHDTLGITVSPPKFVKNFLEEAGNIRDAIRLYKEQVESGIYPGKEHSFY

SEQ ID NO: 11318 - DNA, 795 bp, Photobacterium profundum
  CDS (1)..(795): transl_table=11
atgaaaaaaataacaatcaacgacctgatgacatggaagcatgaaggtcgtaaatttgcatcgataacagcatatgatgcaagttttgctcaattatttgagcaacaggaagtccccgtactgctagttggcgattcattgggaatggttttacaaggtaaaccagataccctgccagtcagcgtaagtgacattgcttaccatactcgatgtgtgcgcgctggtagccctaacactcttttaatggctgatatgccatttatgagctacagcaccccagagcaagcgtgtgagagcgctgcagagcttatgcgagctggcgctaacatggtcaaactggaaggtggtgcatggttagctgaaaccattacaaaactcaccgagcgtgcagttccagtatgtgctcatctaggccttactccacaatctgtaaatatttttggtggatacaaagttcaaggtcgcgattctgatcacgcagcacagatggtaaaagatgctattttattgaaaaatgctggtgctcagatcattttgctggaatgtgtacccgcaagccttgcagagcgtatcaccaaggcggttgaagtaccggttattgggattggcgctggtaacgtaacagatggtcagatcctagtgatgcacgatatgtttggtatttctgccaactacatgccgcgcttttcaaaaaattatctcgctgaaactggcgacatgcgtacagctgtcagcaaatacctagaagaggttgaggccggtacttttcctgggccccaacacacctttgagtaa

SEQ ID NO: 11319 - protein, 264 aa, Photobacterium profundum
MKKITINDLMTWKHEGRKFASITAYDASFAQLFEQQEVPVLLVGDSLGMVLQGKPDTLPVSVSDIAYHTRCVRAGSPNTLLMADMPFMSYSTPEQACESAAELMRAGANMVKLEGGAWLAETITKLTERAVPVCAHLGLTPQSVNIFGGYKVQGRDSDHAAQMVKDAILLKNAGAQIILLECVPASLAERITKAVEVPVIGIGAGNVTDGQILVMHDMFGISANYMPRFSKNYLAETGDMRTAVSKYLEEVEAGTFPGPQHTFE

SEQ ID NO: 11320 - DNA, 822 bp, Porphyromonas gingivalis
  CDS (1)..(822): transl_table=11
atgtccacgtaccaaccggaagatactcgtaaggtaactacacatcgcctcatcgagatgaagagccgtggggagaaaatctccatgctcacagcttatgactactcaatggctaagctggtcgatgaggccggtatggatgtcattcttgtaggtgattcggcttcgaacgttatggccggcaatgtcaccaccctgcccatcactctcgatcagatgatctaccacggcaagtctgtggtcaaggccgtcaagcgtgctcttgtggtcgtagatcttcctttcggatcctatcagggcaactccaaagaagccttgtgctcggccatccgtgtgatgaaggagacacatgccgactgtatcaaactcgaaggaggagaagaggtgcgcgagtccattgtgcgaatcctctcggccggtattcccatcatgggacacctcggactgatgcctcagagcatcaataagtttggcacctacaatgtccgcgccaaggaagaggccgaagccgagaagctgcttcaggatgctcacctcttggaagaactcggatgcttcgctctcgtcctcgaaaaaataccggccgaactggctacacgtgtagcttcggagctgagcattccggttatcggcatcggtgccggaggtggtgtggacggtcaggtgctggtgatgcacgacatgctcggtatcacggaggggttcagtccccgtttcctgcgccgttatgccaatctggccaacgagatagatcgggcactcaagcattatatcgctgatgtgaagagtatggacttccccaataaggacgagcagtactga

SEQ ID NO: 11321 - protein, 273 aa, Porphyromonas gingivalis
MSTYQPEDTRKVTTHRLIEMKSRGEKISMLTAYDYSMAKLVDEAGMDVILVGDSASNVMAGNVTTLPITLDQMIYHGKSVVKAVKRALVVVDLPFGSYQGNSKEALCSAIRVMKETHADCIKLEGGEEVRESIVRILSAGIPIMGHLGLMPQSINKFGTYNVRAKEEAEAEKLLQDAHLLEELGCFALVLEKIPAELATRVASELSIPVIGIGAGGGVDGQVLVMHDMLGITEGFSPRFLRRYANLANEIDRALKHYIADVKSMDFPNKDEQY

SEQ ID NO: 11322 - DNA, 774 bp, Prochlorococcus marinus
  CDS (1)..(774): transl_table=11
atgttaccttcagacctagttaattataaaaaaaaatctcgcaaaatcattgcactaactgcttgggactccatatcaggatctattgcagaacaagcaaatgttgatctcgtactagtaggagattcattagcaatggtctgcttaggataccaatcaacattgccaataactttagaaaatataatttatcatactaatgctgtttcaagaggatttaagaaaaaaattgaggaacaacctctagtcgtttcagatatgccttttatgacttaccaatgtggcgaggataaggctgttgagtatgcagggaaaatcattcagagcacttatgcaaaagctgtaaaagtggaaggagctgaaccagaaatacaaaaagttatttctagattaataagaatgggaatccctgttatgggtcatataggtcttacaccacaaagctatctaaatattggattaagaaaacaaggagaaagcttggcaagccaagaaaaaattaagaaagaggcttcaattcttgaagaattaggatgtttttcaatagttcttgaacatattcctgatttgcttgctaaggaaatacaaaattcattaacaattcccacaataggtatcggcgcaggtaattattgcgatgggcaagtaagagttacagcagatttgctaggcctcaatgatgatcaacccccattttgccaaccaattatccaaggaaagaaattatttaaggataaattaaaagaatgggtagactctgaaaggcttagttaa

SEQ ID NO: 11323 - protein, 257 aa, Prochlorococcus marinus
MLPSDLVNYKKKSRKIIALTAWDSISGSIAEQANVDLVLVGDSLAMVCLGYQSTLPITLENIIYHTNAVSRGFKKKIEEQPLVVSDMPFMTYQCGEDKAVEYAGKIIQSTYAKAVKVEGAEPEIQKVISRLIRMGIPVMGHIGLTPQSYLNIGLRKQGESLASQEKIKKEASILEELGCFSIVLEHIPDLLAKEIQNSLTIPTIGIGAGNYCDGQVRVTADLLGLNDDQPPFCQPIIQGKKLFKDKLKEWVDSERLS

SEQ ID NO: 11324 - DNA, 819 bp, Prochlorococcus marinus
  CDS (1)..(819): transl_table=11
atgcaaaccacagatttggttcgttttaaaaagttgggcaaacagataactgtattaactgcttgggatgctatttcatcttcaatagtcgaggctgcaggagctgatgttgttctagtgggagattcacttgggatggttgtcttgggacactcaacgactcttccggtaacacttgatcaaatgcttcaccacacaaaggctgtttgtagaggtttttgtagacctctttcaaaacaacccttagtagtttgtgatctcccttttttaagttatcaatgtggagaagacaaggctgttgaagcggctggaactctcctgaaaaactccactgcttcagctgtgaaacttgaaggagcagaacctgagactttattagtcattaagagacttattagaatggggattccagtaatggggcatcttggcctaactccacagtcagttcatcaacttggatataaatcacaagctagggataaagatagtcaagaaaaaatttttaaagattcaaaaatgcttcaagaatcaggatgttttgcaatcgttttagaacatattccagcagaaattgccagccgattaaagaaacatatagatattcccgtaattggcattggggctggaagtgattgtgatgggcaggtacgagttaccgctgatattcttggcctttcaattgcgcagcctccttttgcaaaacctttacttgcaggacgagaactttgcataaatgccctaaaagaatggattaattctactgatctcgatcaagtgaatcccaccacgaaaacatctgaatcaaaatctgattgctaa

SEQ ID NO: 11325 - protein, 272 aa, Prochlorococcus marinus
MQTTDLVRFKKLGKQITVLTAWDAISSSIVEAAGADVVLVGDSLGMVVLGHSTTLPVTLDQMLHHTKAVCRGFCRPLSKQPLVVCDLPFLSYQCGEDKAVEAAGTLLKNSTASAVKLEGAEPETLLVIKRLIRMGIPVMGHLGLTPQSVHQLGYKSQARDKDSQEKIFKDSKMLQESGCFAIVLEHIPAEIASRLKKHIDIPVIGIGAGSDCDGQVRVTADILGLSIAQPPFAKPLLAGRELCINALKEWINSTDLDQVNPTTKTSESKSDC

SEQ ID NO: 11326 - DNA, 774 bp, Prochlorococcus marinus
  CDS (1)..(774): transl_table=11
atgttaccttcagacctcgttaagtataaaaaaaattctcaaaaaattatcgcactaactgcatgggactctatatcaggatcgattgcagaacaagctaatgttgatcttgtcttggtaggagattccttagcaatggtatgtttaggatataaatctacattgccattaactttagggaacataatttatcatactaatgctgtctcgagaggatttaaaaagaatattgaagaacaacctttggttattgcagatatgccttttctgacttaccaatgcggagaagataaagcagtagagtatgcaggtaaaatcattcagagcacttatgcaaaggctgtaaagatagaaggcgctgaaccggaaatacaaaaagttatttctagattaataagaatgggaatccctgtaatgggccatatcggtcttacaccgcaaagctatcttaatcttggattaaagaaacaaggagaaagcttagagagccaagaaaaaatcaaaaaagaggcttcaattcttgaaaaattaggatgtttttcaatagttcttgaacacattcctgatttgcttgctaaagaaatacaaaacaccttaacaattcccacaataggtatcggtgcaggtaactattgcgatgggcaagtaagagttactgcagatttgttaggtctcaatgatgatcaaccaccattttgccaaccgattattcaaggtaaggaattatttatgaaaaaattaaaagaatgggtagaatctgaaagacttaattaa

SEQ ID NO: 11327 - protein, 257 aa, Prochlorococcus marinus
MLPSDLVKYKKNSQKIIALTAWDSISGSIAEQANVDLVLVGDSLAMVCLGYKSTLPLTLGNIIYHTNAVSRGFKKNIEEQPLVIADMPFLTYQCGEDKAVEYAGKIIQSTYAKAVKIEGAEPEIQKVISRLIRMGIPVMGHIGLTPQSYLNLGLKKQGESLESQEKIKKEASILEKLGCFSIVLEHIPDLLAKEIQNTLTIPTIGIGAGNYCDGQVRVTADLLGLNDDQPPFCQPIIQGKELFMKKLKEWVESERLN

SEQ ID NO: 11328 - DNA, 819 bp, Prochlorococcus marinus
  CDS (1)..(819): transl_table=11
atgcgccccagcgaattaactcaactcaagcaggacgggcgagcgatcagcatcctcacagcctgggatggcttaagcgcggccttggttgaggccgctggagccgatgtggttctagtaggagactcgctagcgatggtggcactgtgccatgcaaccaccctgcctgtgacagtggagcagatgctccaccacacccaagcggtgggtcggggtttcactcgccctctgccacaacagcccctcgtcgtctgcgacctcccattcctgagctaccaatgcggagaagacaaggctgtagctgcagctggaagcctgctcaagcactcctgtgcagccgccgtgaagctagaaggagcagagccagaggtcctagcagtcattgagcgtctggtgcggatggggatcccagtcatggggcatttgggcctcactccacaagcagtacatcggctcggctaccgccgtcaggcggaggaccctcgcagccaagcgcaaatgctgcaacaagcaaaacaacttgagcaagcgggctgtttcgccctagtggtcgaacatgtgccgagttccatcgctcgttgcctgagtcaacaactcaccatccccgtgatcggtatcggcgctggcgaagattgcgatggacaggtaagggtcaccgctgacctgttgggactaactcccagccaaccccccttcagtccgccattgatccaaggtcgccagctgtgcgtagaagcccttcaaggttgggtgaagcaactgcatcagcaggcagagactgccaccacaacaacatctcaaccagaacctgattgctga

SEQ ID NO: 11329 - protein, 272 aa, Prochlorococcus marinus
MRPSELTQLKQDGRAISILTAWDGLSAALVEAAGADVVLVGDSLAMVALCHATTLPVTVEQMLHHTQAVGRGFTRPLPQQPLVVCDLPFLSYQCGEDKAVAAAGSLLKHSCAAAVKLEGAEPEVLAVIERLVRMGIPVMGHLGLTPQAVHRLGYRRQAEDPRSQAQMLQQAKQLEQAGCFALVVEHVPSSIARCLSQQLTIPVIGIGAGEDCDGQVRVTADLLGLTPSQPPFSPPLIQGRQLCVEALQGWVKQLHQQAETATTTTSQPEPDC

SEQ ID NO: 11330 - DNA, 774 bp, Prochlorococcus marinus
  CDS (1)..(774): transl_table=11
atgttgccatcagaactcgttaaatataaaaaaaattctcaaaaaatcattgcattaactgcttgggactccatatcaggttctctagctgagcaatcaggagcagatattgttctagtaggagactctttagcaatggtgtgtttaggatacaaatccacattaccagtaactttagagaatatgatttatcacacaaatgcagtttcaagagggttcagcagagaaatagaagaacattccttattagtttgtgatatgccttttctaacttatcaatgcggagaagataaggcagtggaatatgccgggaaaataattaagaacacctatgcaaaggcagtaaaaattgaaggtgctgaaccagaggtccaaactgttatttcaaggctaataagaatggggattcctgtcatggggcatttaggacttacaccacagagttatttaaatctaggattaaaaaaacaagggctcaagaaagaaagttacgaaaaaatcaaaagagatgctttatcactagaaaaattgggatgcttttctatagttttggagcatattccggaattacttgctaaagaaattcaaaccgatttagaaataccgacaataggaataggtgcaggcgtcttttgtgatggtcaggtaagagttacggctgatttattaggcctaagtgataagcagcctccattttgtaaaccaattgttgatgggaaaaaatattttggtgaaaaacttaaagagtgggtaacttctgaaaggcttagttaa

SEQ ID NO: 11331 - protein, 257 aa, Prochlorococcus marinus
MLPSELVKYKKNSQKIIALTAWDSISGSLAEQSGADIVLVGDSLAMVCLGYKSTLPVTLENMIYHTNAVSRGFSREIEEHSLLVCDMPFLTYQCGEDKAVEYAGKIIKNTYAKAVKIEGAEPEVQTVISRLIRMGIPVMGHLGLTPQSYLNLGLKKQGLKKESYEKIKRDALSLEKLGCFSIVLEHIPELLAKEIQTDLEIPTIGIGAGVFCDGQVRVTADLLGLSDKQPPFCKPIVDGKKYFGEKLKEWVTSERLS

SEQ ID NO: 11332 - DNA, 774 bp, Prochlorococcus marinus
  CDS (1)..(774): transl_table=11
atgttaccttcagacctcgttaaatataaagaacaatctcaaaaaattattgcacttactgcatgggactctatatcaggatctattgcagaacaagctaatgttgatctagtcttagtaggagattccttagcaatggtctgtttaggatacaaatctacattgccattaactttagaaaatataatttatcatactaatgctgtttcaagggggttcaaaaagaaaattgaagaacaacctttgttagttaccgatatgccttttctgacttaccaatgtggagaggataaagctgttgagtatgcaggaaaaataattcaaagcacttatgcaaaagctgtaaaagtagaaggggctgaaccagaaatacaaaaagttatttctagattaataagaatgggaatccctgttatgggtcatataggtcttacaccacaaagctacttaaatctaggattaaagaaacaaggagaaagcttagaaagccaagaaaaaataaagaaagatgcttctattcttgaaaaattagggtgtttttcaatagttcttgaacatatgcctgagttgcttgctaaagaaatacaaaataacttaacaattcccacaataggcatcggtgcaggtaatttttgcgatgggcaagtaagagttactgcagatttattaggccttaatgatgatcaaccaccattttgccaaccgataattcaagggaagcatttatttaaggataaattaaaagaatgggtagactctgaaagacttaactaa

SEQ ID NO: 11333 - protein, 257 aa, Prochlorococcus marinus
MLPSDLVKYKEQSQKIIALTAWDSISGSIAEQANVDLVLVGDSLAMVCLGYKSTLPLTLENIIYHTNAVSRGFKKKIEEQPLLVTDMPFLTYQCGEDKAVEYAGKIIQSTYAKAVKVEGAEPEIQKVISRLIRMGIPVMGHIGLTPQSYLNLGLKKQGESLESQEKIKKDASILEKLGCFSIVLEHMPELLAKEIQNNLTIPTIGIGAGNFCDGQVRVTADLLGLNDDQPPFCQPIIQGKHLFKDKLKEWVDSERLN

SEQ ID NO: 11334 - DNA, 771 bp, Prochlorococcus marinus
  CDS (1)..(771): transl_table=11
atgcttcctaaggaattagttcgatttaaagaacttggaaatcaaatcacaatcctcactgcttgggacagcctttcttcggcaattgttgaagctgcaggagcagatgttgttcttgtaggggactcactagcaatgttcattcatgggcataccacaacattgcctgtaactcttgaacaaatgctccatcacactcaagctgttgggagaggttttttaagtccaaaaaataagcaacctctagtagtttgtgatcttccatttctgagttatcaatgtggagaagataaagccgtagcggcagctggaaccttactgaaaaactcttgtgctgcagctgtaaaaatcgaaggagctgaacctgaagtcatttcagttattgaaaggcttattcgaatgggcatacctgtaatggggcaccttggcttaaccccacaatcagttaataatcttgggtatcatcgacaagctgaagacgcattggggcaagaaaagttagtcactcaggctctaaaaattgaacaggttggctgcttttcagtagtcttagaacatgtcccttcaaaagttgccagtaaagtaactcaaatgctcaaaatccctgtaataggaattggtgcaggagaggaatgtgatggtcaagtaagagtaaccgcagatttactaggccttacagacaaacagcctccatttgcaaaaccccttatagatggaaggtccttatttatagaatcacttacaagttgggttgatcaattgaggaattaa

SEQ ID NO: 11335 - protein, 256 aa, Prochlorococcus marinus
MLPKELVRFKELGNQITILTAWDSLSSAIVEAAGADVVLVGDSLAMFIHGHTTTLPVTLEQMLHHTQAVGRGFLSPKNKQPLVVCDLPFLSYQCGEDKAVAAAGTLLKNSCAAAVKIEGAEPEVISVIERLIRMGIPVMGHLGLTPQSVNNLGYHRQAEDALGQEKLVTQALKIEQVGCFSVVLEHVPSKVASKVTQMLKIPVIGIGAGEECDGQVRVTADLLGLTDKQPPFAKPLIDGRSLFIESLTSWVDQLRN

SEQ ID NO: 11336 - DNA, 819 bp, Prochlorococcus marinus
  CDS (1)..(819): transl_table=11
atgcgccccagcgaattaactcaactcaagcaggacgggcgagcgatcagcatcctcacagcctgggatggcataagtgcggccttggttgaggccgctggagccgatgtggttctagtaggagactccctagcgatggtggcactgtgccatgcaaccaccctgcctgtgacagtggagcagatgctccaccacaccaaagcggtggggaggggtttcactcgccctctgccacaacagcccctcgtcgtctgcgacctcccattcctgagctaccaatgcggagaagacaaggctgtagctgcagctggaagcctgctcaagcactcctgtgcagccgccgtgaagctagaaggagcagagccagaggtcctagcagtcattgagcgtctggtgcgcatggggatcccagtcatggggcatttgggcctcactccacaagcagtacatcagctcggctaccgccgtcaggcggaggaccctcgcagccaagcgcaaatgctgcaacaagcaaaacaacttgagcaagcgggctgtttcgccctggtggtcgaacatgtgccgagttccatcgctcgttgcctgagtcaacaactcaccatccccgtgatcggtatcggcgctggcgaagattgcgatggacaggtaagggtcaccgctgacctgttgggactgactcccagccaaccccccttcagtcaaccattgatccaaggtcgccagctgtgcgtagaagcccttcaaggttgggtgaagcaactgcatcagcaggcaaagactgccaccacaacaacatctccaccagaacctgattgctga

SEQ ID NO: 11337 - protein, 272 aa, Prochlorococcus marinus
MRPSELTQLKQDGRAISILTAWDGISAALVEAAGADVVLVGDSLAMVALCHATTLPVTVEQMLHHTKAVGRGFTRPLPQQPLVVCDLPFLSYQCGEDKAVAAAGSLLKHSCAAAVKLEGAEPEVLAVIERLVRMGIPVMGHLGLTPQAVHQLGYRRQAEDPRSQAQMLQQAKQLEQAGCFALVVEHVPSSIARCLSQQLTIPVIGIGAGEDCDGQVRVTADLLGLTPSQPPFSQPLIQGRQLCVEALQGWVKQLHQQAKTATTTTSPPEPDC

SEQ ID NO: 11338 - DNA, 774 bp, Prochlorococcus marinus subsp
  CDS (1)..(774): transl_table=11
atgttgccatcagaactagttaaatataaaaaaaaatctcaaaagattattgcattaactgcatgggattctatttcaggttctctagctgaacattcaggagcagatattgttctagtgggagactctttagcaatggtctgtttgggatacaaatcgaccttgcctgttacgttagagaatatgatttatcatacaaatgcagtttctagagggttcagcaaagaaatagaagaacagtcattattagtatgtgatatgccttttcttacttatcaatgcggagaaaacaaggcagtggaatatgcaggaaaaataattaagaatacttatgcaaaggcagtaaaagttgagggcgctgatccagaggtacagaatgttatttcaagactcataaggatgggaattcctgtcatgggtcatttagggcttactccacaaagctatttgaatctaggatttaaacaacaagggaacaattcagaaagtcacgaaaaaatcaaacgagatgctttatcactagaaaaattaggatgtttttctatagttttagaacatattccagaattacttgctaaagaaattcaaaccgaattagaaataccaacaataggtataggtgcaggaaaattttgtgatggacaagtaagagttactgctgatttattaggactaaatgataagcaacctccattttgtagaccaattattgatggaaaaaaaatttttggtgaaaaactaaaagaatgggtagcagccgaaaagctcaattaa

SEQ ID NO: 11339 - protein, 257 aa, Prochlorococcus marinus subsp
MLPSELVKYKKKSQKIIALTAWDSISGSLAEHSGADIVLVGDSLAMVCLGYKSTLPVTLENMIYHTNAVSRGFSKEIEEQSLLVCDMPFLTYQCGENKAVEYAGKIIKNTYAKAVKVEGADPEVQNVISRLIRMGIPVMGHLGLTPQSYLNLGFKQQGNNSESHEKIKRDALSLEKLGCFSIVLEHIPELLAKEIQTELEIPTIGIGAGKFCDGQVRVTADLLGLNDKQPPFCRPIIDGKKIFGEKLKEWVAAEKLN

SEQ ID NO: 11340 - DNA, 819 bp, Prochlorococcus marinus
  CDS (1)..(819): transl_table=11
atgcaaaccacagaattggttcgttttaaaaagttgggcaaacagataagtgtattaactgcttgggatgctatctcatcttcaatagtcgaggctgcaggagctgatgttgttctagtgggagattcacttgggatggttgtcttgggacattcaacgactcttccggtaacacttgatcaaatgcttcaccacacaaaggctgtttgtagaggtttttgtaaacctctttcaaaacaacccttagtagtttgtgatctcccttttttaagttatcaatgtggagaggacaaggctgttgaagcggctggaactctcctaaaaaactccactgcttcagcagtgaaactggaaggagcagaacctgagactttattagtaattaagagacttattagaatggggattccagtcatggggcatcttggcctaactccacagtcagttcatcaacttggatataaatcacaagctagggataaagatagtcaagaaaaaatttttaaagattcaaaaatgcttcaagaatcaggatgttttgcaatcgttttagaacatattccaggagaaattgccagcagattaaagaaacatatagatattcctgtaattggcattggagctggaaatgattgtgatgggcaggtaagagttaccgctgatattcttggcctttcaattgcgcagcctccttttgcaaaacctttacttgcaggaagagaactttgcataaatgccctaaaagaatggattaattctactgatctcgatcaagtgaatcccaccacaaaaacatctgaatcaaaatctgattgctaa

SEQ ID NO: 11341 - protein, 272 aa, Prochlorococcus marinus
MQTTELVRFKKLGKQISVLTAWDAISSSIVEAAGADVVLVGDSLGMVVLGHSTTLPVTLDQMLHHTKAVCRGFCKPLSKQPLVVCDLPFLSYQCGEDKAVEAAGTLLKNSTASAVKLEGAEPETLLVIKRLIRMGIPVMGHLGLTPQSVHQLGYKSQARDKDSQEKIFKDSKMLQESGCFAIVLEHIPGEIASRLKKHIDIPVIGIGAGNDCDGQVRVTADILGLSIAQPPFAKPLLAGRELCINALKEWINSTDLDQVNPTTKTSESKSDC

SEQ ID NO: 11342 - DNA, 801 bp, Pseudomonas syringae pv
  CDS (1)..(801): transl_table=11
atgccgaacataaccgttacgtcgctgctggccatgaagcagaagggtgagaagatcaccatgctgacctgctacgacgcaaccttcgcccacacggcctcccaggcgggtgtcgaagtgctgctgataggcgactcgctgggcatggtcctgcagggtcacgacagcaccctgcccgtcacgaccgccgaaaccgcgtaccacgttgcctgtgtcaaacgcggtaatcagggcgcgatgattctcgccgacctgccgttcatggccaacgccacgctggagcagaccttcatcaacagcgcgacgctgatgcaggcaggtgcgcacatgatcaaggtcgaaggcgctgcatggcttggcgagtcgatccgtttgctggcagaacgcggcatcccggtgtgcgcacacatgggcctgacgccgcaggcagtcaacgtactgggcggctacaaggttcagggtcgactggaagcacaggcacggcagatgcgtgccgacgcgatcgcgctggaacaggcgggcgcagcgatgatcctgctggagtgtgtgccgagcgaactcgccgaagaaatcacccaggcggtgaaaattccggtcatcggtattggcgcaggcagcgctaccgacggccaggtactggtgctgcacgacatgctgggcctgtccatcagcgggcgcgtacccaaattcgtaaaaaacttcatgaccggtcagcccgatatccagtcggctatccgggcctacgtggccgcggtcaaagacgtcagctttccggcaactgaacacggattctcggcatga

SEQ ID NO: 11343 - protein, 266 aa, Pseudomonas syringae pv
MPNITVTSLLAMKQKGEKITMLTCYDATFAHTASQAGVEVLLIGDSLGMVLQGHDSTLPVTTAETAYHVACVKRGNQGAMILADLPFMANATLEQTFINSATLMQAGAHMIKVEGAAWLGESIRLLAERGIPVCAHMGLTPQAVNVLGGYKVQGRLEAQARQMRADAIALEQAGAAMILLECVPSELAEEITQAVKIPVIGIGAGSATDGQVLVLHDMLGLSISGRVPKFVKNFMTGQPDIQSAIRAYVAAVKDVSFPATEHGFSA

SEQ ID NO: 11344 - DNA, 801 bp, Pseudomonas fluorescens
  CDS (1)..(801): transl_table=11
atgccagacattaccctgaccaccttgcagagcctcaagctcaaaggtgaaaaaatcaccatgctgacctgctatgacgccaccttcgcccacgccagctgccaggccgggattgaagtgctgctggtgggcgactccctgggcatggttcttcaagggaatgacagcaccctgcccgtcaccaccgatgaacttgcgtaccacaccgccagcgtcaagcgtggcaacgatggcgccttcatcatcgccgacctgccgttcatgggttacgcgacgcttgaacagaccttccagaatgccggcaagctgatgcaagccggtgcgcacatgatcaaagtcgaaggtgcggtgtggcttgccgagtcgatccgcctgctggctgagcgcggcgtgccggtgtgcgcgcacatgggcctgacaccacagtcggtgaacctcctcggcggctacaaggtacagggccgtaatgaggcccaggcgcgccagatgcgcgccgatgccatcgccttggaacaagccggcgcggcaatgatcctgctcgaatgcgtgccaagcgaactggcggcagaaatcacccaggccgtgaaagtgccggtgatcggtattggcgcgggttccgccaccgatggccaggtactggtgttgcacgacatgctcggcctgtcgatcaccggtcgcgtgccgaagttcgtgaaaaacttcatgaccggccaagccagcatccacgacgcattgagcgcctacgtcgctgaagtcaaaggcgtgaccttccctggcgccgaacacggattctctgcatga

SEQ ID NO: 11345 - protein, 266 aa, Pseudomonas fluorescens
MPDITLTTLQSLKLKGEKITMLTCYDATFAHASCQAGIEVLLVGDSLGMVLQGNDSTLPVTTDELAYHTASVKRGNDGAFIIADLPFMGYATLEQTFQNAGKLMQAGAHMIKVEGAVWLAESIRLLAERGVPVCAHMGLTPQSVNLLGGYKVQGRNEAQARQMRADAIALEQAGAAMILLECVPSELAAEITQAVKVPVIGIGAGSATDGQVLVLHDMLGLSITGRVPKFVKNFMTGQASIHDALSAYVAEVKGVTFPGAEHGFSA

SEQ ID NO: 11346 - DNA, 801 bp, Pseudomonas fluorescens
  CDS (1)..(801): transl_table=11
atgccagccatcaccctgaccacgctccagagcctcaagcagaaaggtgaaaagatcaccatgctgacctgctatgacgcgaccttcgcccacgcctgcaatgaggccggtgtcgaagtgctgctggtgggcgactccctcggcatggtcctgcagggtcacgacagcaccctgccggtgaccaccgcagaaatggcctaccacgttgccagcgtcaaacgcggcaactctgatgccctgatcctggccgacctgccgttcatggccaacgccaccctcgagcaaaccatgaccaacagtgccctgctgatgcaggccggcgcgcacatggtcaaggtcgaaggcgccttgtggctggcggactcgatccgcctgctggccgaacgcggcgtgccggtctgcgctcacatgggcctgaccccgcaagccgtgaacattctcggtggctataaagtgcagggtcgcaacgagaaccaggcacgccagatgcgcgccgacgcgatctccctggagcaggccggcgcggccatgctgctgctcgaatgcgtgccgagcgaactggcggctgaaatcacccaggcggtgaagattccggtgatcggcattggcgccggcagcgacaccgacggccaggtgctggtactgcacgacatgctcggcctgtcgatcagcggccgtgtgccaaaattcgtgaagaacttcatgcagggtcaggacagcatccagtccgcgctgaaggcttacgtcagtgaagtcaaagccaccactttccccgggatcgaacacggattctctgcatga

SEQ ID NO: 11347 - protein, 266 aa, Pseudomonas fluorescens
MPAITLTTLQSLKQKGEKITMLTCYDATFAHACNEAGVEVLLVGDSLGMVLQGHDSTLPVTTAEMAYHVASVKRGNSDALILADLPFMANATLEQTMTNSALLMQAGAHMVKVEGALWLADSIRLLAERGVPVCAHMGLTPQAVNILGGYKVQGRNENQARQMRADAISLEQAGAAMLLLECVPSELAAEITQAVKIPVIGIGAGSDTDGQVLVLHDMLGLSISGRVPKFVKNFMQGQDSIQSALKAYVSEVKATTFPGIEHGFSA

SEQ ID NO: 11348 - DNA, 801 bp, Pseudomonas syringae pv
  CDS (1)..(801): transl_table=11
atgccgaacataaccgttacgtcgctgctggccatgaagcacaagggtgagaaaatcaccatgctgacctgttacgacgcaaccttcgcccacacggcctgccaggcgggtgtcgaagtgctgctgataggcgactcgctgggcatggttttacaggggcacgacagcaccttgccggtcaccaccgccgagaccgcctatcacgtggcctgtgtgaaacgcggcaatcagggcgcgctgattcttgccgacctgccgttcatggccaacgccacgctggaacagaccttcatcaacagcaccacgctgatgcaggccggtgcgcacatgatcaaggtcgagggcgctgcgtggctgggcgaatcgatccgcctgctggcagagcgcgggatcccggtgtgcgcgcacatgggcctgacaccgcagtcagtcaatgtgctgggcggttacaaggttcagggccgactggaagcgcaggcgcggcagatgcgcgccgacgccatcgccctggaacaggcaggcgccgccatgatcctgctggagtgcgtgccgagcgagctggccgaagaaatcacccacgcggtaaagattccggtcatcggcattggcgcaggcagcgccaccgacggccaggtgctggtgttgcacgacatgctgggcctgtccatcaccggacgcgtacccaagttcgtgaaaaacttcatgatcggtcagcccgacattcagtcggccattcaggcctacgtcagcgccgtcaaagacgtcagttttccggctattgaacacggattctcggcatga

SEQ ID NO: 11349 - protein, 266 aa, Pseudomonas syringae pv
MPNITVTSLLAMKHKGEKITMLTCYDATFAHTACQAGVEVLLIGDSLGMVLQGHDSTLPVTTAETAYHVACVKRGNQGALILADLPFMANATLEQTFINSTTLMQAGAHMIKVEGAAWLGESIRLLAERGIPVCAHMGLTPQSVNVLGGYKVQGRLEAQARQMRADAIALEQAGAAMILLECVPSELAEEITHAVKIPVIGIGAGSATDGQVLVLHDMLGLSITGRVPKFVKNFMIGQPDIQSAIQAYVSAVKDVSFPAIEHGFSA

SEQ ID NO: 11350 - DNA, 801 bp, Pseudomonas syringae pv
  CDS (1)..(801): transl_table=11
atgccgaacataaccgttacgtcgctgctggccatgaagcagaagggtgagaagatcaccatgctgacctgctacgacgcaaccttcgcccacacggcctcccaggcgggtgtcgaagtgctgctgataggcgactcgctgggcatggtcctgcaaggtcacgacagcaccctgcctgttaccaccgctgaaacggcgtaccacgttgcctgtgtgaaacgcggcaaccagggcgcgatgattcttgccgacctgccgttcatggccaacgcaacgctggagcagaccctgatcaacagcgcaacgctgatgcaggcgggcgcccacatgatcaaggtcgaaggcgctgcctggctggccgagtcgatccgtttgctggccgagcgcggcattccggtgtgcgcgcacatgggcctgaccccacaggcagtcaacgtgctgggcggctacaaggttcagggccggctggagacgcaggcgcggcagatgcgcgccgatgccatcgcactggaacaggcgggcgcagcgatgatcctgctggagtgcgtgcccagcgaactggccgaggaaatcacccaggcggtgaaggtcccggtcatcggcattggcgcaggcagcgccactgatggtcaggtcctggtgctgcacgacatgctcggcctgtccatcaccgggcgcgtgcccaagttcgtgaaaaacttcatgaccggccagcccgatatccagtcggctatccgggcctacgtgaccgccgtcaaagacctcagctttccggccactgaacacggattctcggcatga

SEQ ID NO: 11351 - protein, 266 aa, Pseudomonas syringae pv
MPNITVTSLLAMKQKGEKITMLTCYDATFAHTASQAGVEVLLIGDSLGMVLQGHDSTLPVTTAETAYHVACVKRGNQGAMILADLPFMANATLEQTLINSATLMQAGAHMIKVEGAAWLAESIRLLAERGIPVCAHMGLTPQAVNVLGGYKVQGRLETQARQMRADAIALEQAGAAMILLECVPSELAEEITQAVKVPVIGIGAGSATDGQVLVLHDMLGLSITGRVPKFVKNFMTGQPDIQSAIRAYVTAVKDLSFPATEHGFSA

SEQ ID NO: 11352 - DNA, 849 bp, Pyrococcus abyssi
  CDS (1)..(849): transl_table=11
atgagggagataacccctagaaaaattatcgagatgaagggaaaagaaaagatagcgatgataaccgcttacgattacccatcggctcttctcgctgacaaagctgggttcgacatagtctttgttggagattccctggggatggtagtgtatggagaaccaaatactctcaacgtgagcatggagcagatggtattccacacgagagccgtagcaagggcagttaagagagccctagttctagctgacatgccctttggaagctatgaggtgagcgttgaagaaggaattaagaatgcgataaagctaatacaggctggagctgatgccgttaaaattgaaggaggctacgatcacaaaaagttagttaaaaggcttgttaggatgggcattccagttatggggcatactggattaacgcctcaacgctacttaaggcttgggggttataggattatgggttccacggaggaggaggtcgaggagataataagggatgcaaaagccctagaaaaggcgggagcctttgctgtggtcttggagttcgttcttgcagatgttgctaagctcgtgactgaagaagtctccataccgacgataggaataggctctgggccctatgtggatgggcaagttttagtttggcacgacgttctcggcctctacgaggagtcaccacccttcgttaagaggtacgcgaacttgagggatgaaatattgggggcaatctccgaattcaaaaaagatgtaaaggaaggaaaattcccaggaagggagcattactgggagttccaggataaggaagaatttaagaggataaaggagagcgttttgaggaaggttgactaa

SEQ ID NO: 11353 - protein, 282 aa, Pyrococcus abyssi
MREITPRKIIEMKGKEKIAMITAYDYPSALLADKAGFDIVFVGDSLGMVVYGEPNTLNVSMEQMVFHTRAVARAVKRALVLADMPFGSYEVSVEEGIKNAIKLIQAGADAVKIEGGYDHKKLVKRLVRMGIPVMGHTGLTPQRYLRLGGYRIMGSTEEEVEEIIRDAKALEKAGAFAVVLEFVLADVAKLVTEEVSIPTIGIGSGPYVDGQVLVWHDVLGLYEESPPFVKRYANLRDEILGAISEFKKDVKEGKFPGREHYWEFQDKEEFKRIKESVLRKVD

SEQ ID NO: 11354 - DNA, 789 bp, Pyrobaculum aerophilum
  CDS (1)..(789): transl_table=11
gtgtccgccaggaggcgggttacggattttgtaaagggaaaagggccgtatgtgtgggtcacagcttacgactacccaacagctaaaatagtagacgaggccggcgtagacggaatactagtgggcgactcgttgggaatggtggtgttgggcttgcccaatacactcggcgtaactctcgcggatatgataagacatacccaggcagtagcccgcgcgcggccaagggcgttagtagtcgcagacatgccgtttatgagttacgagaccgggcccagagacgcgctgaggaacgcgtctaaattaattaaagccggggcagacgcagttaagctggagggaggcgctgaatacgcccgtattgtagaaaagctcgtaaaagcggggataccggtaatgggccacattggccttaacccacagcgcgtcttagccctaggcggctttaaaatggtgggccggacggaggaacagaggcgtaagctactagacgacgcaaaggcgttaagagacgccggggccttctcccttgtgatagaattcgtccccgcgtctgtggcaaaagaaattacagaggccgtagacatacccactatatgcatcggcgcggggccccactgcgacgggcagatactggttctacacgatataataggccttacggagaggcctccctctttcgccaagagatatgccaacgtcgccgatgtgatacgaagcgcagttaagcagtatgtaaatgaggtgaagacgggccaattcccctctaaagaacactttaaagagtag

SEQ ID NO: 11355 - protein, 262 aa, Pyrobaculum aerophilum
MSARRRVTDFVKGKGPYVWVTAYDYPTAKIVDEAGVDGILVGDSLGMVVLGLPNTLGVTLADMIRHTQAVARARPRALVVADMPFMSYETGPRDALRNASKLIKAGADAVKLEGGAEYARIVEKLVKAGIPVMGHIGLNPQRVLALGGFKMVGRTEEQRRKLLDDAKALRDAGAFSLVIEFVPASVAKEITEAVDIPTICIGAGPHCDGQILVLHDIIGLTERPPSFAKRYANVADVIRSAVKQYVNEVKTGQFPSKEHFKE

SEQ ID NO: 11356 - DNA, 852 bp, Pyrococcus furiosus
  CDS (1)..(852): transl_table=11
atgagagaaatcacccccaagagaattatggaaatgaagggaaaagaaaagatcactatgataacagcctatgattatccctcagcacttcttgcagataaggcaggttttgacatagtctttgtcggtgactcccttggaatggttgtctatggagagcaaaacaccctcaacgttacaatggatcagatgattttccatactagggcagttgccaaagccgtgaagagggcattggttttggcagacatgcccttcggcagctatgaagtttctgttgaagagggagtgaagaacgccataaagctaattcaggccggagcagatgcagttaagatagaggggggctatgaccatagaaaacttgtcaaaaagctggtaaggatgggaatcccagttatgggccacacagggcttactccccagagatacctaaggctcggtggttacagaataatgggagagaatgaagaggaagttgaggaaatattgagggatgcaaaagctttggaaaaagctggggcctttgccgtcgttctggaatttgtcctagccgacgtggcaaagctagttactgaagaggtctcaatccccaccataggaattggctctggaccctacgttgatggccaagttttggtttggcacgatgttttggggctatatgaaagttcaccccccttcgccaagaggtatgcgaaccttagagaagaaatactgagggcaatatcggagtttagaaaagaggttaaagaaggaaaattcccaggaaaggagcactactgggaataccaagataaagaaacatttaataggattaaagagaacgtcatgagaaagcttaggctttag

SEQ ID NO: 11357 - protein, 283 aa, Pyrococcus furiosus
MREITPKRIMEMKGKEKITMITAYDYPSALLADKAGFDIVFVGDSLGMVVYGEQNTLNVTMDQMIFHTRAVAKAVKRALVLADMPFGSYEVSVEEGVKNAIKLIQAGADAVKIEGGYDHRKLVKKLVRMGIPVMGHTGLTPQRYLRLGGYRIMGENEEEVEEILRDAKALEKAGAFAVVLEFVLADVAKLVTEEVSIPTIGIGSGPYVDGQVLVWHDVLGLYESSPPFAKRYANLREEILRAISEFRKEVKEGKFPGKEHYWEYQDKETFNRIKENVMRKLRL

SEQ ID NO: 11358 - DNA, 852 bp, Pyrococcus horikoshii
  CDS (1)..(852): transl_table=11
atgagagagatcactccaaaaagaataagggagatgaagggaaaggaaaagataaccatgataacagcttacgattatccttcagcgttactagcggataaggccgggttcgatatagttttcattggtgactcccttggtatggttgtttatggagaaccaagtacccttaacgtcacgatggagcagatgattttccatactagggccgttgctaaagccgtgaagagggccctagttttggccgatatgccctttggcagttacgaagttagcgttgaggagggaattaagaacgccataaagctagttcaagctggggccgatgccgttaagattgaaggtggctacgatcatagaaagctcgttaaaaaactcgttaggatcggaattccagttatgggacatacgggattaactccccagaggtacctaaggcttggaggttatagaataatggggggaactgaggaggaggttgaggagatactcagggatgcaaaagctttggaaaaagctggggcatttgccattgttttggagtttgtcttagcggatgttgctaaactagtgacggaggaagtatcgattccaacgataggaataggatcaggaccctatgtggatggacaagtcctagtttggcacgatgtcttgggtttatatgagagttctccaccttttgccaagagatatgctaacctgaaggaagagatattaagggccatctcaaccttcagggaagaggttaaggaggggaaattcccaggaagagagcattactgggagtttcaagataaggaagagttcaaaaggattaaagacaatgtcatgaaaaagctcaatctctag

SEQ ID NO: 11359 - protein, 283 aa, Pyrococcus horikoshii
MREITPKRIREMKGKEKITMITAYDYPSALLADKAGFDIVFIGDSLGMVVYGEPSTLNVTMEQMIFHTRAVAKAVKRALVLADMPFGSYEVSVEEGIKNAIKLVQAGADAVKIEGGYDHRKLVKKLVRIGIPVMGHTGLTPQRYLRLGGYRIMGGTEEEVEEILRDAKALEKAGAFAIVLEFVLADVAKLVTEEVSIPTIGIGSGPYVDGQVLVWHDVLGLYESSPPFAKRYANLKEEILRAISTFREEVKEGKFPGREHYWEFQDKEEFKRIKDNVMKKLNL

SEQ ID NO: 11360 - DNA, 855 bp, Pyrococcus kodakaraensis
  CDS (1)..(855): transl_table=11
atgagggagataacgccgaggaagataatcgagatgaaggggaaggaaaagatagcgatggtaacggcttacgattatccctccgctcttctcgccgacaaggctggcatggacatagtcttcgtcggagactcgctcgggatggttgtctacggcgagcctaacactctcaacgtcagcatggaacagatggtcttccacacgcgggcagttgccaaggccgtaaagagggctctagttctcgcggacatgcccttcggaagctacgaggtcagcgtcgaagaaggcgttaagaacgcgatgaggctaattcgggctggagctgatgcggtaaagatagaaggcggctacgatcacaaaaagctcgttaaaaagctcgtccgcatgggaatcccagtcatgggccatacggggcttactccacagcgctacctccgccttgggggctacagactgatgggtgagactgaggaagagatcgaggagattctgcgcgatgccaaggcccttgaaaaggccggcgccttcgctgtggttcttgagttcgttcttgcagatgtggcaaagctcgtgacggaggaggtttcaatcccgaccataggcatcggggcggggcctcacgttgacggccaggtcttggtgtggcacgacctcctcggaatctacgagaacgttcccccatttgtcaagaagtatgccgatttagccagcataattcagctcgccctcgagaactaccgcggggaagtcaaagagggtagattcccggctaaagagcactactgggagttcctcgacaaggacgacttcgagagaaagaagatgaaggcccttgaacgcctggaggacgaatga

SEQ ID NO: 11361 - protein, 284 aa, Pyrococcus kodakaraensis
MREITPRKIIEMKGKEKIAMVTAYDYPSALLADKAGMDIVFVGDSLGMVVYGEPNTLNVSMEQMVFHTRAVAKAVKRALVLADMPFGSYEVSVEEGVKNAMRLIRAGADAVKIEGGYDHKKLVKKLVRMGIPVMGHTGLTPQRYLRLGGYRLMGETEEEIEEILRDAKALEKAGAFAVVLEFVLADVAKLVTEEVSIPTIGIGAGPHVDGQVLVWHDLLGIYENVPPFVKKYADLASIIQLALENYRGEVKEGRFPAKEHYWEFLDKDDFERKKMKALERLEDE

SEQ ID NO: 11362 - DNA, 822 bp, Ralstonia eutropha
  CDS (1)..(822): transl_table=11
atgagctacctcctcgatccctcccgcaagaccgtcaccatcacccggctgcaggccatgcgcgacgccggtgaaaagatcgcgatgctgaccgcttacgactccagcttcgccgcgttgctcgactactgcggcgtggaagtcatcctggtcggtgattcgctcggcaacgtgatgcaaggccagcaaaccacgctgcccgtgacgctggagcacatggcttaccacaccgaatgcgtggcacgcgccaaccagacggcgctgctggtaaccgacctgcccttcggcacctacggcacgccggaaatggcatttgcaagcgcggtcacgctgatgcgtgcgggcgcgcacatggtcaagctcgaaggcggcgactggctggccccgaccgtgaagttcctggtcgagcgcagcatcccggtgtgcgcccatatcggcctgaccccgcagtcggtgcatgcgttcggcggcttcaaggtgcagggcaagaccgatgaaggcgcagcccaactgcggcgcgacgctcaggcaatggaggctgccggcgcacagatcgtgctgatggaggcggtgccggccacgctcgccggcgagatcacgcagatgctcaaggtgccgaccatcggcatcggtgccggcgcggactgctcgggccaggtgctggtgctgcaggacatgatcaacgtctacccgggacgcaaggccaagttcgtgcgcaacttcatggacggccagacgacgatcgaaggtgcgatccgcgcctatgtggccgccgtgaaggatggcagcttcccggcagcagagcacaccttctccgcctga

SEQ ID NO: 11363 - protein, 273 aa, Ralstonia eutropha
MSYLLDPSRKTVTITRLQAMRDAGEKIAMLTAYDSSFAALLDYCGVEVILVGDSLGNVMQGQQTTLPVTLEHMAYHTECVARANQTALLVTDLPFGTYGTPEMAFASAVTLMRAGAHMVKLEGGDWLAPTVKFLVERSIPVCAHIGLTPQSVHAFGGFKVQGKTDEGAAQLRRDAQAMEAAGAQIVLMEAVPATLAGEITQMLKVPTIGIGAGADCSGQVLVLQDMINVYPGRKAKFVRNFMDGQTTIEGAIRAYVAAVKDGSFPAAEHTFSA

SEQ ID NO: 11364 - DNA, 822 bp, Ralstonia metallidurans
  CDS (1)..(822): transl_table=11
atgagttacctcctcgatccctcccgcaagaccgtcaccatccccaaactgcaggccatgcgtgaagccggcgaaaagatcgccatgctcaccgcctacgattccagcttctccgcgctgctcgatctctgcggcgtggaagtgatcctggtcggcgattcgctcggcaacgtgatgcagggccagcagaccacgctgcccgtcacgctcgagcacatggtctatcacaccgaatgcgtgtcgcgcggcaaccagaccgcgctgctcgtatccgacctgccgttcggcacgtatcccacccccgagaaggccttcgaaagcgccgccgcgctgatgcgtgctggcgcgcagatggtcaagctcgaaggcggagactggctggcgccgacggtgaagttcctggtcgagcgcagcattccggtatgcgcgcatatcgggctgacaccgcaatcggtacacgcgctcggcggcttcaaggtgcagggcaagaccgacgagagcgccgcgcagctgaagcgtgacgcgctggcgctgcagcaagccggcgcgcagctgatcgtcatggaggccgtgccggccaagctcgccgccgaagtgacggcgcaactctccatcccgaccatcggtatcggcgctggtgtcgattgctcgggccaggtgctggtgctgcaggacatgatcaacatctacccgggccgcaaggccaagttcgtacgcaacttcatggagggacagccctcgatcgaagcggcgatccgcgcctatgtggctgctgtgaaggacggcagcttcccggccgtcgagcacacgttctcggcctga

SEQ ID NO: 11365 - protein, 273 aa, Ralstonia metallidurans
MSYLLDPSRKTVTIPKLQAMREAGEKIAMLTAYDSSFSALLDLCGVEVILVGDSLGNVMQGQQTTLPVTLEHMVYHTECVSRGNQTALLVSDLPFGTYPTPEKAFESAAALMRAGAQMVKLEGGDWLAPTVKFLVERSIPVCAHIGLTPQSVHALGGFKVQGKTDESAAQLKRDALALQQAGAQLIVMEAVPAKLAAEVTAQLSIPTIGIGAGVDCSGQVLVLQDMINIYPGRKAKFVRNFMEGQPSIEAAIRAYVAAVKDGSFPAVEHTFSA

SEQ ID NO: 11366 - DNA, 825 bp, Ralstonia solanacearum
  CDS (1)..(825): transl_table=11
atgagcagctatctccaggaatccacccgcaaggccgtgaccgtcacctcgctgcagggcatgcgcgcggcgggcgagcgcatcgccatgctgacggcctacgatgccagcttcgccgccctgatggagcgcagcggcgtggacgtggtgctggtcggcgattcgctgggcaacgtggtgcagggccagaagaccacgctgcccgtcacgctcgaccacatcgtctaccacaccgaatgcgtggcgcgcggcacgaccaaggcgctgctcatgtcggatctgcccttcggcacctacggcacgcccgagcaagccttccacagcgccgtgcgcgtgatgcaggccggcgcgcagatggtcaagctcgaaggcggcgagtggctggcgcccaccctccgtttcctggtcgaacgcagcattccggtgtgcgcgcacatcggcctgacgccgcaatcggtgcatgccttcggcggcttcaaggtccagggccggggcgacgaggccgccgcgcagctcaaggccgatgcgctggccgtgcaggacgccggcgcgcagatggtcctcatggaagccattcccgccacgctggccggcgaggtgacgcgcctgctggcggtccccaccatcggcatcggcgccgggcccgagtgctcgggccaggtgctggtgatgcacgacatgctgggcgtgttccccggccaccggcccaagttcgtgcgcaacttcatggacggcctgaccaccatcgacgccgccgtcacggcctatgtgacggcggtcaaggacggcaccttccccggcccggagcacagcttcaccgcctga

SEQ ID NO: 11367 - protein, 274 aa, Ralstonia solanacearum
MSSYLQESTRKAVTVTSLQGMRAAGERIAMLTAYDASFAALMERSGVDVVLVGDSLGNVVQGQKTTLPVTLDHIVYHTECVARGTTKALLMSDLPFGTYGTPEQAFHSAVRVMQAGAQMVKLEGGEWLAPTLRFLVERSIPVCAHIGLTPQSVHAFGGFKVQGRGDEAAAQLKADALAVQDAGAQMVLMEAIPATLAGEVTRLLAVPTIGIGAGPECSGQVLVMHDMLGVFPGHRPKFVRNFMDGLTTIDAAVTAYVTAVKDGTFPGPEHSFTA

SEQ ID NO: 11368 - DNA, 822 bp, Rhizobium leguminosarum bv
  CDS (1)..(822): transl_table=11
atgagcgcggccggaattcagaagcgcattacgccagcgcgcatctcagccatgaagggcggcaagccgatcgtctgcctgaccgcctatacgacgccgatggcgcggctgctcgatgagcattgcgacctcctgctggtcggggattcgctcggcatggtgctctacggtatggagaccaccatcggcgtcacgctcgatatgatgatcgcacacggcaaggcggtgatgcgcggcgtcggtaaggcctgcgtcgtcgtcgacatgccgttcggcagttatcaggaatcgaaggagattgccttccgcaatgctgtccgcatcctgcaggaaaccggctgcgatgccgtaaagctggagggcggcgaggagatggccgagaccatcgcctttctgacgaagcgggggattccggttatgggccatatcggcctgatgccgcagcaggtccaaaccgcaggcggttatcgatctgtcggccattccgaacacgagacgtcgaagatccgccgcgatgcccacgccgttggcggctcgggcgcctttgccgtcgtcatcgagggcacggtggagccgctcgcccgggaggtgacgtccgccgtgcacgtcccgaccatcggcatcggcgcttcttccgcctgcgacggtcaggttctggtttccgacgacattctgggcctcttcaacgatttcaccccgcgcttcgtgaagcgctacgacgaactcggcaagaggatttcagccgccgctgccgcttatgccgacgaggtccgatcgcgacagtttccggcagcggagcatacgttcaaacggcgatcttga

SEQ ID NO: 11369 - protein, 273 aa, Rhizobium leguminosarum bv
MSAAGIQKRITPARISAMKGGKPIVCLTAYTTPMARLLDEHCDLLLVGDSLGMVLYGMETTIGVTLDMMIAHGKAVMRGVGKACVVVDMPFGSYQESKEIAFRNAVRILQETGCDAVKLEGGEEMAETIAFLTKRGIPVMGHIGLMPQQVQTAGGYRSVGHSEHETSKIRRDAHAVGGSGAFAVVIEGTVEPLAREVTSAVHVPTIGIGASSACDGQVLVSDDILGLFNDFTPRFVKRYDELGKRISAAAAAYADEVRSRQFPAAEHTFKRRS

SEQ ID NO: 11370 - DNA, 861 bp, Rhizobium loti
  CDS (1)..(861): transl_table=11
ttggccacgaaactgccgaccaccgacattcgcatcggcgcggagctgattcgccgccgtaagggcggcgtcccgttggtctgcctgaccgcctacacctatcccgtcgcccgcctgctcgacccgcatgtcgacctgcttctggtcggcgacagcgtctccatggtcctgcatggccatgcgacgacgctcggcgcctcgctggggatgatgatcgcgcatgggcaagcggtgatgcgcggctcggccagggcctgcgtggtcgtcgatatgccggccggcagctacgaggattcggcggcgcaggctgtggcctcagcgcggcgcatcgttgacgagaccggctgccaggcggtgaagcttgaaggcggcgtcgacatggccgggcagattgcggcaatcgccgccgccggcattccggtcatgggtcatatcggcctgctgccgcaatcggtggaaaaggacggcggctacaagatcaagggccgcacggatgagactgtcgcggcgctgatggcggacgcgcgcgccgtcgaaaaggccggcgcgttctccgtggtcatcgagggcaccatcgaggcggtcgccgccgacatcacacgccgcatcgccattccaaccatcggcatcggtgccagcggcgactgcgatggccagattctggtcatcgacgacatggtcgggctaaccgtcgatcgcgtgccgaaattcgtcaaggaatatgccgacctgcgcagcgtgatcgcgaacgccgccgagcgctacgcagcggaggtgcgagaccggactttccccggccctagccatgtcttttcgggttcaaaagcctcttcggacttaaacggcggggatgaatcatga

SEQ ID NO: 11371 - protein, 286 aa, Rhizobium loti
MATKLPTTDIRIGAELIRRRKGGVPLVCLTAYTYPVARLLDPHVDLLLVGDSVSMVLHGHATTLGASLGMMIAHGQAVMRGSARACVVVDMPAGSYEDSAAQAVASARRIVDETGCQAVKLEGGVDMAGQIAAIAAAGIPVMGHIGLLPQSVEKDGGYKIKGRTDETVAALMADARAVEKAGAFSVVIEGTIEAVAADITRRIAIPTIGIGASGDCDGQILVIDDMVGLTVDRVPKFVKEYADLRSVIANAAERYAAEVRDRTFPGPSHVFSGSKASSDLNGGDES

SEQ ID NO: 11372 - DNA, 822 bp, Rhizobium meliloti
  CDS (1)..(822): transl_table=11
atgagcgtccagaccacgaaacggcggctcagccccgccagcatcgaagccctgaagggtgagcgcccgatcgtcagcctgacggcctatacgacgccgatcgcacggcttctcgatcctcacgtggatttcctccttgtcggcgattcgctcggcatggtgctctacggcctcgatacgaccgtcggcgtcacgctcgacatgatgattgcgcatggccaggcggtcatgcgcggttcggagcgctgttgcgtcgtcgtcgatcttcctttcggcgcctatcaggaatccaaggagcaggccttccgcagtgccgcgcgcattctgaaggaaacgggctgcagcgcagtgaagctcgagggcggtgccgagatggccgagacggtcgaattccttgtcagccgtggcattccggtgctcggccatgtgggcttgatgccgcagctcgtcaacacgacggggggctaccgctcggtcgggcgcaacgagaaggaggtggccaagatccgccgcgacgccaaggcgatcgacgatgccggcgctttcgccatcgtggtcgagggaacggtggagccggtcgcccgagagatcactgccacgctgcgcgcgccgaccatcggcatcggtgcttcgccggcctgcgacggccagatactggtatcggacgacatgctcggtcttttcaacgatttcaagccgcgcttcgtcaagcatttcgccgagttggcaccgacgatctcaaaggcggcggaggcctatgccaatgaggtgaaggcgcgcagctttccgggcatagagcacacgtttcaagtaaagcgctga

SEQ ID NO: 11373 - protein, 273 aa, Rhizobium meliloti
MSVQTTKRRLSPASIEALKGERPIVSLTAYTTPIARLLDPHVDFLLVGDSLGMVLYGLDTTVGVTLDMMIAHGQAVMRGSERCCVVVDLPFGAYQESKEQAFRSAARILKETGCSAVKLEGGAEMAETVEFLVSRGIPVLGHVGLMPQLVNTTGGYRSVGRNEKEVAKIRRDAKAIDDAGAFAIVVEGTVEPVAREITATLRAPTIGIGASPACDGQILVSDDMLGLFNDFKPRFVKHFAELAPTISKAAEAYANEVKARSFPGIEHTFQVKR

SEQ ID NO: 11374 - DNA, 810 bp, Rhodopirellula baltica
  CDS (1)..(810): transl_table=11
atgacggaatcggaaaagaggaaatcgcgaatcacgactcgaacgctgcagcgcatgcgtgaccggggtgaacggatcacgatgctgaccgcctacgattttcccaccgcaaaaattttggatgaagccggtgttgatgttttgctggtcggtgacaccgtgggaatggtcgtgcaggggcactcgacgacccttccggtgacgatggatcaaatgatctaccacgccgaaatggtggggcgagccgcggaccacgcgatggtggtggtcgatctaccgttcccggatggtcagctcgatttgcttcacagtgtccgctgtggggctcgcgtgctgaaggaaacccagtgccatgcggtcaagttggaaggcggtgctgagcaagccgaacggatcgaagcgatggtgggggccggcattccggtgatggcccacattgggctgcgcccacagaatattcatgtggaaggcggctatcgcctgcagcgtgatatcgagcgattggtggcggacgcgaaggccgctgaagctgcgggggcgttcacagttcttattgaatgcgttcccagcgaagccgccgctgcgatcacggatgcggtgaaggttccaacgatcggcattggtgccggccgagatgtgtccggacaagttttggtgacccacgacatcctcgggctgacatcaggttacaccccaaagttcacccggttgtttgccgatgttggcaataccatccgagaggcggccaagtcgtattgtgatgaagtgaaggcagccagttttccgagcgatgccgaatcgtttgagtga

SEQ ID NO: 11375 - protein, 269 aa, Rhodopirellula baltica
MTESEKRKSRITTRTLQRMRDRGERITMLTAYDFPTAKILDEAGVDVLLVGDTVGMVVQGHSTTLPVTMDQMIYHAEMVGRAADHAMVVVDLPFPDGQLDLLHSVRCGARVLKETQCHAVKLEGGAEQAERIEAMVGAGIPVMAHIGLRPQNIHVEGGYRLQRDIERLVADAKAAEAAGAFTVLIECVPSEAAAAITDAVKVPTIGIGAGRDVSGQVLVTHDILGLTSGYTPKFTRLFADVGNTIREAAKSYCDEVKAASFPSDAESFE

SEQ ID NO: 11376 - DNA, 825 bp, Rhodopseudomonas palustris
  CDS (1)..(825): transl_table=11
atgtctgttcaatcgaccattcggcggaagaccgctcccgacatccgcgcgcgcaagggcggcgatccgatcgtgatgctgacgtcgtatcacgctcacactgcctcgctggtcgatcgttattgcgacgccattctggtcggggactcgctcggcaacgtgatgcacggcttcgagaccaccgtgccggtgacgctcgagatgatgatcctgcagggtcacgcggtgatgcgcggctcgcagcatgcgctcgtcgtggtcgacatgcctttcggttcgtatgaagcctcgaaggagcaggcctttcactccgccgcacgcatcctcaaggagacgcattgcggcgcggtgaagctcgaaggcggtgtgcggatggccgagaccatcgcgttcctcaccgagcgcggcattccggtgatgggtcacatcggtctcacgccgcagtcgatcaacacgctgggctcgttccgcgcgcagggccgcgaggagggcagctgggaaccgatcgaggccgacgcgcgtgcggttgccgacgccggcgcgttctcggtcgtggtggaagccgtcgccgagccactcggccgcaagatcaccgagatgatttcgatcccgaccatcggcatcggcgccagcgccgcctgcgatggtcaggtgctggtgctcgaagacatgctcggcctgtcgccgaagccgccgaaattcgtcaagcgctatggcgatctcggccccggcatcgaagcggcgatcaagggctatgccgaggaggtccgttcgcgggctttccctgggcccgagcacgtttacggaatgaaatcgaaggcgtga

SEQ ID NO: 11377 - protein, 274 aa, Rhodopseudomonas palustris
MSVQSTIRRKTAPDIRARKGGDPIVMLTSYHAHTASLVDRYCDAILVGDSLGNVMHGFETTVPVTLEMMILQGHAVMRGSQHALVVVDMPFGSYEASKEQAFHSAARILKETHCGAVKLEGGVRMAETIAFLTERGIPVMGHIGLTPQSINTLGSFRAQGREEGSWEPIEADARAVADAGAFSVVVEAVAEPLGRKITEMISIPTIGIGASAACDGQVLVLEDMLGLSPKPPKFVKRYGDLGPGIEAAIKGYAEEVRSRAFPGPEHVYGMKSKA

SEQ ID NO: 11378 - DNA, 837 bp, Rhodospirillum rubrum
  CDS (1)..(837): transl_table=11
atgagtgtcgtccagcctgccggccgacgtctgaccgttcgcgacatcgccagtcgcaaatcccccgccgccgagccggtggtctgccttaccgcctatacggcgccgatggcccgtctgctcgacccccatgtcgacctgctgctggttggcgattcccttggcatggtcatctatggcttgccgaccacccatggcgtgaccgtcgagatgatgatcgcccatggtcaggccgtggtgcggggctcgtcccatgccctggtggtggtcgatatgccctttggtagctatcaggaaagcccggcccaggccttccgcaacgccgcgcgcatcctcagcgagaccggcgccgccgccgtcaagcttgaaggcggccgcgagatggccgaaaccgtcgccttcctggtgcagcgcggcgtgccggtgatgggccatgtcggtctcaagccgcagatggtccatgcgatgggcgggttccgcgcccagggccgcgacgaggccgaggccgaggcggtggtcgccgaaacccgggccatcgccgaggccggggccttctcgatcgtcgtcgaaggcacctttgagcaggtggcggcgcgggcgactcgcgaggtttccgtgccgacgatcggcatcggcgcctcggccgattgcgatggccaggttctggtgatcgacgacgcgctcggtttgttcaccgatttcacccccaaattcgtcaagcgctatgccgatctggcgagcacggtttcggcggccgccgaagcctatgccgccgatgtcagggcccggcgctttcccgcccccgagcattgctttggcatccgcaaggtcggctga

SEQ ID NO: 11379 - protein, 278 aa, Rhodospirillum rubrum
MSVVQPAGRRLTVRDIASRKSPAAEPVVCLTAYTAPMARLLDPHVDLLLVGDSLGMVIYGLPTTHGVTVEMMIAHGQAVVRGSSHALVVVDMPFGSYQESPAQAFRNAARILSETGAAAVKLEGGREMAETVAFLVQRGVPVMGHVGLKPQMVHAMGGFRAQGRDEAEAEAVVAETRAIAEAGAFSIVVEGTFEQVAARATREVSVPTIGIGASADCDGQVLVIDDALGLFTDFTPKFVKRYADLASTVSAAAEAYAADVRARRFPAPEHCFGIRKVG

SEQ ID NO: 11380 - DNA, 870 bp, Rhodococcus sp
  CDS (1)..(870): transl_table=11
atgtccgatagcaagtcgtccgcgagcacgtcagaagatcggctctacggatcagcaccatcgcacgacgttcccaagcgcaagacccgaacccaccacctgcaggccatgaaggccgagggtgaacgctgggcgatgctcaccgcctacgactactccagcgcccgcatcttcgaggaagctgggattcccgttctcctcgtcggcgattcggccgccaacgtcgtctacggatacgagaccaccgtcccggtcacgatcgacgaactcctccccctcgttcgcggcgtcgtccgcggtgcgccgcacgctctcgtggtggcggacctccccttcggcagctacgaaagctcccccgaacaggccctcgcgtccgcgacccggttcatgaaggaggggctggcccacgcggtcaagctcgagggcggcgagcgcgtcgcgccgcagatcgccgccatcaccgcggcaggcatccccgtcatggcccacgtcgggttcaccccgcagagcgtgaactcgctcggcggtttccgcgtgcagggccgcggcgacgccgccgagcagttggtcgccgacgcgatcgccgtgcaggaggccggcgcgttctccgtcgtcatggagatggtgcccgccgagatcgcaggccaggtcacccgcaagctcaccatccccaccgtgggcatcggagcgggcgtcgagtgtgacgcccaggtcctcgtgtggcaggacatggccggctacaccagcggcaagacggcgaagttcgtcaagcgcttcggtaacgtcggggacgagctgcgcagcgcggccgccgcatacgcgaccgaggtacgcgccggaacgttcccggcggaagagcacagcttctag

SEQ ID NO: 11381 - protein, 289 aa, Rhodococcus sp
MSDSKSSASTSEDRLYGSAPSHDVPKRKTRTHHLQAMKAEGERWAMLTAYDYSSARIFEEAGIPVLLVGDSAANVVYGYETTVPVTIDELLPLVRGVVRGAPHALVVADLPFGSYESSPEQALASATRFMKEGLAHAVKLEGGERVAPQIAAITAAGIPVMAHVGFTPQSVNSLGGFRVQGRGDAAEQLVADAIAVQEAGAFSVVMEMVPAEIAGQVTRKLTIPTVGIGAGVECDAQVLVWQDMAGYTSGKTAKFVKRFGNVGDELRSAAAAYATEVRAGTFPAEEHSF

SEQ ID NO: 11382 - DNA, 813 bp, Saccharophagus degradans
  CDS (1)..(813): transl_table=11
atggtgtacacagctactccactcgagaaaaaagtcaccgtcaacacgctgcgcaaaatgaaagcggacaaagaaaaattcatcaccgttgcgctatacgatgcgccaatggcagccatggcacaaaagtgcggcgtagaagttgtactaattggcgatagcctaggtatgacggtactaggttacgacagcaccgtgcccgtcaccatggaacaaatgatctaccacatagaagcggtagcacgtggtaacagccgctcacttattattggcgacctgccatttatgacctatgccacggtagagcaaaccatgattaacgccacccgcgtcatgcaggcgggcgcgcatatggtaaaaatggaaggcggcgcttggctggtcgattcggtacgtatgctgtccgagcgcggcattcccgtttgcgcccaccttggccttaccccgcaatcggtaaataaatttggcggcttccgcgtgcaggggcgctccgaagagcaaggcgaacaaataatcgccgatgccctcgcgctagaagaagcgggtgcagacttactggtattggaatgtatacctgcggaactgggtgcaagagtgactcaagcgcttagcatccccaccataggtattggcgctggtattggcacagacgcacaggtactggtaatcaacgatattcttgggcttaccgagttcccgcccaaattttctaaaaacttcctactagaagccaaagatatacccggcgcactgcaaaagtacgcagcagacgttaaatccggtgtattccctggcccagagcagcagttttaa

SEQ ID NO: 11383 - protein, 270 aa, Saccharophagus degradans
MVYTATPLEKKVTVNTLRKMKADKEKFITVALYDAPMAAMAQKCGVEVVLIGDSLGMTVLGYDSTVPVTMEQMIYHIEAVARGNSRSLIIGDLPFMTYATVEQTMINATRVMQAGAHMVKMEGGAWLVDSVRMLSERGIPVCAHLGLTPQSVNKFGGFRVQGRSEEQGEQIIADALALEEAGADLLVLECIPAELGARVTQALSIPTIGIGAGIGTDAQVLVINDILGLTEFPPKFSKNFLLEAKDIPGALQKYAADVKSGVFPGPEQQF

SEQ ID NO: 11384 - DNA, 795 bp, Salmonella typhi
  CDS (1)..(795): transl_table=11
atgagcaaacccactactatcgctgtgctgcagaaatgcaaacaagagaaaaagcgcttcgccaccattaccgcgtacgattacagcttcgccaaactcttcgccgatgaaggcatcaatgtgatgctggttggcgactcgctgggcatgacaattcaggggcacgactccaccctgcctgtcaccgtggaagatatcgcctaccacacccgcgcggtacgccgcggcgcgccgaactgcctgctgctctccgacctgccgtttatggcttacgccacgccggaacaggcgtttgaaaacgcggctatcgtgatgcgtgcgggggccaacatggtcaaaatcgaaggcggcgcatggttggttgatacggtgaaaatgctcaccgaacgcgccgtgccggtgtgtggccatctgggattaactccccagtcggtgaatatcttcggcggctataaaattcagggccgcggcgatgccgggcagatactgctggatgatgcgctggccttagaagcagcgggcgctcaactgctggtgctggagtgcgtgccggttgaactggcgaagcgcgtcacggaagcgctgtcgattccggtgatcggcatcggcgcgggcaacgtcaccgacggtcagatcctggtgatgcacgatgcgtttggcatcaccggcggtcatattccaaaattcgcgaaaaatttccttgccgaggcgggcgacatgcgcgccgccgtacggcagtatatggcagaagtggagtccggcgtttatccgggcgaagaacacagctttcactaa

SEQ ID NO: 11385 - protein, 264 aa, Salmonella typhi
MSKPTTIAVLQKCKQEKKRFATITAYDYSFAKLFADEGINVMLVGDSLGMTIQGHDSTLPVTVEDIAYHTRAVRRGAPNCLLLSDLPFMAYATPEQAFENAAIVMRAGANMVKIEGGAWLVDTVKMLTERAVPVCGHLGLTPQSVNIFGGYKIQGRGDAGQILLDDALALEAAGAQLLVLECVPVELAKRVTEALSIPVIGIGAGNVTDGQILVMHDAFGITGGHIPKFAKNFLAEAGDMRAAVRQYMAEVESGVYPGEEHSFH

SEQ ID NO: 11386 - DNA, 804 bp, Schizosaccharomyces pombe
  CDS (1)..(804)
atgtcattaaagcaaataactatatccactcttcgtcaatggaaactagcaaataaaaaattcgcttgtattacagcatatgatgccagtttttcacgacttttcgcagaacaggggatgcctgtaatgctcgtcggtgactcccttggaatgactgctcaaggtcatagtactacattaccagtgtcagtagaagacatagcatatcatacaaaaagtgttcgaagaggtgcccctaatcgcctcttgatggctgaccttccatttatgagttacagtacatgggaggatgcttgtaaaaatgcggctactgtaatgcgtgcaggtgcaaatatagttaaaatagaaggaggagggaattggatttttgaaattgtacaaagacttacagaacgatcagtccctgttgctggacaccttggcctgactcctcagtctgtaaacatttttggaggttataaaatacagggtagggaacagtctgcagcagcacgcttaattgaaaatgcacaacagttggaaaagtttggtgcgcagctgctcgtcttagaatgtattccagagtcactagctgaacaaatcactaaaactatatccatacccactatcgggataggagccggaaagcatactgatggccaaatacttgtcatgcatgatgctttaggaattactggaggccgcccacccaaatttgctaagaattttttgtccggggctggggacattcgcacggctatccaacgttacatctacgaagtagaacaaggtctataccctgctgaagaacacagtttccaataa

SEQ ID NO: 11387 - protein, 267 aa, Schizosaccharomyces pombe
MSLKQITISTLRQWKLANKKFACITAYDASFSRLFAEQGMPVMLVGDSLGMTAQGHSTTLPVSVEDIAYHTKSVRRGAPNRLLMADLPFMSYSTWEDACKNAATVMRAGANIVKIEGGGNWIFEIVQRLTERSVPVAGHLGLTPQSVNIFGGYKIQGREQSAAARLIENAQQLEKFGAQLLVLECIPESLAEQITKTISIPTIGIGAGKHTDGQILVMHDALGITGGRPPKFAKNFLSGAGDIRTAIQRYIYEVEQGLYPAEEHSFQ

SEQ ID NO: 11388 - DNA, 795 bp, Shewanella oneidensis
  CDS (1)..(795): transl_table=11
atgtctaaagttactagctcaaccctgttgaaatacaaacaggaaggtagaaaattcaccgctctgacagcctatgatgccagctttgccagcgcgttcgacggcgaaggcatcgatgtgctactggtcggcgattctttgggaatggttctccaaggccacgatgataccctgcccgtcaccaccgccgatattgcctatcacacccgttgcgtgcgtcgcggtattgagcgctcactgctgatcgctgatatgccatttatgagttatgccacgccagaacaggcaatggaaaatgccaccacgctcatgcaagcgggtgccaatatggtcaaacttgaaggtggccactggttattggaaacagtcaccaaattgactgaacgtggcattcctgtttgtgctcacttgggcctaacaccacaatcagtaaacgtttttggtggttttaaagtgcagggccgcgacgctgaaaatgcccagcgcattatcgatgaagctaaagcgttagaagcggcaggcgcgcagttattagtggttgaatgtattcccgcatcacttgccaccgcaattactcaagccttaactattcccgttatcggcattggtgcaggcgctaccaccgacggccaaattctggtcatgcacgatgtattaggtatctccagtggttatattccacgtttttcgaaaaactacctaaaacaaactggcgagatccgttctgccgtgcgggcgtatattgaagaagtcgccaacggcagcttccccagtgcggagcacacgtttaactaa

SEQ ID NO: 11389 - protein, 264 aa, Shewanella oneidensis
MSKVTSSTLLKYKQEGRKFTALTAYDASFASAFDGEGIDVLLVGDSLGMVLQGHDDTLPVTTADIAYHTRCVRRGIERSLLIADMPFMSYATPEQAMENATTLMQAGANMVKLEGGHWLLETVTKLTERGIPVCAHLGLTPQSVNVFGGFKVQGRDAENAQRIIDEAKALEAAGAQLLVVECIPASLATAITQALTIPVIGIGAGATTDGQILVMHDVLGISSGYIPRFSKNYLKQTGEIRSAVRAYIEEVANGSFPSAEHTFN

SEQ ID NO: 11390 - DNA, 795 bp, Shewanella sp
  CDS (1)..(795): transl_table=11
atgtctaaagttactagctcaaccctgttgaaatacaaacaggaaggtagaaaattcaccgctctgacagcctatgatgccagctttgccagtgcgttcgacggcgaaggcatcgatgtgctactggtcggcgattctttgggaatggttctgcaaggccacgatgatacgctgcctgtcacgacagccgatattgcttaccacacccgttgtgtgcgtcgcggtatcgagcgttcactgctgatcgccgacatgccatttatgagttacgccacgccagaacaagcaatggaaaacgccactgcactgatgcaggcgggtgccaatatggtgaagctggaaggcggtcactggttactcgaaaccgtgactaaactgaccgagcgcggtattcctgtctgcgcccacttgggccttaccccgcaatcggtacacgtttttggtggctttaaagtacaaggccgcgatgctgaaaatgcccagcgcattctcgatgaagccaaagccttagaagctgctggcgcacaactcttagtggttgaatgtattccggaatctctcgccaccgccatcactcaagcattaactatcccagtgatcggcatcggcgctggcgccaccacagatggtcagatcctagtgatgcacgatgtgctcggtatttcgagtggttatattccacgtttttcaaagaactacctcaagcaaacgggtgaaatccgctcggcagtacgcgcttatattgaagaagtggccaatggcaccttcccaagttcagagcacacatttagctaa

SEQ ID NO: 11391 - protein, 264 aa, Shewanella sp
MSKVTSSTLLKYKQEGRKFTALTAYDASFASAFDGEGIDVLLVGDSLGMVLQGHDDTLPVTTADIAYHTRCVRRGIERSLLIADMPFMSYATPEQAMENATALMQAGANMVKLEGGHWLLETVTKLTERGIPVCAHLGLTPQSVHVFGGFKVQGRDAENAQRILDEAKALEAAGAQLLVVECIPESLATAITQALTIPVIGIGAGATTDGQILVMHDVLGISSGYIPRFSKNYLKQTGEIRSAVRAYIEEVANGTFPSSEHTFS

SEQ ID NO: 11392 - DNA, 795 bp, Shewanella sp
  CDS (1)..(795): transl_table=11
atgtctaaagttactagctcaaccctgttgaaatacaaacaggaaggtagaaaattcaccgctctgacagcctatgatgccagctttgccagtgcgttcgacggcgaaggcatcgatgtgctactggtcggcgattctttgggaatggttctgcaaggccacgatgatacgctgcccgtcacgacagccgaaatcgcctaccacacacgttgtgtgcgtcgcggtatcgagcgctcactgctgatcgccgacatgccatttatgagttacgccacgccagaacaagccatggaaaacgccactgcactgatgcaggcgggtgccaatatggtgaagctggaaggcggtcactggttactcgaaaccgtgactaaactgaccgagcgcggtattcctgtctgcgcccacttgggccttaccccgcaatcggtacatgtttttggtggctttaaagtacaaggacgcgatgctgaaaatgcccagcgcattctcgatgaagccaaagccttagaagctgctggcgcacaactcttagtggttgaatgtattccggaatctctcgccaccgccatcactcaagcattaactatcccagtgatcggcatcggcgctggcgccaccacagatggtcagatcctagtgatgcacgatgtgctcggtatttcgagtggttatattccacgtttttcaaagaactatctcaagcaaacgggtgaaatccgctcggcggtacgtgcttatattgaagaagtggccaatggcaccttcccaagttcagagcacacatttagctaa

SEQ ID NO: 11393 - protein, 264 aa, Shewanella sp
MSKVTSSTLLKYKQEGRKFTALTAYDASFASAFDGEGIDVLLVGDSLGMVLQGHDDTLPVTTAEIAYHTRCVRRGIERSLLIADMPFMSYATPEQAMENATALMQAGANMVKLEGGHWLLETVTKLTERGIPVCAHLGLTPQSVHVFGGFKVQGRDAENAQRILDEAKALEAAGAQLLVVECIPESLATAITQALTIPVIGIGAGATTDGQILVMHDVLGISSGYIPRFSKNYLKQTGEIRSAVRAYIEEVANGTFPSSEHTFS

SEQ ID NO: 11394 - DNA, 840 bp, Silicibacter pomeroyi
  CDS (1)..(840): transl_table=11
atgagtgcgactgcccgcaagactgcccccaatgcgcaggatatccgcgcgcgcaagggcggggtgccgctggtcagcctgaccgcctataccacgccgatggcgcggctgatggatgggcattgcgatttcgtgctggtgggcgacagcgtcggcatggtgctgcacgggctgaattccaccctgggtgtgacgatggagatgatgatcctgcacggtcaggcggtggcgcgcgggctggaccgcgcgatgctggtgatcgacatgccattcgccagctacgaggagggtccggcgcaggcgttccgcaatgccgcccggctgatggccgagaccggcgctggtgcggtcaagctggaaggcggggtcgagatggccgagaccatccgctttctggtcaagcgcggcattccggtgatggcccatatcgggctgacgccgcagtcgatcaacacgctgggcggatacaaggtgcagggccgcgacgatcaggcccaggcggtgctggccgatgcccgcgcggtggccgatgcgggcgctttttcggtcgtgctcgagaaggtgcctgcgacgctggccgaccggatcactgccgaggttgcgattccgaccattggcatcggggcctctgccgggtgcgacgggcagatcctggtggttgatgacatgctgggctttttcaccgcgttcaaaccgaaattcgtcaaacggtacgccgatctgggtccgctggccgaggcggcgattgccgaatacgccgccgaagtgcgcgcgcgcagctttccggcggcggaacatgtgtttggcgatcaggccccggccaaaggtgccaaggcatga

SEQ ID NO: 11395 - protein, 279 aa, Silicibacter pomeroyi
MSATARKTAPNAQDIRARKGGVPLVSLTAYTTPMARLMDGHCDFVLVGDSVGMVLHGLNSTLGVTMEMMILHGQAVARGLDRAMLVIDMPFASYEEGPAQAFRNAARLMAETGAGAVKLEGGVEMAETIRFLVKRGIPVMAHIGLTPQSINTLGGYKVQGRDDQAQAVLADARAVADAGAFSVVLEKVPATLADRITAEVAIPTIGIGASAGCDGQILVVDDMLGFFTAFKPKFVKRYADLGPLAEAAIAEYAAEVRARSFPAAEHVFGDQAPAKGAKA

SEQ ID NO: 11396 - DNA, 843 bp, Silicibacter sp
  CDS (1)..(843): transl_table=11
atgagcgcatcatcgcaaaaaacggccctaacggccgaagacatccgggccatgaaagggcggaccccgattgtcagcctcacggcttataccacaccgatggcgcagctgatggatgaacattgcgattttgtactggtcggggacagcgtcggcatggtgttgcatgggctgccgtcgacgcttggggtcacgatggagatgatgatcctgcacggtgctgccgtcgctcgcggcctgaagcgcgcgatgatggtgatcgacatgcccttcggaagctacgaacaatcgccagcgcaggcctttgcgaatgccgcccgtctgatggcggaaaccggtgcggcggctgtcaaactcgaaggcggcgaagagatggccgacaccatccgctttctcgtgaaacgcggtattcccgtgatggcgcatatcgggctcacgccgcagtcgatcaacacgctgggcggctacaaggtgcagggccgcgacgacgctgccaaaccccttatcgccgatgcccgcgcggttgctgaggccggggcctttgcggtggttctggaaaaagtcccggcaagccttgccgatcaagtgactgagatcgtcgacattcccaccatcggcatcggggcctctgcgggctgtgatggccaggtgctggtggtggatgacatgcttggcttttttggcgccttcaagccgaagttcgtcaaacgctacgccgagcttggccccgccgccgaagaagcaatcgcagactacgcctccgaggtccgcgcgcggcgttttcccagtgcagaacacacctttgcggaccacgcgccgcaaaaagcccctcaacaagactga

SEQ ID NO: 11397 - protein, 280 aa, Silicibacter sp
MSASSQKTALTAEDIRAMKGRTPIVSLTAYTTPMAQLMDEHCDFVLVGDSVGMVLHGLPSTLGVTMEMMILHGAAVARGLKRAMMVIDMPFGSYEQSPAQAFANAARLMAETGAAAVKLEGGEEMADTIRFLVKRGIPVMAHIGLTPQSINTLGGYKVQGRDDAAKPLIADARAVAEAGAFAVVLEKVPASLADQVTEIVDIPTIGIGASAGCDGQVLVVDDMLGFFGAFKPKFVKRYAELGPAAEEAIADYASEVRARRFPSAEHTFADHAPQKAPQQD

SEQ ID NO: 11398 - DNA, 864 bp, Sphingopyxis alaskensis
  CDS (1)..(864): transl_table=11
atgtctacgctccccaaaacgctcaccctcgacacctccacgagccgcgcaaatccgacgccgcagccgatgaagcgcctgacggttccgcgcatccgccagcgcaaggggggcgaaccgatcgtgatgctcaccgcctatacggtgcgcatggcgcagttgctcgacccgcattgcgacatgctgctggtgggcgattcgctcgcgcaggtgatctatggcctgccgcacaccgtcggggtgacgatggagatgatggcgctgcacggcgccgccgtggtgcgcggcagttaccatgccgcggtgatcgtcgacatgcccttcggcagctatgagggcagcccgcagcaggcctttgacaacgccgcgcgactgctcaaggaaaccggcgccgcggcggtcaaggtcgagggtggcaaggtgcttgctccgacgatcgagttcctgacccagcgcggcattccggtgatggggcatgtcgggctgaccccgcaggcggtgaacatccttggcggttatggcgtgcgcggcaagagcgaggaggaagcgcgctcgatcgtcgaggatgcggttgcggtcgcccaggccggcgccttttcgatcgtcatcgagggcgtactcgaatcgatcgcgatcgaaatcaccaacaaggtcgcatgtccgacgatcggcatcggcgcatcggcgcagtgcgatggccaggtgctcgtcaccgacgacatgctgggcatgttcgagcgtgtacccaagttcgtcaaacgctatcgggacatggcgggcgtcgtcagcggcgccgtgcaggattatgcggacgaagtcaggtcccgttcattcccgaccgaggatcagatctacgcgggctga

SEQ ID NO: 11399 - protein, 287 aa, Sphingopyxis alaskensis
MSTLPKTLTLDTSTSRANPTPQPMKRLTVPRIRQRKGGEPIVMLTAYTVRMAQLLDPHCDMLLVGDSLAQVIYGLPHTVGVTMEMMALHGAAVVRGSYHAAVIVDMPFGSYEGSPQQAFDNAARLLKETGAAAVKVEGGKVLAPTIEFLTQRGIPVMGHVGLTPQAVNILGGYGVRGKSEEEARSIVEDAVAVAQAGAFSIVIEGVLESIAIEITNKVACPTIGIGASAQCDGQVLVTDDMLGMFERVPKFVKRYRDMAGVVSGAVQDYADEVRSRSFPTEDQIYAG

SEQ ID NO: 11400 - DNA, 819 bp, Staphylococcus aureus
  CDS (1)..(819): transl_table=11
ttgaaaacagtaagtcaattaatagatatgaaacaaaaggaaactaaaatttctatggtaacagcttatgattttccaagtgctaaacaagtggaagcagcgggtattgatatgattcttgttggggattcacttggtatgactgtattaggttatgaaagtaccgtacaagtgacgttagcagatatgattcatcacggtcgtgcagtaagaagaggcgcaccaaatacatttgtagttgttgatatgccgattggtgcagtaggcatctctatgacacaagacttaaatcatgctctaaagctttatcaggagacgaatgcaaatgcaattaaagcagaaggagcgcatattacaccatttattgaaaaagcaacggcaattggtattcctgttgttgcacatttaggattaacacctcaaagtgttggcgttatggggtataaattacaaggtgcaacgaaagaagcagcggagcaacttattttagacgcgaaaaatgtagaacaagctggtgcagttgcgttagtacttgaagcaattccaaatgatttagcagaagaaattagcaagcacttaacaattccagtcattggtattggtgcaggaaaaggtacagatggtcaagtattggtttatcacgatatgttaaattatggtgttgaacataaagcgaaatttgtgaagcaatttgctgattttagtgttggtgtggatggtttaaaacaatacgatcaagaagttaaatctggtgcatttccatcagaagaatatacgtataaaaagaaaattatgaatgaggttaataacaatgactaa

SEQ ID NO: 11401 - protein, 272 aa, Staphylococcus aureus
MKTVSQLIDMKQKETKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 11402 - DNA, 819 bp, Staphylococcus aureus
  CDS (1)..(819): transl_table=11
ttgaaaacagtaagtcaattaatagatatgaaacaaaagcaaactaaaatttctatggtaacagcttatgattttccaagtgctaaacaagtggaagcagcgggtattgatatgattcttgttggggattcacttggtatgactgtattaggttatgaaagtaccgtacaagtgacgttagcagatatgattcatcacggtcgtgcagtaagaagaggcgcaccaaatacatttgtagttgttgatatgccgattggtgcagtaggcatctctatgacacaagacttaaatcatgctctaaagctttatcaggagacgaatgcaaatgcaattaaagcagaaggagcgcatattacaccatttattgaaaaagcaacggcaattggtattcctgttgttgcacatttaggattaacacctcaaagtgttggcgttatggggtataaattacaaggtgcaacgaaagaagcagcggagcaacttattttagatgcgaaaaatgtagaaaaagctggtgcagttgcgttagtacttgaagcaattccaaatgatttagcagaggaaattagcaagcacttaacaattccagtcattggtattggtgcaggaaaaggtacagatggtcaagtattggtttatcacgatatgttaaattatggtattgaacataaagcgaaatttgtgaagcaatttgctgattttagtgttggtgtggatggtttaaagcaatacgatcaagaagttaaatctggtgcatttccatcagaagaatatacgtataaaaagaaaattatgaatgaggtgaataacaatgactaa

SEQ ID NO: 11403 - protein, 272 aa, Staphylococcus aureus
MKTVSQLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEKAGAVALVLEAIPNDLAEEISKHLTIPVIGIGAGKGTDGQVLVYHDMLNYGIEHKAKFVKQFADFSVGVDGLKQYDQEVKSGAFPSEEYTYKKKIMNEVNNND

SEQ ID NO: 11404 - DNA, 819 bp, Staphylococcus epidermidis
  CDS (1)..(819): transl_table=11
ttgaaaactttaaatcatttaaacaaaatgaaggcatcacagcaaaagatttctatggttacagcttatgattatcctagtgctaagcaagcacaacaagctgaaattgacatgattttggtaggagattctttaggaatgacagtgttaggatatgatagtactgttcaagttacattgaacgatatgattcatcatggtaaggctgttaaaagaggtgcttcagatacatttatagttgttgatatgcctatagggactgttggtttaagtgatgaagaagatctaaaaaatgcacttaagctttatcaaaacacgaatgctaacgctgtcaaagtagaaggggctcatcttacatcatttattcaaaaagcaactaaaatgggtatacctgttgtttctcacttaggtcttacacctcaaagtgtaggtgtaatggggtataaacttcaaggggatacaaagacagccgctatgcaacttatcaaagatgctaaagctatggaaactgctggtgcagtagtactggttttagaagccatacctagtgatttagctcgagaaattagtcagcaactcactattccagttataggtataggggcaggaaaagatactgatgggcaagtgttagtgtatcatgatatgttaaattatggtgttgatcgacacgctaagtttgttaagcaatttgcagacttttcaagtggtattgatggattaaggcaatataatgaagaagttaaagcagggacgtttccttctgaaaatcatacttacaaaaaacgtattatggatgaggtagagcaacatgactaa

SEQ ID NO: 11405 - protein, 272 aa, Staphylococcus epidermidis
MKTLNHLNKMKASQQKISMVTAYDYPSAKQAQQAEIDMILVGDSLGMTVLGYDSTVQVTLNDMIHHGKAVKRGASDTFIVVDMPIGTVGLSDEEDLKNALKLYQNTNANAVKVEGAHLTSFIQKATKMGIPVVSHLGLTPQSVGVMGYKLQGDTKTAAMQLIKDAKAMETAGAVVLVLEAIPSDLAREISQQLTIPVIGIGAGKDTDGQVLVYHDMLNYGVDRHAKFVKQFADFSSGIDGLRQYNEEVKAGTFPSENHTYKKRIMDEVEQHD

SEQ ID NO: 11406 - DNA, 864 bp, Streptomyces avermitilis
  CDS (1)..(864): transl_table=11
atgacgcagctttcggctgcccagaagccgtccgacagcagcaaggcactgtacggaggcaagggcacgcgtcgcatcaccatccgcgacatcaccaccgccaaggaacgcggcgagaagtggcccatgctcaccgcgtacgacgcgatgaccgcgtccgtcttcgacgaggccggcatcccggtcatgctcgtcggggactcggcgggcaactgccacctggggtacgagacgaccgtgcccgtcaccctcgacgagatgaccatgctgtcggccgcggtcgtacgcggcaccagccgcgccctgatcgtcggcgacctgcccttcggctcgtaccaggagggcccggtccaggcgctgcgctcggccacccggctggtcaaggaggccggggtcggggccgtgaagctggagggcggtgagcgctcgcaccgccagatcgagctgttggtcgagtccggcatcccggtcatggcgcacatcggtctgaccccgcagtccgtgaacgccatgggctaccgcgtccagggccgcggcgaggaggcggcccagcagctgctgcgggacgccaaggcggtccaggacgcgggcgcgttcgccgtggtcctggagctggtcccggcggaactggccgcggaggtcacgcgggtcctgcacatcccgacggtcggcatcggtgccggtccggagacggacgcgcaggtgctggtctggacggacatgctcgggctgaccggcggcaaggtgccgaagttcgtgaagaagtacgccgatctgcgcgaggtcatgggcaacgcggcgaaggcgttcgccgaggacgtcgtcggcgggacgttcccgctggaggagcactccgtccactag

SEQ ID NO: 11407 - protein, 287 aa, Streptomyces avermitilis
MTQLSAAQKPSDSSKALYGGKGTRRITIRDITTAKERGEKWPMLTAYDAMTASVFDEAGIPVMLVGDSAGNCHLGYETTVPVTLDEMTMLSAAVVRGTSRALIVGDLPFGSYQEGPVQALRSATRLVKEAGVGAVKLEGGERSHRQIELLVESGIPVMAHIGLTPQSVNAMGYRVQGRGEEAAQQLLRDAKAVQDAGAFAVVLELVPAELAAEVTRVLHIPTVGIGAGPETDAQVLVWTDMLGLTGGKVPKFVKKYADLREVMGNAAKAFAEDVVGGTFPLEEHSVH

SEQ ID NO: 11408 - DNA, 876 bp, Streptomyces coelicolor
  CDS (1)..(876): transl_table=11
atgacgcagctttcggctgcccagacgccgcagcccaagcccgccgacgggaacagggcgctgtacgggggcaagatcaaccgccgtatcaccgtccgggacatcaccgccgccaaggagcgcggcgagaagtggcccatgctcaccgcgtacgacgcgatgaccgcctccgtcttcgacgagtccggcatcccggtgatgctcgtcggcgactccgcgggcaactgccacctcggctacgagaccaccgtgcccgtcacactggacgagatgacgatgctctcggccgcggtagtccggggcaccagccgcgccctgatcgtgggcgacctgcccttcggctcctaccaggagggcccggtgcaggcgctgcgctcggcgactcggctggtcaaggaggccggggtcggcgcggtcaagctggagggcggcgagcgctcgcaccggcagatcgagctgctggtggagtccggcatcccggtgatggcgcacatcggcctcaccccgcagtccgtcaactccatgggctaccgggtgcagggccgcggcgaggaggcggcccagcagctgctgcgcgacgccaaggcggtccaggacgcgggcgccttcgcggtcgtcctggagctggtgccggccgagctggccgccgaggtgacccggacgctgcacatcccgacggtcggtatcggcgcgggcccggacaccgacgcccaggtgctggtgtggaccgacatgctcgggctgaccggcgggcggatgccgaagttcgtcaagcagtacgccgacctgcgcaaggtcatgggcgacgcggcgaaggcgtacgccgaggacgtcgtcggcggcacgttccccgcggacgagcactccgtccactga

SEQ ID NO: 11409 - protein, 291 aa, Streptomyces coelicolor
MTQLSAAQTPQPKPADGNRALYGGKINRRITVRDITAAKERGEKWPMLTAYDAMTASVFDESGIPVMLVGDSAGNCHLGYETTVPVTLDEMTMLSAAVVRGTSRALIVGDLPFGSYQEGPVQALRSATRLVKEAGVGAVKLEGGERSHRQIELLVESGIPVMAHIGLTPQSVNSMGYRVQGRGEEAAQQLLRDAKAVQDAGAFAVVLELVPAELAAEVTRTLHIPTVGIGAGPDTDAQVLVWTDMLGLTGGRMPKFVKQYADLRKVMGDAAKAYAEDVVGGTFPADEHSVH

SEQ ID NO: 11410 - DNA, 807 bp, Sulfolobus acidocaldarius
  CDS (1)..(807): transl_table=11
atgtcagcagggaaggtatcaataagggactttctgaaaaagaaggggaaagagaaaataactatgcttacagcctacgattacccaacggcaaaaataatgtcaatgacgaatcttgatggaatcctggttggcgattccttatcgatggtcgttttagggtatgaaaatactctaaaggtttctatgaaagaaatgctagttcacttggattctgtggtcagggcgaaacctagacagttagtagtcgctgatatgccatttctatcctatgaggtttcggctaatacagcagttaagaatgcgggattgtttgtaaggcatggggcggattctgtaaaacttgaggggggagaagagatggcagatgtagtgagaaagattgtgagggcggggattccagtcatgggacatatagggcttactcctcaaaggtttttgaggatcggcggatttagggttttaggaaaaagtaaacatgaggaagagcaactcttgagggatgctgaggtactagaggaggcaggtatcttttctttggttatagaaaacacttatgcagacgtagcaaagaagattactgaaaagcttaaagtaccaactatttgcattggagcaggtccctattgtgatggtcagatattagttattcatgacgttctgggactgagcgagtttacaccatattttgctaaagcatatgttaatttgaaagaggaaatccaaaaggctgttaataaatatgttgaagaagtaagggagagtaagtttccgcagggagaaaattataaggagagggaaagttga

SEQ ID NO: 11411 - protein, 268 aa, Sulfolobus acidocaldarius
MSAGKVSIRDFLKKKGKEKITMLTAYDYPTAKIMSMTNLDGILVGDSLSMVVLGYENTLKVSMKEMLVHLDSVVRAKPRQLVVADMPFLSYEVSANTAVKNAGLFVRHGADSVKLEGGEEMADVVRKIVRAGIPVMGHIGLTPQRFLRIGGFRVLGKSKHEEEQLLRDAEVLEEAGIFSLVIENTYADVAKKITEKLKVPTICIGAGPYCDGQILVIHDVLGLSEFTPYFAKAYVNLKEEIQKAVNKYVEEVRESKFPQGENYKERES

SEQ ID NO: 11412 - DNA, 804 bp, Sulfolobus solfataricus
  CDS (1)..(804): transl_table=11
atgaaaaaggtgacaataagggatttcataaagaagaaatcaatgaaggagaaaattacgatgttaacagcttacgattaccccacagcgaaaataatatctaatactacgctagattccatactagtaggagattccttaggaatggttgttctaggatatacaaatacgcttaacgtaaccatgagagacatgatctcccatactagagcagtagcaagagctaatcctcctcagttaatagtttcagatatgccgttcctaagttatgagatagacgtgaaaagtgcagtgaagaatgcaggtcttttagttaaggctggtagtgacgcggtaaaactagagggtggagaggaaattaaagacattattagagcaatcgtaaaggctggaatacccgtaatggggcatattggtttaacccctcaaaggttcttgaggctagggggatttagaactatcggaaaaactaagcaggaagaggagcaattaataaaggatagtttagaactagaagatgcaggggtattttcaatagttatagaaaatacatacgtggatatagctaaaaggattacggaaaaactaaacgtgcctacaatctgtataggagcaggcccatattgtgatggacaagtgttagtaatacacgatttactagggttatctgaggttaccccttacttcgctaagtcatacgttaatttgaaagaaatcatctccagcgctattaatcagtatataattgacgtgaaaactaataagtttcctgaaaaacaacattataaggaaagagaaagttga

SEQ ID NO: 11413 - protein, 267 aa, Sulfolobus solfataricus
MKKVTIRDFIKKKSMKEKITMLTAYDYPTAKIISNTTLDSILVGDSLGMVVLGYTNTLNVTMRDMISHTRAVARANPPQLIVSDMPFLSYEIDVKSAVKNAGLLVKAGSDAVKLEGGEEIKDIIRAIVKAGIPVMGHIGLTPQRFLRLGGFRTIGKTKQEEEQLIKDSLELEDAGVFSIVIENTYVDIAKRITEKLNVPTICIGAGPYCDGQVLVIHDLLGLSEVTPYFAKSYVNLKEIISSAINQYIIDVKTNKFPEKQHYKERES

SEQ ID NO: 11414 - DNA, 804 bp, Sulfolobus tokodaii
  CDS (1)..(804): transl_table=11
atggaaaaggttacaataagggatttcttgaaaaagaaggaaaagaaagagaaaataataatgttaacagcctacgattatccctcagcgaagataatatctcagacgaatcttgatggtatcctagttggagactcccttggaatggtagttttaggaaaagagaacacacttaaagtgactatgagagatatgttaattcatttagacgcagtagtaaaagctaagcctccacagttaatagttgctgatatgccattcttaagctatgaaacgtcaatcaaagatgctgtaaaaaatgccggattacttgctagacacggtgctgatgcagtaaaattagaaggtggagaggaaatgagagatgttgttagggctatagtaagggctggaatacctgttatgggtcatataggattaaccccacaaagattcttaagaataggtggatatagaattttggggaaaagagaaaaagaagaggaacaattacttaaagatgcaaaaacactagaagaagctggggctttttcaatagtaatagaaaacacttactcagatgtggctaaaaagataactgaaagcattagtattccaacgatatgtataggagcaggaccatattgtgacggacaaattttagttattcatgacttacttggtctttcagattttactccttattttgcaaaaaaatatatagatttacggggactaataagaagagcaatagaggattatatttcagaggtaaaagaagggaaattcccaggaaaagaacattataaatctcgagatagctga

SEQ ID NO: 11415 - protein, 267 aa, Sulfolobus tokodaii
MEKVTIRDFLKKKEKKEKIIMLTAYDYPSAKIISQTNLDGILVGDSLGMVVLGKENTLKVTMRDMLIHLDAVVKAKPPQLIVADMPFLSYETSIKDAVKNAGLLARHGADAVKLEGGEEMRDVVRAIVRAGIPVMGHIGLTPQRFLRIGGYRILGKREKEEEQLLKDAKTLEEAGAFSIVIENTYSDVAKKITESISIPTICIGAGPYCDGQILVIHDLLGLSDFTPYFAKKYIDLRGLIRRAIEDYISEVKEGKFPGKEHYKSRDS

SEQ ID NO: 11416 - DNA, 837 bp, Syntrophus aciditrophicus; identical to SEQ ID NO: 11018
  CDS (19)..(837): transl_table=11

SEQ ID NO: 11417 - protein, 272 aa, Syntrophus aciditrophicus
MSTQSKGRKITTSVIRGMKKKGEKITMLTAYDYAMASLLDEVGVEMLLVGDSLGMVVLGYESTLPVTMNDMLHHTRAVSRGANNAMVVADLPFMSYQCSVEEAVRNAGRFLQEAGAHAVKLEGGREIAESVKRMTVSGIPVVGHLGLTPQSVQQFGGFKVQGKGDAAAQRIMEDAKIIEEAGAFSVVLECVPAPLAQRITDDLAIPTIGIGAGAGCDGQVLVVNDMLGIYERFTPKFVKKYANLSDNIRGAVKQYIEEVKNGTFPDQDHSFL

SEQ ID NO: 11418 - DNA, 807 bp, Synechococcus sp
  CDS (1)..(807): transl_table=11
atgccgatcacgcctcgtcacctgcgtcagtggaagcaacagggtcgcccgattgtggcgctgaccgcttgggattttgcgatcgccagcattttggatgaggcaggcatcgatctggttcttgttggcgattccttggcaatggttgccctcgggcatcccacgacgctgcccctaagcctagaagacatgattcaccatgtgcaggccgtgcagcgtggttgccgcaatgccctgatcgtcagcgacttgccgtttttgtcctaccaaaccagcccagaagacgcgattctcgcagcaggacaactgctgaaggtgacggaggctcaagccgtcaaattagaggggggctatccgcgcctcttagaaacggtgcaacgactggtggaagtcggcattccggtgatggggcatgtggggctgactccgcaatccgtgcgccagctcggctatcgccagcagggacaaacgcccgaagcgcagcagcagattttggatcaggctctcgcgctggaggctgctggcgcgttcgcgatcgtcttggaacacattcccgatcgccttgcagccatgatcacggcgaaactctcgattccaacgatcgggattggggctggccctaattgtgatgggcaaattttggtgaccgccgatctgctaggactgacccctagccagccgccctttgcgccggcttatctcaacctgcggcaagcgatcggatctgccgtgcagcgttacgcccgagaagtgcgcgatcgccagttcctccagtctcagccagctgaacaggaaccactctcctag

SEQ ID NO: 11419 - protein, 268 aa, Synechococcus sp
MPITPRHLRQWKQQGRPIVALTAWDFAIASILDEAGIDLVLVGDSLAMVALGHPTTLPLSLEDMIHHVQAVQRGCRNALIVSDLPFLSYQTSPEDAILAAGQLLKVTEAQAVKLEGGYPRLLETVQRLVEVGIPVMGHVGLTPQSVRQLGYRQQGQTPEAQQQILDQALALEAAGAFAIVLEHIPDRLAAMITAKLSIPTIGIGAGPNCDGQILVTADLLGLTPSQPPFAPAYLNLRQAIGSAVQRYAREVRDRQFLQSQPAEQEPLS

SEQ ID NO: 11420 - DNA, 804 bp, Synechococcus sp
  CDS (1)..(804): transl_table=11
gtgcgtccagctgatctgatccgacagaagcagaacggtcgaacgatcacgatcctcacggcctgggacagtctctctgcggccctggtggaagccgctggcgcggatgctgttttggtgggggactccctggcgatggtggccctgggacatgccaccaccctgccggtgaccctcgatcagatgcggcaccacacccttgcggtcagccgcggattcgccgcagctccctccaagcaaccgctgttgatctgcgaccttcccttcctcagctatcaatgcggggcagacctcgccgttcaggccgcaggaacgctgttgaaggaaacacccgctgccgccgtcaagctcgagggggccgaggctgaggtcctggccgtgatcgaccggctggtgcggatggggattccagtcatgggccatttgggactgacgccgcaggcggtgcatcgtcttggctaccggcggcaagccgaagatccggtgagtcaggaacggctgctcacccaggcgattgccctcgagcaggcgggttgcttcgcgcttgtgctcgagcatgtcccctcggctcttgctagagaggtgcgacgacgtctcctgatccctgtgatcggcatcggtgctggagacgactgcgatggccagatccgcgtcaccgctgacctgctgggcctgacggagcagcaaccacccttcagcccggccctgattcccgggcagcagctgtttgtggaggcgctgcggacgtggattgctgcacagactcccaccacaacaccacctccagcaacacccgattactga

SEQ ID NO: 11421 - protein, 267 aa, Synechococcus sp
MRPADLIRQKQNGRTITILTAWDSLSAALVEAAGADAVLVGDSLAMVALGHATTLPVTLDQMRHHTLAVSRGFAAAPSKQPLLICDLPFLSYQCGADLAVQAAGTLLKETPAAAVKLEGAEAEVLAVIDRLVRMGIPVMGHLGLTPQAVHRLGYRRQAEDPVSQERLLTQAIALEQAGCFALVLEHVPSALAREVRRRLLIPVIGIGAGDDCDGQIRVTADLLGLTEQQPPFSPALIPGQQLFVEALRTWIAAQTPTTTPPPATPDY

SEQ ID NO: 11422 - DNA, 816 bp, Synechococcus sp
  CDS (1)..(816): transl_table=11
atgcgtccttctgatctgacccgcttcaagcagaagggccaacccatcgccgtactcaccgcttgggacagcctctctgcagctctggccgaagccgccggtgcagatgtgctgctgatcggtgattcactggccatggtggcgctgggtcatgccacaacactcccggtgagcctggaccagatgctccatcacacccaggcggtggcacgaggattgacgaccatgcccgccgatcagcccctgctggtctgtgacctgccctttctcagctaccaatgcggtgaagaccgcgccgttgcagcggcagggcgcctgctgaaggagtccagtgctgcggcggtgaagttggagggagcggaacccgaggttgtcgccgtgatcgaccgtctggtgcgcatgggcattcccgtgatggggcatctgggcctcacgcctcaggccgtgcatcgtctggggtaccgccgccaggccacggacgccatcagccaggaacgcctgctcgagcaagcatgcaccctcgagcagaagggctgcttctccttggtgctggaacatgttccagccgagctggcgtgccgggtgcagcaggccctgaccatcccggtgatcggcatcggggcaggtgatgactgcgatggccaagtgcgcgtcacggcagatctgcttgggctcaccgccaaacaacctcccttcagcccagcactcgtggatggccgccgactgttcatcgacgcattgaagggttgggtcaatcagacccggaaccacactcctcccaccaatgggaggatcacccaagccgatagaacttga

SEQ ID NO: 11423 - protein, 271 aa, Synechococcus sp
MRPSDLTRFKQKGQPIAVLTAWDSLSAALAEAAGADVLLIGDSLAMVALGHATTLPVSLDQMLHHTQAVARGLTTMPADQPLLVCDLPFLSYQCGEDRAVAAAGRLLKESSAAAVKLEGAEPEVVAVIDRLVRMGIPVMGHLGLTPQAVHRLGYRRQATDAISQERLLEQACTLEQKGCFSLVLEHVPAELACRVQQALTIPVIGIGAGDDCDGQVRVTADLLGLTAKQPPFSPALVDGRRLFIDALKGWVNQTRNHTPPTNGRITQADRT

SEQ ID NO: 11424 - DNA, 783 bp, Synechocystis sp
  CDS (1)..(783): transl_table=11
atggccattacccccacccaattgttggattggaagcgtcaacaacggcctattgtggcccttactgcctgggatacggcgatcgcctcggtgttggatgcggcgggagtggaaattattctggtgggggattccctcggaatggtggctttgggctacgaaactaccctaccggtgagcttggacaccatgattcaccacacagcggcagttaaaaggggagtacaaagagccttggtggtctgtgacctgccctttttgacctatcaggaaagtccagcccaggccatggggtcagcgggaagggttttgcaggaaaccggtgcccaggcagtgaaattagaagggggtcacccccgcatggtggaaaccgtagctcgactaacggaggtgggcattccggtgatgggtcatgtgggcttaacgccccaatcagtccatcagttgggttatcggcaacagggccaggacccggccacagcggagaaaattcttcatcaggcgatcgccttggcagaggcgggagtgtttgccattgttttagaacatattcctagcgaactagcggctagtatcactgagcagttgcccattcccaccattggcattggggcagggccccagtgtgacggccaggttttggtgacggcggatttactcggtttgacagtcaaacaaccgccctttgctccggcctatctgaatttacgacataccattacggaaacagtgcataaattcagtggagaagtgcgacaaagacaatttccccggcggggttag

SEQ ID NO: 11425 - protein, 260 aa, Synechocystis sp
MAITPTQLLDWKRQQRPIVALTAWDTAIASVLDAAGVEIILVGDSLGMVALGYETTLPVSLDTMIHHTAAVKRGVQRALVVCDLPFLTYQESPAQAMGSAGRVLQETGAQAVKLEGGHPRMVETVARLTEVGIPVMGHVGLTPQSVHQLGYRQQGQDPATAEKILHQAIALAEAGVFAIVLEHIPSELAASITEQLPIPTIGIGAGPQCDGQVLVTADLLGLTVKQPPFAPAYLNLRHTITETVHKFSGEVRQRQFPRRG

SEQ ID NO: 11426 - DNA, 843 bp, Thermobifida fusca
  CDS (1)..(843): transl_table=11
atgagttctcacacccccgctcctgctttgtatggcggctccgcaaaccgccgggtcacggttcaggacttggccgcagcgaaagagcgcggcgaacgctggccgatgctcaccgcctatgacgcgctgactgcccggattttcgacgaggcgggcattccggtgctgctggtgggtgactctgctgcgatggtggtgttcggctacgactccacgatcccggtcacccttgacgacatgatcccgttgacggccgcggtgtcgcgggcgacgaagcgggcgctggtggtggctgacctcccgttcggctcctaccaggccggtccggagcaggctttggagtcggcggcgcggctgatgaaggagggcggcgcccaggcggtcaagctggagggcggccaccgggtcatcgcccaggtggaggctttggtgtcggcgggtatcccggtgatgggccacatcgggttgacgccgcagtcggtgaatgtgctgggcggctaccgcgtgcagggccgcagcgaggaggcggccgaggcgctgctgtctgatgcgaaggagcttgagcgggcgggcgtgttctcggtggtgctggagtgcgtgcctgcgcgggtgggcgcggagatcacccggcagttgacggtgccgacgatcgggatcggcgcgggtccggacacggacgcccaggtgctggtgtggcaggacatggccgggttgtcgccgcgggtcgccaagttcgtcaagtcgtacgcgaatctggcggagcagttgcgggacgctgccacgagtttcgcggaggaagtggtggcgggcacgttcccggacgagcagcactcctacgcctag

SEQ ID NO: 11427 - protein, 280 aa, Thermobifida fusca
MSSHTPAPALYGGSANRRVTVQDLAAAKERGERWPMLTAYDALTARIFDEAGIPVLLVGDSAAMVVFGYDSTIPVTLDDMIPLTAAVSRATKRALVVADLPFGSYQAGPEQALESAARLMKEGGAQAVKLEGGHRVIAQVEALVSAGIPVMGHIGLTPQSVNVLGGYRVQGRSEEAAEALLSDAKELERAGVFSVVLECVPARVGAEITRQLTVPTIGIGAGPDTDAQVLVWQDMAGLSPRVAKFVKSYANLAEQLRDAATSFAEEVVAGTFPDEQHSYA

SEQ ID NO: 11428 - DNA, 789 bp, Thiobacillus denitrificans
  CDS (1)..(789): transl_table=11
atgccggtgacgctctcgacgctaaaagcgctgcggcagaagggcgagaagatcgccgtgctcacgtgctacgacgcgagcttcgcgcgcgtgttcgacgccgccggcgtcgacgtcctgctcgtcggcgattcgctcggcatggtgatccagggccacgcctcgacgctgcccgtcaaactggccgaaatggcgtatcacacgcgctgcgtcgcggccggaacgacgcgcgccttcatcgtcgccgacctgcctttcggcagctaccagccgtcgccggagcgcgcctacacggcggccgcgcgcctgatggcggccggcgcgcacatgatcaagctcgaaggcggtgcggtcatggtcgacacggtcgcgtttcttgccgcgcgcggcattccggtgtgcgcccacctcgggcttctgccgcagtcggtcaaccagctcggcggctaccgggtgcaggggcgcgaggacggcgacgccgcacagctcgtcgccgacgcccgcgcgctcgaggcagccggtgcgggactgatcgtgctcgaaatggtgcctgcggcgctggcgaagaccgtcaccgcggcgctgtcgatgccaaccatcggcatcggggccggtgccgactgcgcgggacaggtcctcgtgtcctacgacatgctcggcctctatccgcgcgcgccgaagttctcgaagaattttctcgccggcgccggcagcgtcgacgccgccgtgcgcgcctacgtcgcggcagtcaaggacggcagcttccccgccgccgaacacgcgttctga

SEQ ID NO: 11429 - protein, 262 aa, Thiobacillus denitrificans
MPVTLSTLKALRQKGEKIAVLTCYDASFARVFDAAGVDVLLVGDSLGMVIQGHASTLPVKLAEMAYHTRCVAAGTTRAFIVADLPFGSYQPSPERAYTAAARLMAAGAHMIKLEGGAVMVDTVAFLAARGIPVCAHLGLLPQSVNQLGGYRVQGREDGDAAQLVADARALEAAGAGLIVLEMVPAALAKTVTAALSMPTIGIGAGADCAGQVLVSYDMLGLYPRAPKFSKNFLAGAGSVDAAVRAYVAAVKDGSFPAAEHAF

SEQ ID NO: 11430 - DNA, 792 bp, Trichodesmium erythraeum
  CDS (1)..(792): transl_table=11
atggcagttacaactaaacaattaattcaatggaaacaaaaaggtcgcccaatagtagctctgacagcttatgattatacgatcgctcaacttttagacaatgctggagtagatttaattctggtgggagattctctgggaatggtaactttaggttatgaaacaactttaccagtgactcttgaggaaatgattcatcatgctaaagcagtacgacgagctgtaaaacaagctttaatggtggtagatttaccatttttaacttatcaggaaagtccccaacaagctatacattcagcaggaagaatactaaaagaaacaggagctcaagctgtcaaactagaaagtggtaatgaagcgatcgctcaaactgttaagaaactaacgtcaataggtattcctgtgatgggtcatattggcctaattccccaatctgtacatcaatttggaggttatcctcaacaaggcaacgctcctgatgctagtgcgcgtattttaacagaagctctagctttggcagaagctggtgcttttgccctagttctagaacatattaaagcagatttagctaaagagattacagaaaaagtttctattcctactattggtattggtgcaggtgcctattgtgatggtcagatattagtgattaatgatgttttagggctttcccattggcagccaccttttgctaaaccttatgttaacttgcgagagactattactcaagcagttaaagaatatagtttagaagtaaagaaaagaaaatttcctcaaccaccatcaccatag

SEQ ID NO: 11431 - protein, 263 aa, Trichodesmium erythraeum
MAVTTKQLIQWKQKGRPIVALTAYDYTIAQLLDNAGVDLILVGDSLGMVTLGYETTLPVTLEEMIHHAKAVRRAVKQALMVVDLPFLTYQESPQQAIHSAGRILKETGAQAVKLESGNEAIAQTVKKLTSIGIPVMGHIGLIPQSVHQFGGYPQQGNAPDASARILTEALALAEAGAFALVLEHIKADLAKEITEKVSIPTIGIGAGAYCDGQILVINDVLGLSHWQPPFAKPYVNLRETITQAVKEYSLEVKKRKFPQPPSP

SEQ ID NO: 11432 - DNA, 819 bp, Tropheryma whipplei
  CDS (1)..(819): transl_table=11
gtgatctgtatgtcacgcaaaccttctccaaccagacgaacaaggatacatcgctttcataaaggttcctgcggcaggaagctggtgggtcttacatgttatgacttttcaacagccagggtcctgagtgattgcgagctcgactttcttctagttggtgattcagcaagcggtgtgatttatggatatgaaaacacaggcagtgtctgtcttgacgaaattatttaccttgccgcaggcgttgtaagaggtgcaccaaatagctttattattgttgaccttccctttggaacatacgaaaaatctgatgaattagctgtcgaaacagcaatagaggttataaaaagaactggggcctcggctgtaaagcttgaaggtggtgctcgaatggcatgtaggataagcgcgattgtaagagctggtgtgccggttatgggacatattgggtttaccccgcagaccattaacgctcttggggggtacaaaatacagggacgtgataacgccgatttgatttacctggatgcacaggctgttgagcaggcaggggcttttgcggttgttatggaaatggtaactgaagatcttgcgaaaaccataacctcagaaatcaagataacaacaattggcgtcggcgcggggagatacacagatggacagttattagtcataaatgatttaattggcctgagtgaaaagaaaataacattcgcgccacgatacgcaagtattgataatactgtggcatcctgcgtaaaactatggcgaaaagatgttctagagggcaatttccctcagaaagaccatattccagcataa

SEQ ID NO: 11433 - protein, 272 aa, Tropheryma whipplei
MICMSRKPSPTRRTRIHRFHKGSCGRKLVGLTCYDFSTARVLSDCELDFLLVGDSASGVIYGYENTGSVCLDEIIYLAAGVVRGAPNSFIIVDLPFGTYEKSDELAVETAIEVIKRTGASAVKLEGGARMACRISAIVRAGVPVMGHIGFTPQTINALGGYKIQGRDNADLIYLDAQAVEQAGAFAVVMEMVTEDLAKTITSEIKITTIGVGAGRYTDGQLLVINDLIGLSEKKITFAPRYASIDNTVASCVKLWRKDVLEGNFPQKDHIPA

SEQ ID NO: 11434 - DNA, 795 bp, Vibrio parahaemolyticus
  CDS (1)..(795): transl_table=11
atgaaaaagatgaccatcaacgaccttatcaagtggaagcaagaaggtcgtaaatttgctacttcaaccgcttacgatgcgagctttgcacaactttttgaaagccaagaaatgcccgttcttttagttggtgattcacttggtatggtattgcaaggtgaaaacgatacgctaccagtaacggtagacgacatcgtgtaccacactcgctgtgtacgtgctggcagcccgaattgcttactaatggccgatatgccattcatgagctacgcaacaccagagcaagcgtgtgagaacgcagcaaaattgatgcgcgcaggcgcaaacatggtaaaaatcgaaggcggcgactggctagttgataccgttaagatgcttactgaacgcgcagtgccagtctgtgctcaccttggtttaacccctcagtctgttaacatttttggtggttacaaaatccaaggtcgcgatcaagaaaaagcggatcgcatggtaaaagatgcgttagcgctacaagaagcaggcgctcaaatcgtcctactagaatgtgtgcctgctgaactggcagagcgcattactaaagtactcgacgtgccagtcatcggtatcggtgcgggtaacgtaacggatggtcagattcttgtaatgcatgatatgttcggcatctctgccaactacatgcctaaattctccaaaaacttccttgctgaaacaggtgatatgcgcaaagccgttgcaaaatacattgaagatgtagcaaacggtgtattcccagacgacgcacataccattgcctag

SEQ ID NO: 11435 - protein, 264 aa, Vibrio parahaemolyticus
MKKMTINDLIKWKQEGRKFATSTAYDASFAQLFESQEMPVLLVGDSLGMVLQGENDTLPVTVDDIVYHTRCVRAGSPNCLLMADMPFMSYATPEQACENAAKLMRAGANMVKIEGGDWLVDTVKMLTERAVPVCAHLGLTPQSVNIFGGYKIQGRDQEKADRMVKDALALQEAGAQIVLLECVPAELAERITKVLDVPVIGIGAGNVTDGQILVMHDMFGISANYMPKFSKNFLAETGDMRKAVAKYIEDVANGVFPDDAHTIA

SEQ ID NO: 11436 - DNA, 795 bp, Vibrio vulnificus
  CDS (1)..(795): transl_table=11
atgaaaaaaatcaccattaatgacctgattaagtggaagcaggaaggtcgtaaatttgcgacttcaacagcatacgatgcaagttttgcgcaactttttgagagccaagaaatgccagtgttactggtcggcgactctcttggtatggtgttgcaaggcaaaaatgacacgcttccagtgactgttgaagacattgcttaccacacacgctgtgttcgtgcgggtagcccaaattgtctattgatggcggatatgccatttatgagttacgccacaccagagcaagcctgtgaaaacgcggcgcaattaatgcgagcgggcgccaacatggtcaaaatcgaaggtggcgattggctggttgatacggtaaaaatgctcacagagcgtgcggttccagtgtgtgcccacctcggtttaacaccacaatccgttaatatttttggtggttacaaagtgcaaggccgcgatcaggaaaaagccgatcgcatggtcaaagatgcactggcgttgcaagcggcaggcgcacaaatcgttctacttgagtgtgtacctgctgagctagcagcacgaattactcaagtgctggatgtacccgtgattggtattggcgctggaaatgtcaccgatggccaaatcctcgtgatgcacgatatgtttggtatttcagccaattacatgccaaaattctcgaaaaatttcctggcagaaacaggagatatgcgcaaagccgtggcgctgtacatggaacaagtacaagcaggcaccttccctgatgaagcgcacaccattgcttag

SEQ ID NO: 11437 - protein, 264 aa, Vibrio vulnificus
MKKITINDLIKWKQEGRKFATSTAYDASFAQLFESQEMPVLLVGDSLGMVLQGKNDTLPVTVEDIAYHTRCVRAGSPNCLLMADMPFMSYATPEQACENAAQLMRAGANMVKIEGGDWLVDTVKMLTERAVPVCAHLGLTPQSVNIFGGYKVQGRDQEKADRMVKDALALQAAGAQIVLLECVPAELAARITQVLDVPVIGIGAGNVTDGQILVMHDMFGISANYMPKFSKNFLAETGDMRKAVALYMEQVQAGTFPDEAHTIA

SEQ ID NO: 11438 - DNA, 798 bp, Wigglesworthia glossinidia brevipalpis
  CDS (1)..(798): transl_table=11
atgaaaaaaacaaatatatatgatttatacaaattaaaagaacaaaataaaaaatttgcttctataactgcttatgatgcaacatttgcaaatttattttttaaaaaaggaattagaacaattttagtaggggattcattaggaatgacgattcaaggtcattcatcaacagttcctgtaaaaatagatgaaatgatgtatcatacaaaatgtgttagaagaggagctccttcatgtttaataatttctgatcttccttttatgagctataataatataaatgatgcattaaataattccaaaaaattaattcagtcaggagctaatatagtcaaattagaaggaggattgtgggtttcagatattattcatgaacttaatacaagatctataccagtatgcggacacataggattaactcctcaatctataaacatgcaaggatcatataaaatacaaggaagaaataataatgatgcaattaggctaatggaagaagcaatttctatagaagaatcaggagcaaaattattagttttagaatgtattatacaaaaattatctaacaacattactaaaaaattaaatattccaacaataggaatagggtctggtaaaaaaacagacggccaaatactagtaatgcaagatgttcttggtattactatagaaggcaaaattccatctttttcaaaaaattttactaaaaataaatttggaatagaaaaagctatagaattatatatagaagaagttgaaaatgaattatttccaagtgaaaatcatagttttaattaa

SEQ ID NO: 11439 - protein, 265 aa, Wigglesworthia glossinidia brevipalpis
MKKTNIYDLYKLKEQNKKFASITAYDATFANLFFKKGIRTILVGDSLGMTIQGHSSTVPVKIDEMMYHTKCVRRGAPSCLIISDLPFMSYNNINDALNNSKKLIQSGANIVKLEGGLWVSDIIHELNTRSIPVCGHIGLTPQSINMQGSYKIQGRNNNDAIRLMEEAISIEESGAKLLVLECIIQKLSNNITKKLNIPTIGIGSGKKTDGQILVMQDVLGITIEGKIPSFSKNFTKNKFGIEKAIELYIEEVENELFPSENHSFN

SEQ ID NO: 11440 - DNA, 789 bp, Wolinella succinogenes
  CDS (1)..(789): transl_table=11
atgaaaaatattaccgtctcttcgattaaaaagaagaaaaaccaagagaaaatcaccatgatcactgcctatgatgcgctttttgcgaggctttttgatggtgaagtggatattttgcttgtgggagatagtttggcgatgagctttgggggtgaggaagacaccctccctattggaatggatgagatgatctatcataccaaggctgtttgtaggggggcggaaaagtcccttgtcgtgattgatatgccctttggaagttacgacaccaaggaaaaagccctccataacgccatccgtgcctataaagagagtggtgctagcgcggtaaagcttgaagggggaattcaaaaggctgaaaccatcgcgcttttgagtgaaaatggaatcgccgttatggggcacatagggctcaagccccaatttgtgcgtgctgagggaggatacaaggtcaaaggcaaagaggagggcgaagctcaatctctcctaagagacgccaaagcgctagaagaatcaggagtctttgccctcgtgcttgaaggggtgaaggcagaggtcgcccaagaggtcgctagaagcgtgagcgtgcccgtcatcgggattgggagcggatcgcaagtggacggtcaggtgctggtgtggagcgatatgctgggattttttgaaggattcacgcctaaatttgttcgccgttatcttgagggagcgagccttatccgtcaaggggtgagggagtacgccaaagatgtgcgagaggggcgattcccttcggaggctgagagctactga

SEQ ID NO: 11441 - protein, 262 aa, Wolinella succinogenes
MKNITVSSIKKKKNQEKITMITAYDALFARLFDGEVDILLVGDSLAMSFGGEEDTLPIGMDEMIYHTKAVCRGAEKSLVVIDMPFGSYDTKEKALHNAIRAYKESGASAVKLEGGIQKAETIALLSENGIAVMGHIGLKPQFVRAEGGYKVKGKEEGEAQSLLRDAKALEESGVFALVLEGVKAEVAQEVARSVSVPVIGIGSGSQVDGQVLVWSDMLGFFEGFTPKFVRRYLEGASLIRQGVREYAKDVREGRFPSEAESY

SEQ ID NO: 11442 - DNA, 816 bp, Xanthomonas axonopodis pv
  CDS (1)..(816): transl_table=11
atgagcagccacgccgacagcaagccctggaccgtgcccgccttggcgcaggccaagcgcgagggtcgaaaactggtcatgttgaccgcgtacgacgccggtttcgcgcgcaccttcgacgccaatggcgtggacctgatcctggtcggcgattcgctcggcatggtggtgcaggggcacgattccaccttgccggtgaccaccgccgacatggtctaccacacggcttcggttgcccgtgcgctcgatcgcgccttgctggtggcggacctgtcgttccaggccgacgccacgcctgagcgtgcattggacgccgccacccagctgctgcaggctggcgcggagatggtcaagatcgaaggcgccgggcacaagctggaggtcatccgttacctggtcgagcgcgagatcccggtctgctcgcacctgggcctgaccccgcaatcggtgctgcggttcggtggctacaaggtgcaggggcgcggcgaggctggcgagcagctgcgtcgtgacgcacaggccgtggtcgacgccggtgccagcctgttggtgctggaatgcgtgccgacgccgatcgccacgcagattagtgccgagctcagcgtgcccaccatcggcatcggtgccggccccggttgcgacggccaggtgctggtgatgcacgacatgctcgggctggacagtggccaccgccggcccaagttcgtcaaggatttcctggccgaaggcggctcggttgccggcgcggtgcgcgcctatgcacaggcggtgcgcgacggcagttttcccgatgcagagcacgcgtacgccgcatga

SEQ ID NO: 11443 - protein, 271 aa, Xanthomonas axonopodis pv
MSSHADSKPWTVPALAQAKREGRKLVMLTAYDAGFARTFDANGVDLILVGDSLGMVVQGHDSTLPVTTADMVYHTASVARALDRALLVADLSFQADATPERALDAATQLLQAGAEMVKIEGAGHKLEVIRYLVEREIPVCSHLGLTPQSVLRFGGYKVQGRGEAGEQLRRDAQAVVDAGASLLVLECVPTPIATQISAELSVPTIGIGAGPGCDGQVLVMHDMLGLDSGHRRPKFVKDFLAEGGSVAGAVRAYAQAVRDGSFPDAEHAYAA

SEQ ID NO: 11444 - DNA, 816 bp, Xanthomonas oryzae pv
  CDS (1)..(816): transl_table=11
atgagcagccacgccgacagcaatccctggaccgtgcccgccttggcgcaggccaagcgcgcgggtcgaaaactggtcatgttgaccgcgtacgacgccagcttcgcgcgcaccttcgacgtcaatggcgtggacctgatcctggttggcgactcgctcggcatggtgatgcaggggcatgattccaccttggcggtgaccaccgccgacatggtctaccacaccgccgcggtggcccgcgcgctcgatcgcgcattgctggtggccgacctgtcgttccaggccgacgccacgcccgaacgtgcattggatgccgccacccaactgctgcaggccggtgcggagatggtcaagatcgagggcgccgggcataagctcgaggtcatccgttacctggtcgagcgcgagattccggtctgctcgcacctggggctgaccccgcaatcggtgctgcgcttcggcggctacaaggtgcagggccgcggcgaagccggcgagcagttgcgccgcgatgcgcaggcggtggtcgacgccggtgccagcctggtggtactggaatgcgtgccgacgccgatcgccacgcaaatcagcgcagaactcagcgtgcccaccatcggcatcggtgccggccccggttgcgacggccaggtgctggtgatgcacgacatgctgggcctggacagcggtcatcgtcggcccaagttcgtcaaggatttcctggccgaaggcggctcggtggctggtgcggtgcgtgcctacgcgcaggccgtgcgcgatggcagctttcccgatgcagagcacgcgtacgccgcatga

SEQ ID NO: 11445 - protein, 271 aa, Xanthomonas oryzae pv
MSSHADSNPWTVPALAQAKRAGRKLVMLTAYDASFARTFDVNGVDLILVGDSLGMVMQGHDSTLAVTTADMVYHTAAVARALDRALLVADLSFQADATPERALDAATQLLQAGAEMVKIEGAGHKLEVIRYLVEREIPVCSHLGLTPQSVLRFGGYKVQGRGEAGEQLRRDAQAVVDAGASLVVLECVPTPIATQISAELSVPTIGIGAGPGCDGQVLVMHDMLGLDSGHRRPKFVKDFLAEGGSVAGAVRAYAQAVRDGSFPDAEHAYAA

SEQ ID NO: 11446 - DNA, 819 bp, Xylella fastidiosa
  CDS (1)..(819): transl_table=11
atgagcatatataccaatagcaaaccttggacggtgcctgctttggcggaggccaagcgaaacggttctaaaatcgtgatgttgactgcttatgatgctgggtttgctcgtattcttgacgcaaacggcgtagacctagtccttgttggcgattcgttgggaatggtggtacagggccatgactcgactcttccggtgagtgtgcatgacatggtgtaccacactgcgtgtgtggctcggggggtacgtcaggcaatgcttgtggttgatttgccatttcaggctgatgcgtcgccggagcgtgcgctagaggctgccactccattactgcgggtgggggcacagatgatcaaaatcgaaggtgctgggcacaagcttgaggtgattagttacttggttgagcgtgagattccggtgtgttcgcacttggggctgactccgcaatcggtactgcgttttggaggttataaggtgcaaggacgtggtgaggaggctggggggcgtttgcgtgccgaggcacgtgcggcggtggaggctggtgctactctcttgctattggagtgtgtgccgtcgcagttggcagcgcagatcactaccgatgtatcggtgccgacgattggtatcggtgccggtgctggttgtgatggccaagtgctggtgctgcatgatctccttggcctagacagtggtcaccctcgaccgaaattcgttaaagattttctcgctcatgggggatcggttgctggcgcggttcgcgcttatgcgaatgcggttcgagatggttcgtttccagatgtcgagcatacttacacatcgtga

SEQ ID NO: 11447 - protein, 272 aa, Xylella fastidiosa
MSIYTNSKPWTVPALAEAKRNGSKIVMLTAYDAGFARILDANGVDLVLVGDSLGMVVQGHDSTLPVSVHDMVYHTACVARGVRQAMLVVDLPFQADASPERALEAATPLLRVGAQMIKIEGAGHKLEVISYLVEREIPVCSHLGLTPQSVLRFGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 11448 - DNA, 801 bp, Yersinia pseudotuberculosis; identical to SEQ ID NO: 11010
  CDS (4)..(801): transl_table=11

SEQ ID NO: 11449 - protein, 265 aa, Yersinia pseudotuberculosis
MKTTTMSQLRQWKQEKRKFATLTAYDASFAQLFAEQGIQVLLVGDSLGMTLQGFDSTLPVTVADVAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 11450 - DNA, 1095 bp, Oryza sativa
  CDS (1)..(1095)
atgatgatgatgatgcggcgggcgttccggcacctggcgcggcagcagcggcggccgctgagccacgtgccggagtcggccgtctacggcgggccgcggccgcaggatgtgggggcggcggcgggagcgggggcgggggcgggggcgacgcggcgggtgacggtgacgacgctccgcgggaagcaccgacgcggggagcccatcaccgtcgtcacggcctacgactacccgtccgcggtgcacgtcgactcggccgggatcgacgtctgcctcgtcggggactcggcggccatggtggtgcacggccacgacaccacgctccccatctcgctcgacgtcatgctcgagcactgccgcgccgtcgcccgcggcgccaccaggccgctcctcgtcggcgacctccccttcggttgctatgagtcctcctccacgcgggctgttgactctgcggtgagggtgctaaaagaaggtggaatggacgcaatcaagctggaaggaggtgcaccctcgagaatcagtgcggctaaggctattgtggaggctggaatcgctgtaatggggcatgttgggctcacgccgcaggctattagcgtgcttggtggatttcgaccacaaggaaagacggttgatagtgctgtgaaggttgtggagacagcacttgccttgcaggaggctggctgcttctcggttgtgttggagtgtgtgccagctcctgtggcagctgctgcaacatcagcattgcaaatcccaaccattggaattggtgctggaccattctgcagtggacaggtcttagtttaccatgacttgttagggatgatgcaacatccacaccatgccaaggtcacaccgaaattctgcaaacaatttggaaatgtcggtcatgtcatcaacaaggctctatcggagtacaagcaggaagtggaaacccggagtttcccaggtcccagccatacgccgtacaagatagctgccgcggatgtggatggcttcgcgaatgcactgcagaagatgggcttggacgaggctgcaaatgctgcagctgccgcagctgaaaacgcagagaaagatggagaactacccgagaacaaatga

SEQ ID NO: 11451 - protein, 364 aa, Oryza sativa
MMMMMRRAFRHLARQQRRPLSHVPESAVYGGPRPQDVGAAAGAGAGAGATRRVTVTTLRGKHRRGEPITVVTAYDYPSAVHVDSAGIDVCLVGDSAAMVVHGHDTTLPISLDVMLEHCRAVARGATRPLLVGDLPFGCYESSSTRAVDSAVRVLKEGGMDAIKLEGGAPSRISAAKAIVEAGIAVMGHVGLTPQAISVLGGFRPQGKTVDSAVKVVETALALQEAGCFSVVLECVPAPVAAAATSALQIPTIGIGAGPFCSGQVLVYHDLLGMMQHPHHAKVTPKFCKQFGNVGHVINKALSEYKQEVETRSFPGPSHTPYKIAAADVDGFANALQKMGLDEAANAAAAAAENAEKDGELPENK

SEQ ID NO: 11452 - DNA, 1200 bp, Oryza sativa
  CDS (1)..(1200)
atgtctttctcccgcctcctaaccccaagaattctcctggacaccaccgccgtgttcccgccaagcagcagcgtcgtcgccccgtcgctctcccgccaactgcggtgcacgcgcacgggtgggtcgccgccggcgccgccgcataggctcgtggcgcggcgggcgatgagcaacggggcggcggagccggccatctacggcggcggcggcggcgcacaacaggcggcgtcgtctgctgcggcgcggcgcgtgacgctggcgacgctccgcgggaagcaccggcgcggggagccgatcagcatggtgaccgcctacgactacccgtccggggtgcacgtcgacgccgccgggttcgacatctgcctcgtcggcgactccgccgccatggtcgcgcacggccacgacaacaccctccccatctccctcgacctcatgatcgagcactgccgcgccgtggcgcgcggcgcggccaggacgttcctcgtcggcgacctcccgttcggcagctacgaggcctccaccgcacaggctgtcggctcggcggtgagggtgatgaaggaaggcggcgtgaattcaatcaagctggaagggagcgcgccgtcgaggatcagcgcggcgagggccatcgtggacgccgggatcgccgtgatggggcacatcgggctcacgccgcagtccgtcagcgcgctcggcgggttccggccacaggggaagacggtcgagagcgccgtcaaggtcgtggaggcggcgctcgcgttgcaggaggccggctgcttcgccgtcgtgctggagtgcgtgccggctccggtggcggcggcggcgacttcggcactgacaatcccgaccattggcatcggcgccgggccattctgcagcgggcaggtcttagtctaccacgacttgttagggacgttccaaacaagtcatgccaaggtctcgccaaaattctgtaaacagtatggtaacattggggacgtgattaacagagctctatcaaagtacaagcaagaggtggaaacccagtcttttccgggtcctagtcacacgccctacaaactagctgccacagatgttgatgcctttctgaatgcgctgaagatgaagggcctgaatgtggctgctgatgctgcagccgatgctgttgaatatacagatgagaaagagataaatggaacgccgcagctcaaggtctatgcttga

SEQ ID NO: 11453 - protein, 399 aa, Oryza sativa
MSFSRLLTPRILLDTTAVFPPSSSVVAPSLSRQLRCTRTGGSPPAPPHRLVARRAMSNGAAEPAIYGGGGGAQQAASSAAARRVTLATLRGKHRRGEPISMVTAYDYPSGVHVDAAGFDICLVGDSAAMVAHGHDNTLPISLDLMIEHCRAVARGAARTFLVGDLPFGSYEASTAQAVGSAVRVMKEGGVNSIKLEGSAPSRISAARAIVDAGIAVMGHIGLTPQSVSALGGFRPQGKTVESAVKVVEAALALQEAGCFAVVLECVPAPVAAAATSALTIPTIGIGAGPFCSGQVLVYHDLLGTFQTSHAKVSPKFCKQYGNIGDVINRALSKYKQEVETQSFPGPSHTPYKLAATDVDAFLNALKMKGLNVAADAAADAVEYTDEKEINGTPQLKVYA

SEQ ID NO: 11454 - DNA, 1059 bp, Zea mays
  CDS (1)..(1059)
atgcggcggtccctaccccttctcctcgcgcggcaggtggcgcggcggcggcggctgagcaacgtgccggagtccaccgtctacgggggcccacgcccgcaggagtcctcggcggcgcggcgcgtgacggtgaccacactccgtgggaagcaccgccgcggggagcccatcaccgtcgtcaccgcctacgactacccctcggcggtccacgtcgactccgccggcatcgacgtctgcctcgtcggggactccgccgccatggtcgtccacggccacgacaccacgctccccatcacgctcgacatcatgctcgagcactgccgcgccgtggcccggggcgcgccgcgcccgctcctcgtcggggatctcccattcggctgctacgagtcctccgccgcccaggctgttgattcagccgtgagggtcctcaaggaaggtggaatggatgcgatcaagctggaagggggtgccccatcgaggatcactgcagccaaggctattgtggaggctggaatcgctgtcatggggcatgttggcctcacaccgcaagctattagtgttctcggtggatttaggcctcaagggaagacggttgacagtgctataaaggttgtggagacagcacttgccttgcaggaggctggatgcttctcggttgtgttggagtgtgtgcctgctccagtggcagcagctgcaacatcagcattgaaaatcccaaccattggcattggggctggaccattctgtagtggccaggtcttggtgtaccatgacttgttagggatgctgcaacacccacatcatgccaaggtcacaccaaaattctgtaaacaatttggtaacgtgggcgatgtcatcaacaaggcgctatcagagtacaagcaagaagtggaggctcaggctttccctggtccaagccacacaccgtataagataactcccacagatgttgacggctttgcagatgcactgcagaagatgggtttgagtgacgccgcagatgccgcagccgccgctgctgaaaacagggagaaaggtggagaaccaaaaggagagtag

SEQ ID NO: 11455 - protein, 352 aa, Zea mays
MRRSLPLLLARQVARRRRLSNVPESTVYGGPRPQESSAARRVTVTTLRGKHRRGEPITVVTAYDYPSAVHVDSAGIDVCLVGDSAAMVVHGHDTTLPITLDIMLEHCRAVARGAPRPLLVGDLPFGCYESSAAQAVDSAVRVLKEGGMDAIKLEGGAPSRITAAKAIVEAGIAVMGHVGLTPQAISVLGGFRPQGKTVDSAIKVVETALALQEAGCFSVVLECVPAPVAAAATSALKIPTIGIGAGPFCSGQVLVYHDLLGMLQHPHHAKVTPKFCKQFGNVGDVINKALSEYKQEVEAQAFPGPSHTPYKITPTDVDGFADALQKMGLSDAADAAAAAAENREKGGEPKGE

SEQ ID NO: 11456 - DNA, 28 bp, Artificial sequence
  primer
atgaatataatgaaaagacaattatgca

SEQ ID NO: 11457 - DNA, 26 bp, Artificial sequence
  primer
ttacttttcgttaattgaagagagga

SEQ ID NO: 11458 - protein, 282 aa, Artificial sequence
  consensus sequence
  Variant (2)..(7): Xaa in position 2 to 7 is any amino acid
  Variant (8)..(22): Xaa in position 8 to 22 is any or no amino acid
  Variant (27)..(29): Xaa in position 27 to 29 is any amino acid
  Variant (31)..(39): Xaa in position 31 to 39 is any amino acid
  Variant (40)..(42): Xaa in position 40 to 42 is any or no amino acid
  Variant (48)..(52): Xaa in position 48 to 52 is any amino acid
  Variant (53)..(53): Xaa in position 53 is any or no amino acid
  Variant (55)..(57): Xaa in position 55 to 57 is any amino acid
  Variant (59)..(68): Xaa in position 59 to 68 is any amino acid
  Variant (70)..(72): Xaa in position 70 to 72 is any amino acid
  Variant (74)..(74): Xaa in position 74 is any amino acid
  Variant (77)..(84): Xaa in position 77 to 84 is any amino acid
  Variant (85)..(89): Xaa in position 85 to 89 is any or no amino acid
  Variant (91)..(91): Xaa in position 91 is any amino acid
  Variant (94)..(95): Xaa in position 94 to 95 is any amino acid
  Variant (97)..(105): Xaa in position 97 to 105 is any amino acid
  Variant (106)..(106): Xaa in position 106 is any or no amino acid
  Variant (108)..(118): Xaa in position 108 to 118 is any amino acid
  Variant (119)..(120): Xaa in position 119 to 120 is any or no amino acid
  Variant (122)..(122): Xaa in position 122 is any amino acid
  Variant (125)..(137): Xaa in position 125 to 137 is any amino acid
  Variant (138)..(143): Xaa in position 138 to 143 is any or no amino acid
  Variant (145)..(145): Xaa in position 145 is any amino acid
  Variant (148)..(149): Xaa in position 148 to 149 is any amino acid
  Variant (151)..(151): Xaa in position 151 is any amino acid
  Variant (157)..(158): Xaa in position 157 to 158 is any amino acid
  Variant (159)..(161): Xaa in position 159 to 161 is any or no amino acid
  Variant (164)..(166): Xaa in position 164 to 166 is any amino acid
  Variant (169)..(176): Xaa in position 169 to 176 is any amino acid
  Variant (177)..(181): Xaa in position 177 to 181 is any or no amino acid
  Variant (183)..(187): Xaa in position 183 to 187 is any amino acid
  Variant (190)..(193): Xaa in position 190 to 193 is any amino acid
  Variant (195)..(195): Xaa in position 195 is any amino acid
  Variant (197)..(198): Xaa in position 197 to 198 is any amino acid
  Variant (200)..(202): Xaa in position 200 to 202 is any amino acid
  Variant (204)..(212): Xaa in position 204 to 212 is any amino acid
  Variant (213)..(214): Xaa in position 213 to 214 is any or no amino acid
  Variant (216)..(216): Xaa in position 216 is any amino acid
  Variant (223)..(225): Xaa in position 223 to 225 is any amino acid
  Variant (229)..(229): Xaa in position 229 is any amino acid
  Variant (232)..(233): Xaa in position 232 to 233 is any amino acid
  Variant (235)..(236): Xaa in position 235 to 236 is any amino acid
  Variant (238)..(244): Xaa in position 238 to 244 is any amino acid
  Variant (245)..(250): Xaa in position 245 to 250 is any or no amino acid
  Variant (252)..(263): Xaa in position 252 to 263 is any amino acid
  Variant (264)..(267): Xaa in position 264 to 267 is any or no amino acid
  Variant (269)..(271): Xaa in position 269 to 271 is any amino acid
  Variant (273)..(274): Xaa in position 273 to 274 is any amino acid
  Variant (275)..(275): Xaa in position 275 is any or no amino acid
  Variant (277)..(278): Xaa in position 277 to 278 is any amino acid
  Variant (279)..(280): Xaa in position 279 to 280 is any or no amino acid
KXXXXXXXXXXXXXXXXXXXXXTAYDXXXAXXXXXXXXXXXXLVGDSXXXXXXGXXXTXXXXXXXXXXHXXXVXRGXXXXXXXXXXXXXDXPFXXYXXXXXXXXXXAXXXXXXXXXXXXXKXEGXXXXXXXXXXXXXXXXXXXGXPVXXHXGLTPQXXXXXGGXXXQGXXXXXXXXXXXXXAXXXXXAGXXXXVXEXXPXXXAXXXXXXXXXXXPXIGIGAGXXXDGQXLVXXDXXGXXXXXXXXXXXXXFXXXXXXXXXXXXXXXXAXXXYXXXVXXXXFP

SEQ ID NO: 11459 - protein, 29 aa, Artificial sequence
  protein pattern
  Variant (2)..(2): Xaa in position 2 is any amino acid
  Variant (3)..(6): Xaa in position 3 to 6 is any or no amino acid
  Variant (8)..(8): Xaa in position 8 is Thr or Val
  Variant (9)..(9): Xaa in position 9 is Ile or Val
  Variant (10)..(10): Xaa in position 10 is Cys or Gly
  Variant (13)..(13): Xaa in position 13 is Ala or Ser
  Variant (14)..(14): Xaa in position 14 is Gly or Ser
  Variant (15)..(16): Xaa in position 15 to 16 is any amino acid
  Variant (17)..(17): Xaa in position 17 is Ala, Cys, Thr or Val
  Variant (18)..(18): Xaa in position 18 is Ala, Asp, Ser or Thr
  Variant (19)..(19): Xaa in position 19 is Ala or Gly
  Variant (21)..(21): Xaa in position 21 is Ile or Val
  Variant (22)..(22): Xaa in position 22 is any amino acid
  Variant (24)..(25): Xaa in position 24 to 25 is any amino acid
  Variant (27)..(28): Xaa in position 27 to 28 is any amino acid
  Variant (29)..(29): Xaa in position 29 is Gly, Asn, Gln, Ser or Thr
TXXXXXPXXXIGXXXXXXXQXXVXXDXXX

SEQ ID NO: 11460 - protein, 18 aa, Artificial sequence
  protein pattern
  Variant (3)..(3): Xaa in position 3 is any amino acid
  Variant (4)..(4): Xaa in position 4 is Ala, Gly or Ser
  Variant (6)..(6): Xaa in position 6 is Ile, Leu, Met or Val
  Variant (9)..(9): Xaa in position 9 is any amino acid
  Variant (12)..(16): Xaa in position 12 to 16 is any amino acid
  Variant (17)..(17): Xaa in position 17 is any or no amino acid
PVXXHXGLXPQXXXXXXG

SEQ ID NO: 11461 - DNA, 1608 bp, Saccharomyces cerevisiae
  CDS (1)..(1608)
atggaagatatagaaggatacgaaccacatatcactcaagagttgatagaccgtggccatgcaagacgtatgggccacttggaaaactactttgctgttttgagtaggcagaaaatgtactcgaattttactgtttacgcggaattgaataaaggtgttaataagagacaactaatgcttgtcttgaaagtattacttcaaaaatactcaactcttgcgcatacaatcattcctaagcattatcctcatcatgaagcgtactactctagcgaagagtaccttagtaaaccttttccacagcatgatttcataaaggtgatttctcatcttgaattcgatgacttgattatgaataatcaaccagaatacagagaagtcatggagaaaatctcagaacagttcaaaaaggatgatttcaaagtcaccaataggttaatcgaattgattagccctgtaatcatacctctgggtaatccgaagaggcctaattggagattgatttgtttaccaggtaaggatactgatgggtttgaaacgtggaaaaacttcgtttatgtcactaaccactgcggctccgacggtgtcagtggatcgaattttttcaaagatttagctctactcttttgtaaaatcgaagaaaaagggtttgattatgatgaagagttcatcgaagatcaagtcatcattgactatgatcgagactacactgaaatttctaaattgccaaaaccgattacggatcgtattgactacaagccagcattgacttcattacccaaattctttttaacaaccttcatttatgaacattgtaattttaaaacctccagcgaatctacacttacagctagatatagcccctctagtaatgctaatgctagttacaattacttgttgcatttcagtactaagcaagtagaacaaatcagagctcagatcaagaaaaatgttcacgatgggtgcaccctaacacccttcattcaagcgtgctttcttgtagccctgtatagactggataagctgttcacaaaatctcttctcgagtatgggttcgatgtggctattccaagcaacgcaagaaggtttttaccaaacgatgaagagttaagagattcttataaatacggctccaacgttggaggttcgcattacgcctatctaatctcctcattcgacattcccgaaggtgacaatgacaagttttggagtcttgtcgaatactactatgaccgctttttagaatcgtacgacaacggtgaccacttgattggtctgggggtcctacaacttgattttatcgttgaaaacaagaatatagacagccttcttgccaactcttatttgcaccagcaaagaggcggtgcaatcatcagtaatacaggacttgtctcgcaagatacgaccaagccgtactacgttcgggatttaatcttctcgcagtctgcaggcgccttgagatttgcgttcggcctaaacgtttgctccacaaacgtgaatggtatgaacatggacatgagcgtggttcagggcactctacgggatcgtggcgaatgggaatcgttctgcaagctcttctaccaaaccatcggcgaatttgcgtcgctttaa

SEQ ID NO: 11462 - protein, 535 aa, Saccharomyces cerevisiae
MEDIEGYEPHITQELIDRGHARRMGHLENYFAVLSRQKMYSNFTVYAELNKGVNKRQLMLVLKVLLQKYSTLAHTIIPKHYPHHEAYYSSEEYLSKPFPQHDFIKVISHLEFDDLIMNNQPEYREVMEKISEQFKKDDFKVTNRLIELISPVIIPLGNPKRPNWRLICLPGKDTDGFETWKNFVYVTNHCGSDGVSGSNFFKDLALLFCKIEEKGFDYDEEFIEDQVIIDYDRDYTEISKLPKPITDRIDYKPALTSLPKFFLTTFIYEHCNFKTSSESTLTARYSPSSNANASYNYLLHFSTKQVEQIRAQIKKNVHDGCTLTPFIQACFLVALYRLDKLFTKSLLEYGFDVAIPSNARRFLPNDEELRDSYKYGSNVGGSHYAYLISSFDIPEGDNDKFWSLVEYYYDRFLESYDNGDHLIGLGVLQLDFIVENKNIDSLLANSYLHQQRGGAIISNTGLVSQDTTKPYYVRDLIFSQSAGALRFAFGLNVCSTNVNGMNMDMSVVQGTLRDRGEWESFCKLFYQTIGEFASL

SEQ ID NO: 11463 - DNA, 1638 bp, Saccharomyces pastorianus; strain W34/70
  CDS (1)..(1638)
atggatagtttagaggaatacgaaccgcacgttacgcaagagctgatcgatcgtggccatgcaaggcgcatgggccatttggaaaactattttgctgttttgcgtaggcaaaacatgtattcgaatttcgctgtttatggggaactgaataaggccgttagcaagagacaactgagacttgccttgaggttattgcttctaaagtatccaattctttcgcatacaattgttcccaaaaaataccctaaccacgaagcgtattatctcagtcaggaatatctgaataagccgtttcctcagcatgattttatcaaggttatacctcacctagaactggaggatttaatcatgaacagtcaatcagaatacagggaagtcatcggcaaaatttcggaacaatataagaatgataattttaaagtcacgagtagcttaatcgaattagtcgctcctataatcgtaccggcatgtgacccggaaaggcccaattggaggcttatttgtttacctagtagggatactagcgcgggcgaggcgtggaccaacttcgtttatgtcagtaaccattgcggctccgatggtattagtggaacgaatttttttcaggatttgactgctttactctctacgatcgaggagaacgggttcgactatgaggaggagatcgtggataacaacgtcatcatcgactataacgaagatcacaaagaaatctcgaagcttccgatctccatcacagaccgtattgactataagcctagattgacgtcgctacctaaattcttcttgaagaacatcgtgtctgagtattgtgagttcagaacttccaatgagtcgacagtcacttccaggtactctccctcctctaatgcaaatgcaggtttcaaccatctgttgcatttcagtgccgaagatacacaacaaattaggtcggaaattaaaaaaaaagttcatgctggatgtaccataacgcccttcattcaagcctgctttttcgtagctttatatagacacgataaagttttcaccaagtccttccttgaatatgggttcgacgtggccctcccaagtagcacaagaagattcttaccaaacgacgaagagctaagagactcctacaaatacggcgcaaacgttggtggttcacattacacctatttgatctcctcttttaacgtccccgagggcgacgccaacaagttctggcgtctcgtcgagtactaccacgactgcttcttaaagtcgtacgataacggagaccacttgatcggcttgggcacactacaactagacttcatcgttcaaaacaagaacgtggaccaaattatttccaccacctacttggaccaccaaagaggcggtgccatcatcagcaacacagggtttgtcaggcaagatacgaccaagccgtactacgcccgcgacctaatattctcacagtctgcaggcgccttgagatttgcgtttggcctaaacgtctgctccacaaacgttggtggtatgaacatggacatgagcgtagttcagggcactctacggaatcggggcgaatgggagtcgttctgcgacgttttctaccacgccatcggcgaatttgcgtcgcttggatgcgatactgccgtcgcgggtctcgtatag

SEQ ID NO: 11464 - protein, 545 aa, Saccharomyces pastorianus; strain W34/70
MDSLEEYEPHVTQELIDRGHARRMGHLENYFAVLRRQNMYSNFAVYGELNKAVSKRQLRLALRLLLLKYPILSHTIVPKKYPNHEAYYLSQEYLNKPFPQHDFIKVIPHLELEDLIMNSQSEYREVIGKISEQYKNDNFKVTSSLIELVAPIIVPACDPERPNWRLICLPSRDTSAGEAWTNFVYVSNHCGSDGISGTNFFQDLTALLSTIEENGFDYEEEIVDNNVIIDYNEDHKEISKLPISITDRIDYKPRLTSLPKFFLKNIVSEYCEFRTSNESTVTSRYSPSSNANAGFNHLLHFSAEDTQQIRSEIKKKVHAGCTITPFIQACFFVALYRHDKVFTKSFLEYGFDVALPSSTRRFLPNDEELRDSYKYGANVGGSHYTYLISSFNVPEGDANKFWRLVEYYHDCFLKSYDNGDHLIGLGTLQLDFIVQNKNVDQIISTTYLDHQRGGAIISNTGFVRQDTTKPYYARDLIFSQSAGALRFAFGLNVCSTNVGGMNMDMSVVQGTLRNRGEWESFCDVFYHAIGEFASLGCDTAVAGLV

SEQ ID NO: 11465 - DNA, 1695 bp, Candida glabrata CBS 138
  CDS (1)..(1695)
atggcgccaaacaccaagtcgattgaacagccgctgatctctaaggctaaaatttccgggaagggcccggatgggtttgcgattgaagagtccctgcttgagagaggccattccagaaggatggggcatctggagaactattttgcgattatgcaaagacagaagctttacaccaatttcaacatgtatggtgagcttaacaaagaagttacccgtgagcaattggctgttgcgattcgccaaattctgctgagacatcccataatgatgcaagctatcattcctaagaagttcccagagcatgaggagtactacaccagcgatgattattacaacactccgttccctgagaacgactttttaagggtaatcaccagcaagatcaagctgagcgatatcataatcaatgagcaaagcgaggactacggtgagattatagacatgatcctttcggagtacaagaagaacggttacaagtttgacgcgtacatgcaggagctcattgggaacattgttattcctatcggcaacccaaacaagcctaactggaggctgctgtgtctgccaagtgctgagggaggcggggcccagtggaagaagtttgtgtatataagcaaccactgctgctcggacgccatcagcgctgtgaacctgttccaggacattgcggagaatgtgtctcttatagagcagaactcctgggcggttccgtatgcggatgatgtgattgtggactatgagcaggacgttgcggacatcgccaagctgccggctccgatcactgagagggttgagtacaggccgcccttgagcaagctgcccaagatcatgctggtgtcgttcctgaagaccgcgctgaacttcaagagtgatgcgctggagacgcgctgcaacgacgagtacagcggcgagcccgagaccagcgctgtgcagatgggggatgtgtgctacgactccatcctgaactacacgtgtgaggaagtagcggtcatcagggacaggatcaagcacaacgtgcacggcaagtgtacggtgacgccgttcatccaggcggcgttcttcgtggcgatgcaccagtcgcggaagctgctgggccagaagcaagggttcaaggagtggatgagcgagtggggggtggacatggccacgcccagcagcacgaggcggtacctgccagaggaccccgaggtgcgtgacatgtacaagtacggctccaacgtcggcggcatacactacctgtacatgatctcgggtatgaaggtcgagcgcgaggagacggagaagttctggagcctcgtggagtactaccacgacattctactcgcgtcgcacagcaacggtgaccagaccgtggggctgggcacgctgatgctggacgtgatcgtggacaagaagaacgtcgacaagctgatccgggacgagtacctgtaccagaagcgaggcggtgtcatcatgagcaatgcggggtacttccaccaggaccccgcgcaagcctaccacgtcaccgacctggtctttgggcagagacccggcgcgctgaagttcagcttcggcgtgaacgtggtgtcgacgaacatcggcggcatgaacctaaacgtcggcatggtgcgccgcacgctgagggaccgcgccgagttccgcgagttcatcgggatcctcgacagagtgatccgcgacttcacggggctgaactag

SEQ ID NO: 11466 - protein, 564 aa, Candida glabrata CBS 138
MAPNTKSIEQPLISKAKISGKGPDGFAIEESLLERGHSRRMGHLENYFAIMQRQKLYTNFNMYGELNKEVTREQLAVAIRQILLRHPIMMQAIIPKKFPEHEEYYTSDDYYNTPFPENDFLRVITSKIKLSDIIINEQSEDYGEIIDMILSEYKKNGYKFDAYMQELIGNIVIPIGNPNKPNWRLLCLPSAEGGGAQWKKFVYISNHCCSDAISAVNLFQDIAENVSLIEQNSWAVPYADDVIVDYEQDVADIAKLPAPITERVEYRPPLSKLPKIMLVSFLKTALNFKSDALETRCNDEYSGEPETSAVQMGDVCYDSILNYTCEEVAVIRDRIKHNVHGKCTVTPFIQAAFFVAMHQSRKLLGQKQGFKEWMSEWGVDMATPSSTRRYLPEDPEVRDMYKYGSNVGGIHYLYMISGMKVEREETEKFWSLVEYYHDILLASHSNGDQTVGLGTLMLDVIVDKKNVDKLIRDEYLYQKRGGVIMSNAGYFHQDPAQAYHVTDLVFGQRPGALKFSFGVNVVSTNIGGMNLNVGMVRRTLRDRAEFREFIGILDRVIRDFTGLN

SEQ ID NO: 11467 - DNA, 1554 bp, Kluyveromyces lactis NRRL Y-1140
  CDS (1)..(1554)
atgggttcggtgtgtttatcatcaaaaaagttagagcgcggccatgccagacgtgctggttatgttgaggaagtcttattgatggaacatcgtcaaaaactgtactcgaattttgtagtgcacggtgagttgaaaagtgcagcttctgagttgcaattggcccatgccctaagggctttgtttctaaggtatccgatacttgctacgactatcattccagagtattggaacgaaaaagagacgtattataccagtgaagcattttacaataaaccgggacttgcagaggattacgttagtgtagtagatcaattgaagcttgaagatgtgatcatgaacaagcaacctgaacattccaaattttataacgagattttgaatcaatgggaacatgatgggttcaaatacggagatgatttgtccgtggtcgtcagtcagtacactttttcatgttgggatccaacgaaaccccatttcagattggtgcttttgccttcggcagatgataagaagggagcgaggggattcaaggatattctttacatcacgaaccatgttacaagtgatggtacttccggagctaatttattggaagacttatcgatcgaattgggtaaattttctggaaccaatttgcaacagttagagtatcttttacattatggaagagactacgagcaattgccgaagttaccagacccaatcgaagaaaaagtatcttatggtgtcaatccatcgtttattgcatctttcctcttgagtcaaatgggaaagaaattgttgaccaagaaatgggaccaacccatcactcgtcctatcgatgcgtcacccgctagtcacatggctcacattatcaagattgacccaacaggtatgcagaagatgagagctagagtgaaggacaagttgaatggtaaagctacgttaacgcccttcatgcaagcgtgctggtttgttagttgctatgaagctgggttgtttgacgatagaaaatggaacgaatttttcatcaacatggcagttcctatgaacactagacaatatctacctgaagatcccgaagtaagagatcgttttagatatggtaccgttgtaggaggtaccaatttcaatttcctaatctcttcttttaatatcacaagtaaccaacaattctgggatctaaccgaatattaccaacaatggttcacgaaaactagagaggaagggctagctacaaaaacattcggtacgcttttcgccgattttgttagcaaatccaataatttggataagttaatcaaacaagatatgatgcatcagagaagagcatttgcacttttaagtaacgtcggttatcggccacaaaaagcacaagagagcaatccattccaactacaagacttgatcttctcccaagcagcatgtgaaatgccgttcgtgtttagtttgtgttgtgtctctacagatatcggtggtatgtcgcttaccctaacatgctgtgaggaatcaatctctcaacagcaatggcacaaaatttgccaagtcttcgaaaagaacttgacaactttataa

SEQ ID NO: 11468 - protein, 517 aa, Kluyveromyces lactis NRRL Y-1140
MGSVCLSSKKLERGHARRAGYVEEVLLMEHRQKLYSNFVVHGELKSAASELQLAHALRALFLRYPILATTIIPEYWNEKETYYTSEAFYNKPGLAEDYVSVVDQLKLEDVIMNKQPEHSKFYNEILNQWEHDGFKYGDDLSVVVSQYTFSCWDPTKPHFRLVLLPSADDKKGARGFKDILYITNHVTSDGTSGANLLEDLSIELGKFSGTNLQQLEYLLHYGRDYEQLPKLPDPIEEKVSYGVNPSFIASFLLSQMGKKLLTKKWDQPITRPIDASPASHMAHIIKIDPTGMQKMRARVKDKLNGKATLTPFMQACWFVSCYEAGLFDDRKWNEFFINMAVPMNTRQYLPEDPEVRDRFRYGTVVGGTNFNFLISSFNITSNQQFWDLTEYYQQWFTKTREEGLATKTFGTLFADFVSKSNNLDKLIKQDMMHQRRAFALLSNVGYRPQKAQESNPFQLQDLIFSQAACEMPFVFSLCCVSTDIGGMSLTLTCCEESISQQQWHKICQVFEKNLTTL

SEQ ID NO: 11469 - DNA, 1608 bp, Saccharomyces pastorianus
  CDS (1)..(1608)
atggaagatatagaaggatacgaaccacatatcacgcaagagttgatagaccgtggccatgcaagacgtatgggccacttggaaaactactttgctgttttgagtaggcagaaaatgtactcgaattttactgtttacgcggaattgaataaaggtgttaataagagacaactaatgcttgtcttgaaactattacttcagaaatactcaactcttgcgcatacaatcattcctaagcattatcctcatcatgaagcgtactactctagcgaagagtaccttagtaaaccttttccacagcatgatttcataaaggtgatttctcatcttgaattcgatgacttgattatgaataatcaaccagaatacagagaagtcatggagaaaatctcagaacagttcaaaaaggatgatttcaaagtcaccaataggttaatcgaattgattagccctgtaatcatacctgtgggtaatccgaagaggcctaattggagattgatttgtttaccaggtaaggatactgatgggtttgaaacgtggaaaaacttcgtttatgtcactaaccactgcggctccgacggtgtcagtggatcgaattttttcaaagatttagctctactcttttgtaaaatcgaagaaaaagggtttgattatgatgaagagttcatcgaagatcaggtcatcattgactatgatcgagactacactgaaatttctaaattgccaaaaccgattacggatcgtattgactacaagccagcattgacttcattacccaaattctttttaacaaccttcatttatgaacattgtaattttaaaacctccagcgaatccacacttacagctagatatagcccctctactaatgctaatgctagttacaattacttgttgcatttcagtactaaggaagtagaacaaatcagagcccagatcaagaaaaatgttcacgatgggtgcaccctaacacccttcattcaagcgtgctttcttgtagccctgtatagactagataagctgttcacaaagtctcttctcgagtatgggttcgatgtggctattccaagcaacgcaagaaggtttttaccaaacgatgaagagttaagagattcttataaatacggctccaacgttggaggttcgcattacgcctatctaatctcctcattcgacattcccgaaggtgacaatgacaagttttggagtcttgtcgaatactactatgaccgctttttagaatcgtacgacaacggtgaccacttgattggtctgggggtcctacaacttgattttatcgttcaaaacaagaatatagacagccttcttgccaactcttatttgcaccagcaaagaggcggtgcaatcatcagtaatacaggacttgtctcgcaagatacgaccaagccgtactacgttcgggatttaatcttctcgcagtctgcaggcgccttgagatttgcgttcggcctaaacgtttgctccacaaacgtgaatggtatgaacatggacatgagcgtggttcagggcactctacgggatcgtggcgaatgggaatcgttctgcaagctcttctaccaaaccatcggcgaatttgcgtcgctttaa

SEQ ID NO: 11470 - protein, 535 aa, Saccharomyces pastorianus
MEDIEGYEPHITQELIDRGHARRMGHLENYFAVLSRQKMYSNFTVYAELNKGVNKRQLMLVLKLLLQKYSTLAHTIIPKHYPHHEAYYSSEEYLSKPFPQHDFIKVISHLEFDDLIMNNQPEYREVMEKISEQFKKDDFKVTNRLIELISPVIIPVGNPKRPNWRLICLPGKDTDGFETWKNFVYVTNHCGSDGVSGSNFFKDLALLFCKIEEKGFDYDEEFIEDQVIIDYDRDYTEISKLPKPITDRIDYKPALTSLPKFFLTTFIYEHCNFKTSSESTLTARYSPSTNANASYNYLLHFSTKEVEQIRAQIKKNVHDGCTLTPFIQACFLVALYRLDKLFTKSLLEYGFDVAIPSNARRFLPNDEELRDSYKYGSNVGGSHYAYLISSFDIPEGDNDKFWSLVEYYYDRFLESYDNGDHLIGLGVLQLDFIVQNKNIDSLLANSYLHQQRGGAIISNTGLVSQDTTKPYYVRDLIFSQSAGALRFAFGLNVCSTNVNGMNMDMSVVQGTLRDRGEWESFCKLFYQTIGEFASL

SEQ ID NO: 11471 - DNA, 1578 bp, Saccharomyces pastorianus
  CDS (1)..(1578)
atgaatgaaatcgatgagaaaaatcaggcccccgtgcaacaagaatgcctgaaagagatgattcagaatgggcatgctcggcgtatgggatctgttgaagatctgtatgttgctctcaacagacaaaacttatatcgaaacttctgcacatatggagaattgagtgattactgtactagggatcagctcacattagctttgagggaaatctgcctgaaaaatccaactcttttacatattgttctaccaacaagatggccaaatcatgaaaattattatcgcagttccgaatactattcacggccacatccagtgcatgattatatctcagtattacaagaattgaaactgagtggtgtggttctcaatgaacaacctgagtacagtgcagtaatgaagcaaatattagaagaattcaaaaatagtaagggttcctatactgcaaaaatttttaaacttactaccactttgactattccttactttggaccaacaggaccgagttggcggctaatttgtcttccagaagagcacacagaaaagtggagaaaatttatctttgtatctaatcattgcatgtctgatggtcggtcttcgatccacttttttcatgatttaagagacgaattaaataatattaaaactccaccaaaaaaattagattacattttcaagtacgaggaggattaccaattattgaggaaacttccagaaccgatcgaaaaggtgatagactttagaccaccgtacttgtttattccgaagtcacttctttcgggtttcatctacaatcatttgagattttcttcaaaaggtgtctgtatgagaatggatgatgtggaaaaaaccgatgatgttgtcaccgagatcatcaatatttcaccaacagaatttcaagcgattaaagcaaatattaaatcaaatatccaaggtaagtgtactatcactccgtttttacatgtttgttggtttgtatctcttcataaatggggtaaatttttcaaaccattgaacttcgaatggcttacggatatttttatccccgcagattgccgctcacaactaccagatgatgatgaaatgagacagatgtacagatatggcgctaacgttggatttattgacttcaccccctggataagcgaatttgacatgaatgataacaaagaaaatttttggccacttattgagcactaccatgaagtaatttcggaagctttaagaaataaaaagcatctccatggcttagggttcaatatacaaggcttcgttcaaaaatatgtgaacattgacaaggtaatgtgcgatcgtgccatcgggaaaagacgcggaggtacattgttaagcaatgtaggtctgtttaatcagttagaggagcccgatgccaaatattctatatgcgatttggcatttggccaatttcaaggatcctggcaccaagcattttccttgggtgtttgttcgactaatgtaaaggggatgaatattgttgttgcttcaacaaagaatgttgttggtagtcaagaatctctcgaagagctttgctccatttacaaagctctccttttaggcccttag

SEQ ID NO: 11472 - protein, 525 aa, Saccharomyces pastorianus
MNEIDEKNQAPVQQECLKEMIQNGHARRMGSVEDLYVALNRQNLYRNFCTYGELSDYCTRDQLTLALREICLKNPTLLHIVLPTRWPNHENYYRSSEYYSRPHPVHDYISVLQELKLSGVVLNEQPEYSAVMKQILEEFKNSKGSYTAKIFKLTTTLTIPYFGPTGPSWRLICLPEEHTEKWRKFIFVSNHCMSDGRSSIHFFHDLRDELNNIKTPPKKLDYIFKYEEDYQLLRKLPEPIEKVIDFRPPYLFIPKSLLSGFIYNHLRFSSKGVCMRMDDVEKTDDVVTEIINISPTEFQAIKANIKSNIQGKCTITPFLHVCWFVSLHKWGKFFKPLNFEWLTDIFIPADCRSQLPDDDEMRQMYRYGANVGFIDFTPWISEFDMNDNKENFWPLIEHYHEVISEALRNKKHLHGLGFNIQGFVQKYVNIDKVMCDRAIGKRRGGTLLSNVGLFNQLEEPDAKYSICDLAFGQFQGSWHQAFSLGVCSTNVKGMNIVVASTKNVVGSQESLEELCSIYKALLLGP

SEQ ID NO: 11473 - DNA, 1638 bp, Saccharomyces pastorianus
  CDS (1)..(1638)
atggaaacagaagaaagccaatttagcagtataacaaaaatcatcaatccaaaaactctaatgaatacctacagtgaaaaaacgtctcttgttcaagatgaatgtcttgtcaagatgatacagaatgggcattcccggcgtatgggatctgtggaagatttgtacgctgcactcaacagacagaaattgtatcggaatttttcgacatattcagagctgaatgattactgtaccaaagatcagctcgcattagctctaagaaatatatgtttgaaaaatccgactctcctacatattgtattaccggcaagatggccagatcatgaaaagtattaccttagctcagaatattattcacagccccgtccaaaacatgattatatttcggttttgcctgagttgaaattagatggtgtgattctcaacgagcaacctgagcacaatgccctaatgaagcaaatactagaagaatttgcgaatagcaatggatcttatactgcaaaaatctttaaattgaccaccgctttgactataccttacactgggccaacaagtccaacttggcggttgatttgtctcccagaagaagatgacacgaataagtggaagaaatttatatttgtatccaatcactgcatgtgcgatggtagatcctcaattcacttttttcaggatctaagagatgaattaaacaacataaaaactctgccaaagaaattggactacattttcgagtacgaaaaggattaccaacttttgagaaagctcccagaacccattgaaaatatgatagatttcaggccgccatatttgtttattccgaagtctcttctttctggttttatttacagtcatttgaggttttcttcaaagggtgtttgcacgagaatggatgagatagaaaaaagtgatgagattgttacagaaattatcaatatttctccatcagagtttcaaaaaattagaacgaaaattaaattaaacattcccggtaagtgcaccatcactccgttcttagaagtttgttggtttgttactctccataaatggggcaagtttttcaaaccactgaagttcgagtggctcactgatgtttttatacctgcagattgccgctcattgctgcctgaagatgaagaagtgagagctatgtacaggtacggcgctaacgttgggtttgttgacttcactccatggataagcaaattcaacatgaacgacagcaaagaaaatttctggccacttattgcacattatcatgaagtaatttccggggcgataaaagacaagaagcatctcaatggtttggggttcaacatacaaagcttggtccaaaagtatgtcaacattgataaagtaatgcgtgatcgtgctcttggtaaatcacgtgggggcactttgttgagcaacgtaggtatgttccaccaatcggaggagaccgaacacaagtatcgtataagagatttggcctttggtcaatttcaagggtcatggcatcaagctttttcattgggtgtttcttcgactaatgtgaagggaatgaacattttgatttcttcaacgaaaaatgtcgtgggtagtcaagaattgttggaggaactttgtgctatgtacaaggctctgcttttaaatccctga

SEQ ID NO: 11474 - protein, 545 aa, Saccharomyces pastorianus
METEESQFSSITKIINPKTLMNTYSEKTSLVQDECLVKMIQNGHSRRMGSVEDLYAALNRQKLYRNFSTYSELNDYCTKDQLALALRNICLKNPTLLHIVLPARWPDHEKYYLSSEYYSQPRPKHDYISVLPELKLDGVILNEQPEHNALMKQILEEFANSNGSYTAKIFKLTTALTIPYTGPTSPTWRLICLPEEDDTNKWKKFIFVSNHCMCDGRSSIHFFQDLRDELNNIKTLPKKLDYIFEYEKDYQLLRKLPEPIENMIDFRPPYLFIPKSLLSGFIYSHLRFSSKGVCTRMDEIEKSDEIVTEIINISPSEFQKIRTKIKLNIPGKCTITPFLEVCWFVTLHKWGKFFKPLKFEWLTDVFIPADCRSLLPEDEEVRAMYRYGANVGFVDFTPWISKFNMNDSKENFWPLIAHYHEVISGAIKDKKHLNGLGFNIQSLVQKYVNIDKVMRDRALGKSRGGTLLSNVGMFHQSEETEHKYRIRDLAFGQFQGSWHQAFSLGVSSTNVKGMNILISSTKNVVGSQELLEELCAMYKALLLNP

SEQ ID NO: 11475 - DNA, 1608 bp, Saccharomyces cerevisiae
  CDS (1)..(1608)
atggaagatatagaaggatacgaaccacatatcactcaagagttgatagaccgtggccatgcaagacgtatgggccacttggaaaactactttgctgttttgagtaggcagaaaatgtactcgaattttactgtttacgcggaattgaataaaggtgttaataagagacaactaatgcttgtcttgaaagtattacttcaaaaatactcaactcttgcgcatacaatcattcctaagcattatcctcatcatgaagcgtactactctagcgaagagtaccttagtaaaccttttccacagcatgatttcataaaggtgatttctcatcttgaattcgatgacttgattatgaataatcaaccagaatacagagaagtcatggagaaaatctcagaacagttcaaaaaggatgatttcaaagtcaccaataggttaatcgaattgattagccctgtaatcatacctctgggtaatccgaagaggcctaattggagattgatttgtttaccaggtaaggatactgatgggtttgaagcgtggaaaaacttcgtttatgtcactaaccactgcggctccgacggtgtcagtggatcgaattttttcaaagatttagctctactcttttgtaaaatcgaagaaaaagggtttgattatgatgaagagttcatcgaagatcaagtcatcattgactatgatcgagactacactgaaatttctaaattgccaaaaccgattacggatcgtattgactacaagccagcattgacttcattacccaaattctttttaacaaccttcatttatgaacattgtaattttaaaacctccagcgaatctacacttacagctagatatagcccctctagtaatgctaatgctagttacaattacttgttgcatttcagtactaagcaagtagaacaaatcagagctcagatcaagaaaaatgttcacgatgggtgcaccctaacacccttcattcaagcgtgctttcttgtagccctgtatagactggataagctgttcacaaaatctcttctcgagtatgggttcgatgtggctattccaagcaacgcaagaaggtttttaccaaacgatgaagagttaagagattcttataaatacggctccaacgttggaggttcgcattacgcctatctaatctcctcattcgacattcccgaaggtgacaatgacaagttttggagtcttgtcgaatactactatgaccgctttttagaatcgtacgacaacggtgaccacttgattggtctgggggtcctacaacttgattttatcgttgaaaacaagaatatagacagccttcttgccaactcttatttgcaccagcaaagaggcggtgcaatcatcagtaatacaggacttgtctcgcaagatacgaccaagccgtactacgttcgggatttaatcttctcgcagtctgcaggcgccttgagatttgcgttcggcctaaacgtttgctccacaaacgtgaatggtatgaacatggacatgagcgtggttcagggcactctacgggatcgtggcgaatgggaatcgttctgcaagctcttctaccaaaccatcggcgaatttgcgtcgctttaa

SEQ ID NO: 11476 - protein, 535 aa, Saccharomyces cerevisiae
MEDIEGYEPHITQELIDRGHARRMGHLENYFAVLSRQKMYSNFTVYAELNKGVNKRQLMLVLKVLLQKYSTLAHTIIPKHYPHHEAYYSSEEYLSKPFPQHDFIKVISHLEFDDLIMNNQPEYREVMEKISEQFKKDDFKVTNRLIELISPVIIPLGNPKRPNWRLICLPGKDTDGFEAWKNFVYVTNHCGSDGVSGSNFFKDLALLFCKIEEKGFDYDEEFIEDQVIIDYDRDYTEISKLPKPITDRIDYKPALTSLPKFFLTTFIYEHCNFKTSSESTLTARYSPSSNANASYNYLLHFSTKQVEQIRAQIKKNVHDGCTLTPFIQACFLVALYRLDKLFTKSLLEYGFDVAIPSNARRFLPNDEELRDSYKYGSNVGGSHYAYLISSFDIPEGDNDKFWSLVEYYYDRFLESYDNGDHLIGLGVLQLDFIVENKNIDSLLANSYLHQQRGGAIISNTGLVSQDTTKPYYVRDLIFSQSAGALRFAFGLNVCSTNVNGMNMDMSVVQGTLRDRGEWESFCKLFYQTIGEFASL

SEQ ID NO: 11477 - DNA, 1638 bp, Saccharomyces pastorianus
  CDS (1)..(1638)
atggaaacagaagaaagccaatttagcagtataacaaaaatcatcaatccaaagactctaatgaatacctacagtgaaaaaacgtctcttgttcaagatgaatgtcttgtcaagatgatacagaatgggcattcccggcgtatgggatctgtggaagatttgtacgctgcactcaacagacagaaattgtatcggaatttttcgacatattcagagctgaatgattactgtaccaaagatcagctcgcattagctctaagaaatatatgtttgaaaaatccgactctcctacatattgtattaccggcaagatggccagatcataaaaagtattaccttagctcagaatattattcacagccccgtccaaaacatgattatatttcggttttgcctgagttgaaattagatggtgtgattctcaacgagcaacctgagcacaatgccctaatgaagcaaatactagaagaatttgcgaatagcaatggatcttatactgcaaaaatctttaaattgaccaccgctttgactataccttacactgggccaacaagtccaacttggcggttgatttgtctcccagaagaagatgacacgaataagtggaagaaatttatatttgtatccaatcactgcatgtgcgatggtagatcctcaattcacttttttcaggatctaagagatgaattaaacaacataaaaactctgccaaagaaattggactacattttcgagtacgaaaaggattaccaacttttgagaaagctcccagaacccattgaaaatatgatagatttcaggccgccatatttgtttattccgaagtctcttctttctggttttatttacagtcatttgaggttttcttcaaagggtgtttgcacgagaatggatgagatagaaaaaagtgatgagattgttacagaaattatcaatatttctccatcagagtttcaaaaaattagaacgaaaattaaattaaacattcccggtaagtgcaccatcactccgttcttagaagtttgttggtttgttactctccataaatggggcaagtttttcaaaccactgaagttcgagtggctcactgatgtttttatacctgcagattgccgctcattgctgcctgaagatgaagaagtgagagctatgtacaggtacggcgctaacgttgggtttgttgacttcactccatggataagcaaattcaacatgaacgacagcaaagaaaatttctggccacttattgcacattatcatgaagtaatttccggggcgataaaagacaagaagcatctcaatggtttggggttcaacatacaaagcttggtccaaaagtatgtcaacattgataaagtaatgcgtgatcgtgctcttggtaaatcacgtgggggcactttgttgagcaacgtaggtatgttccaccaatcggaggagaccgaacacaagtatcgtataagagatttggcctttggtcaatttcaagggtcatggcatcaagctttttcattgggtgtttcttcgactaatgtgaagggaatgaacattttgatttcttcaacgaaaaatgtcgtgggtagtcaagaattgttggaggaactttgtgctatgtacaaggctctgcttttaaatccctga

SEQ ID NO: 11478 - protein, 545 aa, Saccharomyces pastorianus
METEESQFSSITKIINPKTLMNTYSEKTSLVQDECLVKMIQNGHSRRMGSVEDLYAALNRQKLYRNFSTYSELNDYCTKDQLALALRNICLKNPTLLHIVLPARWPDHKKYYLSSEYYSQPRPKHDYISVLPELKLDGVILNEQPEHNALMKQILEEFANSNGSYTAKIFKLTTALTIPYTGPTSPTWRLICLPEEDDTNKWKKFIFVSNHCMCDGRSSIHFFQDLRDELNNIKTLPKKLDYIFEYEKDYQLLRKLPEPIENMIDFRPPYLFIPKSLLSGFIYSHLRFSSKGVCTRMDEIEKSDEIVTEIINISPSEFQKIRTKIKLNIPGKCTITPFLEVCWFVTLHKWGKFFKPLKFEWLTDVFIPADCRSLLPEDEEVRAMYRYGANVGFVDFTPWISKFNMNDSKENFWPLIAHYHEVISGAIKDKKHLNGLGFNIQSLVQKYVNIDKVMRDRALGKSRGGTLLSNVGMFHQSEETEHKYRIRDLAFGQFQGSWHQAFSLGVSSTNVKGMNILISSTKNVVGSQELLEELCAMYKALLLNP

SEQ ID NO: 11479 - DNA, 1608 bp, Saccharomyces pastorianus
  CDS (1)..(1608)
atggaagatatagaaggatacgaaccacatctcacgcaagagttgatagaccgtggccatgcaagacgtatgggccacttggaaaactactttgctgttttgagtaggcagaaaatgtactcgaattttactgtttacgcggaattgaataaaggtgttaataagaggcaactaatgcttgtcttgaaactattacttcagaaatactcaactcttgcgcatacaatcattcctaagcattatcctcatcatgaagcgtactactctagcgaagagtaccttagtaaaccttttccacagcatgatttcataaaggtgatttctcatcttgaattcgatgacttgattatgaataatcaaccagaatacagagaagtcatggagaaaatctcagaacagttcaaaaaggatgatttcaaagtcaccaataggttaatcgaattgattagccctgtaatcatacctgtgggtaatccgaagaggcctaattggagattgatttgtttaccaggtaaggatactgatgggtttgaaacgtggaaaaacttcgtttatgtcactaaccactgcggctccgacggtgtcagtggatcgaattttttcaaagatttagctctactcttttgtaaaatcgaagaaaaagggtttgattatgatgaagagttcatcgaagatcaagtcatcattgactatgatcgagactacactgaaatttctaaattgccaaaaccgattacggatcgtattgactacaagccagcattgacttcattacccaaattctttttaacaaccttcatttatgaacattgtaattttaaaacctccagcgaatccacacttacagctagatatagcccctctactaatgctaatgctagttacaattactcgttgcatttcagtactaaggaagtagaacaaatcagagcccagatcaagaaaaatgttcacgatgggtgcaccctaacacccttcattcaagcgtgctttcttgtagccctgtatagactagataagctgttcacaaagtctcttctcgagtatgggttcgatgtggctattccaagcaacgcaagaaggtttttaccaaacgatgaagagttaagagattcttataaatacggctccaacgttggaggttcgcattacgcctatctaatctcctcattcgacattcccgaaggtgacaatgacaagttttggagtcttgtcgaatactactatgaccgctttttagaatcgtacgacaacggtgaccacttgattggtctgggggtcctacaacttgattttatcgttcaaaacaagaatatagacagccttcttgccaactcttatttgcaccagcaaagaggcggtgcaatcatcagtaatacaggacttgtctcgcaagatacgaccaagccgtactacgttcgggatttaatcttctcgcagtctgcaggcgccttgagatttgcgttcggcctaaacgtttgctccacaaacgtgaatggtatgaacatggacatgagcgtggttcagggcactctacgggatcgtggcgaatgggaatcgttctgcaagctcttctaccaaaccatcggcgaatttgcgtcgctttaa

SEQ ID NO: 11480 - protein, 535 aa, Saccharomyces pastorianus
MEDIEGYEPHLTQELIDRGHARRMGHLENYFAVLSRQKMYSNFTVYAELNKGVNKRQLMLVLKLLLQKYSTLAHTIIPKHYPHHEAYYSSEEYLSKPFPQHDFIKVISHLEFDDLIMNNQPEYREVMEKISEQFKKDDFKVTNRLIELISPVIIPVGNPKRPNWRLICLPGKDTDGFETWKNFVYVTNHCGSDGVSGSNFFKDLALLFCKIEEKGFDYDEEFIEDQVIIDYDRDYTEISKLPKPITDRIDYKPALTSLPKFFLTTFIYEHCNFKTSSESTLTARYSPSTNANASYNYSLHFSTKEVEQIRAQIKKNVHDGCTLTPFIQACFLVALYRLDKLFTKSLLEYGFDVAIPSNARRFLPNDEELRDSYKYGSNVGGSHYAYLISSFDIPEGDNDKFWSLVEYYYDRFLESYDNGDHLIGLGVLQLDFIVQNKNIDSLLANSYLHQQRGGAIISNTGLVSQDTTKPYYVRDLIFSQSAGALRFAFGLNVCSTNVNGMNMDMSVVQGTLRDRGEWESFCKLFYQTIGEFASL

SEQ ID NO: 11481 - DNA, 1578 bp, Saccharomyces cerevisiae
  CDS (1)..(1578)
atgaatgaaatcgatgagaaaaatcaggcccccgtgcaacaagaatgcctgaaagagatgattcagaatgggcatgctcggcgtatgggatgtgttgaagatctgtatgttgctctcaacagacaaaacttatatcgaaacttctgcacatatggagaattgagtgattactgtactagagatcagctcacattagctttgagggaaatctgcctgaaaaatccaactcttttacatattgttctaccaacaagatggccaaatcatgaaaattattatcgcagttccgaatactattcacggccacatccagtgcatgattatatttcagtattacaagaattgaaactgagtggtgtggttctcaatgaacaacctgagtacagtgcagtaatgaagcaaatattagaagaattcaaaaatagtaagggttcctatactgcaaaaatttttaaacttactaccactttgactattccttactttggaccaacaggaccgagttggcggctaatttgtcttccagaagagcacacagaaaagtggaaaaaatttatctttgtatctaatcattgcatgtctgatggtcggtcttcgatccacttttttcatgatttaagagacgaattaaataatattaaaactccaccaaaaaaatgggattacattttcaagtacgaggaggattaccaattattgaggaaacttccagaaccgatcgaaaaggtgatagactttagaccaccgtacttggtttttccgaagtcacttctttcgggtttcatctacaatcatttgagattttcttcaaaaggtgtctgtatgagaatggatgatgtggaaaaaaccgatgatgttgtcaccgagatcatcgatatttcaccaacagaatttcaagcgattaaagcaaatattaaatcaaatatccaaggtaagtgtactatcactccgtttttacatgtttgttggtttgtatctcttcataaatggggtaaatttttcaaaccattgaacttcgaatggcttacggatatttttatccccgcagattgccgctcacaactaccagatgatgatgaaatgagacagatgtacagatatggcgctaacgttggatttattgacttcaccccctggataagcgaatttgacatgaatgataacaaagaaaatttttggccacttattgagcactaccatgaagtaatttcggaagctttaagaaataaaaagcatctccatggcttagggttcaatatacaaggcttcgttcaaaaatatgtgaacattgacaaggtaatgtgcgatcgtgccatcgggaaaagacgcggaggtacattgttaagcaatgtaggtctgtttaatcagttagaggagcccgatgccaaatattctatatgcgatttggcatttggccaatttcaaggatcctggcaccaagcattttccttgggtgtttgttcgactaatgtaaaggggatgaatattgttgttgcttcaacaaagaatgttgttggtagtcaagaatctctcgaagagctttgctccatttacaaagctctccttttaggcccttag

SEQ ID NO: 11482 - protein, 525 aa, Saccharomyces cerevisiae
MNEIDEKNQAPVQQECLKEMIQNGHARRMGCVEDLYVALNRQNLYRNFCTYGELSDYCTRDQLTLALREICLKNPTLLHIVLPTRWPNHENYYRSSEYYSRPHPVHDYISVLQELKLSGVVLNEQPEYSAVMKQILEEFKNSKGSYTAKIFKLTTTLTIPYFGPTGPSWRLICLPEEHTEKWKKFIFVSNHCMSDGRSSIHFFHDLRDELNNIKTPPKKWDYIFKYEEDYQLLRKLPEPIEKVIDFRPPYLVFPKSLLSGFIYNHLRFSSKGVCMRMDDVEKTDDVVTEIIDISPTEFQAIKANIKSNIQGKCTITPFLHVCWFVSLHKWGKFFKPLNFEWLTDIFIPADCRSQLPDDDEMRQMYRYGANVGFIDFTPWISEFDMNDNKENFWPLIEHYHEVISEALRNKKHLHGLGFNIQGFVQKYVNIDKVMCDRAIGKRRGGTLLSNVGLFNQLEEPDAKYSICDLAFGQFQGSWHQAFSLGVCSTNVKGMNIVVASTKNVVGSQESLEELCSIYKALLLGP

SEQ ID NO: 11483 - DNA, 1578 bp, Saccharomyces pastorianus
  CDS (1)..(1578)
atgaatgaaatcgatgagaaaaatcaggcccccgtgcaccaagaatgcctgaaagagatgattcagaatgggcatgctcggcgtatgggatctgttgaagatctgtatgttgctctcaacagacaaaacttatatcgaaacttctgcacatatggagaattgagtgattactgtactagggatcagctcacattagctttgagggaaatctgcctgaaaaatccaactcttttacatattgttctaccaacaagatggccaaatcatgaaaattattatcgcagttccgaatactattcacggccacatccagtgcatgattatatctcagtattacaagaattgaaactgagtggtgtggttctcaatgaacaacctgagtacagtgcagtaatgaagcaaatattagaagaattcaaaaatagtaagggttcctatactgcaaaaatttttaaacttactaccactttgactattccttactttggaccaacaggaccgagttggcggctaatttgtcttccagaagagcacacagaaaagtggaaaaaatttatctttgtatctaatcattgcatgtctgatggtcggtcttcgatccacttttttcatgatttaagagacgaattaaataatattaaaactccaccaaaaaaattagattacattttcaagtacgaggaggattaccaattattgaggaaacttccagaaccgatcgaaaaggtgatagactttagaccaccgtacttgtttattccgaagtcacttctttcgggtttcatctacaatcatttgagattttcttcaaaaggtgtctgtatgagaatggatgatgtggaaaaaaccgatgatgttgtcaccgagatcatcaatatttcaccaacagaatttcaagcgattaaagcaaatattaaatcaaatatccaaggtaagtgtactatcactccgtttttacatgtttgttggtttgtatctcttcataaatggggtaaatttttcaaaccattgaacttcgaatggcttacggatatttttatccccgcagattgccgctcacaactaccagatgatgatgaaatgagacagatgtacagatatggcgctaacgttggatttattgacttcaccccctggataagcgaatttgacatgaatgataacaaagaaaatttttggccacttattgagcactaccatgaagtaatttcggaagctttaagaaataaaaagcatctccatggcttagggttcaatatacaaggcttcgttcaaaaatatgtgaacattgacaaggtaatgtgcgatcgtgccatcgggaaaagacgcggaggtacattgttaagcaatgtaggtctgtttaatcagttagaggagcccgatgccaaatattctatatgcgatttggcatttggccaatttcaaggatcctggcaccaagcattttccttgggtgtttgttcgactaatgtaaaggggatgaatattgttgttgcttcaacaaagaatgttgttggtagtcaagaatctctcgaagagctttgctccatttacaaagctctccttttaggcccttag

SEQ ID NO: 11484 - protein, 525 aa, Saccharomyces pastorianus
MNEIDEKNQAPVHQECLKEMIQNGHARRMGSVEDLYVALNRQNLYRNFCTYGELSDYCTRDQLTLALREICLKNPTLLHIVLPTRWPNHENYYRSSEYYSRPHPVHDYISVLQELKLSGVVLNEQPEYSAVMKQILEEFKNSKGSYTAKIFKLTTTLTIPYFGPTGPSWRLICLPEEHTEKWKKFIFVSNHCMSDGRSSIHFFHDLRDELNNIKTPPKKLDYIFKYEEDYQLLRKLPEPIEKVIDFRPPYLFIPKSLLSGFIYNHLRFSSKGVCMRMDDVEKTDDVVTEIINISPTEFQAIKANIKSNIQGKCTITPFLHVCWFVSLHKWGKFFKPLNFEWLTDIFIPADCRSQLPDDDEMRQMYRYGANVGFIDFTPWISEFDMNDNKENFWPLIEHYHEVISEALRNKKHLHGLGFNIQGFVQKYVNIDKVMCDRAIGKRRGGTLLSNVGLFNQLEEPDAKYSICDLAFGQFQGSWHQAFSLGVCSTNVKGMNIVVASTKNVVGSQESLEELCSIYKALLLGP
